United States Patent 10,706,955 (BIOINFORMATIC PROCESSES FOR DETERMINATION OF PEPTIDE BINDING) - sequence listing, part 45

SEQ ID NO: 1718502 - protein, 20 aa, Staphylococcus aureus
VKTPSNKVLGFYSNNANTNA

SEQ ID NO: 1718503 - protein, 20 aa, Staphylococcus aureus
VLGISFLFLIISIFAGCGTG

SEQ ID NO: 1718504 - protein, 18 aa, Staphylococcus aureus
VLGISLLFLIISINAGCG

SEQ ID NO: 1718505 - protein, 19 aa, Staphylococcus aureus
VLKDEFKGVTKIGDGDVEK

SEQ ID NO: 1718506 - protein, 20 aa, Staphylococcus aureus
VLKDEFKGVTKIGDGDVEKV

SEQ ID NO: 1718507 - protein, 22 aa, Staphylococcus aureus
VLKEKYKLHGEYSKAYKNAVNS

SEQ ID NO: 1718508 - protein, 20 aa, Staphylococcus aureus
VLKVKEKAYQDILNAQTTND

SEQ ID NO: 1718509 - protein, 17 aa, Staphylococcus aureus
VLLFCYSQNRIATADVG

SEQ ID NO: 1718510 - protein, 17 aa, Staphylococcus aureus
VLLLIIFIGGCGNMKDE

SEQ ID NO: 1718511 - protein, 23 aa, Staphylococcus aureus
VLPEIQHNIKFFKNDDTQNIAEK

SEQ ID NO: 1718512 - protein, 20 aa, Staphylococcus aureus
VLSAPSIDYGLIGFVSHDYD

SEQ ID NO: 1718513 - protein, 19 aa, Staphylococcus aureus
VLSAPSLDYGLIGFVSHDY

SEQ ID NO: 1718514 - protein, 18 aa, Staphylococcus aureus
VLSGCSLPGLGSKSTEND

SEQ ID NO: 1718515 - protein, 18 aa, Staphylococcus aureus
VLSISFLYLIISFTAGCG

SEQ ID NO: 1718516 - protein, 37 aa, Staphylococcus aureus
VLTTEKFLDFDLLFKNFTWLDGKSVEFKDLKVEFSSS

SEQ ID NO: 1718517 - protein, 28 aa, Staphylococcus aureus
VLVDYEKYGKFYNLSIKGTIDQIDKTNN

SEQ ID NO: 1718518 - protein, 18 aa, Staphylococcus aureus
VLYISFLILIISIVAGCG

SEQ ID NO: 1718519 - protein, 24 aa, Staphylococcus aureus
VLYPGLSKDVFKSKASQVTVVKQE

SEQ ID NO: 1718520 - protein, 17 aa, Staphylococcus aureus
VMILIFAIAGCGKSDET

SEQ ID NO: 1718521 - protein, 22 aa, Staphylococcus aureus
VMSEFIKFVLEDKGKAAEEAGY

SEQ ID NO: 1718522 - protein, 22 aa, Staphylococcus aureus
VNAKYDVIYNGHTFATSLPAKF

SEQ ID NO: 1718523 - protein, 23 aa, Staphylococcus aureus
VNAKYDVIYNGHTFATSLPAKFV

SEQ ID NO: 1718524 - protein, 25 aa, Staphylococcus aureus
VNALKNRALTDIGVTSTTAMVNSIR

SEQ ID NO: 1718525 - protein, 22 aa, Staphylococcus aureus
VNDSRSWDFKIRNRSGQVIYDW

SEQ ID NO: 1718526 - protein, 17 aa, Staphylococcus aureus
VNENLGLNPSHEGETDP

SEQ ID NO: 1718527 - protein, 23 aa, Staphylococcus aureus
VNGKARTGWVIVDYAGYPWPGYD

SEQ ID NO: 1718528 - protein, 24 aa, Staphylococcus aureus
VNGKSGWVSKAYLAEPVAPKKAVA

SEQ ID NO: 1718529 - protein, 20 aa, Staphylococcus aureus
VNINKGRLTKSFASNLANMN

SEQ ID NO: 1718530 - protein, 23 aa, Staphylococcus aureus
VNINKGRLTKSFTSNLANMNFLR

SEQ ID NO: 1718531 - protein, 20 aa, Staphylococcus aureus
VNINKGRLTKSFTSNLTNMN

SEQ ID NO: 1718532 - protein, 20 aa, Staphylococcus aureus
VNLDFGDITSAYVVMVNTKF

SEQ ID NO: 1718533 - protein, 24 aa, Staphylococcus aureus
VNLDFGDITSAYVVMVNTKFQYTN

SEQ ID NO: 1718534 - protein, 21 aa, Staphylococcus aureus
VNLKGSGFVSHQSISKGQKLT

SEQ ID NO: 1718535 - protein, 24 aa, Staphylococcus aureus
VNNVPTPRTVTFNDTLTYKTYSQD

SEQ ID NO: 1718536 - protein, 24 aa, Staphylococcus aureus
VNQKDIRATSLFETDPSISNNDDS

SEQ ID NO: 1718537 - protein, 19 aa, Staphylococcus aureus
VNRTYRIGTTKNVEVGQDT

SEQ ID NO: 1718538 - protein, 24 aa, Staphylococcus aureus
VNRTYRLGTTKRVEISHGNVQTKK

SEQ ID NO: 1718539 - protein, 17 aa, Staphylococcus aureus
VNSDLQGDITIRGYQDL

SEQ ID NO: 1718540 - protein, 24 aa, Staphylococcus aureus
VNTLKNRALNDIGVTSTAMVNSIR

SEQ ID NO: 1718541 - protein, 25 aa, Staphylococcus aureus
VNVAKTGTAHLFKVPTDADRLDLQF

SEQ ID NO: 1718542 - protein, 20 aa, Staphylococcus aureus
VPDLIRLSKTFLIESRDLTT

SEQ ID NO: 1718543 - protein, 24 aa, Staphylococcus aureus
VPENVSHLKIQFVPKNDAITDARG

SEQ ID NO: 1718544 - protein, 17 aa, Staphylococcus aureus
VPGEAVQLVKFDDYWQG

SEQ ID NO: 1718545 - protein, 18 aa, Staphylococcus aureus
VPHIHGFNKHTEIIEEDT

SEQ ID NO: 1718546 - protein, 17 aa, Staphylococcus aureus
VPNETNLNLTFATADKE

SEQ ID NO: 1718547 - protein, 30 aa, Staphylococcus aureus
VPSVTVVDNLPGFTLINGGKVGVLSHAMVR

SEQ ID NO: 1718548 - protein, 19 aa, Staphylococcus aureus
VPTLKAERSAMINITTGAN

SEQ ID NO: 1718549 - protein, 22 aa, Staphylococcus aureus
VPVKHVIPDIVAHSHYTVQGQD

SEQ ID NO: 1718550 - protein, 17 aa, Staphylococcus aureus
VQKDHKLVMLFGDNLLD

SEQ ID NO: 1718551 - protein, 18 aa, Staphylococcus aureus
VQNYRKVSNRNKADALKA

SEQ ID NO: 1718552 - protein, 33 aa, Staphylococcus aureus
VQQLHANPVKKPAGKTALDQAAADRKTQIEQTP

SEQ ID NO: 1718553 - protein, 34 aa, Staphylococcus aureus
VQQLHANPVKKPAGKTALDQAAADRKTQIEQTPN

SEQ ID NO: 1718554 - protein, 20 aa, Staphylococcus aureus
VQQLHANPVKKPSGKTALDQ

SEQ ID NO: 1718555 - protein, 22 aa, Staphylococcus aureus
VRNFLKQNIEDIHFANDDQPNN

SEQ ID NO: 1718556 - protein, 21 aa, Staphylococcus aureus
VRSGFNPEFLTYISNEKTNDK

SEQ ID NO: 1718557 - protein, 17 aa, Staphylococcus aureus
VSALKAEQLAMISVSPS

SEQ ID NO: 1718558 - protein, 18 aa, Staphylococcus aureus
VSDAEGIISATNNPEMNP

SEQ ID NO: 1718559 - protein, 24 aa, Staphylococcus aureus
VSEVVKSSFGYHVIKADKPTDFNS

SEQ ID NO: 1718560 - protein, 17 aa, Staphylococcus aureus
VSKVMSHVMRYGKQSRY

SEQ ID NO: 1718561 - protein, 17 aa, Staphylococcus aureus
VSLSALPQSLAITHESQ

SEQ ID NO: 1718562 - protein, 19 aa, Staphylococcus aureus
VSMNQAFNSNITFKVAATD

SEQ ID NO: 1718563 - protein, 19 aa, Staphylococcus aureus
VSQIREIRLYPKGDDYVAK

SEQ ID NO: 1718564 - protein, 24 aa, Staphylococcus aureus
VSTARKVPEIKNGSVVMATGEVLE

SEQ ID NO: 1718565 - protein, 21 aa, Staphylococcus aureus
VSTLALTACGEKEKPKKEENK

SEQ ID NO: 1718566 - protein, 35 aa, Staphylococcus aureus
VSTTEKFLDFDLLFKSIDWLDGISAEFKDLKVEFS

SEQ ID NO: 1718567 - protein, 34 aa, Staphylococcus aureus
VSTTEKFLDFDLLFKSINWLDGISAKFKDLKVEF

SEQ ID NO: 1718568 - protein, 18 aa, Staphylococcus aureus
VTADMKRLSGTTTLDNEI

SEQ ID NO: 1718569 - protein, 23 aa, Staphylococcus aureus
VTDEFKNKMTYGSNQSVNLDFGD

SEQ ID NO: 1718570 - protein, 38 aa, Staphylococcus aureus
VTIRPQDYVVFIPPVGKQIRAVVYYNKVVASNMSNAVT

SEQ ID NO: 1718571 - protein, 20 aa, Staphylococcus aureus
VTNLSYRMNLFVNGHQTKVN

SEQ ID NO: 1718572 - protein, 18 aa, Staphylococcus aureus
VTVKPLRDKYRVGTSSTA

SEQ ID NO: 1718573 - protein, 17 aa, Staphylococcus aureus
VTVNADGTNVQWSNGAG

SEQ ID NO: 1718574 - protein, 25 aa, Staphylococcus aureus
VTVPVKHVIPDIVAHSHYTVQGQDF

SEQ ID NO: 1718575 - protein, 30 aa, Staphylococcus aureus
VTVSDALPNCGIKAKSSISMNNVTYTTQDE

SEQ ID NO: 1718576 - protein, 19 aa, Staphylococcus aureus
VVALTGYEGVLGYRTNELM

SEQ ID NO: 1718577 - protein, 21 aa, Staphylococcus aureus
VVDNLPGYTLINGGKVGVFSH

SEQ ID NO: 1718578 - protein, 17 aa, Staphylococcus aureus
VVLGLTHQRYLAIHEAI

SEQ ID NO: 1718579 - protein, 22 aa, Staphylococcus aureus
VVLLEGISQMMPMIKESPFKHT

SEQ ID NO: 1718580 - protein, 22 aa, Staphylococcus aureus
VVLLEGISQMMPMIKESPFKTT

SEQ ID NO: 1718581 - protein, 22 aa, Staphylococcus aureus
VVLLEGISQMMPMIKETPFKET

SEQ ID NO: 1718582 - protein, 24 aa, Staphylococcus aureus
VVNAKYDIIYNGHTFATSLPAKFV

SEQ ID NO: 1718583 - protein, 24 aa, Staphylococcus aureus
VVPESKLGSIVLEYKEINNRVNVA

SEQ ID NO: 1718584 - protein, 25 aa, Staphylococcus aureus
VVPESKLGSIVLEYKEINNRVNVAT

SEQ ID NO: 1718585 - protein, 19 aa, Staphylococcus aureus
VYGPESWGNINQLRNKSID

SEQ ID NO: 1718586 - protein, 22 aa, Staphylococcus aureus
VYKAQLYLTPYGPKQYVEHLNQ

SEQ ID NO: 1718587 - protein, 25 aa, Staphylococcus aureus
VYYTKKKAEVELDINTASTWKKFEV

SEQ ID NO: 1718588 - protein, 36 aa, Staphylococcus aureus; identical to SEQ ID NO: 1575635

SEQ ID NO: 1718589 - protein, 28 aa, Staphylococcus aureus
WATSSDVLKLKANYTIDDSVKEGDTFTF

SEQ ID NO: 1718590 - protein, 17 aa, Staphylococcus aureus
WGNASNWASAAASSGYT

SEQ ID NO: 1718591 - protein, 17 aa, Staphylococcus aureus
WLDPKINQTFAKEIKDE

SEQ ID NO: 1718592 - protein, 17 aa, Staphylococcus aureus
WLIKKGFNIYNRYTLNR

SEQ ID NO: 1718593 - protein, 23 aa, Staphylococcus aureus
WNSTLTWPGSYSVSIQNVDDNNN

SEQ ID NO: 1718594 - protein, 17 aa, Staphylococcus aureus
WTNAKIASRPTDGGLSW

SEQ ID NO: 1718595 - protein, 25 aa, Staphylococcus aureus
WTQNAQRMNFQFTNSYGPSKDVVGI

SEQ ID NO: 1718596 - protein, 22 aa, Staphylococcus aureus
WVAMNKPNAAKVVNAKYDVIYN

SEQ ID NO: 1718597 - protein, 31 aa, Staphylococcus aureus
WVVAAFPSKAWAKRVYPELSVEEAYIKFIDE

SEQ ID NO: 1718598 - protein, 26 aa, Staphylococcus aureus
WYMHNNRLTVSAGDKVKAGDQIAYSG

SEQ ID NO: 1718599 - protein, 30 aa, Staphylococcus aureus
WYSHIQVYGPESWGNIIQLRNKNVDIFGIK

SEQ ID NO: 1718600 - protein, 17 aa, Staphylococcus aureus
YAKKAYYTVYFKNGGKR

SEQ ID NO: 1718601 - protein, 17 aa, Staphylococcus aureus
YASRNDVAFVYPKNQSE

SEQ ID NO: 1718602 - protein, 17 aa, Staphylococcus aureus
YDAANRVITIKSTGGGT

SEQ ID NO: 1718603 - protein, 20 aa, Staphylococcus aureus
YDKEGYRDGEFEKGDKGMWI

SEQ ID NO: 1718604 - protein, 25 aa, Staphylococcus aureus
YDSDKDYAYIRFPVSNGTRDVKIVS

SEQ ID NO: 1718605 - protein, 21 aa, Staphylococcus aureus
YDVPFQFRLIFVESDNGITIT

SEQ ID NO: 1718606 - protein, 23 aa, Staphylococcus aureus
YDVPFQFRLIFVESGNGVAITTF

SEQ ID NO: 1718607 - protein, 23 aa, Staphylococcus aureus
YEHGGNIIDIDFDSVPHIHGFNK

SEQ ID NO: 1718608 - protein, 24 aa, Staphylococcus aureus
YEKRAEERKARFLDRQKSKKEPVV

SEQ ID NO: 1718609 - protein, 35 aa, Staphylococcus aureus
YENKELRKAMLYAIDREKWIKAFFNGYASEINSFV

SEQ ID NO: 1718610 - protein, 18 aa, Staphylococcus aureus
YEQGGNIVDIDFDSVPQI

SEQ ID NO: 1718611 - protein, 22 aa, Staphylococcus aureus
YESCRSMQAIGYKELIPVINGQ

SEQ ID NO: 1718612 - protein, 21 aa, Staphylococcus aureus
YEYYVEHLVRDAVGTPLKRCA

SEQ ID NO: 1718613 - protein, 20 aa, Staphylococcus aureus
YFEFDFKRKPYDNLKLNPDD

SEQ ID NO: 1718614 - protein, 21 aa, Staphylococcus aureus
YFLERTYRKPSDFYNMTSLVQ

SEQ ID NO: 1718615 - protein, 25 aa, Staphylococcus aureus
YGDYKCPFCKELDEKVMPKLRKNYI

SEQ ID NO: 1718616 - protein, 19 aa, Staphylococcus aureus
YGPAKIKNIILKFNGDPNN

SEQ ID NO: 1718617 - protein, 17 aa, Staphylococcus aureus
YHFFSIKDPADVYYTKK

SEQ ID NO: 1718618 - protein, 26 aa, Staphylococcus aureus
YHNKDLDFAFGLSMTSKNVARYENIN

SEQ ID NO: 1718619 - protein, 20 aa, Staphylococcus aureus
YKAQLYLTPYGPKQYVEHLN

SEQ ID NO: 1718620 - protein, 23 aa, Staphylococcus aureus
YKEATKLILKFAIGSNIIGLSAF

SEQ ID NO: 1718621 - protein, 22 aa, Staphylococcus aureus
YKELEQAVALIRTMPQRQQTSR

SEQ ID NO: 1718622 - protein, 18 aa, Staphylococcus aureus
YKFTDYVDRYENVNAKLE

SEQ ID NO: 1718623 - protein, 32 aa, Staphylococcus aureus; identical to SEQ ID NO: 1587610

SEQ ID NO: 1718624 - protein, 23 aa, Staphylococcus aureus
YKKTPKFILGFGGIDDDALKPHV

SEQ ID NO: 1718625 - protein, 17 aa, Staphylococcus aureus
YKLEDIFTKEEIKKYKA

SEQ ID NO: 1718626 - protein, 17 aa, Staphylococcus aureus
YKLSLKYRDKLQTMIGG

SEQ ID NO: 1718627 - protein, 26 aa, Staphylococcus aureus
YKQAVAKAEALISGTPDVVVTPSEIT

SEQ ID NO: 1718628 - protein, 17 aa, Staphylococcus aureus
YKVKKVIPYTGSADLAI

SEQ ID NO: 1718629 - protein, 17 aa, Staphylococcus aureus
YMAPLYGSKKNLVYDNK

SEQ ID NO: 1718630 - protein, 19 aa, Staphylococcus aureus
YNGETLNFVIVDPITGVQL

SEQ ID NO: 1718631 - protein, 21 aa, Staphylococcus aureus
YNGPCKSKYMFGGATLSGQYL

SEQ ID NO: 1718632 - protein, 27 aa, Staphylococcus aureus
YNIPNGYKYYSLYDEKNRWMGYFNSND

SEQ ID NO: 1718633 - protein, 18 aa, Staphylococcus aureus
YNPGVTPLIFPGDVISLV

SEQ ID NO: 1718634 - protein, 19 aa, Staphylococcus aureus
YNPKEARAHWEKAKKELGK

SEQ ID NO: 1718635 - protein, 23 aa, Staphylococcus aureus
YPAADESLKDAIKNPAVENKEHD

SEQ ID NO: 1718636 - protein, 24 aa, Staphylococcus aureus
YPAADESLKDAIKNPAVENKEHDI

SEQ ID NO: 1718637 - protein, 22 aa, Staphylococcus aureus
YPKGNRGVRFMFKLVDGNDKDL

SEQ ID NO: 1718638 - protein, 17 aa, Staphylococcus aureus
YPVGTYINASNKGAPYN

SEQ ID NO: 1718639 - protein, 22 aa, Staphylococcus aureus
YQAQGNVIALGRINGTDTNDHG

SEQ ID NO: 1718640 - protein, 24 aa, Staphylococcus aureus
YQIRWNGFYWAGANYKNYKTRTFK

SEQ ID NO: 1718641 - protein, 26 aa, Staphylococcus aureus
YQKKHGGEISPLFKGNHDNMISSITT

SEQ ID NO: 1718642 - protein, 19 aa, Staphylococcus aureus
YRAKAALRSNNFAKMADAK

SEQ ID NO: 1718643 - protein, 20 aa, Staphylococcus aureus
YRDNFWATADMKRLADTTTL

SEQ ID NO: 1718644 - protein, 28 aa, Staphylococcus aureus
YRDNFWATADMKRLAGTTTLDNEEPKEN

SEQ ID NO: 1718645 - protein, 27 aa, Staphylococcus aureus
YRDNFWATADMKRLAGTTTLENEEPKG

SEQ ID NO: 1718646 - protein, 18 aa, Staphylococcus aureus
YRKPSDFYNMTSLVQGAK

SEQ ID NO: 1718647 - protein, 28 aa, Staphylococcus aureus
YRQHLTDKGAYVWKNLKDYYIGLLGEDS

SEQ ID NO: 1718648 - protein, 34 aa, Staphylococcus aureus
YRQKVTDKGVYVWKDRKDYFVGLLGKDIEKYPQG

SEQ ID NO: 1718649 - protein, 23 aa, Staphylococcus aureus
YSIRKYKVGIFSTLIGTVLLLSN

SEQ ID NO: 1718650 - protein, 25 aa, Staphylococcus aureus
YSIRKYKVGIFSTLIGTVLLLSNPN

SEQ ID NO: 1718651 - protein, 17 aa, Staphylococcus aureus
YSKDVIVDYGNQKGQQL

SEQ ID NO: 1718652 - protein, 18 aa, Staphylococcus aureus
YSSLIPLTPLDSSLLRKE

SEQ ID NO: 1718653 - protein, 20 aa, Staphylococcus aureus
YSVAELFGALGEKLGKGKTL

SEQ ID NO: 1718654 - protein, 19 aa, Staphylococcus aureus
YTFELHKKLQEHRMADAID

SEQ ID NO: 1718655 - protein, 19 aa, Staphylococcus aureus
YTFELHKKLQENRMADVID

SEQ ID NO: 1718656 - protein, 19 aa, Staphylococcus aureus
YTGAYGVVVLEGISQMMPM

SEQ ID NO: 1718657 - protein, 48 aa, Staphylococcus aureus
YTKPSLEFEKQFGFMLKPWTTVRFMNVIPDWFIYKIALVGKDDMKYKD

SEQ ID NO: 1718658 - protein, 48 aa, Staphylococcus aureus
YTKPSLEFKNEIGIILKKWTTIRFMNIVPDYFIYKIALVGKDDKKYGE

SEQ ID NO: 1718659 - protein, 25 aa, Staphylococcus aureus
YTLETDKTKYSWSNSYSNVNGSSTA

SEQ ID NO: 1718660 - protein, 25 aa, Staphylococcus aureus
YTNVSGSFEQVAFAKRENATTDKTA

SEQ ID NO: 1718661 - protein, 35 aa, Staphylococcus aureus
YTSGQCTYYVFDRVGGKIGSTWGNANNWASAAAAS

SEQ ID NO: 1718662 - protein, 29 aa, Staphylococcus aureus
YTVGTFSTVIATLVFLGFNTSQAHAAETN

SEQ ID NO: 1718663 - protein, 26 aa, Staphylococcus aureus
YTVGTFSTVIATLVFLGLNTSQAQAT

SEQ ID NO: 1718664 - protein, 19 aa, Staphylococcus aureus
YVAPDFRTVTPIIQNISVA

SEQ ID NO: 1718665 - protein, 21 aa, Staphylococcus aureus
YVKTPSNKVLGFYPTNANTNA

SEQ ID NO: 1718666 - protein, 22 aa, Staphylococcus aureus
YVKTPSNKVLGFYPTNATTNAF

SEQ ID NO: 1718667 - protein, 21 aa, Staphylococcus aureus
YVKTPSNKVLGFYPTSANTNA

SEQ ID NO: 1718668 - protein, 21 aa, Staphylococcus aureus
YVKTPSNKVLGFYSNNANTNA

SEQ ID NO: 1718669 - protein, 22 aa, Staphylococcus aureus
YVKTPSNKVLGFYSNNANTNAF

SEQ ID NO: 1718670 - protein, 51 aa, Staphylococcus aureus
YYAAGGRALEYNQLFMYSQLYLESTQDYQLRLDGLRQTVNRTYRIGTTKNV

SEQ ID NO: 1718671 - protein, 31 aa, Staphylococcus aureus
YYAAGGRALEYNQLFMYSQLYVESTQDHQQR

SEQ ID NO: 1718672 - protein, 17 aa, Staphylococcus aureus
YYGKYTIELDKKLQEDR

SEQ ID NO: 1718673 - protein, 17 aa, Staphylococcus aureus
YYNEQKERITIYMKHNV

SEQ ID NO: 1718674 - protein, 17 aa, Staphylococcus aureus
YYNKPFFERKNVTGYKY

SEQ ID NO: 1718675 - protein, 18 aa, Staphylococcus aureus
YYNQCYFSADNMELNDGR

SEQ ID NO: 1718676 - protein, 19 aa, Staphylococcus aureus
YYNQCYFSADNMELNDGRL

SEQ ID NO: 1718677 - protein, 19 aa, Staphylococcus aureus
YYRGDEVNFTMGVSDRHSG

SEQ ID NO: 1718678 - protein, 18 aa, Staphylococcus aureus
YYYQCYFSADNMELNDGR

SEQ ID NO: 1718679 - protein, 18 aa, Staphylococcus aureus
YYYQCYFSKKTNDINSHQ

SEQ ID NO: 1718680 - protein, 17 aa, Staphylococcus aureus
LFLLAMYELGKYVTEQV

SEQ ID NO: 1718681 - protein, 17 aa, Staphylococcus aureus
ELYYYIKGGRVDYGAAH

SEQ ID NO: 1718682 - protein, 23 aa, Staphylococcus aureus
LKHPDCAKEYWGRKGRVGIVPLL

SEQ ID NO: 1718683 - protein, 20 aa, Staphylococcus aureus
LPNSRALIWQQFDYNNSRER

SEQ ID NO: 1718684 - protein, 20 aa, Staphylococcus aureus
ELKAILPFHRSLRVANYDNQ

SEQ ID NO: 1718685 - protein, 17 aa, Staphylococcus aureus
FYFNYPFLFGNDDYIFK

SEQ ID NO: 1718686 - protein, 23 aa, Staphylococcus aureus
GKPMKPFLGVRGWYLSEYSKHKY

SEQ ID NO: 1718687 - protein, 24 aa, Staphylococcus aureus
KKEYKFPVINARNFLTGIGIEETK

SEQ ID NO: 1718688 - protein, 20 aa, Staphylococcus aureus
ESKHLGGFPISGQFLACTNP

SEQ ID NO: 1718689 - protein, 18 aa, Staphylococcus aureus
EVKGERPTIHFLGQASYE

SEQ ID NO: 1718690 - protein, 19 aa, Staphylococcus aureus
FLTGCGKSQEKATLEKDID

SEQ ID NO: 1718691 - protein, 20 aa, Staphylococcus aureus
KNKNLRLAIAQAIDKKGYVD

SEQ ID NO: 1718692 - protein, 19 aa, Staphylococcus aureus
LAQDPALKYQFLRLDQPQN

SEQ ID NO: 1718693 - protein, 20 aa, Staphylococcus aureus
LKSAFAFGISRAGMFINNED

SEQ ID NO: 1718694 - protein, 24 aa, Staphylococcus aureus
NDDLKDIPIHFAIYKQSSEDSITP

SEQ ID NO: 1718695 - protein, 25 aa, Staphylococcus aureus
NVKFLKDRYEAMKAFPMFDNIEYTE

SEQ ID NO: 1718696 - protein, 25 aa, Staphylococcus aureus
PYPHGQCTWYVYNRMKQFGTSISGD

SEQ ID NO: 1718697 - protein, 24 aa, Staphylococcus aureus
RHVDLPASVPLAWGAHRAASIVAE

SEQ ID NO: 1718698 - protein, 23 aa, Staphylococcus aureus
VKDYNSPTLIGWVKQGDVIYNNA

SEQ ID NO: 1718699 - protein, 19 aa, Staphylococcus aureus
VKQSNLWKSKDNGFYDLTR

SEQ ID NO: 1718700 - protein, 18 aa, Staphylococcus aureus
YKDGKPWYFLEEKYPDYG

SEQ ID NO: 1718701 - protein, 18 aa, Staphylococcus aureus
GYDPHVWLDPKINQTFAK

SEQ ID NO: 1718702 - protein, 20 aa, Staphylococcus aureus
IPVIFIRLVLDKHFNDVSSS

SEQ ID NO: 1718703 - protein, 21 aa, Staphylococcus aureus
LCYIYKFRARFAVLAHLLTQR

SEQ ID NO: 1718704 - protein, 24 aa, Staphylococcus aureus
NPAEQGRFLKFFVDAGLIKIKKGV

SEQ ID NO: 1718705 - protein, 22 aa, Staphylococcus aureus
YNFPKKPFKYGIHYSEIEDFDN

SEQ ID NO: 1718706 - protein, 23 aa, Staphylococcus aureus
EYVVLRFGWLYGPGTWYGKDGMI

SEQ ID NO: 1718707 - protein, 25 aa, Staphylococcus aureus
QKADLNMFFPFVITGNLIGKATEKE

SEQ ID NO: 1718708 - protein, 21 aa, Staphylococcus aureus
RKSVFLMLNIKKGIFKTHPNL

SEQ ID NO: 1718709 - protein, 18 aa, Staphylococcus aureus
TAGQCTWYVYDKVGGEIG

SEQ ID NO: 1718710 - protein, 22 aa, Staphylococcus aureus
YVFDRVGGKIGSTWGNASNWAN

SEQ ID NO: 1718711 - protein, 17 aa, Staphylococcus aureus
GTIPRGDTGYFFNQAYK

SEQ ID NO: 1718712 - protein, 18 aa, Staphylococcus aureus
HQVFLNWFGQDPAFDYFK

SEQ ID NO: 1718713 - protein, 21 aa, Staphylococcus aureus
KESGFRTSLLMYNHTNKKMTK

SEQ ID NO: 1718714 - protein, 18 aa, Staphylococcus aureus
KKYIAFKMEITAKKDDKD

SEQ ID NO: 1718715 - protein, 19 aa, Staphylococcus aureus
KLIVVLCAIIVFIALIGLS

SEQ ID NO: 1718716 - protein, 19 aa, Staphylococcus aureus
WNGFYWAGANYKNFKTRTF

SEQ ID NO: 1718717 - protein, 18 aa, Staphylococcus aureus
GKTAQAMFIYELRGDGNI

SEQ ID NO: 1718718 - protein, 18 aa, Staphylococcus aureus
IKKAGLKYGFSLEEKAVT

SEQ ID NO: 1718719 - protein, 17 aa, Staphylococcus aureus
ISEQFGFVNIGVKNYEA

SEQ ID NO: 1718720 - protein, 17 aa, Staphylococcus aureus
MKKWIPLMMKGREDNPG

SEQ ID NO: 1718721 - protein, 19 aa, Staphylococcus aureus
NRMGGTYIKSGYGADTSGI

SEQ ID NO: 1718722 - protein, 20 aa, Staphylococcus aureus
RFIAFLLALFFFLSVNNVFG

SEQ ID NO: 1718723 - protein, 19 aa, Staphylococcus aureus
NPEDLRVVIDLSNAKAGKY

SEQ ID NO: 1718724 - protein, 18 aa, Staphylococcus aureus
YEGWEFLGIVKGDDDSAR

SEQ ID NO: 1718725 - protein, 17 aa, Staphylococcus aureus
YGHGAGVVTSRTISANQ

SEQ ID NO: 1718726 - protein, 17 aa, Staphylococcus aureus
KGIKRKVIETHDDVKQV

SEQ ID NO: 1718727 - protein, 20 aa, Staphylococcus aureus
KNSRVDFGLAQWGLKQKPNE

SEQ ID NO: 1718728 - protein, 18 aa, Staphylococcus aureus
DISVGAFFRARLGNEVLE

SEQ ID NO: 1718729 - protein, 17 aa, Staphylococcus aureus
IEAAISFIENNPKGSVL

SEQ ID NO: 1718730 - protein, 19 aa, Staphylococcus aureus
VKIVGRLNYRTSYGQNVLK

SEQ ID NO: 1718731 - protein, 20 aa, Staphylococcus aureus
ANCALPYVIGEVVEDRKYAL

SEQ ID NO: 1718732 - protein, 18 aa, Staphylococcus aureus
KDLRLGMDSSWMNRKGDG

SEQ ID NO: 1718733 - protein, 22 aa, Staphylococcus aureus
NDPLREGIKYAKQAGWDTVSKA

SEQ ID NO: 1718734 - protein, 19 aa, Staphylococcus aureus
NKSGLAWPSAFKVQLQLPD

SEQ ID NO: 1718735 - protein, 22 aa, Staphylococcus aureus
YTSYFPKYAYRNGVGRPEGIVV

SEQ ID NO: 1718736 - protein, 23 aa, Staphylococcus aureus
KDIYKGKGIEVLNIYGDLKDGTH

SEQ ID NO: 1718737 - protein, 17 aa, Staphylococcus aureus
LRTGPNAAYPVIYKVEK

SEQ ID NO: 1718738 - protein, 23 aa, Staphylococcus aureus
NLKGWHTGAGMSYLYNSDVKHYR

SEQ ID NO: 1718739 - protein, 25 aa, Staphylococcus aureus
AEPGDLVVFSGRFGGGYGHTAIVLN

SEQ ID NO: 1718740 - protein, 18 aa, Staphylococcus aureus
GTPLKRCAIVNRHNGTII

SEQ ID NO: 1718741 - protein, 18 aa, Staphylococcus aureus
LLIAFAVLFSADFTYQSV

SEQ ID NO: 1718742 - protein, 22 aa, Staphylococcus aureus
YSIRKYKVGIFSTLIGTVLLLS

SEQ ID NO: 1718743 - protein, 17 aa, Staphylococcus aureus
CKPDFWKTLKYKKDKVT

SEQ ID NO: 1718744 - protein, 18 aa, Staphylococcus aureus
FDLFPKKELVPFVPYKFL

SEQ ID NO: 1718745 - protein, 19 aa, Staphylococcus aureus
IDGSILISEMNWIGEYIVS

SEQ ID NO: 1718746 - protein, 17 aa, Staphylococcus aureus
KKELVPFVPYKFLNIYG

SEQ ID NO: 1718747 - protein, 20 aa, Staphylococcus aureus
REKRVIKREHVREAQKLVDN

SEQ ID NO: 1718748 - protein, 18 aa, Staphylococcus aureus
RYSKGGKHYLIFDKNRKF

SEQ ID NO: 1718749 - protein, 17 aa, Staphylococcus aureus
GDTGYFFNQAYKKDGAI

SEQ ID NO: 1718750 - protein, 30 aa, Staphylococcus aureus; identical to SEQ ID NO: 1658002

SEQ ID NO: 1718751 - protein, 23 aa, Staphylococcus aureus
TLKETKGKIVLFNRMGGTYIKSG

SEQ ID NO: 1718752 - protein, 18 aa, Staphylococcus aureus
TVTTSLKNNGNFGASFNT

SEQ ID NO: 1718753 - protein, 19 aa, Staphylococcus aureus
YKDAWPLKASVVNFRADHT

SEQ ID NO: 1718754 - protein, 22 aa, Staphylococcus aureus
APKKAEHFHIFMGNDNDALLKE

SEQ ID NO: 1718755 - protein, 18 aa, Staphylococcus aureus
ARTGWLIVDYAGYPWPGY

SEQ ID NO: 1718756 - protein, 17 aa, Staphylococcus aureus
FPKKELVPFVPYKFLNI

SEQ ID NO: 1718757 - protein, 20 aa, Staphylococcus aureus
HVHFQRMSGGIGNQYAVDPT

SEQ ID NO: 1718758 - protein, 20 aa, Staphylococcus aureus
DAYCCVLVLRGELLDQHKDV

SEQ ID NO: 1718759 - protein, 17 aa, Staphylococcus aureus
EHLKENLNWIWNSLSIE

SEQ ID NO: 1718760 - protein, 22 aa, Staphylococcus aureus
HNGNYKYVFSFKDPNANGKYSI

SEQ ID NO: 1718761 - protein, 20 aa, Staphylococcus aureus
INKDIVGWIKLSGTSLNYPV

SEQ ID NO: 1718762 - protein, 24 aa, Staphylococcus aureus
KVGVFSHAMVRTSMFDSGDAKNYQ

SEQ ID NO: 1718763 - protein, 19 aa, Staphylococcus aureus
MSEFIKFVLEDKGKAAEEA

SEQ ID NO: 1718764 - protein, 19 aa, Staphylococcus aureus
NVKGLGIISHRTINAAAAE

SEQ ID NO: 1718765 - protein, 20 aa, Staphylococcus aureus
RNAKSAVYTITWKDGSKKEV

SEQ ID NO: 1718766 - protein, 19 aa, Staphylococcus aureus
TAAIKDFWEKVGLKTNVKL

SEQ ID NO: 1718767 - protein, 22 aa, Staphylococcus aureus
VVPIVFATLLFKTSQDAFESSQ

SEQ ID NO: 1718768 - protein, 24 aa, Staphylococcus aureus
EDKELRKAMLYAIDREKWIKAFFN

SEQ ID NO: 1718769 - protein, 23 aa, Staphylococcus aureus
FGPKGRFGGLVYDTLGFNAVDKK

SEQ ID NO: 1718770 - protein, 21 aa, Staphylococcus aureus
GVSASTWAAIIARESNGQVNA

SEQ ID NO: 1718771 - protein, 17 aa, Staphylococcus aureus
LKENLNWIWNSLSIEDQ

SEQ ID NO: 1718772 - protein, 18 aa, Staphylococcus aureus
LRNGVKMIVEQVAHTVSQ

SEQ ID NO: 1718773 - protein, 19 aa, Staphylococcus aureus
MAVMLFLTGCGKSQEKATL

SEQ ID NO: 1718774 - protein, 19 aa, Staphylococcus aureus
PTPELKTGSGIDWSDEALT

SEQ ID NO: 1718775 - protein, 17 aa, Staphylococcus aureus
YEGLDVFFVQEKRDKHD

SEQ ID NO: 1718776 - protein, 17 aa, Staphylococcus aureus
DGYLLSDKKYKDWTEHN

SEQ ID NO: 1718777 - protein, 25 aa, Staphylococcus aureus
PALYPNYWGGNKFKVIEELRKQGYN

SEQ ID NO: 1718778 - protein, 17 aa, Staphylococcus aureus
SKIKVIMKDGGYYTFEL

SEQ ID NO: 1718779 - protein, 17 aa, Staphylococcus aureus
YLPRFVFGHYMKSYLSM

SEQ ID NO: 1718780 - protein, 23 aa, Staphylococcus aureus
VKAMRWPFQYNIGLKTNDKYVSL

SEQ ID NO: 1718781 - protein, 18 aa, Staphylococcus aureus
KDNGIAVLEQDVITPTVK

SEQ ID NO: 1718782 - protein, 24 aa, Staphylococcus aureus
KLDNGQEVIIIWNPWDNGFMTQDA

SEQ ID NO: 1718783 - protein, 24 aa, Staphylococcus aureus
VIIVLIGALGFAIYAAINHSTSSS

SEQ ID NO: 1718784 - protein, 20 aa, Staphylococcus aureus
DEVLPALAYFTFSPKNYEDK

SEQ ID NO: 1718785 - protein, 22 aa, Staphylococcus aureus
FPDKSLKLSYKVNVANIDTPKN

SEQ ID NO: 1718786 - protein, 24 aa, Staphylococcus aureus
GGVPNEFNGAVFINENVRNFLKQN

SEQ ID NO: 1718787 - protein, 19 aa, Staphylococcus aureus
KAAALEEFDEVVQAQIDQA

SEQ ID NO: 1718788 - protein, 22 aa, Staphylococcus aureus
PENVSHLKIQFVPKNDAITDAR

SEQ ID NO: 1718789 - protein, 17 aa, Staphylococcus aureus
QEDATWKKLNAVKNNRV

SEQ ID NO: 1718790 - protein, 19 aa, Staphylococcus aureus
TDVDLRLSKQAKYTVNFKN

SEQ ID NO: 1718791 - protein, 25 aa, Staphylococcus aureus
TTNKDGYKYYSFIDNVGLFSGSHLY

SEQ ID NO: 1718792 - protein, 23 aa, Staphylococcus aureus
VFNEKNEVIGIHWGGVPNEFNGA

SEQ ID NO: 1718793 - protein, 18 aa, Staphylococcus aureus
YATLFPRTGIYAERKHNA

SEQ ID NO: 1718794 - protein, 28 aa, Staphylococcus aureus
CTYYVFDRVGGKIGSTWGNASNWANAAA

SEQ ID NO: 1718795 - protein, 18 aa, Staphylococcus aureus
DKILDLKYKLRVNNVPTP

SEQ ID NO: 1718796 - protein, 19 aa, Staphylococcus aureus
FKIDWNRHGFWGYWSGENH

SEQ ID NO: 1718797 - protein, 20 aa, Staphylococcus aureus
HAKDASWLTSRKQLQPYGQY

SEQ ID NO: 1718798 - protein, 18 aa, Staphylococcus aureus
MDEFKIDWNRHGFWGYWS

SEQ ID NO: 1718799 - protein, 19 aa, Staphylococcus aureus
YDYKYFYSYKVVKGVKKYF

SEQ ID NO: 1718800 - protein, 17 aa, Staphylococcus aureus
YPSEYHVDFQVKRNRKT

SEQ ID NO: 1718801 - protein, 22 aa, Staphylococcus aureus
DKFKISQILTFNFIKDKSYDKD

SEQ ID NO: 1718802 - protein, 20 aa, Staphylococcus aureus
FVNSELRRSDMFDKNNPQNY

SEQ ID NO: 1718803 - protein, 18 aa, Staphylococcus aureus
LSGKWLWQKPNGSIHATL

SEQ ID NO: 1718804 - protein, 17 aa, Staphylococcus aureus
SNTEILYELGLGKYIVG

SEQ ID NO: 1718805 - protein, 30 aa, Staphylococcus aureus; identical to SEQ ID NO: 1588326

SEQ ID NO: 1718806 - protein, 18 aa, Staphylococcus aureus
FVPSMHWIAANPKDLNDY

SEQ ID NO: 1718807 - protein, 18 aa, Staphylococcus aureus
LRWPGSYSVSIQNVDDNN

SEQ ID NO: 1718808 - protein, 20 aa, Staphylococcus aureus
EFALITGAALLARRRTKNEK

SEQ ID NO: 1718809 - protein, 26 aa, Staphylococcus aureus
FSIRKFNVGIFSALIATVTFISTNPT

SEQ ID NO: 1718810 - protein, 23 aa, Staphylococcus aureus
ILKNRPGIHYAPPILEKNKDGQR

SEQ ID NO: 1718811 - protein, 18 aa, Staphylococcus aureus
LRSKLKFKYMGEVIESKQ

SEQ ID NO: 1718812 - protein, 20 aa, Staphylococcus aureus
YPVVFVHGFLGLVGDNAPAL

SEQ ID NO: 1718813 - protein, 21 aa, Staphylococcus aureus
GHAKDASWLTSRKQLQPYGQY

SEQ ID NO: 1718814 - protein, 23 aa, Staphylococcus aureus
NVIPNRFIYKIALVGKDEKKYKD

SEQ ID NO: 1718815 - protein, 21 aa, Staphylococcus aureus
AKAQGLEAFDNIQIDSTEKQK

SEQ ID NO: 1718816 - protein, 19 aa, Staphylococcus aureus
DHVDFIGVDFLDFKRKGAE

SEQ ID NO: 1718817 - protein, 23 aa, Staphylococcus aureus
HAKELRAKLDLILGDTDNPHKIT

SEQ ID NO: 1718818 - protein, 17 aa, Staphylococcus aureus
LRWPGSYSVSIQNVDDN

SEQ ID NO: 1718819 - protein, 23 aa, Staphylococcus aureus
TAEEKTEALAMIKQITDQAKQGI

SEQ ID NO: 1718820 - protein, 19 aa, Staphylococcus aureus
TKMMLPLMMTKGGSIVNTS

SEQ ID NO: 1718821 - protein, 18 aa, Staphylococcus aureus
DLPLKEFALITGAALLAR

SEQ ID NO: 1718822 - protein, 30 aa, Staphylococcus aureus
KEGKAKINAVKTFSEYKKDALAKIEDAYNA

SEQ ID NO: 1718823 - protein, 17 aa, Staphylococcus aureus
LRARLFVDQIVSFVNNS

SEQ ID NO: 1718824 - protein, 24 aa, Staphylococcus aureus
WSAHISLWGAESWGNINQLKDRYV

SEQ ID NO: 1718825 - protein, 19 aa, Staphylococcus aureus
YKKDALAKIEDAYNAKVNE

SEQ ID NO: 1718826 - protein, 17 aa, Staphylococcus aureus
SDIDLRLSKQAEYTVHF

SEQ ID NO: 1718827 - protein, 17 aa, Staphylococcus aureus
YQSLKDSFNYGYKYLTD

SEQ ID NO: 1718828 - protein, 22 aa, Staphylococcus aureus
NKDLDFAFGLSMTSKNVARYES

SEQ ID NO: 1718829 - protein, 18 aa, Staphylococcus aureus
RYLQEEYNIYGFNDTNKG

SEQ ID NO: 1718830 - protein, 23 aa, Staphylococcus aureus
LVAPEHIVRAAARDAVKQQYEAK

SEQ ID NO: 1718831 - protein, 18 aa, Staphylococcus aureus
VELYYYIKGGRVDYGAAH

SEQ ID NO: 1718832 - protein, 24 aa, Staphylococcus aureus
VIILLIGALGFAIYAAINHSTSSN

SEQ ID NO: 1718833 - protein, 17 aa, Staphylococcus aureus
VKSSFGYHIIKADKPTD

SEQ ID NO: 1718834 - protein, 17 aa, Staphylococcus aureus
YTYGYKTGGDFSINRGG

SEQ ID NO: 1718835 - protein, 28 aa, Staphylococcus aureus
CTYYVFDRVGGKIGSTWGNASNWASAAA

SEQ ID NO: 1718836 - protein, 23 aa, Staphylococcus aureus
FKPFREVSDSMPYPHGQCTWYVY

SEQ ID NO: 1718837 - protein, 29 aa, Staphylococcus aureus
IYQLRDGYKYYDFVDSIGLHSGSHVYVER

SEQ ID NO: 1718838 - protein, 19 aa, Staphylococcus aureus
LGKLRAGLDLIKKPIQMQD

SEQ ID NO: 1718839 - protein, 17 aa, Staphylococcus aureus
NDELLFYRNTRIATVEN

SEQ ID NO: 1718840 - protein, 17 aa, Staphylococcus aureus
NPDRRVAQQNAFYNVLK

SEQ ID NO: 1718841 - protein, 22 aa, Staphylococcus aureus
RNAKSAVYTITWKDGSKKEVDL

SEQ ID NO: 1718842 - protein, 20 aa, Staphylococcus aureus
SGYCLKNKYMYGGVTLAGDY

SEQ ID NO: 1718843 - protein, 19 aa, Staphylococcus aureus
CVKSCSLLFMLNGNPKPEQ

SEQ ID NO: 1718844 - protein, 20 aa, Staphylococcus aureus
DAYCCVLVLRGELLDQHKAV

SEQ ID NO: 1718845 - protein, 17 aa, Staphylococcus aureus
DNIKKVLLFLSRNTSSS

SEQ ID NO: 1718846 - protein, 18 aa, Staphylococcus aureus
FMNIVPDYFIYKIALVGK

SEQ ID NO: 1718847 - protein, 22 aa, Staphylococcus aureus
HNGNYKYVFSFKDPNVNGKYSI

SEQ ID NO: 1718848 - protein, 17 aa, Staphylococcus aureus
IVICVLLVLITISQILK

SEQ ID NO: 1718849 - protein, 21 aa, Staphylococcus aureus
KFKISQILTFNFIKDKSYDKD

SEQ ID NO: 1718850 - protein, 17 aa, Staphylococcus aureus
KFLDFDLLFKSINWLDG

SEQ ID NO: 1718851 - protein, 28 aa, Staphylococcus aureus
LEQLKAQRINPVVKKNALEAIREVVNKQ

SEQ ID NO: 1718852 - protein, 21 aa, Staphylococcus aureus
PIYKREYKHFYTPEEAQRAQE

SEQ ID NO: 1718853 - protein, 24 aa, Staphylococcus aureus
RTGVPASTWAAIIARESNGQVNAY

SEQ ID NO: 1718854 - protein, 18 aa, Staphylococcus aureus
SALPGRKSGSLVGISQID

SEQ ID NO: 1718855 - protein, 17 aa, Staphylococcus aureus
YPSEYHVDFQVQRNPKT

SEQ ID NO: 1718856 - protein, 17 aa, Staphylococcus aureus
ALYISVMILIFAIAGCG

SEQ ID NO: 1718857 - protein, 17 aa, Staphylococcus aureus
AVLKRFNVALSDIEAVI

SEQ ID NO: 1718858 - protein, 18 aa, Staphylococcus aureus
DGYLLSDKNYKDWTEHNQ

SEQ ID NO: 1718859 - protein, 27 aa, Staphylococcus aureus
DTPIPDWYLGSILNRLGDQIYYAKELT

SEQ ID NO: 1718860 - protein, 23 aa, Staphylococcus aureus
FGPKGRFGGLVYDTLGFNAVDKN

SEQ ID NO: 1718861 - protein, 24 aa, Staphylococcus aureus
GIATLKGVEPHIVVKPEAQEAIKA

SEQ ID NO: 1718862 - protein, 21 aa, Staphylococcus aureus
HVHFQRMSGGIGNQYAVDPTS

SEQ ID NO: 1718863 - protein, 23 aa, Staphylococcus aureus
IKSMRWPFQYNIGLKTNDKYVSL

SEQ ID NO: 1718864 - protein, 22 aa, Staphylococcus aureus
IRFLKLKVGKIINVAKVDIIAF

SEQ ID NO: 1718865 - protein, 18 aa, Staphylococcus aureus
KEDLEFIIDKFFKKIQQE

SEQ ID NO: 1718866 - protein, 24 aa, Staphylococcus aureus
KPSQIKGAILFGGFYNMQTVRETE

SEQ ID NO: 1718867 - protein, 34 aa, Staphylococcus aureus
KSSLEFKNELGIIIKKWTTIRFMNIVPDYFIYKI

SEQ ID NO: 1718868 - protein, 19 aa, Staphylococcus aureus
LCISLLILIIFVTSCDGDN

SEQ ID NO: 1718869 - protein, 17 aa, Staphylococcus aureus
LGISFLFLVISITAGCG

SEQ ID NO: 1718870 - protein, 17 aa, Staphylococcus aureus
LKNNGNFGASFNTDDFV

SEQ ID NO: 1718871 - protein, 17 aa, Staphylococcus aureus
LSEKLSFDRMFDVLDSK

SEQ ID NO: 1718872 - protein, 19 aa, Staphylococcus aureus
MAIMLFLTGCGKSQEKATL

SEQ ID NO: 1718873 - protein, 25 aa, Staphylococcus aureus
MRYLKRLSWYISILILIVVIAGCGK

SEQ ID NO: 1718874 - protein, 19 aa, Staphylococcus aureus
MSEFIKFVLEDKGKAAEEG

SEQ ID NO: 1718875 - protein, 17 aa, Staphylococcus aureus
NNGLSMVPWGTKNQVIL

SEQ ID NO: 1718876 - protein, 22 aa, Staphylococcus aureus
PHLSFSGKWLWQNPNGTIHATL

SEQ ID NO: 1718877 - protein, 17 aa, Staphylococcus aureus
RVTNGIYDFVCEIDTLY

SEQ ID NO: 1718878 - protein, 19 aa, Staphylococcus aureus
SDIDLRLSKQAKYTVHFKN

SEQ ID NO: 1718879 - protein, 18 aa, Staphylococcus aureus
SINWLDGISAEFKDLKVE

SEQ ID NO: 1718880 - protein, 20 aa, Staphylococcus aureus
SNVKGLGIISHRTINAAAAE

SEQ ID NO: 1718881 - protein, 21 aa, Staphylococcus aureus
SSKKKALNWWDYEIGTPRSLT

SEQ ID NO: 1718882 - protein, 30 aa, Staphylococcus aureus
TNVFPYHGVVAFKDATGFVIGKNTIITNKH

SEQ ID NO: 1718883 - protein, 26 aa, Staphylococcus aureus
VIAEKSVAYGPIWRLFKVPENVSHLK

SEQ ID NO: 1718884 - protein, 20 aa, Staphylococcus aureus
YKDAWPLKASVVNFRADHTR

SEQ ID NO: 1718885 - protein, 21 aa, Staphylococcus aureus
YSGYCLKNKYIYGGVTLAGDY

SEQ ID NO: 1718886 - protein, 18 aa, Staphylococcus aureus
YTNQWNRLHWIGNNYKNQ

SEQ ID NO: 1718887 - protein, 18 aa, Staphylococcus aureus
ASIAPVVAVLVGFIAKQG

SEQ ID NO: 1718888 - protein, 19 aa, Staphylococcus aureus
DAVLKRFNVALGDIEAVIT

SEQ ID NO: 1718889 - protein, 17 aa, Staphylococcus aureus
ENFKFFVQYGDFKDIND

SEQ ID NO: 1718890 - protein, 21 aa, Staphylococcus aureus
FKPFREVSDSMPYPHGQCTWY

SEQ ID NO: 1718891 - protein, 27 aa, Staphylococcus aureus
FPYNGVVSFKDATGFVIGKNTIITNKH

SEQ ID NO: 1718892 - protein, 19 aa, Staphylococcus aureus
INKDIVGWIKLSGTSLNYP

SEQ ID NO: 1718893 - protein, 22 aa, Staphylococcus aureus
KEINPKFKGLRSYYTKSSLEFK

SEQ ID NO: 1718894 - protein, 18 aa, Staphylococcus aureus
KPFREVSDNMPYPHGQCT

SEQ ID NO: 1718895 - protein, 19 aa, Staphylococcus aureus
LALITGAALLARRRSKKEK

SEQ ID NO: 1718896 - protein, 22 aa, Staphylococcus aureus
LDFKRKGAELANFYTGIINDLL

SEQ ID NO: 1718897 - protein, 17 aa, Staphylococcus aureus
LLILIIFVTSCDGDNKI

SEQ ID NO: 1718898 - protein, 19 aa, Staphylococcus aureus
MDAYKEVRQAATARKAQNA

SEQ ID NO: 1718899 - protein, 19 aa, Staphylococcus aureus
NDFPITWFYPLGEKKVERT

SEQ ID NO: 1718900 - protein, 17 aa, Staphylococcus aureus
NGKSGWVSKAYLVDTAK

SEQ ID NO: 1718901 - protein, 17 aa, Staphylococcus aureus
NNFPYNGVVSFKDATGF

SEQ ID NO: 1718902 - protein, 21 aa, Staphylococcus aureus
NQLRKAMKFDQSFKPSQIKGA

SEQ ID NO: 1718903 - protein, 17 aa, Staphylococcus aureus
VSDSMPYPHGQCTWYVY

SEQ ID NO: 1718904 - protein, 18 aa, Staphylococcus aureus
YLPRFVFGHYMKSYLSMY

SEQ ID NO: 1718905 - protein, 17 aa, Staphylococcus aureus
YLQEEYNIYGFNDTNKG

SEQ ID NO: 1718906 - protein, 32 aa, Staphylococcus aureus; identical to SEQ ID NO: 1677936

SEQ ID NO: 1718907 - protein, 22 aa, Staphylococcus aureus
ATLKGVQPHIVIKPEAQQAIKA

SEQ ID NO: 1718908 - protein, 17 aa, Staphylococcus aureus
INPKFKDLRAYYTKPSL

SEQ ID NO: 1718909 - protein, 20 aa, Staphylococcus aureus
KELEQAVALIRTMPQRQQTS

SEQ ID NO: 1718910 - protein, 18 aa, Staphylococcus aureus
KGLDFAFGLSMTSKNVAR

SEQ ID NO: 1718911 - protein, 24 aa, Staphylococcus aureus
KGMKEARKGVGYKAEIEVHTTLFS

SEQ ID NO: 1718912 - protein, 19 aa, Staphylococcus aureus
LRLSKQAKYTVHFKNGTKR

SEQ ID NO: 1718913 - protein, 19 aa, Staphylococcus aureus
LRNGVKMIVEQVAHTVSQL

SEQ ID NO: 1718914 - protein, 17 aa, Staphylococcus aureus
LSKQAKFTVNFKNGTKK

SEQ ID NO: 1718915 - protein, 26 aa, Staphylococcus aureus
PEKPKRVAVLTGFYVGDFIKLGIKPI

SEQ ID NO: 1718916 - protein, 21 aa, Staphylococcus aureus
PFGKLRAGFDLFKKPTQMQNG

SEQ ID NO: 1718917 - protein, 18 aa, Staphylococcus aureus
RKANGYKLFKDDIEITTS

SEQ ID NO: 1718918 - protein, 21 aa, Staphylococcus aureus
TDVDLRLSKQAKFTVNFKNGT

SEQ ID NO: 1718919 - protein, 22 aa, Staphylococcus aureus
TFATSLPAKFVVKDVQPAKPTV

SEQ ID NO: 1718920 - protein, 17 aa, Staphylococcus aureus
VVSNEFAFLHPHKITTN

SEQ ID NO: 1718921 - protein, 18 aa, Staphylococcus aureus
IDGSILISEMNWIGEYIV

SEQ ID NO: 1718922 - protein, 25 aa, Staphylococcus aureus
IGEKVVAYGPIWRLLKVPENVSHLK

SEQ ID NO: 1718923 - protein, 18 aa, Staphylococcus aureus
ILTVCLIGLLILATNEDA

SEQ ID NO: 1718924 - protein, 34 aa, Staphylococcus aureus
KPSLEFKNEIGIILKKWTTIRFMNIVPDYFIYKI

SEQ ID NO: 1718925 - protein, 21 aa, Staphylococcus aureus
LEKSRCIPINLWVNGNLKTIS

SEQ ID NO: 1718926 - protein, 18 aa, Staphylococcus aureus
LKDYETWRTYMLAQETFT

SEQ ID NO: 1718927 - protein, 17 aa, Staphylococcus aureus
PVVAVLVGFIAKQGLKK

SEQ ID NO: 1718928 - protein, 18 aa, Staphylococcus aureus
RLWLYLVLLAVFIGACGM

SEQ ID NO: 1718929 - protein, 17 aa, Staphylococcus aureus
TKIKPAAREKINQKANE

SEQ ID NO: 1718930 - protein, 17 aa, Staphylococcus aureus
VAVLVGFIAKQGLKKAI

SEQ ID NO: 1718931 - protein, 24 aa, Staphylococcus aureus
VFNEKNEVIGIHWGGVPNQFNGAV

SEQ ID NO: 1718932 - protein, 19 aa, Staphylococcus aureus
VSDYYYWKIIDSLEAQFTG

SEQ ID NO: 1718933 - protein, 17 aa, Staphylococcus aureus
WTYKDGKPWYFLEEKYP

SEQ ID NO: 1718934 - protein, 18 aa, Staphylococcus aureus
AEHFHIFMGNDNDALLKE

SEQ ID NO: 1718935 - protein, 17 aa, Staphylococcus aureus
DDKAYKCSFYNPETTNT

SEQ ID NO: 1718936 - protein, 29 aa, Staphylococcus aureus
ELVGNLLPGDYFGTIRFGRKEQLFEIRVK

SEQ ID NO: 1718937 - protein, 21 aa, Staphylococcus aureus
GMKQARKGVGYKAAIEVHTTL

SEQ ID NO: 1718938 - protein, 18 aa, Staphylococcus aureus
GNVIALGRIRGNDTNDHG

SEQ ID NO: 1718939 - protein, 17 aa, Staphylococcus aureus
IFLLAMYELGKYVTEQV

SEQ ID NO: 1718940 - protein, 21 aa, Staphylococcus aureus
KDLDFAFGLSMTSKNVARYES

SEQ ID NO: 1718941 - protein, 19 aa, Staphylococcus aureus
KKKIDEYELYKKWYKSSNK

SEQ ID NO: 1718942 - protein, 22 aa, Staphylococcus aureus
NKDLDFAFGLSMTSKNIARYEN

SEQ ID NO: 1718943 - protein, 18 aa, Staphylococcus aureus
TRGFAVYFSPEIKKFIAD

SEQ ID NO: 1718944 - protein, 19 aa, Staphylococcus aureus
WIDEGFMPLIYKGEMMDLS

SEQ ID NO: 1718945 - protein, 21 aa, Staphylococcus aureus
YKGILRVGAATGFVVGKNTIL

SEQ ID NO: 1718946 - protein, 19 aa, Staphylococcus aureus
APKKAEHFHIFMGNDNDAL

SEQ ID NO: 1718947 - protein, 17 aa, Staphylococcus aureus
APNLKLAITAGVGSDHV

SEQ ID NO: 1718948 - protein, 20 aa, Staphylococcus aureus
DEVMPALAYFTFSPKNYEDK

SEQ ID NO: 1718949 - protein, 20 aa, Staphylococcus aureus
FKLDWNKHGFWGYWSGENHV

SEQ ID NO: 1718950 - protein, 19 aa, Staphylococcus aureus
GEISPLFKGNHDNMISSIT

SEQ ID NO: 1718951 - protein, 26 aa, Staphylococcus aureus
GLVLIMFVLCGFIFPLTVTALGQVLF

SEQ ID NO: 1718952 - protein, 23 aa, Staphylococcus aureus
IATLKGVQPHIVIKPEAQQAIKA

SEQ ID NO: 1718953 - protein, 23 aa, Staphylococcus aureus
IKAMRWPFQYNIGLKTNDPNVDL

SEQ ID NO: 1718954 - protein, 18 aa, Staphylococcus aureus
KGRGFELTNVTGYKYGNK

SEQ ID NO: 1718955 - protein, 17 aa, Staphylococcus aureus
KLTYRTASDVVINNAQP

SEQ ID NO: 1718956 - protein, 24 aa, Staphylococcus aureus
LFVCSLIVCGFFAYKIYFPTDAEN

SEQ ID NO: 1718957 - protein, 18 aa, Staphylococcus aureus
LWGAESWGNVNQLRDRYV

SEQ ID NO: 1718958 - protein, 23 aa, Staphylococcus aureus
NAKELRAKLDIILGDAKDPVRIT

SEQ ID NO: 1718959 - protein, 18 aa, Staphylococcus aureus
NFKKIGWDVEAHKIMNNG

SEQ ID NO: 1718960 - protein, 30 aa, Staphylococcus aureus
TNIFPYNGVVSFKDATGFVIGKNTIITNKH

SEQ ID NO: 1718961 - protein, 17 aa, Staphylococcus aureus
FLKQNIEDIHFANDDQP

SEQ ID NO: 1718962 - protein, 24 aa, Staphylococcus aureus
GGVPNQFNGAVFINENVRNFLKQN

SEQ ID NO: 1718963 - protein, 24 aa, Staphylococcus aureus
HTFATSLPAKFVVKDVQPAKPTVT

SEQ ID NO: 1718964 - protein, 18 aa, Staphylococcus aureus
KAPNLKLAITAGVGSDHV

SEQ ID NO: 1718965 - protein, 25 aa, Staphylococcus aureus
KLNNGQEVIIIWNPWDNGFMTQDAK

SEQ ID NO: 1718966 - protein, 20 aa, Staphylococcus aureus
SSLSCALLLLSAANTEANSA

SEQ ID NO: 1718967 - protein, 17 aa, Staphylococcus aureus
TRGFAVYFSPEIKKFIA

SEQ ID NO: 1718968 - protein, 18 aa, Staphylococcus aureus
ARTGWLIVDYAGYTWPGY

SEQ ID NO: 1718969 - protein, 24 aa, Staphylococcus aureus
ENLKGWHTGAGMSYLYNSDVKHYR

SEQ ID NO: 1718970 - protein, 17 aa, Staphylococcus aureus
EPVINRKASAREQLTTL

SEQ ID NO: 1718971 - protein, 23 aa, Staphylococcus aureus
FYKTPKYSLGDYVWYDSNKDGKQ

SEQ ID NO: 1718972 - protein, 18 aa, Staphylococcus aureus
GPTLRLFKVPDNVRNLKI

SEQ ID NO: 1718973 - protein, 20 aa, Staphylococcus aureus
KGIVRIGSATGFVVGKNTIL

SEQ ID NO: 1718974 - protein, 20 aa, Staphylococcus aureus
PTPELKTGSGIDWSDEALTQ

SEQ ID NO: 1718975 - protein, 18 aa, Staphylococcus aureus
RNFLKQNIEDINFANDDH

SEQ ID NO: 1718976 - protein, 19 aa, Staphylococcus aureus
RYSKGGKHYLIFDKNRKFT

SEQ ID NO: 1718977 - protein, 19 aa, Staphylococcus aureus
RYTNQWNRLHWVGNNYKNQ

SEQ ID NO: 1718978 - protein, 24 aa, Staphylococcus aureus
TLKETKGKIVLFNRMGGTYIKSGY

SEQ ID NO: 1718979 - protein, 23 aa, Staphylococcus aureus
VFETARGVLYPGVSDMYDAKQYV

SEQ ID NO: 1718980 - protein, 24 aa, Staphylococcus aureus
YKRTIKISGLKAMYALKSKDFKKM

SEQ ID NO: 1718981 - protein, 20 aa, Staphylococcus aureus
ANCALPYVIGEVVEDRRYAL

SEQ ID NO: 1718982 - protein, 30 aa, Staphylococcus aureus; identical to SEQ ID NO: 1587652

SEQ ID NO: 1718983 - protein, 17 aa, Staphylococcus aureus
AVYTITWKDGSKKEVDL

SEQ ID NO: 1718984 - protein, 25 aa, Staphylococcus aureus
FMNVIPDWFIYKIALVGKDDKKYKD

SEQ ID NO: 1718985 - protein, 20 aa, Staphylococcus aureus
GFMLKPWTTVRFMNVIPDWF

SEQ ID NO: 1718986 - protein, 22 aa, Staphylococcus aureus
IFNGLKRRAQTILDENRNNVPL

SEQ ID NO: 1718987 - protein, 21 aa, Staphylococcus aureus
KELEQAVALIRTMPQRQQTSR

SEQ ID NO: 1718988 - protein, 19 aa, Staphylococcus aureus
KGGDGFDFGHVERFIQNPP

SEQ ID NO: 1718989 - protein, 18 aa, Staphylococcus aureus
KLKGLGLLQNGQKVSIYS

SEQ ID NO: 1718990 - protein, 34 aa, Staphylococcus aureus
KPSLEFKNEIGIILKKWTTIRFMNVVPDYFIYKI

SEQ ID NO: 1718991 - protein, 17 aa, Staphylococcus aureus
PNNKFTMYRVFGSKKTE

SEQ ID NO: 1718992 - protein, 18 aa, Staphylococcus aureus
RNDELLFYRNTRIATVEN

SEQ ID NO: 1718993 - protein, 18 aa, Staphylococcus aureus
RSFYSIRKSTLGVASVIV

SEQ ID NO: 1718994 - protein, 25 aa, Staphylococcus aureus
RTGSPIRLMIGFDYPDAFGNGETLV

SEQ ID NO: 1718995 - protein, 20 aa, Staphylococcus aureus
TFASLDIFNGLKRRAQTILD

SEQ ID NO: 1718996 - protein, 18 aa, Staphylococcus aureus
AEERKARFLDKQKNKKTP

SEQ ID NO: 1718997 - protein, 23 aa, Staphylococcus aureus
DNDPLREGIKYAKQAGWDTVSKA

SEQ ID NO: 1718998 - protein, 18 aa, Staphylococcus aureus
FFTDHSWYNDLLVDFDSK

SEQ ID NO: 1718999 - protein, 17 aa, Staphylococcus aureus
KDLRLGMDSSWMNRKGD

SEQ ID NO: 1719000 - protein, 17 aa, Staphylococcus aureus
KGYEWNPQPIKSMKHSG

SEQ ID NO: 1719001 - protein, 24 aa, Staphylococcus aureus
KVGVFSHAMVRTSMFDSGDNKNYQ

SEQ ID NO: 1719002 - protein, 18 aa, Staphylococcus aureus
LEYNQLFMYSQLYVESTQ

SEQ ID NO: 1719003 - protein, 20 aa, Staphylococcus aureus
LKISQILTFNFIKDKSYDKD

SEQ ID NO: 1719004 - protein, 18 aa, Staphylococcus aureus
LTEREKRVIKREHVREAQ

SEQ ID NO: 1719005 - protein, 19 aa, Staphylococcus aureus
NGFPITWFYPLGEKKVERK

SEQ ID NO: 1719006 - protein, 17 aa, Staphylococcus aureus
NKLVLGISFLFLIISIF

SEQ ID NO: 1719007 - protein, 22 aa, Staphylococcus aureus
PLGKLRAGFDLLKKPTQMQDGD

SEQ ID NO: 1719008 - protein, 17 aa, Staphylococcus aureus
SALPGRKSGSLVGISQI

SEQ ID NO: 1719009 - protein, 19 aa, Staphylococcus aureus
TILFKGFFTDHSWYNDLLV

SEQ ID NO: 1719010 - protein, 18 aa, Staphylococcus aureus
VFATLLFKTSQDAFESSQ

SEQ ID NO: 1719011 - protein, 23 aa, Staphylococcus aureus
YTSYFPKYAYRNGVGRPEGIVVH

SEQ ID NO: 1719012 - protein, 17 aa, Staphylococcus aureus
YYLEDYIIYAIGLTNKY

SEQ ID NO: 1719013 - protein, 17 aa, Staphylococcus aureus
DKILDLRYKLRVNNVPT

SEQ ID NO: 1719014 - protein, 18 aa, Staphylococcus aureus
EINPKFKDLRAYYTKPSL

SEQ ID NO: 1719015 - protein, 18 aa, Staphylococcus aureus
EPVINRKASAREQLTTLF

SEQ ID NO: 1719016 - protein, 20 aa, Staphylococcus aureus
GDTIKVAWPTSGTVKIEGYS

SEQ ID NO: 1719017 - protein, 27 aa, Staphylococcus aureus
GIYQLKDGYKYYSFVDSIGLHSGSHVF

SEQ ID NO: 1719018 - protein, 17 aa, Staphylococcus aureus
IPCNLWIDGHQTEIELT

SEQ ID NO: 1719019 - protein, 23 aa, Staphylococcus aureus
IPLDPSALVYLVIPTSQTRDGGS

SEQ ID NO: 1719020 - protein, 19 aa, Staphylococcus aureus
ISIGMFLALGMSNKAYADE

SEQ ID NO: 1719021 - protein, 27 aa, Staphylococcus aureus
KIRNRSGQVIYDWPTVHINSLKDLARA

SEQ ID NO: 1719022 - protein, 17 aa, Staphylococcus aureus
KNGSLAISGRVSMNQAY

SEQ ID NO: 1719023 - protein, 19 aa, Staphylococcus aureus
KRDAYTNAVSRAETILNKT

SEQ ID NO: 1719024 - protein, 19 aa, Staphylococcus aureus
LCISLLILIIFATSCGSNK

SEQ ID NO: 1719025 - protein, 18 aa, Staphylococcus aureus
LRYKLRVNNVPTPRTVTF

SEQ ID NO: 1719026 - protein, 17 aa, Staphylococcus aureus
MLPKIEAAISFIENNPK

SEQ ID NO: 1719027 - protein, 23 aa, Staphylococcus aureus
NLKGWHTGAGMSYLYNSDVKHYH

SEQ ID NO: 1719028 - protein, 20 aa, Staphylococcus aureus
NSLTEKLKGLGLLQNGQKVS

SEQ ID NO: 1719029 - protein, 24 aa, Staphylococcus aureus
SSDVLKLKANYTIDDSVKEGDTFT

SEQ ID NO: 1719030 - protein, 26 aa, Staphylococcus aureus
TKPSLEFEKQFGFMLKPWTTVRFMNV

SEQ ID NO: 1719031 - protein, 17 aa, Staphylococcus aureus
YKMRWNPAHPGTHQYAT

SEQ ID NO: 1719032 - protein, 19 aa, Staphylococcus aureus
YSIRKYKVGIFSTLIGTVL

SEQ ID NO: 1719033 - protein, 24 aa, Staphylococcus aureus
YYQHSKKALGIWFVVDHNRVVEVT

SEQ ID NO: 1719034 - protein, 26 aa, Staphylococcus aureus
AARTRNPIRLMIGFDYPDGYGNSETL

SEQ ID NO: 1719035 - protein, 19 aa, Staphylococcus aureus
DGYQWVIKFNKGHAPHENM

SEQ ID NO: 1719036 - protein, 21 aa, Staphylococcus aureus
DSGKYKVIFEKPAGLTQTGTN

SEQ ID NO: 1719037 - protein, 19 aa, Staphylococcus aureus
DYKNIPCNLWIDGHQTEIE

SEQ ID NO: 1719038 - protein, 24 aa, Staphylococcus aureus
GHAPHENMIYWFALPAGQTPVGRT

SEQ ID NO: 1719039 - protein, 22 aa, Staphylococcus aureus
GTFSTVIATLVFLGLNTSQAQA

SEQ ID NO: 1719040 - protein, 17 aa, Staphylococcus aureus
IPNGIDLSIKFSDNKIN

SEQ ID NO: 1719041 - protein, 31 aa, Staphylococcus aureus; identical to SEQ ID NO: 1586642

SEQ ID NO: 1719042 - protein, 20 aa, Staphylococcus aureus
KKKAEVELDINTASTWKKFE

SEQ ID NO: 1719043 - protein, 27 aa, Staphylococcus aureus
NNMNFLRWVNFPQDYTVTWTNAKIANR

SEQ ID NO: 1719044 - protein, 18 aa, Staphylococcus aureus
PEVKKNALEAIREVVNKQ

SEQ ID NO: 1719045 - protein, 23 aa, Staphylococcus aureus
PNGEIKARSSISMNNVTYTTQDE

SEQ ID NO: 1719046 - protein, 18 aa, Staphylococcus aureus
TNAFRPGGVNPLNEYQLS

SEQ ID NO: 1719047 - protein, 26 aa, Staphylococcus aureus
EGDTFTFKYGQYFRPGSVRLPSQTQN

SEQ ID NO: 1719048 - protein, 24 aa, Staphylococcus aureus
FMNVIPDWFIYKIALVGKDDKKYK

SEQ ID NO: 1719049 - protein, 31 aa, Staphylococcus aureus
GIYQLRDGYKYYDFVDSIGLHSGSHVYVERR

SEQ ID NO: 1719050 - protein, 17 aa, Staphylococcus aureus
LCISLLILSIFVTSCDG

SEQ ID NO: 1719051 - protein, 17 aa, Staphylococcus aureus
LPIRAGYSLEIKVPLNA

SEQ ID NO: 1719052 - protein, 17 aa, Staphylococcus aureus
LRSKLKFKYMGEVIESK

SEQ ID NO: 1719053 - protein, 17 aa, Staphylococcus aureus
LYISVMILMFAIAGCGK

SEQ ID NO: 1719054 - protein, 17 aa, Staphylococcus aureus
PEKVSVNLLANGEKVET

SEQ ID NO: 1719055 - protein, 20 aa, Staphylococcus aureus
PTPELKTGSGIDWSDEALTD

SEQ ID NO: 1719056 - protein, 22 aa, Staphylococcus aureus
PVPEDHAYIRFPVSDGTQELKI

SEQ ID NO: 1719057 - protein, 18 aa, Staphylococcus aureus
RTDLKMANFHKYNLEELS

SEQ ID NO: 1719058 - protein, 23 aa, Staphylococcus aureus
SAHISLWGAESWGNINQLKDRYV

SEQ ID NO: 1719059 - protein, 23 aa, Staphylococcus aureus
DKFKISQILTFNFIKDKSYDKDT

SEQ ID NO: 1719060 - protein, 25 aa, Staphylococcus aureus
KAFACSMAGLYACAHYCGVWAIVNP

SEQ ID NO: 1719061 - protein, 27 aa, Staphylococcus aureus
KGHAPHQNMIFWFALPADQVPVGRTDF

SEQ ID NO: 1719062 - protein, 23 aa, Staphylococcus aureus
LDSPRIIPINLIINGKHQTVTTK

SEQ ID NO: 1719063 - protein, 23 aa, Staphylococcus aureus
LNKYPVVFVHGFLGLVGDNAPAL

SEQ ID NO: 1719064 - protein, 18 aa, Staphylococcus aureus
LSEKLSFERMFDVMDSKQ

SEQ ID NO: 1719065 - protein, 18 aa, Staphylococcus aureus
NCKPDFWKTLKYKKDKVT

SEQ ID NO: 1719066 - protein, 19 aa, Staphylococcus aureus
PDKILDLKYKLRVNNVPTP

SEQ ID NO: 1719067 - protein, 20 aa, Staphylococcus aureus
PDKILDLKYKLRVNNVPTPR

SEQ ID NO: 1719068 - protein, 18 aa, Staphylococcus aureus
QAGHPVFYVYAGNQGNAS

SEQ ID NO: 1719069 - protein, 17 aa, Staphylococcus aureus
TGTAHLFKVPTDADRLD

SEQ ID NO: 1719070 - protein, 31 aa, Staphylococcus aureus
TKPSLEFEKQFGFMLKPWTTVRFMNVIPDWF

SEQ ID NO: 1719071 - protein, 19 aa, Staphylococcus aureus
VGTPLKRCAIVNRHNGTII

SEQ ID NO: 1719072 - protein, 17 aa, Staphylococcus aureus
WTTVRFMNVIPDWFIYK

SEQ ID NO: 1719073 - protein, 21 aa, Staphylococcus aureus
YKGIVRIGSATGFVVGKNTIL

SEQ ID NO: 1719074 - protein, 22 aa, Staphylococcus aureus
YQHSKKSLGIWFVVDHNRVVEV

SEQ ID NO: 1719075 - protein, 32 aa, Staphylococcus aureus
YTKPSFEFEKQFGFMLKPWTTVRFMNVIPNRF

SEQ ID NO: 1719076 - protein, 23 aa, Staphylococcus aureus
YYQHSKKSLGIWFVVDHNRVVEV

SEQ ID NO: 1719077 - protein, 27 aa, Staphylococcus aureus
AKTGKYELGEAFKIYKFNGEEDNSYYY

SEQ ID NO: 1719078 - protein, 23 aa, Staphylococcus aureus
DNSWCAGFSMAALLNATKNTDTY

SEQ ID NO: 1719079 - protein, 19 aa, Staphylococcus aureus
EKLYKIGDYVWEDVDKDGV

SEQ ID NO: 1719080 - protein, 26 aa, Staphylococcus aureus
FSIRKFNVGIFSALIATVTFISINPT

SEQ ID NO: 1719081 - protein, 25 aa, Staphylococcus aureus
GAVFIKGGDGFDFGHVERFIQNPPH

SEQ ID NO: 1719082 - protein, 19 aa, Staphylococcus aureus
GFYKPTYNLGDYVWEDTNK

SEQ ID NO: 1719083 - protein, 23 aa, Staphylococcus aureus
GTFSTVIATLVFLGFNTSQAHAA

SEQ ID NO: 1719084 - protein, 30 aa, Staphylococcus aureus; identical to SEQ ID NO: 1586405

SEQ ID NO: 1719085 - protein, 19 aa, Staphylococcus aureus
INTASTWKKFEVYENNQKL

SEQ ID NO: 1719086 - protein, 17 aa, Staphylococcus aureus
ISVGAFFRARLGNEVLE

SEQ ID NO: 1719087 - protein, 19 aa, Staphylococcus aureus
KGRGFELTNVTGYKYGNKV

SEQ ID NO: 1719088 - protein, 19 aa, Staphylococcus aureus
KLDWNKHGFWGYWSGENHV

SEQ ID NO: 1719089 - protein, 24 aa, Staphylococcus aureus
KLNNGQEVIIIWNPWDNGFMTQDA

SEQ ID NO: 1719090 - protein, 21 aa, Staphylococcus aureus
KQAGHPVFYVYAGNQGNASVN

SEQ ID NO: 1719091 - protein, 23 aa, Staphylococcus aureus
KQAGHPVFYVYAGNQGNASVNLG

SEQ ID NO: 1719092 - protein, 19 aa, Staphylococcus aureus
KYEGWEFLGIVKGDDDSAR

SEQ ID NO: 1719093 - protein, 18 aa, Staphylococcus aureus
LKNNGNFGASFNTDDFVY

SEQ ID NO: 1719094 - protein, 18 aa, Staphylococcus aureus
LLIAFAVLFSADFIYQSV

SEQ ID NO: 1719095 - protein, 22 aa, Staphylococcus aureus
NGEIKARSSISMNNVTYTTQDE

SEQ ID NO: 1719096 - protein, 21 aa, Staphylococcus aureus
NYDYTKLVFAKPIYNDPSLVK

SEQ ID NO: 1719097 - protein, 32 aa, Staphylococcus aureus
RGIYQLRDGYKYYDFVDSIGLHSGSHVYVERR

SEQ ID NO: 1719098 - protein, 20 aa, Staphylococcus aureus
RPTDGGLSWSDDHKSLIYRY

SEQ ID NO: 1719099 - protein, 17 aa, Staphylococcus aureus
SEEGANKSGLAWPSAFK

SEQ ID NO: 1719100 - protein, 23 aa, Staphylococcus aureus
SGIPLDPSALVYLVAPTNQTTNG

SEQ ID NO: 1719101 - protein, 30 aa, Staphylococcus aureus
SNLANMNFLRWVNFPQDYTVTWTNAKIANR

SEQ ID NO: 1719102 - protein, 17 aa, Staphylococcus aureus
TEREKRVIKREHVREAQ

SEQ ID NO: 1719103 - protein, 17 aa, Staphylococcus aureus
VKHVIPEIVAHSHYTVQ

SEQ ID NO: 1719104 - protein, 23 aa, Staphylococcus aureus
VPENVSHLKIQFVPKNDAITDAR

SEQ ID NO: 1719105 - protein, 18 aa, Staphylococcus aureus
YKTPKYNLGNYVWEDTNK

SEQ ID NO: 1719106 - protein, 19 aa, Staphylococcus aureus
AELRTGPNAAYPVIYKVEK

SEQ ID NO: 1719107 - protein, 18 aa, Staphylococcus aureus
AITRKGMVSNRLNKFSIR

SEQ ID NO: 1719108 - protein, 27 aa, Staphylococcus aureus
ARTGSPIRLMIGFDYPDAFGNGETLVP

SEQ ID NO: 1719109 - protein, 21 aa, Staphylococcus aureus
DFKRKGAELANFYTGIINDLL

SEQ ID NO: 1719110 - protein, 19 aa, Staphylococcus aureus
DGYQWVIKFNKGHAPHQNM

SEQ ID NO: 1719111 - protein, 25 aa, Staphylococcus aureus
DIPLDPSALVYLVIPTSQTRDGGSE

SEQ ID NO: 1719112 - protein, 19 aa, Staphylococcus aureus
ELEQAVALIRTMPQRQQTS

SEQ ID NO: 1719113 - protein, 18 aa, Staphylococcus aureus
FNGAVFINENVRNFLKQN

SEQ ID NO: 1719114 - protein, 29 aa, Staphylococcus aureus
FNKGHAPHQNMIFWFALPADQVPVGRTDF

SEQ ID NO: 1719115 - protein, 19 aa, Staphylococcus aureus
FVYKIQLPEGVEYVNNSLT

SEQ ID NO: 1719116 - protein, 22 aa, Staphylococcus aureus
GMKQARKGVGYKAAIEVHTTLF

SEQ ID NO: 1719117 - protein, 24 aa, Staphylococcus aureus
HNAKELRAKLDIILGDAKDPVRIT

SEQ ID NO: 1719118 - protein, 25 aa, Staphylococcus aureus
HVFETARGVLYPGVSDMYDAKQYVK

SEQ ID NO: 1719119 - protein, 17 aa, Staphylococcus aureus
IDALPHLNNAQKADVKS

SEQ ID NO: 1719120 - protein, 19 aa, Staphylococcus aureus
IIQKPIRSVQEVQTALTNV

SEQ ID NO: 1719121 - protein, 23 aa, Staphylococcus aureus
ILKNRPGIHYAPPILEKNKEGQR

SEQ ID NO: 1719122 - protein, 19 aa, Staphylococcus aureus
KKNGSLAISGRVSMNQAYN

SEQ ID NO: 1719123 - protein, 17 aa, Staphylococcus aureus
KQIRAVVYYNKVVASNM

SEQ ID NO: 1719124 - protein, 19 aa, Staphylococcus aureus
LAISGRVSMNQAYNSDITF

SEQ ID NO: 1719125 - protein, 19 aa, Staphylococcus aureus
LKISQILTFNFIKDKSYDK

SEQ ID NO: 1719126 - protein, 17 aa, Staphylococcus aureus
LSEKLSFERMFDVMDSK

SEQ ID NO: 1719127 - protein, 27 aa, Staphylococcus aureus
LVGNLLPGDYFGTIRFGRKEQLFEIRV

SEQ ID NO: 1719128 - protein, 19 aa, Staphylococcus aureus
LWGAESWGNVNQLRDRYVD

SEQ ID NO: 1719129 - protein, 17 aa, Staphylococcus aureus
MCISLLIVIIFVTSCGG

SEQ ID NO: 1719130 - protein, 18 aa, Staphylococcus aureus
MKKWIPLMMKGREDNPGI

SEQ ID NO: 1719131 - protein, 18 aa, Staphylococcus aureus
NKNGSLAITGRVSMNQAF

SEQ ID NO: 1719132 - protein, 30 aa, Staphylococcus aureus; identical to SEQ ID NO: 1587500

SEQ ID NO: 1719133 - protein, 20 aa, Staphylococcus aureus
NSFVPSMHWIAADPKELNDY

SEQ ID NO: 1719134 - protein, 19 aa, Staphylococcus aureus
NSRVDFGLAQWGLKQKPNE

SEQ ID NO: 1719135 - protein, 20 aa, Staphylococcus aureus
NTNAFRPGGVNPLNEYQLSQ

SEQ ID NO: 1719136 - protein, 19 aa, Staphylococcus aureus
PWDVYAFPYYYVYNDFSDH

SEQ ID NO: 1719137 - protein, 25 aa, Staphylococcus aureus
QVFETARGVLYPGVSDMYDAKQYVK

SEQ ID NO: 1719138 - protein, 25 aa, Staphylococcus aureus
RKGMIPNRLNKFSIRKYSVGTASIL

SEQ ID NO: 1719139 - protein, 21 aa, Staphylococcus aureus
RPTDGGLSWSDDHKSLIYRYD

SEQ ID NO: 1719140 - protein, 19 aa, Staphylococcus aureus
SDIDLRLSKQAKYTVYFKN

SEQ ID NO: 1719141 - protein, 20 aa, Staphylococcus aureus
SDIDLRLSKQAKYTVYFKNG

SEQ ID NO: 1719142 - protein, 24 aa, Staphylococcus aureus
TGFYKEPKYNLGDYVWEDTNKDGI

SEQ ID NO: 1719143 - protein, 24 aa, Staphylococcus aureus
TNKDGYKYYSFIDNVGLFSGSHLY

SEQ ID NO: 1719144 - protein, 18 aa, Staphylococcus aureus
YYRGDEVNFTMGVSDRHS

SEQ ID NO: 1719145 - protein, 18 aa, Staphylococcus aureus
AGQEVYKIGNYVWEDTNK

SEQ ID NO: 1719146 - protein, 17 aa, Staphylococcus aureus
ALYMSVFLLIIFIVGCR

SEQ ID NO: 1719147 - protein, 17 aa, Staphylococcus aureus
AQLYLSPYGPKQYVEHL

SEQ ID NO: 1719148 - protein, 18 aa, Staphylococcus aureus
DAARAIDALPHLNNAQKA

SEQ ID NO: 1719149 - protein, 17 aa, Staphylococcus aureus
DGFTYKWNRDTTGTNDA

SEQ ID NO: 1719150 - protein, 17 aa, Staphylococcus aureus
DLFPKKDLVPFIPYKFV

SEQ ID NO: 1719151 - protein, 21 aa, Staphylococcus aureus
DSGKYKVIFEKPAGLTQTVTN

SEQ ID NO: 1719152 - protein, 18 aa, Staphylococcus aureus
DTEDFYITLKIIDVKQPE

SEQ ID NO: 1719153 - protein, 17 aa, Staphylococcus aureus
EALKAQVTSAGRVSAAN

SEQ ID NO: 1719154 - protein, 19 aa, Staphylococcus aureus
EINPKFKDLRAYYTKPSLE

SEQ ID NO: 1719155 - protein, 17 aa, Staphylococcus aureus
FDGVCIYGGVTMHSTAD

SEQ ID NO: 1719156 - protein, 22 aa, Staphylococcus aureus
FGDINSAYIIKVVSKYTPTSDG

SEQ ID NO: 1719157 - protein, 19 aa, Staphylococcus aureus
FGRQNFEYINGQKPAESPG

SEQ ID NO: 1719158 - protein, 20 aa, Staphylococcus aureus
FKRKGAELANFYTGIINDLL

SEQ ID NO: 1719159 - protein, 25 aa, Staphylococcus aureus
GGVPNEFNGAVFINENVRNFLKQNI

SEQ ID NO: 1719160 - protein, 24 aa, Staphylococcus aureus
ISGIPLDPSALVYLVAPTNQTTNG

SEQ ID NO: 1719161 - protein, 19 aa, Staphylococcus aureus
KDTEDFYISLKIVDVKQPE

SEQ ID NO: 1719162 - protein, 17 aa, Staphylococcus aureus
KKYYSGTGYNFQNVSGY

SEQ ID NO: 1719163 - protein, 17 aa, Staphylococcus aureus
KRFVATVLLLLVFISGC

SEQ ID NO: 1719164 - protein, 17 aa, Staphylococcus aureus
KVLILMGVPGSYLVATD

SEQ ID NO: 1719165 - protein, 20 aa, Staphylococcus aureus
KYYRGDEVSFTMGVSDRHSG

SEQ ID NO: 1719166 - protein, 19 aa, Staphylococcus aureus
LAITGRVSMNQAFNSDITF

SEQ ID NO: 1719167 - protein, 18 aa, Staphylococcus aureus
LASALVLGACGSHDGDKK

SEQ ID NO: 1719168 - protein, 17 aa, Staphylococcus aureus
LFLLAMYELGKYVTEKV

SEQ ID NO: 1719169 - protein, 18 aa, Staphylococcus aureus
LGKLRAGLDLLKKPTQMQ

SEQ ID NO: 1719170 - protein, 17 aa, Staphylococcus aureus
LLFLLAMYELGKYVTEQ

SEQ ID NO: 1719171 - protein, 18 aa, Staphylococcus aureus
LLFLLAMYELGKYVTEQV

SEQ ID NO: 1719172 - protein, 17 aa, Staphylococcus aureus
LNAKYYRGDEVSFTMGV

SEQ ID NO: 1719173 - protein, 17 aa, Staphylococcus aureus
LNKFSIRKYTVGTASIL

SEQ ID NO: 1719174 - protein, 19 aa, Staphylococcus aureus
LNLRAKIDLILGDEKDPIR

SEQ ID NO: 1719175 - protein, 17 aa, Staphylococcus aureus
LRLLFLLAMYELGKYVT

SEQ ID NO: 1719176 - protein, 22 aa, Staphylococcus aureus
MDEFKIDWNRHGFWGYWSGENH

SEQ ID NO: 1719177 - protein, 19 aa, Staphylococcus aureus
MVSNRLNKFSIRKYTVGTA

SEQ ID NO: 1719178 - protein, 19 aa, Staphylococcus aureus
NKNGSLAITGRVSMNQAFN

SEQ ID NO: 1719179 - protein, 20 aa, Staphylococcus aureus
NKSGLAWPSAFKVQLQLPDN

SEQ ID NO: 1719180 - protein, 22 aa, Staphylococcus aureus
NLKGWHTGAGMSYLYNSDVKHY

SEQ ID NO: 1719181 - protein, 17 aa, Staphylococcus aureus
NSGGFKIDTGYIYTSSM

SEQ ID NO: 1719182 - protein, 17 aa, Staphylococcus aureus
PDIILRLPHGMPEEVKK

SEQ ID NO: 1719183 - protein, 22 aa, Staphylococcus aureus
QARGNVAALGRVNANDSTDHGN

SEQ ID NO: 1719184 - protein, 27 aa, Staphylococcus aureus
QRVTLKYKWKFGEGIKAGDYFDFTLSD

SEQ ID NO: 1719185 - protein, 17 aa, Staphylococcus aureus
RLPHGMPEEVKKMFQKE

SEQ ID NO: 1719186 - protein, 24 aa, Staphylococcus aureus
RQHLTDKGAYVWKNLKDYYIGLLG

SEQ ID NO: 1719187 - protein, 19 aa, Staphylococcus aureus
RWGLNQGINANGWMRTDLK

SEQ ID NO: 1719188 - protein, 19 aa, Staphylococcus aureus
RYSKGGKHYLIFDKHQKFT

SEQ ID NO: 1719189 - protein, 28 aa, Staphylococcus aureus
SIATVLLLLGGLVFAIFAYVDHSNKAKE

SEQ ID NO: 1719190 - protein, 22 aa, Staphylococcus aureus
TGDGYQWVIKFNKGHAPHENMI

SEQ ID NO: 1719191 - protein, 17 aa, Staphylococcus aureus
TYKVVRTVPKHVFETAR

SEQ ID NO: 1719192 - protein, 19 aa, Staphylococcus aureus
VELYYYIKGGRVDYGAAHA

SEQ ID NO: 1719193 - protein, 19 aa, Staphylococcus aureus
VFETARGVLYPGVSDMYDA

SEQ ID NO: 1719194 - protein, 24 aa, Staphylococcus aureus
VFETARGVLYPGVSDMYDAKQYVK

SEQ ID NO: 1719195 - protein, 24 aa, Staphylococcus aureus
VGTFSTVIATLVFLGLNTSQAQAA

SEQ ID NO: 1719196 - protein, 20 aa, Staphylococcus aureus
VGVLSHAMVRTSMFEAGSNR

SEQ ID NO: 1719197 - protein, 19 aa, Staphylococcus aureus
VNGGWRYNYGNQFYVQLVS

SEQ ID NO: 1719198 - protein, 18 aa, Staphylococcus aureus
VVINARLTTHIDLIRGGN

SEQ ID NO: 1719199 - protein, 17 aa, Staphylococcus aureus
WFISVIILGIFIIGCDS

SEQ ID NO: 1719200 - protein, 18 aa, Staphylococcus aureus
YLPRFVFGHYMKSYLSMF

SEQ ID NO: 1719201 - protein, 17 aa, Staphylococcus aureus
YPSEYHVDFQVKRNPKT

SEQ ID NO: 1719202 - protein, 26 aa, Staphylococcus aureus
AARTRNPIRLMIGFDYPDAYGNSETL

SEQ ID NO: 1719203 - protein, 18 aa, Staphylococcus aureus
AMTRKGMVSNRLNKFSIR

SEQ ID NO: 1719204 - protein, 19 aa, Staphylococcus aureus
AQAEAGGRPNYRTTGYSQS

SEQ ID NO: 1719205 - protein, 19 aa, Staphylococcus aureus
DAARAIDALPHLNNAQKAD

SEQ ID NO: 1719206 - protein, 20 aa, Staphylococcus aureus
DALMPYNFISSVFKNNDGQP

SEQ ID NO: 1719207 - protein, 21 aa, Staphylococcus aureus
DNALWKNVRDALKDANIIDKT

SEQ ID NO: 1719208 - protein, 27 aa, Staphylococcus aureus
DSGFYKTPKYSLGDYVWYDSNKDGKQD

SEQ ID NO: 1719209 - protein, 17 aa, Staphylococcus aureus
EALKAQVTSAGRVSVAN

SEQ ID NO: 1719210 - protein, 22 aa, Staphylococcus aureus
EDIKARLTLYSYIDKQAVPNET

SEQ ID NO: 1719211 - protein, 17 aa, Staphylococcus aureus
EEFKFFVQYGNFKELEN

SEQ ID NO: 1719212 - protein, 20 aa, Staphylococcus aureus
EKSRCIPINLWVNGNLKTIS

SEQ ID NO: 1719213 - protein, 19 aa, Staphylococcus aureus
EVMPALAYFTFSPKNYEDK

SEQ ID NO: 1719214 - protein, 18 aa, Staphylococcus aureus
FFTNHSWYNDLLVDFDSK

SEQ ID NO: 1719215 - protein, 19 aa, Staphylococcus aureus
FGRKEQLFEIRVKPHTPTI

SEQ ID NO: 1719216 - protein, 18 aa, Staphylococcus aureus
FGRQTFEYINGERPTESP

SEQ ID NO: 1719217 - protein, 25 aa, Staphylococcus aureus
FSIRKFNVGIFSALIATVTFISTNP

SEQ ID NO: 1719218 - protein, 19 aa, Staphylococcus aureus
FVNSELRRSDMFDKNNPQN

SEQ ID NO: 1719219 - protein, 31 aa, Staphylococcus aureus; identical to SEQ ID NO: 1587793

SEQ ID NO: 1719220 - protein, 17 aa, Staphylococcus aureus
GDYRVEFSNLPKGYEVT

SEQ ID NO: 1719221 - protein, 25 aa, Staphylococcus aureus
GHAPHENMIYWFALPAGQTPVGRTE

SEQ ID NO: 1719222 - protein, 27 aa, Staphylococcus aureus
GIYQLKDGYKYYSFVDSIGLHSGSHVY

SEQ ID NO: 1719223 - protein, 33 aa, Staphylococcus aureus
GKAKINAVKTFSEYKKDALAKIADAYNAKVNEA

SEQ ID NO: 1719224 - protein, 17 aa, Staphylococcus aureus
GVLYPGVSDMYDAKQYV

SEQ ID NO: 1719225 - protein, 18 aa, Staphylococcus aureus
GVPNQFNGAVFINENVRN

SEQ ID NO: 1719226 - protein, 18 aa, Staphylococcus aureus
IDALPHLNNAQKADVKSK

SEQ ID NO: 1719227 - protein, 18 aa, Staphylococcus aureus
IIQKPIRTVQEVQSALTN

SEQ ID NO: 1719228 - protein, 20 aa, Staphylococcus aureus
IKGGDGFDFGHVERFIQNPP

SEQ ID NO: 1719229 - protein, 21 aa, Staphylococcus aureus
IKQRALNRMAVNTVAAPQQGT

SEQ ID NO: 1719230 - protein, 19 aa, Staphylococcus aureus
IKYSDTVQVYGLNPEDIKN

SEQ ID NO: 1719231 - protein, 22 aa, Staphylococcus aureus
INANRDAISFAEGDISVTNTPN

SEQ ID NO: 1719232 - protein, 18 aa, Staphylococcus aureus
INTASTWKKFEVYENNQK

SEQ ID NO: 1719233 - protein, 25 aa, Staphylococcus aureus
IRKHKLGAASVFLGTMIVVGMGQEK

SEQ ID NO: 1719234 - protein, 29 aa, Staphylococcus aureus
KEGKAKINAVKTFSEYKKDALAKIEDAYN

SEQ ID NO: 1719235 - protein, 17 aa, Staphylococcus aureus
KFLDFDLLFKNFTWLDG

SEQ ID NO: 1719236 - protein, 17 aa, Staphylococcus aureus
KGDTMTINYDKNVIPSD

SEQ ID NO: 1719237 - protein, 26 aa, Staphylococcus aureus
KGHAPHENMIYWFALPAGQTPVGRTE

SEQ ID NO: 1719238 - protein, 17 aa, Staphylococcus aureus
KIDRPSIGIGLINLKDI

SEQ ID NO: 1719239 - protein, 26 aa, Staphylococcus aureus
KIRNRSGQVIYDWPTVHIYSLEDLSR

SEQ ID NO: 1719240 - protein, 17 aa, Staphylococcus aureus
KKDLVPFIPYKFVNIYG

SEQ ID NO: 1719241 - protein, 33 aa, Staphylococcus aureus
KPSLEFKNEIGIILKKWTTIRFMNIVPDYFIYK

SEQ ID NO: 1719242 - protein, 18 aa, Staphylococcus aureus
KVEAALQFLEKNTKGSVL

SEQ ID NO: 1719243 - protein, 23 aa, Staphylococcus aureus
KVGVFSHAMVRTSMFDSGDAKNY

SEQ ID NO: 1719244 - protein, 17 aa, Staphylococcus aureus
KVRKARSVDEGSFDITR

SEQ ID NO: 1719245 - protein, 17 aa, Staphylococcus aureus
LCASIIVSGCSFIPKNQ

SEQ ID NO: 1719246 - protein, 29 aa, Staphylococcus aureus
LENRGWDFDGSYGWQCFDLVNVYWNHLYG

SEQ ID NO: 1719247 - protein, 22 aa, Staphylococcus aureus
LKGWHTGAGMSYLYNSDVKHYR

SEQ ID NO: 1719248 - protein, 22 aa, Staphylococcus aureus
LPEIQHNIKFFKNDDGQNIADK

SEQ ID NO: 1719249 - protein, 18 aa, Staphylococcus aureus
LQEDATWKKLNAVKNNRV

SEQ ID NO: 1719250 - protein, 17 aa, Staphylococcus aureus
LSGKWLWQKPNGTIHAT

SEQ ID NO: 1719251 - protein, 19 aa, Staphylococcus aureus
LSITGRVSMNQAFNSDITF

SEQ ID NO: 1719252 - protein, 18 aa, Staphylococcus aureus
MISNRLNKFSIRKYTVGT

SEQ ID NO: 1719253 - protein, 17 aa, Staphylococcus aureus
MKGRIIGREGRNIRTLE

SEQ ID NO: 1719254 - protein, 18 aa, Staphylococcus aureus
MLGISFLFLVISITAGCG

SEQ ID NO: 1719255 - protein, 17 aa, Staphylococcus aureus
MNVVPDYFIYKIALVGK

SEQ ID NO: 1719256 - protein, 20 aa, Staphylococcus aureus
NAMKGLRYSIANETTVKASQ

SEQ ID NO: 1719257 - protein, 21 aa, Staphylococcus aureus
NDLKKRAQTILAENRNNVPLN

SEQ ID NO: 1719258 - protein, 27 aa, Staphylococcus aureus
NRKGMIPNRLNKFSIRKYSVGTASILV

SEQ ID NO: 1719259 - protein, 17 aa, Staphylococcus aureus
NSFVPSMHWIAANPKDL

SEQ ID NO: 1719260 - protein, 18 aa, Staphylococcus aureus
NSRVDFGLAQWGLKQKPN

SEQ ID NO: 1719261 - protein, 21 aa, Staphylococcus aureus
NTNAFRPGGVQELNEYQLSQL

SEQ ID NO: 1719262 - protein, 24 aa, Staphylococcus aureus
NTNAFRPGGVQELNEYQLSQLFTD

SEQ ID NO: 1719263 - protein, 17 aa, Staphylococcus aureus
NVSHLKIQFSPKNDAIT

SEQ ID NO: 1719264 - protein, 20 aa, Staphylococcus aureus
PDKSLKLSYKVNVANIDTPK

SEQ ID NO: 1719265 - protein, 20 aa, Staphylococcus aureus
PEIQHNIKFFKNDDGQNIAD

SEQ ID NO: 1719266 - protein, 21 aa, Staphylococcus aureus
PTDGFTYKWNRDTTGTNDANW

SEQ ID NO: 1719267 - protein, 18 aa, Staphylococcus aureus
QRALNRMAVNTVAAPQQG

SEQ ID NO: 1719268 - protein, 21 aa, Staphylococcus aureus
REIEPVISRKASAREQLTTLF

SEQ ID NO: 1719269 - protein, 18 aa, Staphylococcus aureus
RKQLKIEPGHFSYHEMSP

SEQ ID NO: 1719270 - protein, 19 aa, Staphylococcus aureus
RLWLYLVLLAVFIGACGMK

SEQ ID NO: 1719271 - protein, 19 aa, Staphylococcus aureus
RPTEIKVELYQDGKATGKT

SEQ ID NO: 1719272 - protein, 18 aa, Staphylococcus aureus
SMLPKVEAALQFLEKNTK

SEQ ID NO: 1719273 - protein, 33 aa, Staphylococcus aureus
SNLANMNFLRWVNFPQDYTVTWTNAKIANRPTD

SEQ ID NO: 1719274 - protein, 24 aa, Staphylococcus aureus
TDVDLRLSKQAKFTVNFKNGTKKV

SEQ ID NO: 1719275 - protein, 19 aa, Staphylococcus aureus
TILFKGFFTNHSWYNDLLV

SEQ ID NO: 1719276 - protein, 25 aa, Staphylococcus aureus
TKPSLEFEKQFGFMLKPWTTVRFMN

SEQ ID NO: 1719277 - protein, 23 aa, Staphylococcus aureus
TKTATYKVVRTVPKHVFETARGV

SEQ ID NO: 1719278 - protein, 21 aa, Staphylococcus aureus
TKTATYKVVRTVPKQVFETAR

SEQ ID NO: 1719279 - protein, 17 aa, Staphylococcus aureus
TVIATLVFLGLNTSQAQ

SEQ ID NO: 1719280 - protein, 19 aa, Staphylococcus aureus
TVPKHVFETARGVLYPGVS

SEQ ID NO: 1719281 - protein, 17 aa, Staphylococcus aureus
TVSLFFFTFLIKNNLAY

SEQ ID NO: 1719282 - protein, 23 aa, Staphylococcus aureus
VFIKGGDGFDFGHVERFIQNPPH

SEQ ID NO: 1719283 - protein, 24 aa, Staphylococcus aureus
VFNEKNEVIGIHWGGVPNEFNGAV

SEQ ID NO: 1719284 - protein, 19 aa, Staphylococcus aureus
VGKQIRAVVYYNKVVASNM

SEQ ID NO: 1719285 - protein, 25 aa, Staphylococcus aureus
VGTFSTVIATLVFLGFNTSQAHAAE

SEQ ID NO: 1719286 - protein, 17 aa, Staphylococcus aureus
VNSELRRSDMFDKNNPQ

SEQ ID NO: 1719287 - protein, 18 aa, Staphylococcus aureus
VPKGYTLNKGYDVNTKEL

SEQ ID NO: 1719288 - protein, 17 aa, Staphylococcus aureus
VPKHVFETARGVLYPGV

SEQ ID NO: 1719289 - protein, 22 aa, Staphylococcus aureus
VPVKRVIPEIVAHSHYTVQGQD

SEQ ID NO: 1719290 - protein, 19 aa, Staphylococcus aureus
YATLFPRTGIYAERKHNAF

SEQ ID NO: 1719291 - protein, 20 aa, Staphylococcus aureus
YDYKYFYSYKVVKGVKKYFS

SEQ ID NO: 1719292 - protein, 20 aa, Staphylococcus aureus
YDYTKLVFAKPIYNDPSLVK

SEQ ID NO: 1719293 - protein, 32 aa, Staphylococcus aureus; identical to SEQ ID NO: 1587610

SEQ ID NO: 1719294 - protein, 22 aa, Staphylococcus aureus
YKTPKYSLGDYVWYDSNKDGKQ

SEQ ID NO: 1719295 - protein, 17 aa, Staphylococcus aureus
YKVGIFSTLIGTVLLLS

SEQ ID NO: 1719296 - protein, 18 aa, Staphylococcus aureus
YPGLKINSYRVFGSESAE

SEQ ID NO: 1719297 - protein, 20 aa, Staphylococcus aureus
YSIRKYKVGIFSTLIGTVLL

SEQ ID NO: 1719298 - protein, 18 aa, Staphylococcus aureus
YYRGDEVSFTMGVSDRHS

SEQ ID NO: 1719299 - protein, 17 aa, Staphylococcus aureus
AAALEEFDEVVQAQIDQ

SEQ ID NO: 1719300 - protein, 19 aa, Staphylococcus aureus
AGQEVYKIGNYVWEDTNKN

SEQ ID NO: 1719301 - protein, 23 aa, Staphylococcus aureus
AHIRLWGAESWGNINQLRDRYVD

SEQ ID NO: 1719302 - protein, 17 aa, Staphylococcus aureus
ANDAWKKLVDKLKEKHI

SEQ ID NO: 1719303 - protein, 27 aa, Staphylococcus aureus
ANKPLPEMWPYGVNDSRSWDYKIRNRS

SEQ ID NO: 1719304 - protein, 34 aa, Staphylococcus aureus; identical to SEQ ID NO: 1586455

SEQ ID NO: 1719305 - protein, 24 aa, Staphylococcus aureus
AVFIKGGDGFDFGHVERFIQNPPH

SEQ ID NO: 1719306 - protein, 17 aa, Staphylococcus aureus
AVKQDLTEVQALDQLMD

SEQ ID NO: 1719307 - protein, 17 aa, Staphylococcus aureus
CKPDFWKTLKYKKDKIT

SEQ ID NO: 1719308 - protein, 18 aa, Staphylococcus aureus
DAYKEVKQAATARKAQNA

SEQ ID NO: 1719309 - protein, 17 aa, Staphylococcus aureus
DGFTYKWNNAATGTNDA

SEQ ID NO: 1719310 - protein, 18 aa, Staphylococcus aureus
DGKFSHFAYVKPNNQSLS

SEQ ID NO: 1719311 - protein, 17 aa, Staphylococcus aureus
DGLNAINPIAPVTVVKQ

SEQ ID NO: 1719312 - protein, 22 aa, Staphylococcus aureus
DSLTDGQLWLGVKNPLIDAQII

SEQ ID NO: 1719313 - protein, 17 aa, Staphylococcus aureus
DTEDFYITLKIIDVKQP

SEQ ID NO: 1719314 - protein, 17 aa, Staphylococcus aureus
DTIKVAWPTSGTVKIEG

SEQ ID NO: 1719315 - protein, 18 aa, Staphylococcus aureus
DVDLRLSKQAKYTVVFKN

SEQ ID NO: 1719316 - protein, 19 aa, Staphylococcus aureus
EEFFRAVVINARLTTHIDL

SEQ ID NO: 1719317 - protein, 18 aa, Staphylococcus aureus
EFFRAVVINARLTTHIDL

SEQ ID NO: 1719318 - protein, 29 aa, Staphylococcus aureus
EGDTFTFKYGQYFRPGSVRLPSQTQNLYN

SEQ ID NO: 1719319 - protein, 18 aa, Staphylococcus aureus
EISEQFGFVNIGVKNYEA

SEQ ID NO: 1719320 - protein, 18 aa, Staphylococcus aureus
EKLTYRTASDVVINNAQP

SEQ ID NO: 1719321 - protein, 18 aa, Staphylococcus aureus
EPVINRKASAREKLTTLV

SEQ ID NO: 1719322 - protein, 18 aa, Staphylococcus aureus
ERELRYAKKATYTVHFKN

SEQ ID NO: 1719323 - protein, 19 aa, Staphylococcus aureus
ETKIKPAAREKINQKANEL

SEQ ID NO: 1719324 - protein, 17 aa, Staphylococcus aureus
EVKGERPTIHFLGQASY

SEQ ID NO: 1719325 - protein, 17 aa, Staphylococcus aureus
FEYKKVTGYGFIEGKDR

SEQ ID NO: 1719326 - protein, 19 aa, Staphylococcus aureus
FGRKEQLFEIRVKPHTPRI

SEQ ID NO: 1719327 - protein, 17 aa, Staphylococcus aureus
FILLSFIALTLITSPFV

SEQ ID NO: 1719328 - protein, 18 aa, Staphylococcus aureus
FKSATGFVVGKNTILTNK

SEQ ID NO: 1719329 - protein, 22 aa, Staphylococcus aureus
FTIKYSDTVQVYGLNPEDIKNI

SEQ ID NO: 1719330 - protein, 18 aa, Staphylococcus aureus
FVPSMHWIAADPKELNDY

SEQ ID NO: 1719331 - protein, 20 aa, Staphylococcus aureus
GDGYQWVIKFNKGHAPHQNM

SEQ ID NO: 1719332 - protein, 21 aa, Staphylococcus aureus
GDGYQWVIKFNKGHAPHQNMI

SEQ ID NO: 1719333 - protein, 20 aa, Staphylococcus aureus
GFMLKPWTTVRFMNVIPNRF

SEQ ID NO: 1719334 - protein, 23 aa, Staphylococcus aureus
GGTPFKTACMYGGVTLHDNNQLE

SEQ ID NO: 1719335 - protein, 19 aa, Staphylococcus aureus
GGVPNQFNGAVFINENVRN

SEQ ID NO: 1719336 - protein, 24 aa, Staphylococcus aureus
GIATLKGVEPHIVVKPEAQQPIKA

SEQ ID NO: 1719337 - protein, 30 aa, Staphylococcus aureus
GIYQLRDGYKYYDFVDSIGLHSGSHLYVER

SEQ ID NO: 1719338 - protein, 30 aa, Staphylococcus aureus
GIYQLRDGYKYYDFVDSIGLHSGSHVYVER

SEQ ID NO: 1719339 - protein, 18 aa, Staphylococcus aureus
GKQIRAVVYYNKVVASNM

SEQ ID NO: 1719340 - protein, 19 aa, Staphylococcus aureus
GKTRYQGIWKHIDDKGYFE

SEQ ID NO: 1719341 - protein, 17 aa, Staphylococcus aureus
GNQIRALIFYNNVVASN

SEQ ID NO: 1719342 - protein, 22 aa, Staphylococcus aureus
GPKGRFGGLVYDTLGFNAVDKK

SEQ ID NO: 1719343 - protein, 17 aa, Staphylococcus aureus
GQEVYKIGNYVWEDTNK

SEQ ID NO: 1719344 - protein, 23 aa, Staphylococcus aureus
HAPHENMIYWFALPAGQTPVGRT

SEQ ID NO: 1719345 - protein, 17 aa, Staphylococcus aureus
HMNFQFVGTYGPNKDVV

SEQ ID NO: 1719346 - protein, 18 aa, Staphylococcus aureus
IDEGFMPLIYKGEMMDLS

SEQ ID NO: 1719347 - protein, 18 aa, Staphylococcus aureus
IDWNKHGFWGYWSGENHV

SEQ ID NO: 1719348 - protein, 36 aa, Staphylococcus aureus
IELVGNLLPGDYFGTIRFGRKEQLFEIRVKPHTPRI

SEQ ID NO: 1719349 - protein, 37 aa, Staphylococcus aureus
IELVGNLLPGDYFGTIRFGRKEQLFEIRVKPHTPRIT

SEQ ID NO: 1719350 - protein, 17 aa, Staphylococcus aureus
IKISLKDGSFYNLDLRT

SEQ ID NO: 1719351 - protein, 18 aa, Staphylococcus aureus
IKIYRVPEGYTLNKGYDV

SEQ ID NO: 1719352 - protein, 24 aa, Staphylococcus aureus
IKQILRLLFLLAMYELGKYVTEQV

SEQ ID NO: 1719353 - protein, 17 aa, Staphylococcus aureus
ILDLRYKLRVNNVPTPR

SEQ ID NO: 1719354 - protein, 22 aa, Staphylococcus aureus
ILKNRPGIHYAPSILEKNKDGQ

SEQ ID NO: 1719355 - protein, 22 aa, Staphylococcus aureus
IPLDPSALVYLVIPTSQTRDGG

SEQ ID NO: 1719356 - protein, 25 aa, Staphylococcus aureus
IRKHKLGAASVFLGTMIVVGMGQDK

SEQ ID NO: 1719357 - protein, 18 aa, Staphylococcus aureus
IRPQDYVVFIPPVGKQIR

SEQ ID NO: 1719358 - protein, 17 aa, Staphylococcus aureus
ISDTYYWGVIKNLESQF

SEQ ID NO: 1719359 - protein, 25 aa, Staphylococcus aureus
ISGIPLDPSALVYLVAPTNQTTNGG

SEQ ID NO: 1719360 - protein, 22 aa, Staphylococcus aureus
ITIRPEDYVVFIPPVGNQIRAL

SEQ ID NO: 1719361 - protein, 19 aa, Staphylococcus aureus
ITSSQRWGLNQGINANGWM

SEQ ID NO: 1719362 - protein, 20 aa, Staphylococcus aureus
ITSSQRWGLNQGINANGWMR

SEQ ID NO: 1719363 - protein, 17 aa, Staphylococcus aureus
IVQGPGFLTMEQSGPSL

SEQ ID NO: 1719364 - protein, 20 aa, Staphylococcus aureus
IYKREYKHFYTPEEAQRAQE

SEQ ID NO: 1719365 - protein, 30 aa, Staphylococcus aureus
IYQLRDGYKYYDFVDSIGLHSGSHVYVERR

SEQ ID NO: 1719366 - protein, 23 aa, Staphylococcus aureus
KADLNMFFLFVITGNLIGKATEK

SEQ ID NO: 1719367 - protein, 19 aa, Staphylococcus aureus
KARTGWLIVDYAGYPWPGY

SEQ ID NO: 1719368 - protein, 21 aa, Staphylococcus aureus
KDLDFAFGLSMTSKNIARYEN

SEQ ID NO: 1719369 - protein, 21 aa, Staphylococcus aureus
KDLRAKLDLILGDKENPYKIT

SEQ ID NO: 1719370 - protein, 35 aa, Staphylococcus aureus; identical to SEQ ID NO: 1676123

SEQ ID NO: 1719371 - protein, 18 aa, Staphylococcus aureus
KGDTMTINYDKNVIPSDL

SEQ ID NO: 1719372 - protein, 18 aa, Staphylococcus aureus
KGGDGFDFGHVERFIQNP

SEQ ID NO: 1719373 - protein, 24 aa, Staphylococcus aureus
KGMIPNRLNKFSIRKYSVGTASIL

SEQ ID NO: 1719374 - protein, 26 aa, Staphylococcus aureus
KIRNRSGQVIYDWPTVHINSLKDLAH

SEQ ID NO: 1719375 - protein, 31 aa, Staphylococcus aureus
KIRNRSGQVIYDWPTVHINSLKDLARASDYF

SEQ ID NO: 1719376 - protein, 17 aa, Staphylococcus aureus
KKKIDEYEVYKKMYKKF

SEQ ID NO: 1719377 - protein, 25 aa, Staphylococcus aureus
KLDNGQEVIIIWNPWDNGFMTQDAK

SEQ ID NO: 1719378 - protein, 23 aa, Staphylococcus aureus
KLDNGQEVIIIWNSWDNGFMTQD

SEQ ID NO: 1719379 - protein, 19 aa, Staphylococcus aureus
KMCLCLIILSVFIGACGMK

SEQ ID NO: 1719380 - protein, 18 aa, Staphylococcus aureus
KMKDRISVIGYPKGAQTK

SEQ ID NO: 1719381 - protein, 19 aa, Staphylococcus aureus
KRDAYTNAVSRAEAILNKT

SEQ ID NO: 1719382 - protein, 20 aa, Staphylococcus aureus
KRLNTRMRMAAVQPSSTDSK

SEQ ID NO: 1719383 - protein, 20 aa, Staphylococcus aureus
KSLNTRMRMAAIQPNSTDSK

SEQ ID NO: 1719384 - protein, 18 aa, Staphylococcus aureus
KYPSEYHVDFQVKRNRKT

SEQ ID NO: 1719385 - protein, 18 aa, Staphylococcus aureus
KYTYGYKTGGDFSINQGG

SEQ ID NO: 1719386 - protein, 20 aa, Staphylococcus aureus
LALSSFIILSACGQNTEDNH

SEQ ID NO: 1719387 - protein, 19 aa, Staphylococcus aureus
LCISLLILIIFVTSCDVDN

SEQ ID NO: 1719388 - protein, 21 aa, Staphylococcus aureus
LEKSRCIPINLWVNGNHKTIS

SEQ ID NO: 1719389 - protein, 17 aa, Staphylococcus aureus
LKDYETWHTYMLAQETF

SEQ ID NO: 1719390 - protein, 18 aa, Staphylococcus aureus
LKENLNWIWNSLSIEDQH

SEQ ID NO: 1719391 - protein, 18 aa, Staphylococcus aureus
LNKYPVVFVHGFLGLVGD

SEQ ID NO: 1719392 - protein, 21 aa, Staphylococcus aureus
LPEIQHNIKFFKNDDTQNIAE

SEQ ID NO: 1719393 - protein, 17 aa, Staphylococcus aureus
LPLKEFALITGAALLAR

SEQ ID NO: 1719394 - protein, 18 aa, Staphylococcus aureus
LPSMVALTLVGSAVTAHQ

SEQ ID NO: 1719395 - protein, 22 aa, Staphylococcus aureus
LPTDGFTYKWNRDTTGTNDANW

SEQ ID NO: 1719396 - protein, 19 aa, Staphylococcus aureus
LRLSKQAKYTVHFKNGAKR

SEQ ID NO: 1719397 - protein, 20 aa, Staphylococcus aureus
LRLSKQAKYTVVFKNGTKKV

SEQ ID NO: 1719398 - protein, 17 aa, Staphylococcus aureus
LWLYLVLLAVFIGACGM

SEQ ID NO: 1719399 - protein, 23 aa, Staphylococcus aureus
MISNRLNKFSIRKYTVGTASILV

SEQ ID NO: 1719400 - protein, 19 aa, Staphylococcus aureus
MRTTDKYGYYNYAGYSNFI

SEQ ID NO: 1719401 - protein, 23 aa, Staphylococcus aureus
MSVMILLAGCGKSEEKATLEKDI

SEQ ID NO: 1719402 - protein, 18 aa, Staphylococcus aureus
MVSNRLNKFSIRKYTVGT

SEQ ID NO: 1719403 - protein, 21 aa, Staphylococcus aureus
NAIIQKPIRTVQEVQSALTNV

SEQ ID NO: 1719404 - protein, 18 aa, Staphylococcus aureus
NGDYRVEFSNLPKGYEVT

SEQ ID NO: 1719405 - protein, 20 aa, Staphylococcus aureus
NGEIKARSSISMNNVTYTTQ

SEQ ID NO: 1719406 - protein, 17 aa, Staphylococcus aureus
NINKGRLTKSFASNLAN

SEQ ID NO: 1719407 - protein, 26 aa, Staphylococcus aureus
NMNFLRWVNFPQDYTVTWTNAKIANR

SEQ ID NO: 1719408 - protein, 18 aa, Staphylococcus aureus
NPDRRVAQQNAFYNVLKN

SEQ ID NO: 1719409 - protein, 21 aa, Staphylococcus aureus
NRVNDRLTLAINQLVPLADNS

SEQ ID NO: 1719410 - protein, 19 aa, Staphylococcus aureus
NSLTEKLKGLGLLQNGQKV

SEQ ID NO: 1719411 - protein, 20 aa, Staphylococcus aureus
PEIQHNIKFFKNDDTQNIAE

SEQ ID NO: 1719412 - protein, 25 aa, Staphylococcus aureus
PEQKFKKLSNIVGNYWQKEQGYDNK

SEQ ID NO: 1719413 - protein, 17 aa, Staphylococcus aureus
PKHGFSINELFFIQKEE

SEQ ID NO: 1719414 - protein, 21 aa, Staphylococcus aureus
PKRLNTRMRIAAVQPSSTEAK

SEQ ID NO: 1719415 - protein, 19 aa, Staphylococcus aureus
PVVAVLVGFIAKQGLKKAI

SEQ ID NO: 1719416 - protein, 19 aa, Staphylococcus aureus
QALDHAMELLRNSIADNQA

SEQ ID NO: 1719417 - protein, 17 aa, Staphylococcus aureus
QDYVVFIPPVGKQIRAV

SEQ ID NO: 1719418 - protein, 19 aa, Staphylococcus aureus
QGNVIALGRIRGNDTNDHG

SEQ ID NO: 1719419 - protein, 20 aa, Staphylococcus aureus
RKSVFLMLNIKKGIFKTHPN

SEQ ID NO: 1719420 - protein, 18 aa, Staphylococcus aureus
RNDEFLFYRTTRLSTVEN

SEQ ID NO: 1719421 - protein, 17 aa, Staphylococcus aureus
RNGVKMIVEQVAHKVSQ

SEQ ID NO: 1719422 - protein, 18 aa, Staphylococcus aureus
RPEKVSVNLLANGEKVET

SEQ ID NO: 1719423 - protein, 19 aa, Staphylococcus aureus
RYTNQWNRLHWIGNNYKNQ

SEQ ID NO: 1719424 - protein, 19 aa, Staphylococcus aureus
RYTNYWNRLHWIGNNHKNQ

SEQ ID NO: 1719425 - protein, 24 aa, Staphylococcus aureus
SAHISLWGAESWGNINQLKGRYVD

SEQ ID NO: 1719426 - protein, 24 aa, Staphylococcus aureus
SDIDLRLSKQAKYTVHFKNGTKRV

SEQ ID NO: 1719427 - protein, 19 aa, Staphylococcus aureus
SGKYKVIFEKPTGLTQTGT

SEQ ID NO: 1719428 - protein, 17 aa, Staphylococcus aureus
SSLFVATLTTATLVSSP

SEQ ID NO: 1719429 - protein, 19 aa, Staphylococcus aureus
SSLSCALLLLSAANTEANS

SEQ ID NO: 1719430 - protein, 19 aa, Staphylococcus aureus
SVWLVLLFSVMGLWQVSNA

SEQ ID NO: 1719431 - protein, 17 aa, Staphylococcus aureus
TAGQCTWYVYDKVGGEI

SEQ ID NO: 1719432 - protein, 24 aa, Staphylococcus aureus
TFLFVCSLIVCRFFAYKIYFPTDA

SEQ ID NO: 1719433 - protein, 23 aa, Staphylococcus aureus
TGDGYQWVIKFNKGHAPHENMIY

SEQ ID NO: 1719434 - protein, 23 aa, Staphylococcus aureus
TGDGYQWVIKFNKGHAPHQNMIF

SEQ ID NO: 1719435 - protein, 21 aa, Staphylococcus aureus
TIKYSDTVQVYGLNPEDIKNI

SEQ ID NO: 1719436 - protein, 21 aa, Staphylococcus aureus
TIRPEDYVVFIPPVGNQIRAL

SEQ ID NO: 1719437 - protein, 17 aa, Staphylococcus aureus
TNAFRPGGVNPLNEYQL

SEQ ID NO: 1719438 - protein, 26 aa, Staphylococcus aureus
TNIFPYTGVVAFKSATGFVVGKNTIL

SEQ ID NO: 1719439 - protein, 29 aa, Staphylococcus aureus
TNVFPYHGVVAFKDATGFVIGKNTIITNK

SEQ ID NO: 1719440 - protein, 27 aa, Staphylococcus aureus
TVGTFSTVIATLVFLGFNTSQAHAAET

SEQ ID NO: 1719441 - protein, 18 aa, Staphylococcus aureus
TVPKHVFETARGVLYPGV

SEQ ID NO: 1719442 - protein, 17 aa, Staphylococcus aureus
VDNLPGFTLINGGKVGV

SEQ ID NO: 1719443 - protein, 17 aa, Staphylococcus aureus
VESNGIATLKGVEPHIV

SEQ ID NO: 1719444 - protein, 23 aa, Staphylococcus aureus
VFNEKNEVIGIHWGGVPNQFNGA

SEQ ID NO: 1719445 - protein, 17 aa, Staphylococcus aureus
VFYVYAGNQGNASVNLG

SEQ ID NO: 1719446 - protein, 24 aa, Staphylococcus aureus
VGTFSTVIATLVFLGFNTSQAHAA

SEQ ID NO: 1719447 - protein, 26 aa, Staphylococcus aureus
VIGEKVVAYGPIWRLLKVPENVSHLK

SEQ ID NO: 1719448 - protein, 18 aa, Staphylococcus aureus
VIVSTLFLITSQHQAQAA

SEQ ID NO: 1719449 - protein, 23 aa, Staphylococcus aureus
VKAMRWPFQYNIGLKTNDPNISL

SEQ ID NO: 1719450 - protein, 19 aa, Staphylococcus aureus
VKHVIPEIVAHSHYTVQGQ

SEQ ID NO: 1719451 - protein, 19 aa, Staphylococcus aureus
VKQAATARKAQNATVSNTT

SEQ ID NO: 1719452 - protein, 26 aa, Staphylococcus aureus
VLGEKVVAYGPIWRLFKVPENVSHLK

SEQ ID NO: 1719453 - protein, 23 aa, Staphylococcus aureus
VLIMFVLCGFIFPLTVTALGQVL

SEQ ID NO: 1719454 - protein, 17 aa, Staphylococcus aureus
VNDSRSWDYKIRNRSGQ

SEQ ID NO: 1719455 - protein, 17 aa, Staphylococcus aureus
VPFSVTIGNQITTTTAD

SEQ ID NO: 1719456 - protein, 21 aa, Staphylococcus aureus
VRNFLKQNIEDIHFANDDQPN

SEQ ID NO: 1719457 - protein, 17 aa, Staphylococcus aureus
VTDKGVYVWKDRKDYFV

SEQ ID NO: 1719458 - protein, 21 aa, Staphylococcus aureus
YKGILRVGAGTGFVVGKNTIL

SEQ ID NO: 1719459 - protein, 17 aa, Staphylococcus aureus
YKKVTGYGFIEGKDRFI

SEQ ID NO: 1719460 - protein, 17 aa, Staphylococcus aureus
YKPKYNLGDYVWEDTNK

SEQ ID NO: 1719461 - protein, 17 aa, Staphylococcus aureus
YLKGEAMQYDLSTTGGN

SEQ ID NO: 1719462 - protein, 28 aa, Staphylococcus aureus
YNTYVYKKGMPEFEIATSDVPEQKFKKL

SEQ ID NO: 1719463 - protein, 23 aa, Staphylococcus aureus
YQARGNVAALGRVNANDSTDHGN

SEQ ID NO: 1719464 - protein, 17 aa, Staphylococcus aureus
YQWVIKFNKGHAPHENM

SEQ ID NO: 1719465 - protein, 20 aa, Staphylococcus aureus
YRVPEGYTLNKGYDVNTNDL

SEQ ID NO: 1719466 - protein, 21 aa, Staphylococcus aureus
YSGYCLKNKYIYGGVTFAGDY

SEQ ID NO: 1719467 - protein, 27 aa, Staphylococcus aureus
YTKPSFEFEKQFGFMLKPWTTVRFMNV

SEQ ID NO: 1719468 - protein, 18 aa, Staphylococcus aureus
AAALEEFDEVVQAQIDQA

SEQ ID NO: 1719469 - protein, 17 aa, Staphylococcus aureus
AARAIDALPHLNNAQKA

SEQ ID NO: 1719470 - protein, 18 aa, Staphylococcus aureus
ADASWKKKTVKNYDESVT

SEQ ID NO: 1719471 - protein, 17 aa, Staphylococcus aureus
AEHFHIFMGNDNDALLK

SEQ ID NO: 1719472 - protein, 17 aa, Staphylococcus aureus
AGDYFSEAGAPASTKAF

SEQ ID NO: 1719473 - protein, 18 aa, Staphylococcus aureus
AGDYFSEANAPAATKALG

SEQ ID NO: 1719474 - protein, 25 aa, Staphylococcus aureus
AGQRAVLKYKLKFENGLHQGDYFDF

SEQ ID NO: 1719475 - protein, 18 aa, Staphylococcus aureus
AISGRVSMNQAYNSDITF

SEQ ID NO: 1719476 - protein, 17 aa, Staphylococcus aureus
AITGRVSMNQAFNSDIT

SEQ ID NO: 1719477 - protein, 22 aa, Staphylococcus aureus
AKAQGLEAFDNIQIDSTEKQKA

SEQ ID NO: 1719478 - protein, 26 aa, Staphylococcus aureus
AKTGKYELGEAFKIYKFNGEEDNSYY

SEQ ID NO: 1719479 - protein, 25 aa, Staphylococcus aureus
ALEQLKAQRINPVVKKNTLEAIREV

SEQ ID NO: 1719480 - protein, 18 aa, Staphylococcus aureus
ALMPYNFMSSVFKNNDGK

SEQ ID NO: 1719481 - protein, 22 aa, Staphylococcus aureus
ALPNCGIKAKSSISMNNVTYTT

SEQ ID NO: 1719482 - protein, 24 aa, Staphylococcus aureus
ALVAPEHIVRAAARDAVKQQYEAK

SEQ ID NO: 1719483 - protein, 17 aa, Staphylococcus aureus
AMTRKGMVSNRLNKFSI

SEQ ID NO: 1719484 - protein, 17 aa, Staphylococcus aureus
ANDAWKKLVDKLKEKDI

SEQ ID NO: 1719485 - protein, 26 aa, Staphylococcus aureus
ANMNFLRWVNFPQDYTVTWTNAKIAN

SEQ ID NO: 1719486 - protein, 24 aa, Staphylococcus aureus
ANPNGRRPGGVQGLNEYQISQLFS

SEQ ID NO: 1719487 - protein, 23 aa, Staphylococcus aureus
APHVHFQRMAGGIGNQYAVDPTS

SEQ ID NO: 1719488 - protein, 19 aa, Staphylococcus aureus
AQAEAGGRPNFRTTGYSQS

SEQ ID NO: 1719489 - protein, 29 aa, Staphylococcus aureus
ARGIYQLKDGYKYYSFVDSIGLHSGSHVY

SEQ ID NO: 1719490 - protein, 17 aa, Staphylococcus aureus
ARKGVGYKAAIEVHTTL

SEQ ID NO: 1719491 - protein, 24 aa, Staphylococcus aureus
ARNRTPIQLMIGFDYPDGHGNAET

SEQ ID NO: 1719492 - protein, 24 aa, Staphylococcus aureus
ARNRTPIQLMIGFDYPDSHGNAET

SEQ ID NO: 1719493 - protein, 17 aa, Staphylococcus aureus
ARTGWVIVDYAGYPWPG

SEQ ID NO: 1719494 - protein, 24 aa, Staphylococcus aureus
ARTRNPIRLMIGFDYPDAYGNSET

SEQ ID NO: 1719495 - protein, 18 aa, Staphylococcus aureus
ASLALGLITTGASIVTTQ

SEQ ID NO: 1719496 - protein, 18 aa, Staphylococcus aureus
ATPADPWAAAAGNGGAPV

SEQ ID NO: 1719497 - protein, 25 aa, Staphylococcus aureus
ATTNAFRPGGVQELNEYQLSQLFTD

SEQ ID NO: 1719498 - protein, 19 aa, Staphylococcus aureus
ATYKVVRTVPKHVFETARG

SEQ ID NO: 1719499 - protein, 19 aa, Staphylococcus aureus
AYCCVLVLRGELLDQHKDV

SEQ ID NO: 1719500 - protein, 18 aa, Staphylococcus aureus
CANVILPNNDRHQITDTT

SEQ ID NO: 1719501 - protein, 25 aa, Staphylococcus aureus
CTYYVFDRVGGKIGSTWGNANNWAS

SEQ ID NO: 1719502 - protein, 19 aa, Staphylococcus aureus
CVKSCSLLFMLNGNPRPEQ

SEQ ID NO: 1719503 - protein, 20 aa, Staphylococcus aureus
CVKSCSLLFMLNGSPRPEQL

SEQ ID NO: 1719504 - protein, 18 aa, Staphylococcus aureus
DANEAWKKLTDKLKEKNI

SEQ ID NO: 1719505 - protein, 17 aa, Staphylococcus aureus
DATITWVSGQAPNKDNT

SEQ ID NO: 1719506 - protein, 19 aa, Staphylococcus aureus
DAVLKRFNVTLGDIEAVIT

SEQ ID NO: 1719507 - protein, 17 aa, Staphylococcus aureus
DAYKEVKQAATARKAQN

SEQ ID NO: 1719508 - protein, 21 aa, Staphylococcus aureus
DDVKATLTMPAYIDPENVKKT

SEQ ID NO: 1719509 - protein, 23 aa, Staphylococcus aureus
DFGDINSAYIIKVVSKYTPTSDG

SEQ ID NO: 1719510 - protein, 17 aa, Staphylococcus aureus
DGGLSWSDDHKSLIYRY

SEQ ID NO: 1719511 - protein, 18 aa, Staphylococcus aureus
DGLNAINPIAPVTVVKQA

SEQ ID NO: 1719512 - protein, 20 aa, Staphylococcus aureus
DKGVYVWKDRKDYFVGLLGK

SEQ ID NO: 1719513 - protein, 21 aa, Staphylococcus aureus
DKGVYVWKDRKDYFVGLLGKD

SEQ ID NO: 1719514 - protein, 18 aa, Staphylococcus aureus
DKNIPCNLWIDGHQTEIE

SEQ ID NO: 1719515 - protein, 21 aa, Staphylococcus aureus
DKNIPCNLWIDGHQTEIELTA

SEQ ID NO: 1719516 - protein, 17 aa, Staphylococcus aureus
DNGIAVLEQDVITPTVK

SEQ ID NO: 1719517 - protein, 17 aa, Staphylococcus aureus
DPKRIAVVAPTYAGGLK

SEQ ID NO: 1719518 - protein, 20 aa, Staphylococcus aureus
DPVTAYDFVYAWRKLVDPKT

SEQ ID NO: 1719519 - protein, 19 aa, Staphylococcus aureus
DSEDFYISLKIIDVKQPEG

SEQ ID NO: 1719520 - protein, 21 aa, Staphylococcus aureus
DSGKYKVIFEKPAGLIQTGTN

SEQ ID NO: 1719521 - protein, 19 aa, Staphylococcus aureus
DTEDFYISLKIIDVKQPEG

SEQ ID NO: 1719522 - protein, 25 aa, Staphylococcus aureus
DTGFYKEPKYNLGDYVWEDTNKDGI

SEQ ID NO: 1719523 - protein, 18 aa, Staphylococcus aureus
DYIIYAIGLTNKYEYGDN

SEQ ID NO: 1719524 - protein, 21 aa, Staphylococcus aureus
DYKNIPCNLWIDGHQTEIELT

SEQ ID NO: 1719525 - protein, 21 aa, Staphylococcus aureus
EDIKSRLTLYSYIDKKTVPNE

SEQ ID NO: 1719526 - protein, 22 aa, Staphylococcus aureus
EDIKSRLTLYSYIDKKTVPNET

SEQ ID NO: 1719527 - protein, 21 aa, Staphylococcus aureus
EEKLYKIGDYVWEDVDKDGVQ

SEQ ID NO: 1719528 - protein, 20 aa, Staphylococcus aureus
EKELLKYFPSDYKKPEEKTS

SEQ ID NO: 1719529 - protein, 20 aa, Staphylococcus aureus
EKGKDIGPVRAAYEEGLNNI

SEQ ID NO: 1719530 - protein, 24 aa, Staphylococcus aureus
EKPKRVAVLTGFYVGDFIKLGIKP

SEQ ID NO: 1719531 - protein, 18 aa, Staphylococcus aureus
ELRTGPNAAYPVIYKVEK

SEQ ID NO: 1719532 - protein, 17 aa, Staphylococcus aureus
ENFKFFLQYGNFKDFKD

SEQ ID NO: 1719533 - protein, 24 aa, Staphylococcus aureus
ENKELRKAMLYAIDREKWIKAFFN

SEQ ID NO: 1719534 - protein, 24 aa, Staphylococcus aureus
ENLKGWHTGAGMSYLYNSDVRHYR

SEQ ID NO: 1719535 - protein, 17 aa, Staphylococcus aureus
ERPTIHFLGQASYENDM

SEQ ID NO: 1719536 - protein, 17 aa, Staphylococcus aureus
ESAESIWVIKGIIEAAK

SEQ ID NO: 1719537 - protein, 19 aa, Staphylococcus aureus
ESPGVPRVYTFIGKGDASY

SEQ ID NO: 1719538 - protein, 24 aa, Staphylococcus aureus
EVTPSLKAERLAKISVSPSAITTT

SEQ ID NO: 1719539 - protein, 21 aa, Staphylococcus aureus
FATSLPAKFVVKDVQPAKPTV

SEQ ID NO: 1719540 - protein, 17 aa, Staphylococcus aureus
FAVPGYHAHKFVTPGHA

SEQ ID NO: 1719541 - protein, 24 aa, Staphylococcus aureus
FDNSWCAGFSMAALLNATKNTDTY

SEQ ID NO: 1719542 - protein, 21 aa, Staphylococcus aureus
FESDGTYFAWNYHATGANGAD

SEQ ID NO: 1719543 - protein, 18 aa, Staphylococcus aureus
FGRKEQLFEIRVKPHTPT

SEQ ID NO: 1719544 - protein, 17 aa, Staphylococcus aureus
FGRQNFEYINGQKPAES

SEQ ID NO: 1719545 - protein, 17 aa, Staphylococcus aureus
FGRQTFEYINGERPTES

SEQ ID NO: 1719546 - protein, 19 aa, Staphylococcus aureus
FGRQTFEYINGERPTESPG

SEQ ID NO: 1719547 - protein, 23 aa, Staphylococcus aureus
FGYPEQRYGYYYNSYQLTWDNGL

SEQ ID NO: 1719548 - protein, 23 aa, Staphylococcus aureus
FINANRDAISFAEGDISVTNTPN

SEQ ID NO: 1719549 - protein, 32 aa, Staphylococcus aureus
FKIRNRSGQVIYDWPTVHINSLKDLARAGDYF

SEQ ID NO: 1719550 - protein, 18 aa, Staphylococcus aureus
FMLKPWTTVRFMNVIPDW

SEQ ID NO: 1719551 - protein, 24 aa, Staphylococcus aureus
FMNVIPDWFIYKIALVGKDDMKYK

SEQ ID NO: 1719552 - protein, 21 aa, Staphylococcus aureus
FNEKNEVIGIHWGGVPNEFNG

SEQ ID NO: 1719553 - protein, 17 aa, Staphylococcus aureus
FNGAVFINENVRNFLKQ

SEQ ID NO: 1719554 - protein, 29 aa, Staphylococcus aureus
FNKGHAPHENMIFWFALPADQVPVGRTDF

SEQ ID NO: 1719555 - protein, 22 aa, Staphylococcus aureus
FPDKSLKLSYKVNVTNIDTPKN

SEQ ID NO: 1719556 - protein, 22 aa, Staphylococcus aureus
FPYNGVVSFKDATGFAIEKNTI

SEQ ID NO: 1719557 - protein, 17 aa, Staphylococcus aureus
FVATVLLLLVFISGCGN

SEQ ID NO: 1719558 - protein, 23 aa, Staphylococcus aureus
FVCSLIVCGFFAYKIYFPADAKN

SEQ ID NO: 1719559 - protein, 23 aa, Staphylococcus aureus
FVCSLIVCGFFAYKIYFPTDAEN

SEQ ID NO: 1719560 - protein, 21 aa, Staphylococcus aureus
FVNSELRRSDMFDKNNPQNYQ

SEQ ID NO: 1719561 - protein, 24 aa, Staphylococcus aureus
FYKTPKYSLGDYVWYDSNKDGKQD

SEQ ID NO: 1719562 - protein, 23 aa, Staphylococcus aureus
FYNLNLRCKLAFKYMGEVIESKQ

SEQ ID NO: 1719563 - protein, 20 aa, Staphylococcus aureus
GDGYQWVIKFNKGHAPHENM

SEQ ID NO: 1719564 - protein, 18 aa, Staphylococcus aureus
GDTIKVAWPTSGTVKIEG

SEQ ID NO: 1719565 - protein, 23 aa, Staphylococcus aureus
GEKVVAYGPIWRLLKVPENVSHL

SEQ ID NO: 1719566 - protein, 24 aa, Staphylococcus aureus
GEVLEGGKIRYTFTNDIEDKVDVT

SEQ ID NO: 1719567 - protein, 25 aa, Staphylococcus aureus
GHAPHENMIFWFALPADQVPVGRTD

SEQ ID NO: 1719568 - protein, 26 aa, Staphylococcus aureus
GHAPHENMIYWFALPADQVPVGRTDF

SEQ ID NO: 1719569 - protein, 25 aa, Staphylococcus aureus
GHAPHQNMIFWFALPADQVPVGRTD

SEQ ID NO: 1719570 - protein, 23 aa, Staphylococcus aureus
GIPLDPSSLVYIVYPNEHTRDGG

SEQ ID NO: 1719571 - protein, 17 aa, Staphylococcus aureus
GKFSHFAYVKPNNQSLS

SEQ ID NO: 1719572 - protein, 18 aa, Staphylococcus aureus
GKIDRPSIGIGLINLKDI

SEQ ID NO: 1719573 - protein, 18 aa, Staphylococcus aureus
GKIGSTWGNASNWASAAA

SEQ ID NO: 1719574 - protein, 18 aa, Staphylococcus aureus
GLCISLLILIIFVTSCGG

SEQ ID NO: 1719575 - protein, 17 aa, Staphylococcus aureus
GLSPVKFYDYNLYDFTM

SEQ ID NO: 1719576 - protein, 19 aa, Staphylococcus aureus
GPTLRLFKVPDNVRNLKIQ

SEQ ID NO: 1719577 - protein, 19 aa, Staphylococcus aureus
GQLWKNVRDALKEASIIDK

SEQ ID NO: 1719578 - protein, 24 aa, Staphylococcus aureus
GQRAILKYKLKFENGLHQGDFFDF

SEQ ID NO: 1719579 - protein, 18 aa, Staphylococcus aureus
GTPLKRCAIVNRHNGKII

SEQ ID NO: 1719580 - protein, 18 aa, Staphylococcus aureus
GTPLKRCAIVNRHNGTIV

SEQ ID NO: 1719581 - protein, 18 aa, Staphylococcus aureus
GTSMRTTDKYGYYNYAGY

SEQ ID NO: 1719582 - protein, 25 aa, Staphylococcus aureus
GVPLDPSALVYLVIPTSQTRDGGSE

SEQ ID NO: 1719583 - protein, 18 aa, Staphylococcus aureus
GVPNEFNGAVFINENVRN

SEQ ID NO: 1719584 - protein, 20 aa, Staphylococcus aureus
GVSAATWAAIIARESNGQVN

SEQ ID NO: 1719585 - protein, 24 aa, Staphylococcus aureus
HAKELRAKLDIILGEEKKPNRITN

SEQ ID NO: 1719586 - protein, 19 aa, Staphylococcus aureus
HAPHENMIYWFALPAGQTP

SEQ ID NO: 1719587 - protein, 24 aa, Staphylococcus aureus
HIKAMRWPFQYNIGLKTNDKYVSL

SEQ ID NO: 1719588 - protein, 23 aa, Staphylococcus aureus
HNKELDFAFGLSMTSKNIARYEN

SEQ ID NO: 1719589 - protein, 19 aa, Staphylococcus aureus
HPDPHIIGLVALPYLNASR

SEQ ID NO: 1719590 - protein, 24 aa, Staphylococcus aureus
IATLKGVQPHIVIKPEAQQAIKAS

SEQ ID NO: 1719591 - protein, 24 aa, Staphylococcus aureus
IATLKGVQPHIVIKPEAQQAIKAT

SEQ ID NO: 1719592 - protein, 19 aa, Staphylococcus aureus
IAVMLFLTGCGKSQEKATL

SEQ ID NO: 1719593 - protein, 17 aa, Staphylococcus aureus
IDEGFMPLIYKGEMMDL

SEQ ID NO: 1719594 - protein, 26 aa, Staphylococcus aureus
IELGLKTASTWKKFEVYEGDKKLPVE

SEQ ID NO: 1719595 - protein, 37 aa, Staphylococcus aureus
IELVGNLLPGDYFGTIRFGRKEQLFEIGVKPHTPTIT

SEQ ID NO: 1719596 - protein, 36 aa, Staphylococcus aureus
IELVGNLLPGDYFGTIRFGRKEQLFEIRVKPHTPTI

SEQ ID NO: 1719597 - protein, 37 aa, Staphylococcus aureus
IELVGNLLPGDYFGTIRFGRKEQLFEIRVKPHTPTIT

SEQ ID NO: 1719598 - protein, 19 aa, Staphylococcus aureus
IEPVINRKASAREQLTTLF

SEQ ID NO: 1719599 - protein, 19 aa, Staphylococcus aureus
IEYARVWYQLISTRNDLKG

SEQ ID NO: 1719600 - protein, 20 aa, Staphylococcus aureus
IGPREQVNFLLLDKNNETQY

SEQ ID NO: 1719601 - protein, 19 aa, Staphylococcus aureus
IIQKPIRSVQEVQSALTNV

SEQ ID NO: 1719602 - protein, 17 aa, Staphylococcus aureus
IIQKPIRTVQEVQSALT

SEQ ID NO: 1719603 - protein, 18 aa, Staphylococcus aureus
IKDAIKWLHHNVYGKDPD

SEQ ID NO: 1719604 - protein, 22 aa, Staphylococcus aureus
IKPRTLNRLAVNTVAAPQQGTN

SEQ ID NO: 1719605 - protein, 23 aa, Staphylococcus aureus
IKSMRWPFQYNIGLKTNDPNVSL

SEQ ID NO: 1719606 - protein, 23 aa, Staphylococcus aureus
IKSMRWPFQYNIGLKTNDSNVSL

SEQ ID NO: 1719607 - protein, 17 aa, Staphylococcus aureus
IKVAWPTSGTVKIEGYS

SEQ ID NO: 1719608 - protein, 20 aa, Staphylococcus aureus
IKYSDTVQVYGLNPEDIKNI

SEQ ID NO: 1719609 - protein, 26 aa, Staphylococcus aureus
ILGEKVVAYGPIWRLFKVPENVSHLK

SEQ ID NO: 1719610 - protein, 19 aa, Staphylococcus aureus
ILTVSLFFFTFLIKNNLAY

SEQ ID NO: 1719611 - protein, 18 aa, Staphylococcus aureus
INANRDAISFAEGDISVT

SEQ ID NO: 1719612 - protein, 18 aa, Staphylococcus aureus
INANRDAITFAEGDISVT

SEQ ID NO: 1719613 - protein, 21 aa, Staphylococcus aureus
IPLDPSALVYLVIPTSQTRDG

SEQ ID NO: 1719614 - protein, 24 aa, Staphylococcus aureus
IPPEDFTVFIPPVGKQIRALIYYN

SEQ ID NO: 1719615 - protein, 20 aa, Staphylococcus aureus
IPVIFIRLVLDKHFDDVSSS

SEQ ID NO: 1719616 - protein, 17 aa, Staphylococcus aureus
IQHNIKFFKNDDGQNIA

SEQ ID NO: 1719617 - protein, 17 aa, Staphylococcus aureus
IQHNIKFFKNDDTQNIA

SEQ ID NO: 1719618 - protein, 18 aa, Staphylococcus aureus
IQHNIKFFKNDDTQNIAE

SEQ ID NO: 1719619 - protein, 17 aa, Staphylococcus aureus
IRAGYSLEIKVPLNAIK

SEQ ID NO: 1719620 - protein, 24 aa, Staphylococcus aureus
IRKHKLGAASVFLGTMIVVGMGQE

SEQ ID NO: 1719621 - protein, 17 aa, Staphylococcus aureus
IRLWGAESWGNINQLRD

SEQ ID NO: 1719622 - protein, 25 aa, Staphylococcus aureus
IRNRSGQVIYDWPTVHINSLKDLAR

SEQ ID NO: 1719623 - protein, 24 aa, Staphylococcus aureus
IRNRSGQVIYDWPTVHIYSLEDLS

SEQ ID NO: 1719624 - protein, 17 aa, Staphylococcus aureus
IRPEDYVVFIPPVGNQI

SEQ ID NO: 1719625 - protein, 19 aa, Staphylococcus aureus
IRPQDYIVFIPPVGKQIRA

SEQ ID NO: 1719626 - protein, 22 aa, Staphylococcus aureus
ISDIDLRLSKQAKYTVYFKNGT

SEQ ID NO: 1719627 - protein, 17 aa, Staphylococcus aureus
ISLLILIIFVTSCGGNK

SEQ ID NO: 1719628 - protein, 18 aa, Staphylococcus aureus
ISNGYFWGKIDSLESQFS

SEQ ID NO: 1719629 - protein, 23 aa, Staphylococcus aureus
ITIRPEDYVVFIPPVGNQIRALI

SEQ ID NO: 1719630 - protein, 28 aa, Staphylococcus aureus
IYKEKVVKLEAPMRAGGSVTYSSNGDGT

SEQ ID NO: 1719631 - protein, 30 aa, Staphylococcus aureus
IYQLKDGYKYYDFVDSIGLHSGSHVYVERR

SEQ ID NO: 1719632 - protein, 19 aa, Staphylococcus aureus
KALFAASFVTHFSGQTPHI

SEQ ID NO: 1719633 - protein, 20 aa, Staphylococcus aureus
KAQGLEAFDNIQIDSTEKQK

SEQ ID NO: 1719634 - protein, 18 aa, Staphylococcus aureus
KAWAKRVYPELSVEEAYI

SEQ ID NO: 1719635 - protein, 22 aa, Staphylococcus aureus
KAYDYKYFYSYKVVKGVKKYFS

SEQ ID NO: 1719636 - protein, 18 aa, Staphylococcus aureus
KDLARAGDYFSEAGAPAS

SEQ ID NO: 1719637 - protein, 20 aa, Staphylococcus aureus
KDLDFAFGLSMTSKNIARYE

SEQ ID NO: 1719638 - protein, 31 aa, Staphylococcus aureus; identical to SEQ ID NO: 1586588

SEQ ID NO: 1719639 - protein, 36 aa, Staphylococcus aureus
KEGKAKINAVKTFSEYKKDALAKIADAYNAKVNEED

SEQ ID NO: 1719640 - protein, 22 aa, Staphylococcus aureus
KEIKPKFKGLRSYYTKSSLEFK

SEQ ID NO: 1719641 - protein, 17 aa, Staphylococcus aureus
KFLDFDLLFKSIDWLDG

SEQ ID NO: 1719642 - protein, 19 aa, Staphylococcus aureus
KGGNLKPLEQRECANVILP

SEQ ID NO: 1719643 - protein, 19 aa, Staphylococcus aureus
KGLDFAFGLSMTSKNVARY

SEQ ID NO: 1719644 - protein, 24 aa, Staphylococcus aureus
KGMKEARKGVGYKAAIEVHTTLFS

SEQ ID NO: 1719645 - protein, 17 aa, Staphylococcus aureus
KGYEWNPQSIKSMKHSG

SEQ ID NO: 1719646 - protein, 17 aa, Staphylococcus aureus
KHYRLFLKYSDKQQTII

SEQ ID NO: 1719647 - protein, 17 aa, Staphylococcus aureus
KIGSTWGNANNWASAAA

SEQ ID NO: 1719648 - protein, 22 aa, Staphylococcus aureus
KINPKFKGLRSYYTKPSLEFKN

SEQ ID NO: 1719649 - protein, 26 aa, Staphylococcus aureus
KIRNRSGQVIYEWPTVHINSLRDLAR

SEQ ID NO: 1719650 - protein, 32 aa, Staphylococcus aureus
KIRNRSGQVIYEWPTVHINSLRDLARAGDYFS

SEQ ID NO: 1719651 - protein, 17 aa, Staphylococcus aureus
KKAEHFHIFMGNDNDAL

SEQ ID NO: 1719652 - protein, 19 aa, Staphylococcus aureus
KKGDTMTINYDKNVIPSDL

SEQ ID NO: 1719653 - protein, 18 aa, Staphylococcus aureus
KKIDEYELYKKWYKSSNK

SEQ ID NO: 1719654 - protein, 19 aa, Staphylococcus aureus
KKNGSLAITGRVSMNQAFN

SEQ ID NO: 1719655 - protein, 17 aa, Staphylococcus aureus
KLCLCLIILSIFIGGCG

SEQ ID NO: 1719656 - protein, 17 aa, Staphylococcus aureus
KLCLCLIILSVFIGACG

SEQ ID NO: 1719657 - protein, 18 aa, Staphylococcus aureus
KLCLCLIILSVFIGACGM

SEQ ID NO: 1719658 - protein, 18 aa, Staphylococcus aureus
KLCLCLMILSVFISACGM

SEQ ID NO: 1719659 - protein, 22 aa, Staphylococcus aureus
KPLEQRECANVILPNNDRHQIT

SEQ ID NO: 1719660 - protein, 34 aa, Staphylococcus aureus
KPSLEFKNELGIIIKKWTTIRFMNIVPDYFIYKI

SEQ ID NO: 1719661 - protein, 18 aa, Staphylococcus aureus
KQAATARKAQNATVSNAT

SEQ ID NO: 1719662 - protein, 19 aa, Staphylococcus aureus
KQAGHPVFYVYAGNQGNAS

SEQ ID NO: 1719663 - protein, 17 aa, Staphylococcus aureus
KQALKDRINQILQQGHN

SEQ ID NO: 1719664 - protein, 23 aa, Staphylococcus aureus
KQILRLIFLLAMYELGKYVTEQV

SEQ ID NO: 1719665 - protein, 23 aa, Staphylococcus aureus
KQILRLLFLLAMYELGKYVTEQV

SEQ ID NO: 1719666 - protein, 17 aa, Staphylococcus aureus
KQLIEKIICTVTLVQVK

SEQ ID NO: 1719667 - protein, 20 aa, Staphylococcus aureus
KRLNTRMRIAAVQPSSTDSK

SEQ ID NO: 1719668 - protein, 20 aa, Staphylococcus aureus
KRLNTRMRIAAVQPSSTEAK

SEQ ID NO: 1719669 - protein, 20 aa, Staphylococcus aureus
KSQAEAGGRPNFRTTGYSQS

SEQ ID NO: 1719670 - protein, 21 aa, Staphylococcus aureus
KSQAEAGGRPNFRTTGYSQSN

SEQ ID NO: 1719671 - protein, 30 aa, Staphylococcus aureus
KSSALPLVILAAVARYGINYAIKTYGKKAT

SEQ ID NO: 1719672 - protein, 17 aa, Staphylococcus aureus
KSWGEKTFYHFDVPDEH

SEQ ID NO: 1719673 - protein, 17 aa, Staphylococcus aureus
KTAQAMFIYEIRGDGNI

SEQ ID NO: 1719674 - protein, 17 aa, Staphylococcus aureus
KTAQAMFIYELRGDGNI

SEQ ID NO: 1719675 - protein, 22 aa, Staphylococcus aureus
KTATYKVVRTVPKHVFETARGV

SEQ ID NO: 1719676 - protein, 19 aa, Staphylococcus aureus
KTATYKVVRTVPKQVFETA

SEQ ID NO: 1719677 - protein, 20 aa, Staphylococcus aureus
KTATYKVVRTVPKQVFETAR

SEQ ID NO: 1719678 - protein, 20 aa, Staphylococcus aureus
KTATYKVVRTVPKQVFETTR

SEQ ID NO: 1719679 - protein, 24 aa, Staphylococcus aureus
KVGVFSHAMVRTSMFDSADAKNYQ

SEQ ID NO: 1719680 - protein, 19 aa, Staphylococcus aureus
LAITGRVSMNQAFNSNITF

SEQ ID NO: 1719681 - protein, 19 aa, Staphylococcus aureus
LALITGAALLARRRTKNEK

SEQ ID NO: 1719682 - protein, 28 aa, Staphylococcus aureus
LANMNFLRWVNFPQDYTVSWTNAKIASR

SEQ ID NO: 1719683 - protein, 17 aa, Staphylococcus aureus
LCIILLILIIFVTSCDG

SEQ ID NO: 1719684 - protein, 21 aa, Staphylococcus aureus
LCISLLILIIFVTSCDGDNKI

SEQ ID NO: 1719685 - protein, 17 aa, Staphylococcus aureus
LCISLLILSIFVTSCDS

SEQ ID NO: 1719686 - protein, 17 aa, Staphylococcus aureus
LDPSALVYLVAPTNQTT

SEQ ID NO: 1719687 - protein, 19 aa, Staphylococcus aureus
LDSGFYKTPKYSLGDYVWY

SEQ ID NO: 1719688 - protein, 27 aa, Staphylococcus aureus
LDSGFYKTPKYSLGDYVWYDSNKDGKQ

SEQ ID NO: 1719689 - protein, 23 aa, Staphylococcus aureus
LDSGKYKVIFEKPAGLTQTGTNT

SEQ ID NO: 1719690 - protein, 21 aa, Staphylococcus aureus
LEKSRCIPINLWVNGEHQTIS

SEQ ID NO: 1719691 - protein, 30 aa, Staphylococcus aureus
LENRGWDFDGSYGWQCFDLVNVYWNHIYGH

SEQ ID NO: 1719692 - protein, 17 aa, Staphylococcus aureus
LEQREHANVILPNNDRH

SEQ ID NO: 1719693 - protein, 19 aa, Staphylococcus aureus
LEYNQLFMYSQLYLESTQD

SEQ ID NO: 1719694 - protein, 17 aa, Staphylococcus aureus
LFLLAMYELGKYVTEQI

SEQ ID NO: 1719695 - protein, 18 aa, Staphylococcus aureus
LGKLRAGLDLIKKPIQMQ

SEQ ID NO: 1719696 - protein, 18 aa, Staphylococcus aureus
LGKLRAGLDLLKKPTQMR

SEQ ID NO: 1719697 - protein, 18 aa, Staphylococcus aureus
LKDYETWHTYMLAQETFT

SEQ ID NO: 1719698 - protein, 21 aa, Staphylococcus aureus
LKGWHTGAGMSYLYNSDVKHY

SEQ ID NO: 1719699 - protein, 21 aa, Staphylococcus aureus
LNCKPEFWKTLKYKKDKVTYY

SEQ ID NO: 1719700 - protein, 21 aa, Staphylococcus aureus
LPEIQHNIKFFKNDDGQNIAD

SEQ ID NO: 1719701 - protein, 17 aa, Staphylococcus aureus
LPIRAGYSLEIKVPLNV

SEQ ID NO: 1719702 - protein, 18 aa, Staphylococcus aureus
LPTSMPQYHVGHIQQIRQ

SEQ ID NO: 1719703 - protein, 19 aa, Staphylococcus aureus
LRDLARAGDYFSEANAPAA

SEQ ID NO: 1719704 - protein, 17 aa, Staphylococcus aureus
LREAMKFDQSFKPSQIK

SEQ ID NO: 1719705 - protein, 18 aa, Staphylococcus aureus
LRNGVKMIVEQVAHKVSQ

SEQ ID NO: 1719706 - protein, 17 aa, Staphylococcus aureus
LSEKLSFDRMFDVIDSK

SEQ ID NO: 1719707 - protein, 18 aa, Staphylococcus aureus
LSESYFVNPENFEDVTNS

SEQ ID NO: 1719708 - protein, 24 aa, Staphylococcus aureus
LTAEEKTEALAMIKQITDQAKKGI

SEQ ID NO: 1719709 - protein, 23 aa, Staphylococcus aureus
LTEREKRVIKREHVREAQKLVDN

SEQ ID NO: 1719710 - protein, 17 aa, Staphylococcus aureus
LVSNEFAFLHPHKITTN

SEQ ID NO: 1719711 - protein, 19 aa, Staphylococcus aureus
LWGAESWGNINQLRDRYVD

SEQ ID NO: 1719712 - protein, 17 aa, Staphylococcus aureus
LYISVMILIFAIAGCGK

SEQ ID NO: 1719713 - protein, 18 aa, Staphylococcus aureus
MAVMLFLTGCGKSQEKAT

SEQ ID NO: 1719714 - protein, 17 aa, Staphylococcus aureus
MGINYSIYMDADTIPVD

SEQ ID NO: 1719715 - protein, 19 aa, Staphylococcus aureus
MISNRLNKFSIRKYTVGTA

SEQ ID NO: 1719716 - protein, 20 aa, Staphylococcus aureus
MISNRLNKFSIRKYTVGTAS

SEQ ID NO: 1719717 - protein, 18 aa, Staphylococcus aureus
MKQARKGVGYKAAIEVHT

SEQ ID NO: 1719718 - protein, 17 aa, Staphylococcus aureus
MNIVPDYFIYKIALVGK

SEQ ID NO: 1719719 - protein, 25 aa, Staphylococcus aureus
MPDKILDLKFKLRVNNVPTPRTVTF

SEQ ID NO: 1719720 - protein, 18 aa, Staphylococcus aureus
MSEFIKFVLEDKGKAAEE

SEQ ID NO: 1719721 - protein, 18 aa, Staphylococcus aureus
MSNWYYWGKVKSLESQFA

SEQ ID NO: 1719722 - protein, 20 aa, Staphylococcus aureus
MTLCTFVIIPLFFKILDYQI

SEQ ID NO: 1719723 - protein, 17 aa, Staphylococcus aureus
NAIIQKPIRSVQEVQSA

SEQ ID NO: 1719724 - protein, 21 aa, Staphylococcus aureus
NAIIQKPIRSVQEVQTALTNV

SEQ ID NO: 1719725 - protein, 19 aa, Staphylococcus aureus
NDFPITWFYPLGEKKVERK

SEQ ID NO: 1719726 - protein, 23 aa, Staphylococcus aureus
NDLKKRAQTILAENRNNVPLNKR

SEQ ID NO: 1719727 - protein, 18 aa, Staphylococcus aureus
NDLKRRAQTILAENRNNV

SEQ ID NO: 1719728 - protein, 18 aa, Staphylococcus aureus
NFLKQNIEDIHFANDDQP

SEQ ID NO: 1719729 - protein, 19 aa, Staphylococcus aureus
NGFPIAWFYPLGEKKVERK

SEQ ID NO: 1719730 - protein, 22 aa, Staphylococcus aureus
NGVIKARSSITMNNVTYTTQDE

SEQ ID NO: 1719731 - protein, 17 aa, Staphylococcus aureus
NKALELLIFNQENKNVT

SEQ ID NO: 1719732 - protein, 22 aa, Staphylococcus aureus
NKDLDFAFGLSMTSKNVARYEN

SEQ ID NO: 1719733 - protein, 18 aa, Staphylococcus aureus
NNDEIFIETPFSGINESV

SEQ ID NO: 1719734 - protein, 19 aa, Staphylococcus aureus
NNDEIFIETPFSGINESVK

SEQ ID NO: 1719735 - protein, 29 aa, Staphylococcus aureus
NNMNFLRWVNFPQDYTVTWTNAKIANRPT

SEQ ID NO: 1719736 - protein, 22 aa, Staphylococcus aureus
NNTCKWSSIIWRSPDTKKAKRN

SEQ ID NO: 1719737 - protein, 24 aa, Staphylococcus aureus
NPAEQGRFLKFFVDAGLIKVKKGV

SEQ ID NO: 1719738 - protein, 22 aa, Staphylococcus aureus
NPNGRRPGGVQGLNEYQISQLF

SEQ ID NO: 1719739 - protein, 20 aa, Staphylococcus aureus
NPNVRRPGGVQELNEYQISQ

SEQ ID NO: 1719740 - protein, 17 aa, Staphylococcus aureus
NQLREAMKFDQSFKPSQ

SEQ ID NO: 1719741 - protein, 19 aa, Staphylococcus aureus
NQLREAMKFDQSFKPSQIK

SEQ ID NO: 1719742 - protein, 21 aa, Staphylococcus aureus
NQLRKAMKFDQSFKPSQIKCA

SEQ ID NO: 1719743 - protein, 17 aa, Staphylococcus aureus
NQPKVRIFEYLGNNEDI

SEQ ID NO: 1719744 - protein, 19 aa, Staphylococcus aureus
NRDAISFAEGDISVTNTPN

SEQ ID NO: 1719745 - protein, 19 aa, Staphylococcus aureus
NRKAEALQRLDQLTHLNNA

SEQ ID NO: 1719746 - protein, 20 aa, Staphylococcus aureus
NRKAEALQRLDQLTHLNNAQ

SEQ ID NO: 1719747 - protein, 20 aa, Staphylococcus aureus
NRKANGYKLFKGDIEITTSD

SEQ ID NO: 1719748 - protein, 26 aa, Staphylococcus aureus
NRKGMIPNRLNKFSIRKYSVGTASIL

SEQ ID NO: 1719749 - protein, 20 aa, Staphylococcus aureus
NSFVPSMHWIAANPKDLNDY

SEQ ID NO: 1719750 - protein, 23 aa, Staphylococcus aureus
NSLTEKLKGLGLLQNGQKVSIYS

SEQ ID NO: 1719751 - protein, 19 aa, Staphylococcus aureus
NTNAFRPGGVNPLNEYQLS

SEQ ID NO: 1719752 - protein, 22 aa, Staphylococcus aureus
NTNAFRPGGVQELNEYQLSQLF

SEQ ID NO: 1719753 - protein, 23 aa, Staphylococcus aureus
NTNAFRPGGVQELNEYQLSQLFT

SEQ ID NO: 1719754 - protein, 24 aa, Staphylococcus aureus
NTSAPRMRAFSLAAVAADAPAAGT

SEQ ID NO: 1719755 - protein, 17 aa, Staphylococcus aureus
NVIALGRIRGNDTNDHG

SEQ ID NO: 1719756 - protein, 19 aa, Staphylococcus aureus
NVKGLGIISHRTINASAAE

SEQ ID NO: 1719757 - protein, 17 aa, Staphylococcus aureus
NVNRVNDRLTLAINQLV

SEQ ID NO: 1719758 - protein, 18 aa, Staphylococcus aureus
NVSHLKIQFVPKNDAITD

SEQ ID NO: 1719759 - protein, 18 aa, Staphylococcus aureus
NYGHGAGVVTSRTISANQ

SEQ ID NO: 1719760 - protein, 23 aa, Staphylococcus aureus
PAEQGRFLKFFVDAGLIKIKKGV

SEQ ID NO: 1719761 - protein, 20 aa, Staphylococcus aureus
PEDFTVFIPPVGKQIRALIY

SEQ ID NO: 1719762 - protein, 18 aa, Staphylococcus aureus
PEDLRVVIDLSNAKAGKY

SEQ ID NO: 1719763 - protein, 17 aa, Staphylococcus aureus
PEIQHNIKFFKNDDTQN

SEQ ID NO: 1719764 - protein, 21 aa, Staphylococcus aureus
PEMWPYGVNDSRSWDYKIRNR

SEQ ID NO: 1719765 - protein, 17 aa, Staphylococcus aureus
PESKLGIIVPEYKEINN

SEQ ID NO: 1719766 - protein, 21 aa, Staphylococcus aureus
PESKLGSIVLEYKEINNRVNV

SEQ ID NO: 1719767 - protein, 20 aa, Staphylococcus aureus
PHALKAFPFAINQDNYPNGG

SEQ ID NO: 1719768 - protein, 20 aa, Staphylococcus aureus
PIRLMIGFDYPDAFGNGETL

SEQ ID NO: 1719769 - protein, 18 aa, Staphylococcus aureus
PKKAEHFHIFMGNDNDAL

SEQ ID NO: 1719770 - protein, 20 aa, Staphylococcus aureus
PLDPSSLVYIVYPNEHTRDG

SEQ ID NO: 1719771 - protein, 24 aa, Staphylococcus aureus
PNGEIKARSSISMNNVTYITQDEH

SEQ ID NO: 1719772 - protein, 17 aa, Staphylococcus aureus
PNGYKYYSLYDEKNRWM

SEQ ID NO: 1719773 - protein, 17 aa, Staphylococcus aureus
PNNKFTMYRVFGSKKNR

SEQ ID NO: 1719774 - protein, 40 aa, Staphylococcus aureus; identical to SEQ ID NO: 1588177

SEQ ID NO: 1719775 - protein, 19 aa, Staphylococcus aureus
PQYIKFRHDYNIVEYNDGT

SEQ ID NO: 1719776 - protein, 17 aa, Staphylococcus aureus
PREQVNFQLLDKNNETQ

SEQ ID NO: 1719777 - protein, 19 aa, Staphylococcus aureus
PRTDLKMANFHKYNLEELS

SEQ ID NO: 1719778 - protein, 24 aa, Staphylococcus aureus
PSGEGKRGFAVYFSPEIKKFIADN

SEQ ID NO: 1719779 - protein, 28 aa, Staphylococcus aureus
PSLEFKNEIGIILKKWTTIRFMNIVPDY

SEQ ID NO: 1719780 - protein, 24 aa, Staphylococcus aureus
PSQIKCAILFGGFYNMQTVRETEF

SEQ ID NO: 1719781 - protein, 22 aa, Staphylococcus aureus
PSQIKGAILFGGFYNMQTVRET

SEQ ID NO: 1719782 - protein, 18 aa, Staphylococcus aureus
PTVHIYSLEDLSRASDYF

SEQ ID NO: 1719783 - protein, 20 aa, Staphylococcus aureus
PVGKQIRALIYYNKVVASNM

SEQ ID NO: 1719784 - protein, 21 aa, Staphylococcus aureus
PVPEDHAYIRFPVSDGTQELK

SEQ ID NO: 1719785 - protein, 17 aa, Staphylococcus aureus
QAEAGGRPNYRTTGYSQ

SEQ ID NO: 1719786 - protein, 19 aa, Staphylococcus aureus
QALDHAMELLRNSVADNQA

SEQ ID NO: 1719787 - protein, 20 aa, Staphylococcus aureus
QEVIMIWNPWDRGFMTQDAE

SEQ ID NO: 1719788 - protein, 18 aa, Staphylococcus aureus
QGPAFPFAECGAMSQAYI

SEQ ID NO: 1719789 - protein, 27 aa, Staphylococcus aureus
QLRDGYKYYDFVDSIGLHSGSHVYVER

SEQ ID NO: 1719790 - protein, 18 aa, Staphylococcus aureus
QMWPNGVNDSRSWDFKIR

SEQ ID NO: 1719791 - protein, 18 aa, Staphylococcus aureus
QNAQRMNFQFTNSYGPSK

SEQ ID NO: 1719792 - protein, 20 aa, Staphylococcus aureus
QPPSGYKWYDPKTFKAGSYG

SEQ ID NO: 1719793 - protein, 24 aa, Staphylococcus aureus
QSAKELRAKLDLIIGEEKNAFRIT

SEQ ID NO: 1719794 - protein, 17 aa, Staphylococcus aureus
RAKAALKKNDFKSMAEA

SEQ ID NO: 1719795 - protein, 18 aa, Staphylococcus aureus
RALIYYNKVVASNMSNAV

SEQ ID NO: 1719796 - protein, 20 aa, Staphylococcus aureus
REKRVIKREHVREAQKLVEN

SEQ ID NO: 1719797 - protein, 22 aa, Staphylococcus aureus
RERYLKAGLSPVKFYDYNLYDF

SEQ ID NO: 1719798 - protein, 20 aa, Staphylococcus aureus
RFMNIVPDYFIYKIALVGKD

SEQ ID NO: 1719799 - protein, 26 aa, Staphylococcus aureus
RFMNVIPDWFIYKIALVGKDDKKYKD

SEQ ID NO: 1719800 - protein, 31 aa, Staphylococcus aureus
RGIYQLRDGYKYYDFVDSIGLHSGSHLYVER

SEQ ID NO: 1719801 - protein, 18 aa, Staphylococcus aureus
RIWLYLVLLAVFIGACGM

SEQ ID NO: 1719802 - protein, 19 aa, Staphylococcus aureus
RKGSELANFYIGIINDLLS

SEQ ID NO: 1719803 - protein, 29 aa, Staphylococcus aureus
RKKSIGVASVLVGTLIGFGLLSSKEADAS

SEQ ID NO: 1719804 - protein, 18 aa, Staphylococcus aureus
RKKVDYKAGISITKEDKN

SEQ ID NO: 1719805 - protein, 21 aa, Staphylococcus aureus
RKSVFLMLNIKKGIFMTHPNL

SEQ ID NO: 1719806 - protein, 17 aa, Staphylococcus aureus
RLVKYINIFYAMIANVP

SEQ ID NO: 1719807 - protein, 18 aa, Staphylococcus aureus
RLWLYLVLLAVFISACGM

SEQ ID NO: 1719808 - protein, 18 aa, Staphylococcus aureus
RMGGTYIKSGYGADTSGI

SEQ ID NO: 1719809 - protein, 17 aa, Staphylococcus aureus
RMVWPFQYNIGLTSKDQ

SEQ ID NO: 1719810 - protein, 19 aa, Staphylococcus aureus
RNFLKQNIEDIHFANDDQP

SEQ ID NO: 1719811 - protein, 17 aa, Staphylococcus aureus
RNGVKMIVEQVAHTVSQ

SEQ ID NO: 1719812 - protein, 22 aa, Staphylococcus aureus
RNRTPIQLMIGFDYPDSHGNAE

SEQ ID NO: 1719813 - protein, 17 aa, Staphylococcus aureus
RQNFEYINGQKPAESPG

SEQ ID NO: 1719814 - protein, 25 aa, Staphylococcus aureus
RVGWGEIPMSLGFTYSSNTLMMHLQ

SEQ ID NO: 1719815 - protein, 20 aa, Staphylococcus aureus
RVNDRLTLAINQLVPLADNS

SEQ ID NO: 1719816 - protein, 20 aa, Staphylococcus aureus
RVNKLVIGISLLFLVISITA

SEQ ID NO: 1719817 - protein, 23 aa, Staphylococcus aureus
SDIDLRLSKQAKYTVHFKNGTKR

SEQ ID NO: 1719818 - protein, 26 aa, Staphylococcus aureus
SGFYKTPKYSLGDYVWYDSNKDGKQD

SEQ ID NO: 1719819 - protein, 20 aa, Staphylococcus aureus
SGKYKVIFEKPAGLKQTGTN

SEQ ID NO: 1719820 - protein, 20 aa, Staphylococcus aureus
SGKYKVIFEKPAGLTQTGTN

SEQ ID NO: 1719821 - protein, 18 aa, Staphylococcus aureus
SIDWLDGISAEFKDLKVE

SEQ ID NO: 1719822 - protein, 18 aa, Staphylococcus aureus
SITGRVSMNQAFNSDITF

SEQ ID NO: 1719823 - protein, 18 aa, Staphylococcus aureus
SKGGFYFTDFRGYSTNPL

SEQ ID NO: 1719824 - protein, 17 aa, Staphylococcus aureus
SKVHVPYAITVNGTSQN

SEQ ID NO: 1719825 - protein, 32 aa, Staphylococcus aureus
SNLANMNFLRWVNFPQDYTVTWTNAKIANRPT

SEQ ID NO: 1719826 - protein, 33 aa, Staphylococcus aureus
SNLTNMNFLRWISFPQDYTVTWTNAKIANRPTD

SEQ ID NO: 1719827 - protein, 18 aa, Staphylococcus aureus
SQAEAGGRPNFRTTGYSQ

SEQ ID NO: 1719828 - protein, 25 aa, Staphylococcus aureus
SSDVLKLKANYTIDDSVKEGDTFTF

SEQ ID NO: 1719829 - protein, 21 aa, Staphylococcus aureus
SSKKKALNWWDYEIGTPKSLT

SEQ ID NO: 1719830 - protein, 21 aa, Staphylococcus aureus
SSKKKALNWWDYEIGTPRALT

SEQ ID NO: 1719831 - protein, 21 aa, Staphylococcus aureus
STAKVPPIMAGDQVLANGVID

SEQ ID NO: 1719832 - protein, 19 aa, Staphylococcus aureus
STVIATLVFLGFNTSQAHA

SEQ ID NO: 1719833 - protein, 21 aa, Staphylococcus aureus
TATYKVVRTVPKHVFETARGV

SEQ ID NO: 1719834 - protein, 18 aa, Staphylococcus aureus
TDGFTYKWNNAATGTNDA

SEQ ID NO: 1719835 - protein, 18 aa, Staphylococcus aureus
TDGFTYKWNRDTTGTNDA

SEQ ID NO: 1719836 - protein, 19 aa, Staphylococcus aureus
TDGFTYKWNRDTTGTNDAN

SEQ ID NO: 1719837 - protein, 18 aa, Staphylococcus aureus
TDGGLSWSDDHKSLIYRY

SEQ ID NO: 1719838 - protein, 19 aa, Staphylococcus aureus
TDGGLSWSDDHKSLIYRYD

SEQ ID NO: 1719839 - protein, 23 aa, Staphylococcus aureus
TGDGYQWVIKFNKGHAPHENMIF

SEQ ID NO: 1719840 - protein, 22 aa, Staphylococcus aureus
TGDGYQWVIKFNKGHAPHQNMI

SEQ ID NO: 1719841 - protein, 18 aa, Staphylococcus aureus
TGTAHLFKVPTDADRLDL

SEQ ID NO: 1719842 - protein, 18 aa, Staphylococcus aureus
TILFKGFFTNHSWYNDLL

SEQ ID NO: 1719843 - protein, 23 aa, Staphylococcus aureus
TIRPEDYVVFIPPVGHQIRALIY

SEQ ID NO: 1719844 - protein, 18 aa, Staphylococcus aureus
TKAFGRQNFEYINGQKPA

SEQ ID NO: 1719845 - protein, 32 aa, Staphylococcus aureus
TKPSLEFEKQFGFMLKPWTTVRFMNVIPDWFI

SEQ ID NO: 1719846 - protein, 17 aa, Staphylococcus aureus
TKVKPAAREKINQKANE

SEQ ID NO: 1719847 - protein, 24 aa, Staphylococcus aureus
TLKETKGKIVLFNRMGDTYIKSGY

SEQ ID NO: 1719848 - protein, 22 aa, Staphylococcus aureus
TNIFPYTGVVAFNSATGFVVGK

SEQ ID NO: 1719849 - protein, 18 aa, Staphylococcus aureus
TNVFPYNGVVSFKDATGF

SEQ ID NO: 1719850 - protein, 17 aa, Staphylococcus aureus
TPGICLVLLIILIGGYV

SEQ ID NO: 1719851 - protein, 22 aa, Staphylococcus aureus
TQDYQLRLDGLRQTVNRTYRIG

SEQ ID NO: 1719852 - protein, 17 aa, Staphylococcus aureus
TSMRTTDKYGYYNYAGY

SEQ ID NO: 1719853 - protein, 34 aa, Staphylococcus aureus
TSNLANMNFLRWVNFPQDYTVSWTNAKIASRPTD

SEQ ID NO: 1719854 - protein, 25 aa, Staphylococcus aureus
TVGTFSTVIATLVFLGLNTSQAQAA

SEQ ID NO: 1719855 - protein, 25 aa, Staphylococcus aureus
TVGTFSTVIATLVFLGLNTSQAQAT

SEQ ID NO: 1719856 - protein, 17 aa, Staphylococcus aureus
TVTTSLKNNGNFGASFN

SEQ ID NO: 1719857 - protein, 19 aa, Staphylococcus aureus
TVVDNLPGFTLINGGKVGV

SEQ ID NO: 1719858 - protein, 18 aa, Staphylococcus aureus
TYKVVRTVPKHVFETARG

SEQ ID NO: 1719859 - protein, 18 aa, Staphylococcus aureus
TYPRLRVTGVSFEAVGLP

SEQ ID NO: 1719860 - protein, 27 aa, Staphylococcus aureus
TYYVFDRVGGKIGSTWGNASNWANAAA

SEQ ID NO: 1719861 - protein, 24 aa, Staphylococcus aureus
TYYVFDRVGGKIGSTWGNASNWAS

SEQ ID NO: 1719862 - protein, 23 aa, Staphylococcus aureus
VFNEKNKVIGIHWGGVPNEFNGA

SEQ ID NO: 1719863 - protein, 18 aa, Staphylococcus aureus
VGHQIRALIYYNNVVASN

SEQ ID NO: 1719864 - protein, 20 aa, Staphylococcus aureus
VGKQIRAVVYYNKVVASNMS

SEQ ID NO: 1719865 - protein, 20 aa, Staphylococcus aureus
VGKQIRAVVYYNKVVGSNMS

SEQ ID NO: 1719866 - protein, 24 aa, Staphylococcus aureus
VGTFSTVIATLVFLGLNTSHAQAA

SEQ ID NO: 1719867 - protein, 23 aa, Staphylococcus aureus
VGTFSTVIATLVFLGLNTSQAQA

SEQ ID NO: 1719868 - protein, 20 aa, Staphylococcus aureus
VGTPLKRCAIVNRHNGTIIN

SEQ ID NO: 1719869 - protein, 27 aa, Staphylococcus aureus
VIAEKSVAYGPIWRLFKVPENVSHLKI

SEQ ID NO: 1719870 - protein, 24 aa, Staphylococcus aureus
VIILLIGALGFAIYAAINHSTSSI

SEQ ID NO: 1719871 - protein, 22 aa, Staphylococcus aureus
VIIVLIGTLGFAIYAAINHSTS

SEQ ID NO: 1719872 - protein, 19 aa, Staphylococcus aureus
VKHVIPDIVAHSHYTVQGQ

SEQ ID NO: 1719873 - protein, 20 aa, Staphylococcus aureus
VKKLMIIMQLQMIKLLLQLI

SEQ ID NO: 1719874 - protein, 17 aa, Staphylococcus aureus
VKMGINYSIYMDADTIP

SEQ ID NO: 1719875 - protein, 19 aa, Staphylococcus aureus
VKMGINYSIYMDADTIPVD

SEQ ID NO: 1719876 - protein, 17 aa, Staphylococcus aureus
VKSSFGYHVIKADKPTD

SEQ ID NO: 1719877 - protein, 19 aa, Staphylococcus aureus
VNDRLTLAINQLVPLADNS

SEQ ID NO: 1719878 - protein, 20 aa, Staphylococcus aureus
VNGGWRYNYGNQFYVQLVSQ

SEQ ID NO: 1719879 - protein, 18 aa, Staphylococcus aureus
VNGKSGWVSKAYLFDTAK

SEQ ID NO: 1719880 - protein, 20 aa, Staphylococcus aureus
VPEDHAYIRFPVSDGTQELK

SEQ ID NO: 1719881 - protein, 22 aa, Staphylococcus aureus
VPESKLGSIVLEYKEINNRVNV

SEQ ID NO: 1719882 - protein, 17 aa, Staphylococcus aureus
VPKGYTLNKGYDVNTKE

SEQ ID NO: 1719883 - protein, 19 aa, Staphylococcus aureus
VPMLKAERLAMINITTGAN

SEQ ID NO: 1719884 - protein, 17 aa, Staphylococcus aureus
VPTPRTVTFNDTLTYKT

SEQ ID NO: 1719885 - protein, 23 aa, Staphylococcus aureus
VTVVDNLPGFTFINGGKVGVFSH

SEQ ID NO: 1719886 - protein, 27 aa, Staphylococcus aureus
VYPHQAGYVKLNYGFSVPNSAVKGDTF

SEQ ID NO: 1719887 - protein, 20 aa, Staphylococcus aureus
WDHVDFIGVDFLDFKRKGSE

SEQ ID NO: 1719888 - protein, 18 aa, Staphylococcus aureus
WNGFYWAGANYKNFKTRT

SEQ ID NO: 1719889 - protein, 17 aa, Staphylococcus aureus
WNGFYWAGANYKNYKTR

SEQ ID NO: 1719890 - protein, 19 aa, Staphylococcus aureus
WPTVHIYSLEDLSRASDYF

SEQ ID NO: 1719891 - protein, 25 aa, Staphylococcus aureus
WSAHISLWGAESWGNINQLKGRYVD

SEQ ID NO: 1719892 - protein, 17 aa, Staphylococcus aureus
WTTIRFMNIVPDYFIYK

SEQ ID NO: 1719893 - protein, 17 aa, Staphylococcus aureus
YDPHVWLDPKINQTFAK

SEQ ID NO: 1719894 - protein, 24 aa, Staphylococcus aureus
YEDIKARLTLYSYIDKQAVPNETS

SEQ ID NO: 1719895 - protein, 17 aa, Staphylococcus aureus
YEGFMPLIYKGEMMDLS

SEQ ID NO: 1719896 - protein, 18 aa, Staphylococcus aureus
YFAVPGYHAHKFVTPGHA

SEQ ID NO: 1719897 - protein, 18 aa, Staphylococcus aureus
YGPESWGNIIQLRNKNVD

SEQ ID NO: 1719898 - protein, 17 aa, Staphylococcus aureus
YKVEFETPLGYTPTQVG

SEQ ID NO: 1719899 - protein, 21 aa, Staphylococcus aureus
YKYYYDRGYTLTWDNGLVLYS

SEQ ID NO: 1719900 - protein, 24 aa, Staphylococcus aureus
YQARGNVAALGRVNANDSTDHGNF

SEQ ID NO: 1719901 - protein, 33 aa, Staphylococcus aureus; identical to SEQ ID NO: 1679486

SEQ ID NO: 1719902 - protein, 36 aa, Staphylococcus aureus
YTKPSLEFEKQFGFMLKPWTTVRFMNVIPDWFIYKI

SEQ ID NO: 1719903 - protein, 22 aa, Staphylococcus aureus
YVVLRFGWLYGPGTWYGKDGMI

SEQ ID NO: 1719904 - protein, 25 aa, Staphylococcus aureus
YYKRTIKISGLKAMYALKSKDFKKM

SEQ ID NO: 1719905 - protein, 31 aa, Staphylococcus aureus
TLTAKKSYFILNDKIVFLGTGIKSTDSSKNP

SEQ ID NO: 1719906 - protein, 18 aa, Staphylococcus aureus
ISVIGYPNPNGNKLQMYE

SEQ ID NO: 1719907 - protein, 24 aa, Staphylococcus aureus
TNTNVAPYSGVTWMGAGTGFVVGN

SEQ ID NO: 1719908 - protein, 22 aa, Staphylococcus aureus
STDTVFKFKDTTKLMGKALGKE

SEQ ID NO: 1719909 - protein, 21 aa, Staphylococcus aureus
VVTLAFLLVLAGCSGNSNKQS

SEQ ID NO: 1719910 - protein, 17 aa, Staphylococcus aureus
AFKYFSKQYGITPGYIW

SEQ ID NO: 1719911 - protein, 23 aa, Staphylococcus aureus
ANNLRGYLIMPNQTLQIPNGGSG

SEQ ID NO: 1719912 - protein, 18 aa, Staphylococcus aureus
ISEMNYTYGPYNMNYRTI

SEQ ID NO: 1719913 - protein, 24 aa, Staphylococcus aureus
KLTDADVILYNGLNLETGNGWFEK

SEQ ID NO: 1719914 - protein, 17 aa, Staphylococcus aureus
LSMSAVVLTACGNDTPK

SEQ ID NO: 1719915 - protein, 20 aa, Staphylococcus aureus
RAMITSEGAFKYFSKQYGIT

SEQ ID NO: 1719916 - protein, 25 aa, Staphylococcus aureus
SKLAKEWMEFLKSDKAKEILKEYHF

SEQ ID NO: 1719917 - protein, 19 aa, Staphylococcus aureus
WGNANNWAAAAQGAGFTVN

SEQ ID NO: 1719918 - protein, 21 aa, Staphylococcus aureus
DGFNQSMDLLLSKRVDGTFND

SEQ ID NO: 1719919 - protein, 23 aa, Staphylococcus aureus
DQLGYKIKLIGKGIYENGKVNAS

SEQ ID NO: 1719920 - protein, 26 aa, Staphylococcus aureus
EIPTNDFFIACQFHPEFLSRPNRPHP

SEQ ID NO: 1719921 - protein, 24 aa, Staphylococcus aureus
FDSWKSLYNPKFKNQILLVDGARE

SEQ ID NO: 1719922 - protein, 17 aa, Staphylococcus aureus
FIVSMLILTACGKKESA

SEQ ID NO: 1719923 - protein, 21 aa, Staphylococcus aureus
IATMGFATFTMAHQADAAETT

SEQ ID NO: 1719924 - protein, 18 aa, Staphylococcus aureus
IGALVVGMLCLTLSHWFK

SEQ ID NO: 1719925 - protein, 18 aa, Staphylococcus aureus
IIMLLVLAACGNQGEKNN

SEQ ID NO: 1719926 - protein, 17 aa, Staphylococcus aureus
IKGANDIVIKKGQDYNL

SEQ ID NO: 1719927 - protein, 18 aa, Staphylococcus aureus
ISAIKYARENNVPFFGIC

SEQ ID NO: 1719928 - protein, 24 aa, Staphylococcus aureus
KDIVIKHILVRDKSKKRPLNISQY

SEQ ID NO: 1719929 - protein, 25 aa, Staphylococcus aureus
KVEYQFVNLAFLGKDSIVGSRASHA

SEQ ID NO: 1719930 - protein, 19 aa, Staphylococcus aureus
LALLLLVAACGTGGKQSSD

SEQ ID NO: 1719931 - protein, 18 aa, Staphylococcus aureus
LISEMNWIGEYIVSSRTI

SEQ ID NO: 1719932 - protein, 18 aa, Staphylococcus aureus
LYTAGQCTWYVFDKRAKD

SEQ ID NO: 1719933 - protein, 18 aa, Staphylococcus aureus
MTTLTLFSMSPNSAQAYT

SEQ ID NO: 1719934 - protein, 19 aa, Staphylococcus aureus
MYVHCTLLPYIKAAGEMKT

SEQ ID NO: 1719935 - protein, 22 aa, Staphylococcus aureus
RPNRPHPIFKSFIEASLKYQQN

SEQ ID NO: 1719936 - protein, 19 aa, Staphylococcus aureus
TANKDLLAVHLKLLEDLAE

SEQ ID NO: 1719937 - protein, 31 aa, Staphylococcus aureus
TDGGKPMKPFLGVRGWYLSEYSKHKYWAKDL

SEQ ID NO: 1719938 - protein, 23 aa, Staphylococcus aureus
VGLPNSRALIWQQFDYNNSRERD

SEQ ID NO: 1719939 - protein, 22 aa, Staphylococcus aureus
VMARGLREFPIDITAIVTVADN

SEQ ID NO: 1719940 - protein, 25 aa, Staphylococcus aureus
VQKDHKLVMLFGDNLLDFTDPKEAT

SEQ ID NO: 1719941 - protein, 24 aa, Staphylococcus aureus
VTAQDFVYAWRKTVDPKTGSEFAY

SEQ ID NO: 1719942 - protein, 18 aa, Staphylococcus aureus
VVLASSVLLAGCTTDKKE

SEQ ID NO: 1719943 - protein, 19 aa, Staphylococcus aureus
AEYLADVDGILVPGGFGFR

SEQ ID NO: 1719944 - protein, 30 aa, Staphylococcus aureus
AGKYQFLQSTWDSVAPAKYKGVSPANAPES

SEQ ID NO: 1719945 - protein, 21 aa, Staphylococcus aureus
AGYTFPLAMLKNEAGINATKD

SEQ ID NO: 1719946 - protein, 19 aa, Staphylococcus aureus
DGNRTIYKPTWKSEADSYK

SEQ ID NO: 1719947 - protein, 25 aa, Staphylococcus aureus
DGQRTLLFGPFANVGPKFLKNGSNL

SEQ ID NO: 1719948 - protein, 20 aa, Staphylococcus aureus
DIQIDDWMTVFGDPNYAMTA

SEQ ID NO: 1719949 - protein, 22 aa, Staphylococcus aureus
DLKDIPIHFAIYKQSSEDSITP

SEQ ID NO: 1719950 - protein, 22 aa, Staphylococcus aureus
DNYRTLLPFKESQARGLLQDNM

SEQ ID NO: 1719951 - protein, 27 aa, Staphylococcus aureus
EFKGFLGNNIVKFFDYTFASVGVKPNE

SEQ ID NO: 1719952 - protein, 21 aa, Staphylococcus aureus
EHYYEFHTKKGMLLVTTDGKK

SEQ ID NO: 1719953 - protein, 23 aa, Staphylococcus aureus
EKKYKFSKPYTFSSAVLVIRENE

SEQ ID NO: 1719954 - protein, 17 aa, Staphylococcus aureus
ESKHLGGFPISGQFLAC

SEQ ID NO: 1719955 - protein, 32 aa, Staphylococcus aureus
ETYVLLNNTSHNIPLGWFNVKDLNVQNLGKEV

SEQ ID NO: 1719956 - protein, 24 aa, Staphylococcus aureus
EVMKKWIPLMMKGREDNPGIMAAS

SEQ ID NO: 1719957 - protein, 17 aa, Staphylococcus aureus
FGAKLFQAGYDVTLIDG

SEQ ID NO: 1719958 - protein, 32 aa, Staphylococcus aureus
GEGGRIWTYKDGKPWYFLEEKYPDYGNLVPRD

SEQ ID NO: 1719959 - protein, 18 aa, Staphylococcus aureus
HKYWAKDLMLYITSKDTL

SEQ ID NO: 1719960 - protein, 27 aa, Staphylococcus aureus
HYRHVDLPASVPLAWGAHRAASIVAEQ

SEQ ID NO: 1719961 - protein, 17 aa, Staphylococcus aureus
IADLKYDLARPTEMGIF

SEQ ID NO: 1719962 - protein, 19 aa, Staphylococcus aureus
INEEFEISKQFWGHLVKSG

SEQ ID NO: 1719963 - protein, 30 aa, Staphylococcus aureus
IQDNSYALSRPLFIYVNEKALKDNKVMSEF

SEQ ID NO: 1719964 - protein, 18 aa, Staphylococcus aureus
ITAIFILAACGNHKDDQA

SEQ ID NO: 1719965 - protein, 24 aa, Staphylococcus aureus
KAMAADFLILGTPNYHGSYSGILK

SEQ ID NO: 1719966 - protein, 27 aa, Staphylococcus aureus
KAVNSEKTLFKYLNQNDATQQGVNEKS

SEQ ID NO: 1719967 - protein, 20 aa, Staphylococcus aureus
KGLSKYLKGPYLQLDTEHLA

SEQ ID NO: 1719968 - protein, 29 aa, Staphylococcus aureus
KIEEDYTSYFPKYAYRNGVGRPEGIVVHD

SEQ ID NO: 1719969 - protein, 18 aa, Staphylococcus aureus
KNNGLFTTVYDKTGKPTK

SEQ ID NO: 1719970 - protein, 18 aa, Staphylococcus aureus
KVTIHFAEQESEAFDLCI

SEQ ID NO: 1719971 - protein, 26 aa, Staphylococcus aureus
LAAAVKNLPLIKYSFDQVIMTKEGCM

SEQ ID NO: 1719972 - protein, 19 aa, Staphylococcus aureus
LALSLFLAACGQDSDQQKD

SEQ ID NO: 1719973 - protein, 18 aa, Staphylococcus aureus
LEKLLSKELGIPVKVSVS

SEQ ID NO: 1719974 - protein, 18 aa, Staphylococcus aureus
LGGFPISGQFLACTNPQV

SEQ ID NO: 1719975 - protein, 23 aa, Staphylococcus aureus
LKGKKGYIATPYPTYNTLDEVNE

SEQ ID NO: 1719976 - protein, 21 aa, Staphylococcus aureus
LLIIFFIVLSILEERKRTKKK

SEQ ID NO: 1719977 - protein, 17 aa, Staphylococcus aureus
LLVPAVTLSLAACGNDD

SEQ ID NO: 1719978 - protein, 27 aa, Staphylococcus aureus
MKSKKVDVGFLPPTAYTLAHDQKAADL

SEQ ID NO: 1719979 - protein, 23 aa, Staphylococcus aureus
NEALVRQIVFDIGKMFGNKNSRV

SEQ ID NO: 1719980 - protein, 17 aa, Staphylococcus aureus
NSIIKHYQLTQFDDERM

SEQ ID NO: 1719981 - protein, 25 aa, Staphylococcus aureus
NVKFLKDRYEAMKAFPMFDNIEYTE

SEQ ID NO: 1719982 - protein, 24 aa, Staphylococcus aureus
PAEQGRFLKFFVDAGLIKIKKGVK

SEQ ID NO: 1719983 - protein, 24 aa, Staphylococcus aureus
PQVKGLIYHKFGPNNSLKHVYIDK

SEQ ID NO: 1719984 - protein, 22 aa, Staphylococcus aureus
QDGEIPTLDPIRSIAPSVYSIN

SEQ ID NO: 1719985 - protein, 25 aa, Staphylococcus aureus
QDYQATYVLFEKLYHDLLNQVADSK

SEQ ID NO: 1719986 - protein, 21 aa, Staphylococcus aureus
QHIALGDWADAIIVAPATANT

SEQ ID NO: 1719987 - protein, 22 aa, Staphylococcus aureus
QKGIWQVTPTKHDWDHVDFVGQ

SEQ ID NO: 1719988 - protein, 26 aa, Staphylococcus aureus
QMYGINEVYLISHALLETGNGTSQLA

SEQ ID NO: 1719989 - protein, 21 aa, Staphylococcus aureus
QNIMAVAWYQNSAEAKALYLQ

SEQ ID NO: 1719990 - protein, 19 aa, Staphylococcus aureus
QNTLYKMRWNPAHPGTHQY

SEQ ID NO: 1719991 - protein, 24 aa, Staphylococcus aureus
RHNTKVLSTMIYDIALELISTIPF

SEQ ID NO: 1719992 - protein, 23 aa, Staphylococcus aureus
SELPPLVQSGFNPSFIATVSHEK

SEQ ID NO: 1719993 - protein, 35 aa, Staphylococcus aureus
SETGILLHNIYDLKPLKSFVYGRTILLGDAAHATT

SEQ ID NO: 1719994 - protein, 23 aa, Staphylococcus aureus
SPISTYWSDAKYWAGNAANDGYQ

SEQ ID NO: 1719995 - protein, 26 aa, Staphylococcus aureus
SVVESLKHAGYPFAKDIDIRWIDSSE

SEQ ID NO: 1719996 - protein, 21 aa, Staphylococcus aureus
TGDDPRKVPMKIFPAVHYSMG

SEQ ID NO: 1719997 - protein, 25 aa, Staphylococcus aureus
TIAFTIIHHPILDRFNPFLKTEYSY

SEQ ID NO: 1719998 - protein, 23 aa, Staphylococcus aureus
TKGPVMWGFFGHCSIAIDDKTIL

SEQ ID NO: 1719999 - protein, 23 aa, Staphylococcus aureus
TNQKIYVYNWGEYIDPELIKKFE

SEQ ID NO: 1720000 - protein, 23 aa, Staphylococcus aureus
VDKKPQRLVVDLPIDYYGQAETI

SEQ ID NO: 1720001 - protein, 23 aa, Staphylococcus aureus
VNQKHFDLIKSDKNLSIIRKNGR

SEQ ID NO: 1720002 - protein, 18 aa, Staphylococcus aureus
VPVTASALLLGACGASAT

SEQ ID NO: 1720003 - protein, 18 aa, Staphylococcus aureus
VVLYAHGGAWFQDPLKIH

SEQ ID NO: 1720004 - protein, 24 aa, Staphylococcus aureus
YGEAEHVFVPHFTIAQGLSSQEFE

SEQ ID NO: 1720005 - protein, 23 aa, Staphylococcus aureus
YLLSTTLVLPTLVSPTAYADTPQ

SEQ ID NO: 1720006 - protein, 23 aa, Staphylococcus aureus
YNSPTLIGWVKQGDVIYNNAKSP

SEQ ID NO: 1720007 - protein, 32 aa, Staphylococcus aureus
AIEAARQHRIPVIFIRLVLDKHFNDVSSSNKV

SEQ ID NO: 1720008 - protein, 26 aa, Staphylococcus aureus
APIKETLAASLIRLANWKGDTPLIDP

SEQ ID NO: 1720009 - protein, 33 aa, Staphylococcus aureus
ARMDEYVVLRFGWLYGPGTWYGKDGMIYNQFMD

SEQ ID NO: 1720010 - protein, 19 aa, Staphylococcus aureus
ASGLFQTMPGWGPTNTVDQ

SEQ ID NO: 1720011 - protein, 24 aa, Staphylococcus aureus
DKYNYVIPKEGSNLWFDNMVIPKT

SEQ ID NO: 1720012 - protein, 27 aa, Staphylococcus aureus
EDVKNHLIPKFEAYYKSAKNLPDDTMK

SEQ ID NO: 1720013 - protein, 20 aa, Staphylococcus aureus
FENELKAILPFHRSLRVANY

SEQ ID NO: 1720014 - protein, 33 aa, Staphylococcus aureus
GIEHDFIPGYYQFHIYPVFPIPERRRFLYQVKN

SEQ ID NO: 1720015 - protein, 26 aa, Staphylococcus aureus
GKTYEGIYKDWKPGQKVHLVGHSMGG

SEQ ID NO: 1720016 - protein, 18 aa, Staphylococcus aureus
IEDEVVFDKGYMAPLYGS

SEQ ID NO: 1720017 - protein, 19 aa, Staphylococcus aureus
IIIVALIGILVLNQRYSNS

SEQ ID NO: 1720018 - protein, 17 aa, Staphylococcus aureus
ILIGAVIGGAISLADKS

SEQ ID NO: 1720019 - protein, 18 aa, Staphylococcus aureus
ISIDKINQFLKGKGVLEN

SEQ ID NO: 1720020 - protein, 19 aa, Staphylococcus aureus
KFKISQILTFNFIKDKSYD

SEQ ID NO: 1720021 - protein, 19 aa, Staphylococcus aureus
KGLGIISHRTINAAAAEEL

SEQ ID NO: 1720022 - protein, 24 aa, Staphylococcus aureus
KKAEHFHIFMGNDNDALLKEMDNW

SEQ ID NO: 1720023 - protein, 18 aa, Staphylococcus aureus
KYYDIIVTSNLATKHPFF

SEQ ID NO: 1720024 - protein, 23 aa, Staphylococcus aureus
LGGTLRLGLYPCSIKEGTLAQDV

SEQ ID NO: 1720025 - protein, 27 aa, Staphylococcus aureus
NAIDQDQFIKFYRGDKFKIASPITPLV

SEQ ID NO: 1720026 - protein, 24 aa, Staphylococcus aureus
NDIVIKKGQDYNLLNGISAFDKED

SEQ ID NO: 1720027 - protein, 26 aa, Staphylococcus aureus
NHAQKFVTPLAFQAISRNAVYTDTFI

SEQ ID NO: 1720028 - protein, 23 aa, Staphylococcus aureus
QEKLKEERIVGTAGGGMVAVTVT

SEQ ID NO: 1720029 - protein, 24 aa, Staphylococcus aureus
SASKSDLFMYTGDNLDPVAKKVAS

SEQ ID NO: 1720030 - protein, 19 aa, Staphylococcus aureus
SKDPRDYFVPDSELPPLVQ

SEQ ID NO: 1720031 - protein, 25 aa, Staphylococcus aureus
SNNTKIKLMNVTSTYYDKVAKALKS

SEQ ID NO: 1720032 - protein, 25 aa, Staphylococcus aureus
SSEPLSHLRVIVRSLLGIAVPTQIA

SEQ ID NO: 1720033 - protein, 25 aa, Staphylococcus aureus
SSKGPDLYVYLTKNGDIKNGKEIAM

SEQ ID NO: 1720034 - protein, 21 aa, Staphylococcus aureus
TAGQCTWYVFDRRAQAGSPIS

SEQ ID NO: 1720035 - protein, 27 aa, Staphylococcus aureus
TKNKEGIGYFGYNFYVQNKDKLKEVKI

SEQ ID NO: 1720036 - protein, 29 aa, Staphylococcus aureus
TSDSNNIIDFIYKNLPQTNINQLLTKNKY

SEQ ID NO: 1720037 - protein, 24 aa, Staphylococcus aureus
TSNGTTWSWSYEAANGQTAGFSNV

SEQ ID NO: 1720038 - protein, 32 aa, Staphylococcus aureus
TWSNQAVFFTRQLWNMLVLARVITIGAYNRNE

SEQ ID NO: 1720039 - protein, 20 aa, Staphylococcus aureus
VLAILFVVISACGNKEKEAQ

SEQ ID NO: 1720040 - protein, 17 aa, Staphylococcus aureus
VLYQAFGLKMQPEQQKL

SEQ ID NO: 1720041 - protein, 25 aa, Staphylococcus aureus
VNFENKQIILLPGPPKEMQPMVKNE

SEQ ID NO: 1720042 - protein, 18 aa, Staphylococcus aureus
YERGLHPTLIHRSDKINK

SEQ ID NO: 1720043 - protein, 31 aa, Staphylococcus aureus
YGMLFDAKNFYFNYPFLFGNDDYIFKKNGSE

SEQ ID NO: 1720044 - protein, 25 aa, Staphylococcus aureus
ASAIVKANLWLRTADRIKIVVGRFN

SEQ ID NO: 1720045 - protein, 28 aa, Staphylococcus aureus
AVNKDNKAFYFLLRDDDYFAKVVNGQAR

SEQ ID NO: 1720046 - protein, 33 aa, Staphylococcus aureus; identical to SEQ ID NO: 1692046

SEQ ID NO: 1720047 - protein, 28 aa, Staphylococcus aureus
EDGYHFIEPGSGFLACGYVAKGRMEEPL

SEQ ID NO: 1720048 - protein, 17 aa, Staphylococcus aureus
EIGKGISTYWWNANNWD

SEQ ID NO: 1720049 - protein, 20 aa, Staphylococcus aureus
EVISKLKPDLIIADVSRHKK

SEQ ID NO: 1720050 - protein, 18 aa, Staphylococcus aureus
IATAGFATIAIASGNQAH

SEQ ID NO: 1720051 - protein, 27 aa, Staphylococcus aureus
IENPREFINPLPHISYVRGKNNVKFLK

SEQ ID NO: 1720052 - protein, 25 aa, Staphylococcus aureus
KFMAASAVFTMGFLSVPTAGAEQTN

SEQ ID NO: 1720053 - protein, 24 aa, Staphylococcus aureus
KQLDAGSWFNKKYPKYARASYKNA

SEQ ID NO: 1720054 - protein, 18 aa, Staphylococcus aureus
KRRKLFNGYIECTYYQYW

SEQ ID NO: 1720055 - protein, 17 aa, Staphylococcus aureus
LEELFNRFNGEDFYGEA

SEQ ID NO: 1720056 - protein, 18 aa, Staphylococcus aureus
LPSMVALTLVGSAVTAHQ

SEQ ID NO: 1720057 - protein, 19 aa, Staphylococcus aureus
MRQAIEFVKKHKLKHLLVE

SEQ ID NO: 1720058 - protein, 23 aa, Staphylococcus aureus
NAIEMYYSLQNYYNTRIETIKVS

SEQ ID NO: 1720059 - protein, 29 aa, Staphylococcus aureus
NIMRLNGLNNFFIYPGQKLKVSGTASSSN

SEQ ID NO: 1720060 - protein, 17 aa, Staphylococcus aureus
QLPPLIQSGFNPSFITT

SEQ ID NO: 1720061 - protein, 21 aa, Staphylococcus aureus
RKQLQPYGQYHGGGAHYGVDY

SEQ ID NO: 1720062 - protein, 22 aa, Staphylococcus aureus
RNLYTSGQCTYYVFDRVGGKIG

SEQ ID NO: 1720063 - protein, 30 aa, Staphylococcus aureus
SDRQKADLNMFFPFVITGNLIGKATEKEWR

SEQ ID NO: 1720064 - protein, 20 aa, Staphylococcus aureus
SILSIAAISLTVSTFAGESH

SEQ ID NO: 1720065 - protein, 20 aa, Staphylococcus aureus
SINMNMYTRLLLLDENDHLT

SEQ ID NO: 1720066 - protein, 20 aa, Staphylococcus aureus
SWLTSRKQLQPYGQYHGGGA

SEQ ID NO: 1720067 - protein, 24 aa, Staphylococcus aureus
TLDITPKLMLQGSVDLLNEVATSK

SEQ ID NO: 1720068 - protein, 18 aa, Staphylococcus aureus
TTALGATLLLGACGGGNG

SEQ ID NO: 1720069 - protein, 25 aa, Staphylococcus aureus
VDAGTYWYNDPYTLDFMRKDLKEKL

SEQ ID NO: 1720070 - protein, 25 aa, Staphylococcus aureus
VVSDLLNVALFFESDLHTLPPHFEL

SEQ ID NO: 1720071 - protein, 21 aa, Staphylococcus aureus
YAATQLQYYGLKPDSAEYDGN

SEQ ID NO: 1720072 - protein, 27 aa, Staphylococcus aureus
YDLMFNQTWGLLYDPQSTIAAFKAKNG

SEQ ID NO: 1720073 - protein, 22 aa, Staphylococcus aureus
YNFPKKPFKYGIHYSEIEDFDN

SEQ ID NO: 1720074 - protein, 24 aa, Staphylococcus aureus
YTIDAQGNYHYTWKGNWHPSQLNQ

SEQ ID NO: 1720075 - protein, 22 aa, Staphylococcus aureus
APPEELIPQFDYVKEISEQFGF

SEQ ID NO: 1720076 - protein, 23 aa, Staphylococcus aureus
DAIYQLKKFIGLCNQSIKYNEDI

SEQ ID NO: 1720077 - protein, 25 aa, Staphylococcus aureus
DDINPSVLAHYWGGNKMNIRQDLEE

SEQ ID NO: 1720078 - protein, 22 aa, Staphylococcus aureus
DHLNMDYFKMKPVGLIGNSGGI

SEQ ID NO: 1720079 - protein, 29 aa, Staphylococcus aureus
DSMAGFLLIGLITLLLIPMMNQMQASINH

SEQ ID NO: 1720080 - protein, 22 aa, Staphylococcus aureus
GEWQSVYPYLKDGTLDEVMEHK

SEQ ID NO: 1720081 - protein, 17 aa, Staphylococcus aureus
IFSAVLVLSGCGSMHSS

SEQ ID NO: 1720082 - protein, 27 aa, Staphylococcus aureus
IVQILLVVIIIIFGYKIVQTYIEDKQE

SEQ ID NO: 1720083 - protein, 19 aa, Staphylococcus aureus
IYDFYDYDPYQLAANNAKA

SEQ ID NO: 1720084 - protein, 21 aa, Staphylococcus aureus
KFLDDAKYYLSAYPNETIVMS

SEQ ID NO: 1720085 - protein, 29 aa, Staphylococcus aureus
KLIVVLCAIIVFIALIGLSIRSQSQSPPE

SEQ ID NO: 1720086 - protein, 37 aa, Staphylococcus aureus; identical to SEQ ID NO: 1690278

SEQ ID NO: 1720087 - protein, 18 aa, Staphylococcus aureus
LASTLILGACGHHQDSAK

SEQ ID NO: 1720088 - protein, 22 aa, Staphylococcus aureus
LEPQQLIDIKAFMGDTADGYAG

SEQ ID NO: 1720089 - protein, 25 aa, Staphylococcus aureus
NGQEVIIIWNPWDNGFMTQDAKNNV

SEQ ID NO: 1720090 - protein, 19 aa, Staphylococcus aureus
NIFGLIDRYDEKNSELVIS

SEQ ID NO: 1720091 - protein, 17 aa, Staphylococcus aureus
QTDFNFDEPAYLPRFVF

SEQ ID NO: 1720092 - protein, 33 aa, Staphylococcus aureus
SIRKFSVGASSILIATLLFLSGGQAQAAEKQVN

SEQ ID NO: 1720093 - protein, 21 aa, Staphylococcus aureus
TMYSFGTIPRGDTGYFFNQAY

SEQ ID NO: 1720094 - protein, 26 aa, Staphylococcus aureus
VEGAQKIYDLFKPILEKKDKKLSDDI

SEQ ID NO: 1720095 - protein, 17 aa, Staphylococcus aureus
VGAFFRARLGNEVLENL

SEQ ID NO: 1720096 - protein, 18 aa, Staphylococcus aureus
AMLLASGLILTGCGGNKG

SEQ ID NO: 1720097 - protein, 19 aa, Staphylococcus aureus
DKDEVINGMIWSEILAKPK

SEQ ID NO: 1720098 - protein, 30 aa, Staphylococcus aureus
DTKRLAQDPALKYQFLRLDQPQNISIDKIN

SEQ ID NO: 1720099 - protein, 17 aa, Staphylococcus aureus
EGWHEWVQAAKAKPVYG

SEQ ID NO: 1720100 - protein, 18 aa, Staphylococcus aureus
GATLLLAGCGSQNLAPLE

SEQ ID NO: 1720101 - protein, 22 aa, Staphylococcus aureus
GIGVGVAAGFVVALQGRDDKSV

SEQ ID NO: 1720102 - protein, 18 aa, Staphylococcus aureus
HGGAWFQDPLKIHFEFID

SEQ ID NO: 1720103 - protein, 19 aa, Staphylococcus aureus
KPDLIIADVSRHKKIKSEL

SEQ ID NO: 1720104 - protein, 29 aa, Staphylococcus aureus
MTIAGVVLILVAAYLFAKPHIDNYLHDKD

SEQ ID NO: 1720105 - protein, 30 aa, Staphylococcus aureus
SALSKLERNKKGFFLMVEGASIDKSAHSND

SEQ ID NO: 1720106 - protein, 22 aa, Staphylococcus aureus
TTLSVSLLAPLANPLLENAKAA

SEQ ID NO: 1720107 - protein, 17 aa, Staphylococcus aureus
VAILIILGLVKTIQDYE

SEQ ID NO: 1720108 - protein, 17 aa, Staphylococcus aureus
VISVIISIITTMRENSH

SEQ ID NO: 1720109 - protein, 19 aa, Staphylococcus aureus
VVFMLILVVAVAGCGQKDT

SEQ ID NO: 1720110 - protein, 25 aa, Staphylococcus aureus
DRHPTRGSILQTVNGPFGHVAYVEK

SEQ ID NO: 1720111 - protein, 18 aa, Staphylococcus aureus
GHHQVFIEPITEGSGIIK

SEQ ID NO: 1720112 - protein, 18 aa, Staphylococcus aureus
IEDKYLSERTKRLKLKQL

SEQ ID NO: 1720113 - protein, 17 aa, Staphylococcus aureus
IYLYGSVNGKSGWVSKA

SEQ ID NO: 1720114 - protein, 20 aa, Staphylococcus aureus
KGLADDIHYSVKPKLANITL

SEQ ID NO: 1720115 - protein, 23 aa, Staphylococcus aureus
LAIMGRYVLTPEIFDYLKTQKEG

SEQ ID NO: 1720116 - protein, 24 aa, Staphylococcus aureus
LWGNANNWNYAAKVAGFKVDKTPE

SEQ ID NO: 1720117 - protein, 27 aa, Staphylococcus aureus
NLATKHPFFEYARSFDFIIVSDIGLIN

SEQ ID NO: 1720118 - protein, 24 aa, Staphylococcus aureus
PKNVIFLVGDGMGPSFNTAYRYYK

SEQ ID NO: 1720119 - protein, 21 aa, Staphylococcus aureus
RALKLLEAAGLIKLKKDFGLA

SEQ ID NO: 1720120 - protein, 28 aa, Staphylococcus aureus
RFIAFLLALFFFLSVNNVFGNIFNTGNL

SEQ ID NO: 1720121 - protein, 27 aa, Staphylococcus aureus
CINDNVEVWLIKKGFNIYNRYTLHRFN

SEQ ID NO: 1720122 - protein, 20 aa, Staphylococcus aureus
DAKRIVVLEYSFADALAALD

SEQ ID NO: 1720123 - protein, 21 aa, Staphylococcus aureus
DGHTISTFWGDAKNWAGQASS

SEQ ID NO: 1720124 - protein, 23 aa, Staphylococcus aureus
DKDKVLGLFADKNMPLAIDASKD

SEQ ID NO: 1720125 - protein, 21 aa, Staphylococcus aureus
DTGYFFNQAYKKDGAINKGDY

SEQ ID NO: 1720126 - protein, 21 aa, Staphylococcus aureus
FFLLLSVALLYSCSKQNEKAQ

SEQ ID NO: 1720127 - protein, 26 aa, Staphylococcus aureus
GDRIIETAPTDYLSWGVGAVGNPRFI

SEQ ID NO: 1720128 - protein, 25 aa, Staphylococcus aureus
IDGLNLFEFKYKLKPFFNPENVYSK

SEQ ID NO: 1720129 - protein, 19 aa, Staphylococcus aureus
ILIFMLVLSGCGMKDNDKQ

SEQ ID NO: 1720130 - protein, 21 aa, Staphylococcus aureus
KFAVANLIIVSTVFSSVTPAI

SEQ ID NO: 1720131 - protein, 19 aa, Staphylococcus aureus
LLLLVFISGCGNDKYVKEI

SEQ ID NO: 1720132 - protein, 20 aa, Staphylococcus aureus
LTVLLLLFSFSSITNEVSAS

SEQ ID NO: 1720133 - protein, 21 aa, Staphylococcus aureus
LVLSILIILPVSTLDGHHIAN

SEQ ID NO: 1720134 - protein, 24 aa, Staphylococcus aureus
PDDIEMLQDLVLAATNEAMNKADE

SEQ ID NO: 1720135 - protein, 32 aa, Staphylococcus aureus; identical to SEQ ID NO: 1698838

SEQ ID NO: 1720136 - protein, 21 aa, Staphylococcus aureus
QLNDIAYLKATFKTNKKINGD

SEQ ID NO: 1720137 - protein, 23 aa, Staphylococcus aureus
SSLFVATLTTATLVSSPAANALS

SEQ ID NO: 1720138 - protein, 26 aa, Staphylococcus aureus
YDDNYSLTTLIQNLFNLNSDISDYEQ

SEQ ID NO: 1720139 - protein, 24 aa, Staphylococcus aureus
ANKSGLAWPSAFKVQLQLPDNEVA

SEQ ID NO: 1720140 - protein, 24 aa, Staphylococcus aureus
KFLTLKEFLYYKKKGKFPKRSVWI

SEQ ID NO: 1720141 - protein, 20 aa, Staphylococcus aureus
LLIMLLVVAGCSFGGNHKLS

SEQ ID NO: 1720142 - protein, 30 aa, Staphylococcus aureus; identical to SEQ ID NO: 1691399

SEQ ID NO: 1720143 - protein, 18 aa, Staphylococcus aureus
NYHYTWTGNWNPSQLTQN

SEQ ID NO: 1720144 - protein, 25 aa, Staphylococcus aureus
PYDRDSWNPVYGNQLFMKTRNGSMK

SEQ ID NO: 1720145 - protein, 23 aa, Staphylococcus aureus
QKLSTITLLMAGVITLNGGEFRS

SEQ ID NO: 1720146 - protein, 19 aa, Staphylococcus aureus
RLQKWYDKGYLPKAATHDV

SEQ ID NO: 1720147 - protein, 18 aa, Staphylococcus aureus
TMIDVTFKYLTKDKLNDI

SEQ ID NO: 1720148 - protein, 24 aa, Staphylococcus aureus
VDDKIKVIGYPLPAQNSFKQFEST

SEQ ID NO: 1720149 - protein, 35 aa, Staphylococcus aureus; identical to SEQ ID NO: 1691714

SEQ ID NO: 1720150 - protein, 17 aa, Staphylococcus aureus
ALNLNKEELLKAKPDLI

SEQ ID NO: 1720151 - protein, 25 aa, Staphylococcus aureus
DGMALLFRHFYATSLHKQFMYNSQG

SEQ ID NO: 1720152 - protein, 18 aa, Staphylococcus aureus
GIPVIREQHDGFKGIDAV

SEQ ID NO: 1720153 - protein, 26 aa, Staphylococcus aureus
HSRQYAKRQMTWFKNKMSVHWLDKEN

SEQ ID NO: 1720154 - protein, 26 aa, Staphylococcus aureus
SNNYQWYMHNNRLTVSAGDKVKAGDQ

SEQ ID NO: 1720155 - protein, 20 aa, Staphylococcus aureus
VTTTLLLGSILMNPVANAAD

SEQ ID NO: 1720156 - protein, 27 aa, Staphylococcus aureus
ANIQCDQLIILTAIDYVYINFNTENQQ

SEQ ID NO: 1720157 - protein, 24 aa, Staphylococcus aureus
HGQVYHVFYHPLITDPKVAFTGDT

SEQ ID NO: 1720158 - protein, 17 aa, Staphylococcus aureus
IKDVDAFFKGKKGIKRK

SEQ ID NO: 1720159 - protein, 17 aa, Staphylococcus aureus
KDYNYTYVIKNGNGYYY

SEQ ID NO: 1720160 - protein, 36 aa, Staphylococcus aureus
LKNKRTLIVVIAFVLFIIFLFLLLNSNSEDSGNITI

SEQ ID NO: 1720161 - protein, 24 aa, Staphylococcus aureus
NMHPDLVKIVGRLNYRTSYGQNVL

SEQ ID NO: 1720162 - protein, 20 aa, Staphylococcus aureus
TAKELLATAVQRLAADHTSE

SEQ ID NO: 1720163 - protein, 18 aa, Staphylococcus aureus
TEFEVAYAPPYSHPKDLI

SEQ ID NO: 1720164 - protein, 27 aa, Staphylococcus aureus
TLGICLVLLIILIVGYVIMTKTNGRNA

SEQ ID NO: 1720165 - protein, 33 aa, Staphylococcus aureus
YSIRKYKVGIFSTLIGTVLLLSNPNGAQALTTD

SEQ ID NO: 1720166 - protein, 26 aa, Staphylococcus aureus
ASHAVLMYAPKSFLDFQKQLFAAQQD

SEQ ID NO: 1720167 - protein, 30 aa, Staphylococcus aureus
DLKKYPYIKRMIWPFQYNISLKTKDSNVDL

SEQ ID NO: 1720168 - protein, 25 aa, Staphylococcus aureus
DVEPTSIISILVAAADALSAARPGA

SEQ ID NO: 1720169 - protein, 23 aa, Staphylococcus aureus
GRGYRRVVPSPQPISIIELESIK

SEQ ID NO: 1720170 - protein, 20 aa, Staphylococcus aureus
ILLGIILGVVGGYVVARNLL

SEQ ID NO: 1720171 - protein, 24 aa, Staphylococcus aureus
KNSRVDFGLAQWGLKQKPNESYID

SEQ ID NO: 1720172 - protein, 18 aa, Staphylococcus aureus
SMIKNKILTATLAVGLIA

SEQ ID NO: 1720173 - protein, 25 aa, Staphylococcus aureus
GMTIGLAMNSVYYYKKEKDGPTFSK

SEQ ID NO: 1720174 - protein, 18 aa, Staphylococcus aureus
INIKEKSNFFVVVNHVKG

SEQ ID NO: 1720175 - protein, 18 aa, Staphylococcus aureus
IVALVLLAACGSNNDKKV

SEQ ID NO: 1720176 - protein, 22 aa, Staphylococcus aureus
LSGFDPIRREIARTALVNLVSD

SEQ ID NO: 1720177 - protein, 21 aa, Staphylococcus aureus
LYTSGQCTYYVFDRVGGKIGS

SEQ ID NO: 1720178 - protein, 23 aa, Staphylococcus aureus
NTKDGIKPLLAKKWDVSEDGKTY

SEQ ID NO: 1720179 - protein, 17 aa, Staphylococcus aureus
VARNLLLQKQSQARQTA

SEQ ID NO: 1720180 - protein, 17 aa, Staphylococcus aureus
YVVARNLLLQKQSQARQ

SEQ ID NO: 1720181 - protein, 20 aa, Staphylococcus aureus
ILLILFVVVSPINSPKTIAD

SEQ ID NO: 1720182 - protein, 24 aa, Staphylococcus aureus
IYENAYPILKKYKIPATGFIITGH

SEQ ID NO: 1720183 - protein, 17 aa, Staphylococcus aureus
IYNRYTLHRFNEEYALE

SEQ ID NO: 1720184 - protein, 24 aa, Staphylococcus aureus
KILTATLAVGLIAPLANPFIEISK

SEQ ID NO: 1720185 - protein, 24 aa, Staphylococcus aureus
KQKSFWVAILSAIFLFAQNIAKAI

SEQ ID NO: 1720186 - protein, 20 aa, Staphylococcus aureus
LGGNKFYLVKDYNSPTLIGW

SEQ ID NO: 1720187 - protein, 36 aa, Staphylococcus aureus
VTYQREMDLYQIRWNGFYWAGANYKNFKTRTFKSTY

SEQ ID NO: 1720188 - protein, 18 aa, Staphylococcus aureus
AFYQVLHLKGITEEQRNQ

SEQ ID NO: 1720189 - protein, 26 aa, Staphylococcus aureus
GDIDMNAFQHFAFLDQYKKAHKGTKI

SEQ ID NO: 1720190 - protein, 25 aa, Staphylococcus aureus
HHGGYDPHVWLDPKINQTFAKEIKD

SEQ ID NO: 1720191 - protein, 20 aa, Staphylococcus aureus
LALGILTTGMITTTAQPVKA

SEQ ID NO: 1720192 - protein, 26 aa, Staphylococcus aureus
NIANPNLIFIGQKLKVPMTPLVEPKP

SEQ ID NO: 1720193 - protein, 20 aa, Staphylococcus aureus
TDQQKAFYQVLHLKGITEEQ

SEQ ID NO: 1720194 - protein, 18 aa, Staphylococcus aureus
VEKNLPGVTLKIKQLPFK

SEQ ID NO: 1720195 - protein, 36 aa, Staphylococcus aureus
ENDNAKLCYIYKFRARFAVLAHLLTQREGLPAKQEV

SEQ ID NO: 1720196 - protein, 27 aa, Staphylococcus aureus
GMKICLMLYLLIFLSSCGTNNKIVGQR

SEQ ID NO: 1720197 - protein, 26 aa, Staphylococcus aureus
QQQFVKKPIPTLFLHGFGGSANSEKF

SEQ ID NO: 1720198 - protein, 19 aa, Staphylococcus aureus
QRVVSYPVNFVAGTIGDFF

SEQ ID NO: 1720199 - protein, 25 aa, Staphylococcus aureus
REELQDFWHHLADDLVKTEKVTDTK

SEQ ID NO: 1720200 - protein, 18 aa, Staphylococcus aureus
RYSIRKVSIGILSISIGM

SEQ ID NO: 1720201 - protein, 19 aa, Staphylococcus aureus
DMETRGMVLYINRNTRTTK

SEQ ID NO: 1720202 - protein, 24 aa, Staphylococcus aureus
EYYVEHLVRDAVGTPLKRCAIVNR

SEQ ID NO: 1720203 - protein, 31 aa, Staphylococcus aureus
IGKSKSEQIYYRALTEYLTSNSNFKDCKDAL

SEQ ID NO: 1720204 - protein, 23 aa, Staphylococcus aureus
KGIVYTPEQLPAKSKWSHAVDQG

SEQ ID NO: 1720205 - protein, 23 aa, Staphylococcus aureus
YEGFTYHFESDGTHFAWNYHATG

SEQ ID NO: 1720206 - protein, 18 aa, Staphylococcus aureus
DKGYLPKAATHDVMIGLF

SEQ ID NO: 1720207 - protein, 25 aa, Staphylococcus aureus
KGNKYSLPYFFGTVGILYNKEKYPN

SEQ ID NO: 1720208 - protein, 21 aa, Staphylococcus aureus
KHKVDVLLGGGAKYFGKSNGN

SEQ ID NO: 1720209 - protein, 25 aa, Staphylococcus aureus
MPSNTEILYELGLGKYIVGVSTVDD

SEQ ID NO: 1720210 - protein, 22 aa, Staphylococcus aureus
RHNGTIINIFDDMSEKDKEEFE

SEQ ID NO: 1720211 - protein, 17 aa, Staphylococcus aureus
SSARQFIGNEPFAVLLG

SEQ ID NO: 1720212 - protein, 17 aa, Staphylococcus aureus
VLVHGFNGFTDDINPSV

SEQ ID NO: 1720213 - protein, 19 aa, Staphylococcus aureus
YARENNVPFFGICLGMQLA

SEQ ID NO: 1720214 - protein, 27 aa, Staphylococcus aureus
ASLKSSKIFVIPEANIPFKESEQAAIV

SEQ ID NO: 1720215 - protein, 25 aa, Staphylococcus aureus
GKARTGWLIVDYAGYPWPGYDDIVS

SEQ ID NO: 1720216 - protein, 19 aa, Staphylococcus aureus
VEDRKYALAYTPEKFYDRK

SEQ ID NO: 1720217 - protein, 21 aa, Staphylococcus aureus
VLMLAVIVFAAACGNSSSLDN

SEQ ID NO: 1720218 - protein, 17 aa, Staphylococcus aureus
EVLVADKNKKVINKKTE

SEQ ID NO: 1720219 - protein, 19 aa, Staphylococcus aureus
KEIKAYLKQVDKIKDDEEP

SEQ ID NO: 1720220 - protein, 18 aa, Staphylococcus aureus
ASHILIKVKSKKSDKEGL

SEQ ID NO: 1720221 - protein, 26 aa, Staphylococcus aureus
EHKESFYYDLFYIKGNLPDQYLQIYN

SEQ ID NO: 1720222 - protein, 19 aa, Staphylococcus aureus
EPFKIYKFNKKSDGNYYFP

SEQ ID NO: 1720223 - protein, 24 aa, Staphylococcus aureus
ESTKKLHLNFENTKIFLQLAKSTI

SEQ ID NO: 1720224 - protein, 27 aa, Staphylococcus aureus
GVCNGFQILTEIGLLPGALLHNDSHLF

SEQ ID NO: 1720225 - protein, 25 aa, Staphylococcus aureus
KGRVGIVPLLNNQAYWFITINSKEN

SEQ ID NO: 1720226 - protein, 20 aa, Staphylococcus aureus
QDPHAWLSLDNGIKYVKTIQ

SEQ ID NO: 1720227 - protein, 34 aa, Staphylococcus aureus
REVSDSMPYPHGQCTWYVYNRMKQFGTSISGDLG

SEQ ID NO: 1720228 - protein, 18 aa, Staphylococcus aureus
SLAVGLGIVAGNAGHEAH

SEQ ID NO: 1720229 - protein, 22 aa, Staphylococcus aureus
VTYILSLHNISISNLRILEVRE

SEQ ID NO: 1720230 - protein, 28 aa, Staphylococcus aureus
WSLEKDDGKLVYNIDLKKGNKKQEVTVD

SEQ ID NO: 1720231 - protein, 23 aa, Staphylococcus aureus
YENEYFYIVANIPTLQEYRKYYE

SEQ ID NO: 1720232 - protein, 25 aa, Staphylococcus aureus
YKKPVELMMNYFKALNSTIANVDED

SEQ ID NO: 1720233 - protein, 18 aa, Staphylococcus aureus
FDGVLIPGGFSFGDYLRS

SEQ ID NO: 1720234 - protein, 18 aa, Staphylococcus aureus
IAFVFILAACGNNSSKDK

SEQ ID NO: 1720235 - protein, 18 aa, Staphylococcus aureus
ILPFHRSLRVANYDNQSY

SEQ ID NO: 1720236 - protein, 30 aa, Staphylococcus aureus
LTLNQLYSYNPGVTPLIFPGDVISLVPQNK

SEQ ID NO: 1720237 - protein, 17 aa, Staphylococcus aureus
NQSYSIKPGTKLYTVPW

SEQ ID NO: 1720238 - protein, 26 aa, Staphylococcus aureus
VVVLEYSFADYLAALDMKPVGIADDG

SEQ ID NO: 1720239 - protein, 26 aa, Staphylococcus aureus
YPGDKPVATMWESKGKITYLKGEAMQ

SEQ ID NO: 1720240 - protein, 21 aa, Staphylococcus aureus
DDVLKEKYKLHSDYAKAYKKA

SEQ ID NO: 1720241 - protein, 23 aa, Staphylococcus aureus
DGKTYTFHLRDDVKFHDGTPFDA

SEQ ID NO: 1720242 - protein, 18 aa, Staphylococcus aureus
DITACTWTSKKWPFTTPE

SEQ ID NO: 1720243 - protein, 22 aa, Staphylococcus aureus
EFEYLVDRKATKRRKLFNGYIE

SEQ ID NO: 1720244 - protein, 26 aa, Staphylococcus aureus
EHNGNYKYVFSFKDPNANGKYSIVTV

SEQ ID NO: 1720245 - protein, 25 aa, Staphylococcus aureus
FGTVRPMQIGLVYDALNSEKLDVAL

SEQ ID NO: 1720246 - protein, 43 aa, Staphylococcus aureus
HADPHGYLRSHNYSYDQLYDLINEKYLIKMGKVAPWGTQSTTT

SEQ ID NO: 1720247 - protein, 20 aa, Staphylococcus aureus
IRKYPIGIGPYKVKKIVPGE

SEQ ID NO: 1720248 - protein, 19 aa, Staphylococcus aureus
LEHELSYIDVLLDKNADQA

SEQ ID NO: 1720249 - protein, 32 aa, Staphylococcus aureus
LILLALVLIVVPIVFATLLFKTSQDAFESSQD

SEQ ID NO: 1720250 - protein, 21 aa, Staphylococcus aureus
MAVMLFLTGCGKSQEKATLEK

SEQ ID NO: 1720251 - protein, 19 aa, Staphylococcus aureus
NAKVIMPVYPKIPHQDYQA

SEQ ID NO: 1720252 - protein, 17 aa, Staphylococcus aureus
NIVVIQPATQVKTDARN

SEQ ID NO: 1720253 - protein, 23 aa, Staphylococcus aureus
SPFNDKIPYIKEPKLTKQNIEQA

SEQ ID NO: 1720254 - protein, 24 aa, Staphylococcus aureus
TLIASALVLTTVGSGFHSSSNYNG

SEQ ID NO: 1720255 - protein, 24 aa, Staphylococcus aureus
TLTAGIGTALVGQAHHADAAENYT

SEQ ID NO: 1720256 - protein, 20 aa, Staphylococcus aureus
YIVLILALVNQFLANKGISP

SEQ ID NO: 1720257 - protein, 26 aa, Staphylococcus aureus
YSIKPGTKLYTVPWGTSKQVAGSVSG

SEQ ID NO: 1720258 - protein, 31 aa, Staphylococcus aureus
DIYVKWQKYMNDELPGLPMFQGKSITIVNDK

SEQ ID NO: 1720259 - protein, 28 aa, Staphylococcus aureus
EDKVYNLDPKLWYFAAGSTTTTIKQIEE

SEQ ID NO: 1720260 - protein, 27 aa, Staphylococcus aureus
EKLGADPMTFLGLGGIGDLIVTCTSTH

SEQ ID NO: 1720261 - protein, 29 aa, Staphylococcus aureus
GKNNLRFKFRGIKIQVLLPGNDKSKFQQR

SEQ ID NO: 1720262 - protein, 23 aa, Staphylococcus aureus
IEAGAYNYTFDYEGFTYHFESDG

SEQ ID NO: 1720263 - protein, 28 aa, Staphylococcus aureus
IMSLNGLNNFFIYPGQKLKVTGNASTNS

SEQ ID NO: 1720264 - protein, 30 aa, Staphylococcus aureus
KELDFKLRQYLIQNFDLYKKFPKDSKIKVI

SEQ ID NO: 1720265 - protein, 22 aa, Staphylococcus aureus
KEMDNWPTYYPSKLNKDQIKEE

SEQ ID NO: 1720266 - protein, 21 aa, Staphylococcus aureus
KIAATKPEVIFISGRTANQKN

SEQ ID NO: 1720267 - protein, 17 aa, Staphylococcus aureus
KRKDIYVKWQKYMNDEL

SEQ ID NO: 1720268 - protein, 21 aa, Staphylococcus aureus
MGIPTDIKPFVTTKLISPLGK

SEQ ID NO: 1720269 - protein, 19 aa, Staphylococcus aureus
NIISKIKPATTVKATALQQ

SEQ ID NO: 1720270 - protein, 24 aa, Staphylococcus aureus
PNDYDFSKLYWGAKYNVSISSQSN

SEQ ID NO: 1720271 - protein, 27 aa, Staphylococcus aureus
SRKISLSNFKDYWQGKPKLDHITVTYQ

SEQ ID NO: 1720272 - protein, 19 aa, Staphylococcus aureus
VLAFLALNNAAHAQQHGTQ

SEQ ID NO: 1720273 - protein, 19 aa, Staphylococcus aureus
VLAVMFLLAACGNNSDKEQ

SEQ ID NO: 1720274 - protein, 24 aa, Staphylococcus aureus
VMQTYTVKPGTKLYSVPWGTYKQE

SEQ ID NO: 1720275 - protein, 19 aa, Staphylococcus aureus
VPFFGICLGMQLATVEFSR

SEQ ID NO: 1720276 - protein, 18 aa, Staphylococcus aureus
VQLVKFDDYWQGKPALDK

SEQ ID NO: 1720277 - protein, 18 aa, Staphylococcus aureus
VVLEYSFADALAALDVKP

SEQ ID NO: 1720278 - protein, 17 aa, Staphylococcus aureus
DHLLLPIDHNKVPNIKN

SEQ ID NO: 1720279 - protein, 17 aa, Staphylococcus aureus
DQLWWSYRETFTGGVTP

SEQ ID NO: 1720280 - protein, 31 aa, Staphylococcus aureus
GLRILDPNGYWNSTLRWPGSYSVSIQNVDDN

SEQ ID NO: 1720281 - protein, 27 aa, Staphylococcus aureus
GYELTKRMIWPFQYNIGLTTKDPNVSL

SEQ ID NO: 1720282 - protein, 18 aa, Staphylococcus aureus
HLFENAYYILVYNEPRNE

SEQ ID NO: 1720283 - protein, 24 aa, Staphylococcus aureus
IASSLSCAILLLSAATTQANSAHK

SEQ ID NO: 1720284 - protein, 25 aa, Staphylococcus aureus
IHATLQTWVWYSHIQVFGSESWGNI

SEQ ID NO: 1720285 - protein, 20 aa, Staphylococcus aureus
ILGLIVALLLVAACGNTDNS

SEQ ID NO: 1720286 - protein, 19 aa, Staphylococcus aureus
ILILIATIALSGCANDDGI

SEQ ID NO: 1720287 - protein, 28 aa, Staphylococcus aureus
INDPVSKYLPWFKTSKPIPLKDLMLHQS

SEQ ID NO: 1720288 - protein, 20 aa, Staphylococcus aureus
KGKITYLKGEAMQYDLSTTG

SEQ ID NO: 1720289 - protein, 18 aa, Staphylococcus aureus
KVGVFSHAMVRTSMFDSG

SEQ ID NO: 1720290 - protein, 20 aa, Staphylococcus aureus
KYSIRKYSIGVVSVLAATMF

SEQ ID NO: 1720291 - protein, 22 aa, Staphylococcus aureus
LNTYYKRTIKISGQKAMYALKS

SEQ ID NO: 1720292 - protein, 18 aa, Staphylococcus aureus
LPAIVETTALFYNKKLVK

SEQ ID NO: 1720293 - protein, 18 aa, Staphylococcus aureus
LPGVTLKIKQLPFKQRVS

SEQ ID NO: 1720294 - protein, 24 aa, Staphylococcus aureus
LPNESYIDYIKRVSKSKIWTSDDN

SEQ ID NO: 1720295 - protein, 25 aa, Staphylococcus aureus
NAINPIAPVTVVKQAARDAVSHDAQ

SEQ ID NO: 1720296 - protein, 24 aa, Staphylococcus aureus
NKTVMYLLVNEGELSTFGPKGRFG

SEQ ID NO: 1720297 - protein, 24 aa, Staphylococcus aureus
NRTKSEIFSLTRNGNLWAKDNFTP

SEQ ID NO: 1720298 - protein, 22 aa, Staphylococcus aureus
QNQKFQVFLLGKDENKYKEKTH

SEQ ID NO: 1720299 - protein, 20 aa, Staphylococcus aureus
SILLIVVLVLSACGKSSNKD

SEQ ID NO: 1720300 - protein, 22 aa, Staphylococcus aureus
TFEEIFREYYYNNPQYQNLFYT

SEQ ID NO: 1720301 - protein, 24 aa, Staphylococcus aureus
TLSNKTYILEMIRQLKSQFQDLER

SEQ ID NO: 1720302 - protein, 28 aa, Staphylococcus aureus
VIHACVLLFIIISIALIFHRLQTKTHSI

SEQ ID NO: 1720303 - protein, 21 aa, Staphylococcus aureus
VNKLRDGYLLSDKKYKDWTEH

SEQ ID NO: 1720304 - protein, 18 aa, Staphylococcus aureus
AGLIKLKKDFGLAGTVKD

SEQ ID NO: 1720305 - protein, 30 aa, Staphylococcus aureus
AKVNKAYDYKYFYSYKVVKGVKKYFSFSQS

SEQ ID NO: 1720306 - protein, 20 aa, Staphylococcus aureus
DAVQFVNKLFNVSSAIILLE

SEQ ID NO: 1720307 - protein, 19 aa, Staphylococcus aureus
DVDAFFKGKKGIKRKVIET

SEQ ID NO: 1720308 - protein, 17 aa, Staphylococcus aureus
FAEQESEAFDLCIGADG

SEQ ID NO: 1720309 - protein, 19 aa, Staphylococcus aureus
KLMKQHPFLSTYILTSNKE

SEQ ID NO: 1720310 - protein, 18 aa, Staphylococcus aureus
LVLTFAVVLAACGNGNKS

SEQ ID NO: 1720311 - protein, 27 aa, Staphylococcus aureus
MDEFKIDWNRHGFWGYWSGENHVDKKE

SEQ ID NO: 1720312 - protein, 25 aa, Staphylococcus aureus
MGPSFNTAYRYYKNDPHAKEMTPTA

SEQ ID NO: 1720313 - protein, 24 aa, Staphylococcus aureus
NAKKTLGIWFVVDHNRVVEVTVGH

SEQ ID NO: 1720314 - protein, 24 aa, Staphylococcus aureus
NHPKYKLELVKFNNWPDLMDALNS

SEQ ID NO: 1720315 - protein, 25 aa, Staphylococcus aureus
NVSTYIIIFLVSSAAFAIFLLSANV

SEQ ID NO: 1720316 - protein, 17 aa, Staphylococcus aureus
PHRYSTHYLLLEELRKQ

SEQ ID NO: 1720317 - protein, 24 aa, Staphylococcus aureus
SNNKYVTSFLLMPTVIVVNSDLQG

SEQ ID NO: 1720318 - protein, 18 aa, Staphylococcus aureus
TAFFCSMYWLIVQLNIAN

SEQ ID NO: 1720319 - protein, 20 aa, Staphylococcus aureus
TNILQNLQFDFIDDPTYDKN

SEQ ID NO: 1720320 - protein, 18 aa, Staphylococcus aureus
VSIGILSISIGMFLALGM

SEQ ID NO: 1720321 - protein, 24 aa, Staphylococcus aureus
VTNNYFGYYSFREAPKTQIYTVKK

SEQ ID NO: 1720322 - protein, 21 aa, Staphylococcus aureus
VVFVLSLTVLSGCSLPGLGSK

SEQ ID NO: 1720323 - protein, 17 aa, Staphylococcus aureus
VYALAAGSLNPYYKRTI

SEQ ID NO: 1720324 - protein, 18 aa, Staphylococcus aureus
YISFIQPSIKFMNIIDGN

SEQ ID NO: 1720325 - protein, 21 aa, Staphylococcus aureus
ALILKMQGFISSRTTYYNYKK

SEQ ID NO: 1720326 - protein, 27 aa, Staphylococcus aureus
DNGTIHATLLQFSWYSHIQVYGPESWG

SEQ ID NO: 1720327 - protein, 18 aa, Staphylococcus aureus
DVFAVPELIDIKGGIYSV

SEQ ID NO: 1720328 - protein, 18 aa, Staphylococcus aureus
GISDLDLKFAKQAKYTVY

SEQ ID NO: 1720329 - protein, 18 aa, Staphylococcus aureus
IILLEYDGVVHIGYDNNF

SEQ ID NO: 1720330 - protein, 17 aa, Staphylococcus aureus
IVRGVTTWTAGLESPGH

SEQ ID NO: 1720331 - protein, 17 aa, Staphylococcus aureus
IYSIKKIINYPGKEDVS

SEQ ID NO: 1720332 - protein, 18 aa, Staphylococcus aureus
KDNKGLNFVLTTGTFFVK

SEQ ID NO: 1720333 - protein, 18 aa, Staphylococcus aureus
LIQSGFNPSFITTLSHER

SEQ ID NO: 1720334 - protein, 17 aa, Staphylococcus aureus
LMLAIILAGCSNKGEKY

SEQ ID NO: 1720335 - protein, 18 aa, Staphylococcus aureus
LVQSGFNPSFITTLSHEK

SEQ ID NO: 1720336 - protein, 28 aa, Staphylococcus aureus
NAGQNFLPTHQMPLLARGNFNPEFISVL

SEQ ID NO: 1720337 - protein, 25 aa, Staphylococcus aureus
QENKKLHSWLKISTLIDNVKVKDKY

SEQ ID NO: 1720338 - protein, 24 aa, Staphylococcus aureus
QIELEKPVPYINQLLALNTFAPQN

SEQ ID NO: 1720339 - protein, 33 aa, Staphylococcus aureus
QNDTTLKSWIDDGFMPLIYKGEMMDLSRGRAIS

SEQ ID NO: 1720340 - protein, 17 aa, Staphylococcus aureus
QNFIAQHQMPLLSRSNF

SEQ ID NO: 1720341 - protein, 27 aa, Staphylococcus aureus
QQADYTFASLDIFNDLKRRAQTILDEN

SEQ ID NO: 1720342 - protein, 17 aa, Staphylococcus aureus
RAYNEKGWLNESGAKYP

SEQ ID NO: 1720343 - protein, 18 aa, Staphylococcus aureus
RGVTTWTAGLESPGHSHL

SEQ ID NO: 1720344 - protein, 24 aa, Staphylococcus aureus
SSDKPYRLFLKYSDKQQTIIGGHE

SEQ ID NO: 1720345 - protein, 27 aa, Staphylococcus aureus
SSDWLSTNFGVRFRYNALGDLNTSNIV

SEQ ID NO: 1720346 - protein, 17 aa, Staphylococcus aureus
SVATSMALLLLSGTANA

SEQ ID NO: 1720347 - protein, 20 aa, Staphylococcus aureus
SYVAPYYGQNAAPVARQIYP

SEQ ID NO: 1720348 - protein, 27 aa, Staphylococcus aureus
TKAMPKEMLPILDKPTIQYIVEEAARA

SEQ ID NO: 1720349 - protein, 22 aa, Staphylococcus aureus
TMGVICATQLWHSNHANALVTE

SEQ ID NO: 1720350 - protein, 26 aa, Staphylococcus aureus
VTDKVNGYSLINNGKIGFVNSELRRS

SEQ ID NO: 1720351 - protein, 22 aa, Staphylococcus aureus
YVYDKDKIIILAYKPLSNDDEV

SEQ ID NO: 1720352 - protein, 24 aa, Staphylococcus aureus
ELDYKARHWLTKEKKLYEFDGSAF

SEQ ID NO: 1720353 - protein, 22 aa, Staphylococcus aureus
GGAPVAITAPYTPTTDPNANNA

SEQ ID NO: 1720354 - protein, 19 aa, Staphylococcus aureus
IALSLIFSLSVTPIANAES

SEQ ID NO: 1720355 - protein, 20 aa, Staphylococcus aureus
IFPYTGVVAFKSATGFVVGK

SEQ ID NO: 1720356 - protein, 17 aa, Staphylococcus aureus
IILTTTLLLLGTVLPQN

SEQ ID NO: 1720357 - protein, 27 aa, Staphylococcus aureus
LKELDFKIRKLLIKKYKLYEGSADKGR

SEQ ID NO: 1720358 - protein, 17 aa, Staphylococcus aureus
MLTNYKSSKGPDLYVYL

SEQ ID NO: 1720359 - protein, 20 aa, Staphylococcus aureus
NFKYSDAIDYKKAIKEGQKE

SEQ ID NO: 1720360 - protein, 18 aa, Staphylococcus aureus
RLLIAFAVLFSADFTYQS

SEQ ID NO: 1720361 - protein, 26 aa, Staphylococcus aureus
RQRVLRAIEYYLKTKKLLSNRKKVQQ

SEQ ID NO: 1720362 - protein, 30 aa, Staphylococcus aureus; identical to SEQ ID NO: 1700042

SEQ ID NO: 1720363 - protein, 17 aa, Staphylococcus aureus
SSVASSIALLLLSNTVD

SEQ ID NO: 1720364 - protein, 18 aa, Staphylococcus aureus
TFLASTLILTGCASDQSD

SEQ ID NO: 1720365 - protein, 17 aa, Staphylococcus aureus
TGDYNFPKKPFKYGIHY

SEQ ID NO: 1720366 - protein, 24 aa, Staphylococcus aureus
AGERIKVIGYPHPYKNKYVLYEST

SEQ ID NO: 1720367 - protein, 21 aa, Staphylococcus aureus
AQYRSRLFVAVRNRIMKMMPN

SEQ ID NO: 1720368 - protein, 28 aa, Staphylococcus aureus
EPWSQPPSGYKWYDPTTFKAGSYGSEKG

SEQ ID NO: 1720369 - protein, 24 aa, Staphylococcus aureus
IDKSIYLFGTVNGKSGWVSKAYLA

SEQ ID NO: 1720370 - protein, 22 aa, Staphylococcus aureus
IKINHFCVVPQINSFKVIPPYG

SEQ ID NO: 1720371 - protein, 25 aa, Staphylococcus aureus
INNEDTFMGQFLIKMGIQPEVTKDK

SEQ ID NO: 1720372 - protein, 19 aa, Staphylococcus aureus
KEHPLKIKLITYDGRPELS

SEQ ID NO: 1720373 - protein, 26 aa, Staphylococcus aureus
KELRKAMLYAIDREKWIKAFFNGYAS

SEQ ID NO: 1720374 - protein, 20 aa, Staphylococcus aureus
KVLNLVHMDFLNASSDFGNA

SEQ ID NO: 1720375 - protein, 28 aa, Staphylococcus aureus
LDYRLRERAIKQHGLYSNGLKQGQITIT

SEQ ID NO: 1720376 - protein, 23 aa, Staphylococcus aureus
NTPKVGAIMQTTQGYYGHVAYVE

SEQ ID NO: 1720377 - protein, 25 aa, Staphylococcus aureus
NYEDYIELRQLRYIYDVYFDHDDRI

SEQ ID NO: 1720378 - protein, 20 aa, Staphylococcus aureus
QAAITPYYTYNGYIGNNANF

SEQ ID NO: 1720379 - protein, 17 aa, Staphylococcus aureus
QDILKNRPGIHYAPPIL

SEQ ID NO: 1720380 - protein, 23 aa, Staphylococcus aureus
QTIRLMEEFLRNGNKEEIAYHKA

SEQ ID NO: 1720381 - protein, 21 aa, Staphylococcus aureus
SIKDVLTKYKNPMYSYNEDGT

SEQ ID NO: 1720382 - protein, 20 aa, Staphylococcus aureus
SLNLQTIHDLDVHPIKKPDA

SEQ ID NO: 1720383 - protein, 24 aa, Staphylococcus aureus
VLGIIFLFLVISITAGCGIGKEAE

SEQ ID NO: 1720384 - protein, 18 aa, Staphylococcus aureus
VLLFCYSQNHIATADVGV

SEQ ID NO: 1720385 - protein, 22 aa, Staphylococcus aureus
ASSIALLLLSNTVDAAQHITPV

SEQ ID NO: 1720386 - protein, 22 aa, Staphylococcus aureus
DETEFWKWYKQQTDFNFDEPAY

SEQ ID NO: 1720387 - protein, 27 aa, Staphylococcus aureus
DFGKKYIIFPNPMYGSWEATIYNNNYK

SEQ ID NO: 1720388 - protein, 17 aa, Staphylococcus aureus
IGMFLALGMSNKAYADE

SEQ ID NO: 1720389 - protein, 18 aa, Staphylococcus aureus
ITLSLSLLTACGANQHKE

SEQ ID NO: 1720390 - protein, 23 aa, Staphylococcus aureus
KKEYKFPVINARNFLTGIGIEET

SEQ ID NO: 1720391 - protein, 25 aa, Staphylococcus aureus
KNAAKDLVLKAKEKAYQDILNAQTT

SEQ ID NO: 1720392 - protein, 23 aa, Staphylococcus aureus
LKEIDFKLRKYLIDNYGLYGEMS

SEQ ID NO: 1720393 - protein, 23 aa, Staphylococcus aureus
LTGFILILLLEGIFTNSASAIEY

SEQ ID NO: 1720394 - protein, 24 aa, Staphylococcus aureus
NAGLKVLSAPSLDYGLIGFVSHDY

SEQ ID NO: 1720395 - protein, 26 aa, Staphylococcus aureus
NEKIQKLLAFQTLYIGIDPKRGPSLY

SEQ ID NO: 1720396 - protein, 24 aa, Staphylococcus aureus
NQLYSINAGFRKYPSTKESLKDYS

SEQ ID NO: 1720397 - protein, 22 aa, Staphylococcus aureus
RYSTHYLLLEELRKQLKIKPGH

SEQ ID NO: 1720398 - protein, 25 aa, Staphylococcus aureus
VNVKPDSELIINFTTMQTNSKQGAT

SEQ ID NO: 1720399 - protein, 30 aa, Staphylococcus aureus
ELIKYYTQPHFSLSGKWLWQKPNGSIHATL

SEQ ID NO: 1720400 - protein, 17 aa, Staphylococcus aureus
EQRAGVDANYYAKQTYD

SEQ ID NO: 1720401 - protein, 23 aa, Staphylococcus aureus
ETVNDLYLIVKKLSQGDVKKAVV

SEQ ID NO: 1720402 - protein, 17 aa, Staphylococcus aureus
FDLTRPLEENRKNIKVV

SEQ ID NO: 1720403 - protein, 34 aa, Staphylococcus aureus
FNFDEPAYLPRFVFGHYMKSYLSMFTKKYPNIST

SEQ ID NO: 1720404 - protein, 28 aa, Staphylococcus aureus
IRKNGRKSVFLMLNIKKGIFKTHPNLRQ

SEQ ID NO: 1720405 - protein, 20 aa, Staphylococcus aureus
KKLRDIYPITTKKAPILKLH

SEQ ID NO: 1720406 - protein, 25 aa, Staphylococcus aureus
KTNHVKAMRWPFQYNIGLKTNDKYV

SEQ ID NO: 1720407 - protein, 27 aa, Staphylococcus aureus
LKYAKKAYYTVYFKNGGKRILQLNSKN

SEQ ID NO: 1720408 - protein, 21 aa, Staphylococcus aureus
NVELLGKMYKTYFFKKGESKS

SEQ ID NO: 1720409 - protein, 18 aa, Staphylococcus aureus
NVTPFKYAAGAKAGERIK

SEQ ID NO: 1720410 - protein, 33 aa, Staphylococcus aureus; identical to SEQ ID NO: 1690513

SEQ ID NO: 1720411 - protein, 18 aa, Staphylococcus aureus
TEEKEAFTNALEDILSKA

SEQ ID NO: 1720412 - protein, 20 aa, Staphylococcus aureus
TKYHNVFGIAAYDNDPLREG

SEQ ID NO: 1720413 - protein, 25 aa, Staphylococcus aureus
VLTTGTFFVKMNEKQYPDFKNKNLR

SEQ ID NO: 1720414 - protein, 34 aa, Staphylococcus aureus; identical to SEQ ID NO: 1685634

SEQ ID NO: 1720415 - protein, 18 aa, Staphylococcus aureus
AYDYVFLTCGTFAYHDPY

SEQ ID NO: 1720416 - protein, 17 aa, Staphylococcus aureus
ELYLSKRLAEIHTQVPI

SEQ ID NO: 1720417 - protein, 23 aa, Staphylococcus aureus
ESTRGFAVYFSPEIKKFIADNLD

SEQ ID NO: 1720418 - protein, 17 aa, Staphylococcus aureus
FMAIYDTDAKSDVNQTP

SEQ ID NO: 1720419 - protein, 17 aa, Staphylococcus aureus
GALAVASSLFTWDNKAD

SEQ ID NO: 1720420 - protein, 25 aa, Staphylococcus aureus
IDGLVTKLQAALIDNQAAIAELDTK

SEQ ID NO: 1720421 - protein, 24 aa, Staphylococcus aureus
NKADALKAITALKLQMDEELKTAR

SEQ ID NO: 1720422 - protein, 20 aa, Staphylococcus aureus
NYTYVIKNGNGYYYVTPNSD

SEQ ID NO: 1720423 - protein, 27 aa, Staphylococcus aureus
QQTYAKFKAIATPEQLAKVKVLIDQYV

SEQ ID NO: 1720424 - protein, 26 aa, Staphylococcus aureus
RISIVGYPEPYINKFQMYESTGKVLS

SEQ ID NO: 1720425 - protein, 19 aa, Staphylococcus aureus
SIAALTILTSITGVGTTVV

SEQ ID NO: 1720426 - protein, 19 aa, Staphylococcus aureus
SINTTLTFDDPAISTDENR

SEQ ID NO: 1720427 - protein, 25 aa, Staphylococcus aureus
TDGNDNIKVILPKVQVKPAARQSVG

SEQ ID NO: 1720428 - protein, 24 aa, Staphylococcus aureus
TTNEATIAAITPDANVKPAAKQAI

SEQ ID NO: 1720429 - protein, 18 aa, Staphylococcus aureus
VETNGIATLKGVQPHIVI

SEQ ID NO: 1720430 - protein, 29 aa, Staphylococcus aureus
ALEAIREVVNKQIEIIKNADADASAKEIA

SEQ ID NO: 1720431 - protein, 27 aa, Staphylococcus aureus
DKHLPDMDVIISAPFYPAYMTRERIEK

SEQ ID NO: 1720432 - protein, 18 aa, Staphylococcus aureus
ENERISIVGYPEPYINKF

SEQ ID NO: 1720433 - protein, 17 aa, Staphylococcus aureus
FFSYEWKGLEIAKNLAD

SEQ ID NO: 1720434 - protein, 29 aa, Staphylococcus aureus
FVDAQGHTHYFYNCYPKNANANGSGQTYV

SEQ ID NO: 1720435 - protein, 24 aa, Staphylococcus aureus
GKTYKGIMPNWEPGKKVHLVGHSM

SEQ ID NO: 1720436 - protein, 27 aa, Staphylococcus aureus
GNKYSNIDLGLTQWGFKQLPNESYIDY

SEQ ID NO: 1720437 - protein, 18 aa, Staphylococcus aureus
ILAQLQNIYDTAIGQIDQ

SEQ ID NO: 1720438 - protein, 22 aa, Staphylococcus aureus
KEYKFPVINARNFLTGIGIEET

SEQ ID NO: 1720439 - protein, 20 aa, Staphylococcus aureus
KGQSEPIVLVIFTNKDNKSD

SEQ ID NO: 1720440 - protein, 28 aa, Staphylococcus aureus
NQDNGYYSYYYYNGYNNYNNYNNGYSYN

SEQ ID NO: 1720441 - protein, 21 aa, Staphylococcus aureus
NTKYHNVFGIAAYDNDPLREG

SEQ ID NO: 1720442 - protein, 17 aa, Staphylococcus aureus
NYDTLLLGIEMSRKTLY

SEQ ID NO: 1720443 - protein, 25 aa, Staphylococcus aureus
QAKQDIIQAVTTRKQQIKKSNASLQ

SEQ ID NO: 1720444 - protein, 47 aa, Staphylococcus aureus; identical to SEQ ID NO: 1685942

SEQ ID NO: 1720445 - protein, 18 aa, Staphylococcus aureus
SSAIILLEYDGVVHIGYD

SEQ ID NO: 1720446 - protein, 22 aa, Staphylococcus aureus
SVAEHAVMDLLILLRNYEEGHR

SEQ ID NO: 1720447 - protein, 21 aa, Staphylococcus aureus
TSLALGLLTTGAITVTTQSVK

SEQ ID NO: 1720448 - protein, 18 aa, Staphylococcus aureus
TSLALGLLTTGVITTTTQ

SEQ ID NO: 1720449 - protein, 20 aa, Staphylococcus aureus
VDAVLKRFNVALSDIEAVIT

SEQ ID NO: 1720450 - protein, 26 aa, Staphylococcus aureus
VGDNAPALYPNYWGGNKFKVIEELRK

SEQ ID NO: 1720451 - protein, 21 aa, Staphylococcus aureus
DNFKYSDAIDYKKAIKEGQKE

SEQ ID NO: 1720452 - protein, 24 aa, Staphylococcus aureus
EEKTEALAMIKQITDQAKQGITDA

SEQ ID NO: 1720453 - protein, 18 aa, Staphylococcus aureus
IEFKIKKGIKWHDGNELK

SEQ ID NO: 1720454 - protein, 18 aa, Staphylococcus aureus
KRYLFIEYIPDNVLNCKP

SEQ ID NO: 1720455 - protein, 25 aa, Staphylococcus aureus
PEEVGKLVVFLASDESSFITGETIR

SEQ ID NO: 1720456 - protein, 33 aa, Staphylococcus aureus
PELSFASKYRYPALVRSGFNPEFLTYLSNEKSN

SEQ ID NO: 1720457 - protein, 17 aa, Staphylococcus aureus
QPKGRKFKDFTSKFNIA

SEQ ID NO: 1720458 - protein, 27 aa, Staphylococcus aureus
SINTGKVLYTFYQNPTLVKTAIKAQET

SEQ ID NO: 1720459 - protein, 26 aa, Staphylococcus aureus
TEAVRKIMFALNRFMGNKYSNIDLGL

SEQ ID NO: 1720460 - protein, 17 aa, Staphylococcus aureus
YNNPQYQNLFYTGSNAN

SEQ ID NO: 1720461 - protein, 18 aa, Staphylococcus aureus
YYNNPQYQNLFYTGSNAN

SEQ ID NO: 1720462 - protein, 20 aa, Staphylococcus aureus
AIKDFWEKVGLKTNVKLVEF

SEQ ID NO: 1720463 - protein, 28 aa, Staphylococcus aureus
DDFGKKYIIFPNPMYGSWEATIYNNNYK

SEQ ID NO: 1720464 - protein, 19 aa, Staphylococcus aureus
ESEKNFGVYFTPQLKEFIQ

SEQ ID NO: 1720465 - protein, 21 aa, Staphylococcus aureus
ETEFWKWYKQQTDFNFDEPAY

SEQ ID NO: 1720466 - protein, 26 aa, Staphylococcus aureus
HTNQTGIKKGWLYGYSEIDSSHFTDR

SEQ ID NO: 1720467 - protein, 21 aa, Staphylococcus aureus
IGMAITLKDFGITDVIILEKG

SEQ ID NO: 1720468 - protein, 29 aa, Staphylococcus aureus
IRKNGRKSVFLMLNIKKGIFKTHPNLRQA

SEQ ID NO: 1720469 - protein, 27 aa, Staphylococcus aureus
KATARNEITAILNNKLQEIQATPDATD

SEQ ID NO: 1720470 - protein, 30 aa, Staphylococcus aureus; identical to SEQ ID NO: 1690228

SEQ ID NO: 1720471 - protein, 24 aa, Staphylococcus aureus
KHYRDNFWATADMKRLAGTTTLEN

SEQ ID NO: 1720472 - protein, 23 aa, Staphylococcus aureus
KNVDMPITNALYRVLFENISVKE

SEQ ID NO: 1720473 - protein, 20 aa, Staphylococcus aureus
KTIGIFGFGRIGQLVAERLA

SEQ ID NO: 1720474 - protein, 33 aa, Staphylococcus aureus
MNVDMRGTFLMTKMMLPLMMTKGGSIVNTSSFS

SEQ ID NO: 1720475 - protein, 23 aa, Staphylococcus aureus
NAQPEVTLTADPFSVAVEMNKDA

SEQ ID NO: 1720476 - protein, 24 aa, Staphylococcus aureus
NDDLARVTALVQNYRKVSNRNKAD

SEQ ID NO: 1720477 - protein, 43 aa, Staphylococcus aureus
TVNVAKTGTAHLFKVPTDADRLDLQFIPDNTAVADASRITTNK

SEQ ID NO: 1720478 - protein, 19 aa, Staphylococcus aureus
AIFVLGILTTSVMITENQS

SEQ ID NO: 1720479 - protein, 18 aa, Staphylococcus aureus
DYFVPDSELPPLVQSGFN

SEQ ID NO: 1720480 - protein, 20 aa, Staphylococcus aureus
EGYLKDRSAWDATMYSFGTI

SEQ ID NO: 1720481 - protein, 18 aa, Staphylococcus aureus
FAEQESEAFDLCIGADGI

SEQ ID NO: 1720482 - protein, 19 aa, Staphylococcus aureus
FRENQKWMTPLGRLGKPEE

SEQ ID NO: 1720483 - protein, 26 aa, Staphylococcus aureus
HSGNLYTAGQCTWYVYDKVGGEIGST

SEQ ID NO: 1720484 - protein, 25 aa, Staphylococcus aureus
INAVKTFSEYKKDALAKIEDAYNAK

SEQ ID NO: 1720485 - protein, 19 aa, Staphylococcus aureus
IVMALFLVLAGCSNSNDNN

SEQ ID NO: 1720486 - protein, 19 aa, Staphylococcus aureus
KENKKFLLDLMLNNKSGDT

SEQ ID NO: 1720487 - protein, 20 aa, Staphylococcus aureus
KNIPLIPKSKLPDIPHHKFL

SEQ ID NO: 1720488 - protein, 29 aa, Staphylococcus aureus
KQHTQFIVDEILAIKLPAEATKVSPKEIQ

SEQ ID NO: 1720489 - protein, 23 aa, Staphylococcus aureus
KTQALQQLPNFQTALNAANNEAN

SEQ ID NO: 1720490 - protein, 25 aa, Staphylococcus aureus
QLGTKAINAIQPNIVKKPAALAQIN

SEQ ID NO: 1720491 - protein, 24 aa, Staphylococcus aureus
SEKLLSFFAQAKSYRDALPAKQLG

SEQ ID NO: 1720492 - protein, 18 aa, Staphylococcus aureus
TFLASALILTGCASDQSD

SEQ ID NO: 1720493 - protein, 28 aa, Staphylococcus aureus
VIIVLIGALGFAIYAAINHSTSSSNNQE

SEQ ID NO: 1720494 - protein, 21 aa, Staphylococcus aureus
ALSTTVLAPLGIYSDKIKDVK

SEQ ID NO: 1720495 - protein, 29 aa, Staphylococcus aureus
DFKIRKMLVEKYRLYKGASDKGRIVINMK

SEQ ID NO: 1720496 - protein, 20 aa, Staphylococcus aureus
EAFTNALEDILSKATEDISD

SEQ ID NO: 1720497 - protein, 22 aa, Staphylococcus aureus
EGDLAIVKFSPNEQNKHIGEVV

SEQ ID NO: 1720498 - protein, 27 aa, Staphylococcus aureus
GITALHRTYFVFPENKKVLYQEIDSKV

SEQ ID NO: 1720499 - protein, 32 aa, Staphylococcus aureus
INGQTWYYGKLSNGKLAWIKSTDLAKELIKYN

SEQ ID NO: 1720500 - protein, 20 aa, Staphylococcus aureus
IVRGVTTWTAGLESPGHSHL

SEQ ID NO: 1720501 - protein, 27 aa, Staphylococcus aureus
KAIEQIKPKVRRKRAALDSIEENNKNQ

SEQ ID NO: 1720502 - protein, 28 aa, Staphylococcus aureus
KSSDWLSTNFGVRFRYNALGDLNTSNIV

SEQ ID NO: 1720503 - protein, 18 aa, Staphylococcus aureus
LISYKYLNDKVKSVLKSE

SEQ ID NO: 1720504 - protein, 17 aa, Staphylococcus aureus
LNCKPDFWKTLKYKKDK

SEQ ID NO: 1720505 - protein, 17 aa, Staphylococcus aureus
MAGVITLNGGEFRSIDK

SEQ ID NO: 1720506 - protein, 24 aa, Staphylococcus aureus
NSARKIPINLWVNGKHKTISTDKI

SEQ ID NO: 1720507 - protein, 19 aa, Staphylococcus aureus
RDYFVPDSELPPLVQSGFN

SEQ ID NO: 1720508 - protein, 20 aa, Staphylococcus aureus
RVNTLKNRALTDIGVTSTTA

SEQ ID NO: 1720509 - protein, 17 aa, Staphylococcus aureus
SFSDVFGYFVDDEDFLM

SEQ ID NO: 1720510 - protein, 17 aa, Staphylococcus aureus
SGKDLNISLPLKTKSIA

SEQ ID NO: 1720511 - protein, 34 aa, Staphylococcus aureus
DFDGSYGWQCFDLVNVYWNHLYGHGLKGYGAKDI

SEQ ID NO: 1720512 - protein, 24 aa, Staphylococcus aureus
FTSMATVTLLSSLTPAALASDTNH

SEQ ID NO: 1720513 - protein, 18 aa, Staphylococcus aureus
GIPHHLIDILNPDDTFSA

SEQ ID NO: 1720514 - protein, 25 aa, Staphylococcus aureus
GNKLYSINAGFRKYPSTKESLKDYS

SEQ ID NO: 1720515 - protein, 28 aa, Staphylococcus aureus
GVWMPINEKGYFDFDFKKNPFDNLELKK

SEQ ID NO: 1720516 - protein, 27 aa, Staphylococcus aureus
GYENPDLGTFFLMDTTSRIIGHDAREE

SEQ ID NO: 1720517 - protein, 24 aa, Staphylococcus aureus
IKKIHEPFVIYDGITNGALYHRLK

SEQ ID NO: 1720518 - protein, 17 aa, Staphylococcus aureus
INRVNTLKNRALTDIGV

SEQ ID NO: 1720519 - protein, 29 aa, Staphylococcus aureus
KEPWSQPPSGYKWYDPTTFKAGSYGSEKG

SEQ ID NO: 1720520 - protein, 18 aa, Staphylococcus aureus
KRGEQFFMDNFGLKVKAT

SEQ ID NO: 1720521 - protein, 19 aa, Staphylococcus aureus
KRGEQFFMDNFGLKVKATN

SEQ ID NO: 1720522 - protein, 19 aa, Staphylococcus aureus
LFLLAMYELGKYVTEQVYI

SEQ ID NO: 1720523 - protein, 18 aa, Staphylococcus aureus
LNISLPLKTKSIAPYETD

SEQ ID NO: 1720524 - protein, 18 aa, Staphylococcus aureus
LVLTFAVVLAACGNGSKS

SEQ ID NO: 1720525 - protein, 17 aa, Staphylococcus aureus
PAIVETTALFYNKKLVK

SEQ ID NO: 1720526 - protein, 28 aa, Staphylococcus aureus
QPDESIYDVVFLFPKSMQLKEVMEAMKP

SEQ ID NO: 1720527 - protein, 28 aa, Staphylococcus aureus
RQRVLRAIEYYFKTKKLLSNRKKVQQFT

SEQ ID NO: 1720528 - protein, 23 aa, Staphylococcus aureus
TPKAGAIMQTTQGYYGHVAYVEG

SEQ ID NO: 1720529 - protein, 18 aa, Staphylococcus aureus
TTLLAVAIIIGSIITVVF

SEQ ID NO: 1720530 - protein, 18 aa, Staphylococcus aureus
VSSVLAFLALNNAAHAQQ

SEQ ID NO: 1720531 - protein, 21 aa, Staphylococcus aureus
VVLVLSLTVLSGCSLPGLGSK

SEQ ID NO: 1720532 - protein, 26 aa, Staphylococcus aureus
YAKQTYDYYKNTFGRESYDNHGSPIV

SEQ ID NO: 1720533 - protein, 19 aa, Staphylococcus aureus
YVAPYYGQNAAPVARQIYP

SEQ ID NO: 1720534 - protein, 24 aa, Staphylococcus aureus
DEDTSQLWWVYRDTFTGGVTPAAS

SEQ ID NO: 1720535 - protein, 24 aa, Staphylococcus aureus
DRVKSEIFSLTRNGNLWAKDNFTP

SEQ ID NO: 1720536 - protein, 17 aa, Staphylococcus aureus
FFAEAKSYRDALPAKQL

SEQ ID NO: 1720537 - protein, 37 aa, Staphylococcus aureus
GNSPARLMPDKILDLKYKLRVNNVPTPRTVTFNDTLT

SEQ ID NO: 1720538 - protein, 21 aa, Staphylococcus aureus
HNRIIHSELLRFAGIGESKVE

SEQ ID NO: 1720539 - protein, 23 aa, Staphylococcus aureus
HPKYKLELVKFNNWPDLMDALNS

SEQ ID NO: 1720540 - protein, 20 aa, Staphylococcus aureus
ICVKSCSLLFMLNGNPKPEQ

SEQ ID NO: 1720541 - protein, 24 aa, Staphylococcus aureus
IEAGAYNYTFDYEGFTYHFESDGT

SEQ ID NO: 1720542 - protein, 25 aa, Staphylococcus aureus
IEHLKENLNWIWNSLSIEDQHQFNQ

SEQ ID NO: 1720543 - protein, 20 aa, Staphylococcus aureus
ILGLIVALFLVAACGNTDNS

SEQ ID NO: 1720544 - protein, 26 aa, Staphylococcus aureus
ITALHRTYFVFPENKKVLYQEIDSKV

SEQ ID NO: 1720545 - protein, 19 aa, Staphylococcus aureus
IVMALFLVLAGCSNSNDNQ

SEQ ID NO: 1720546 - protein, 20 aa, Staphylococcus aureus
KLMKQHPFLSTYILTSNKEF

SEQ ID NO: 1720547 - protein, 17 aa, Staphylococcus aureus
KSRPYVVTTLFSTKDNF

SEQ ID NO: 1720548 - protein, 20 aa, Staphylococcus aureus
NVPFFGICLGMQLATVEFSR

SEQ ID NO: 1720549 - protein, 21 aa, Staphylococcus aureus
QPKGRKFKDFTSKFNIASEAK

SEQ ID NO: 1720550 - protein, 18 aa, Staphylococcus aureus
SELANPFMAIYDTDAKSD

SEQ ID NO: 1720551 - protein, 29 aa, Staphylococcus aureus
VIILLIGALGFAIYAAINHSTSSNHNNEQ

SEQ ID NO: 1720552 - protein, 28 aa, Staphylococcus aureus
VKSVLYFNRGISDIDLRLSKQAKYTVHF

SEQ ID NO: 1720553 - protein, 26 aa, Staphylococcus aureus
AIQYADIYLMALPTKAMREVATQIND

SEQ ID NO: 1720554 - protein, 22 aa, Staphylococcus aureus
ALILKMQGFISSRTTYYNYKNT

SEQ ID NO: 1720555 - protein, 26 aa, Staphylococcus aureus
DHGIVFNASLPLYKDAIHQKGSMRSN

SEQ ID NO: 1720556 - protein, 27 aa, Staphylococcus aureus
DNEKIQKLLAFQTLYIGIDPKRGPSLY

SEQ ID NO: 1720557 - protein, 28 aa, Staphylococcus aureus
EDKVYNLDPKLWYFAAGSTTTTIKQIDE

SEQ ID NO: 1720558 - protein, 19 aa, Staphylococcus aureus
EEFEAFKKRSPKYNPGMND

SEQ ID NO: 1720559 - protein, 19 aa, Staphylococcus aureus
EGYLKDRSAWDATMYSFGT

SEQ ID NO: 1720560 - protein, 32 aa, Staphylococcus aureus
EKNNTSFWFDLFPKKELVPFVPYKFLNIYGDN

SEQ ID NO: 1720561 - protein, 33 aa, Staphylococcus aureus
EKNNTSFWFDLFPKKELVPFVPYKFLNIYGDNK

SEQ ID NO: 1720562 - protein, 33 aa, Staphylococcus aureus; identical to SEQ ID NO: 1687992

SEQ ID NO: 1720563 - protein, 18 aa, Staphylococcus aureus
FLSHDLIFPIEYKSYNEV

SEQ ID NO: 1720564 - protein, 19 aa, Staphylococcus aureus
FLSHDLIFPIEYKSYNEVK

SEQ ID NO: 1720565 - protein, 19 aa, Staphylococcus aureus
FNLTSYYTDITWQLDESNK

SEQ ID NO: 1720566 - protein, 24 aa, Staphylococcus aureus
IHATLQTWVWYTHIQVFGPESWGN

SEQ ID NO: 1720567 - protein, 17 aa, Staphylococcus aureus
IILILEIVFHNMNYVNA

SEQ ID NO: 1720568 - protein, 23 aa, Staphylococcus aureus
ILVFILFFNIKDLSYAQGDIGVG

SEQ ID NO: 1720569 - protein, 23 aa, Staphylococcus aureus
ILVFILLFNIKDLTYAQGDIGVG

SEQ ID NO: 1720570 - protein, 24 aa, Staphylococcus aureus
INHNRIIHSELLRFAGIGESKVET

SEQ ID NO: 1720571 - protein, 17 aa, Staphylococcus aureus
IPGGFSFGDYLRSGAMA

SEQ ID NO: 1720572 - protein, 22 aa, Staphylococcus aureus
KIAATKPEVIFISGRTANQKNL

SEQ ID NO: 1720573 - protein, 18 aa, Staphylococcus aureus
NVFPYHGVVAFKDATGFV

SEQ ID NO: 1720574 - protein, 24 aa, Staphylococcus aureus
QEYRKYYEPLIKKNNLNFKKGMKQ

SEQ ID NO: 1720575 - protein, 24 aa, Staphylococcus aureus
QNAPNEVLSFDDNGIRPSTNRSVP

SEQ ID NO: 1720576 - protein, 22 aa, Staphylococcus aureus
SKYDEVTIYCKKAHVIFGGAKL

SEQ ID NO: 1720577 - protein, 21 aa, Staphylococcus aureus
SSAIILLEYDGVVHIGYDNNL

SEQ ID NO: 1720578 - protein, 18 aa, Staphylococcus aureus
TGDYNFPKKPFKYGIHYS

SEQ ID NO: 1720579 - protein, 17 aa, Staphylococcus aureus
TTALFYNKKLVKNAPQT

SEQ ID NO: 1720580 - protein, 21 aa, Staphylococcus aureus
YNYTYVIKNGNGYYYVTPNSD

SEQ ID NO: 1720581 - protein, 23 aa, Staphylococcus aureus
ASIRIHHFCAVPQINSFKVIPSY

SEQ ID NO: 1720582 - protein, 17 aa, Staphylococcus aureus
ATLFPRTGIYAERKHNA

SEQ ID NO: 1720583 - protein, 18 aa, Staphylococcus aureus
AYYTKPSLEFKNEIGIIL

SEQ ID NO: 1720584 - protein, 19 aa, Staphylococcus aureus
DLNISLPLKTKSIAPYETD

SEQ ID NO: 1720585 - protein, 24 aa, Staphylococcus aureus
DSDNQPILYLISKESHIKTSVTEF

SEQ ID NO: 1720586 - protein, 22 aa, Staphylococcus aureus
DTISYIPKVGYYDKITHAHAYG

SEQ ID NO: 1720587 - protein, 20 aa, Staphylococcus aureus
DVLKEKYKLHGEYAKAYKKA

SEQ ID NO: 1720588 - protein, 26 aa, Staphylococcus aureus
EHNGNYKYVFSFKDPNVNGKYSIVTV

SEQ ID NO: 1720589 - protein, 23 aa, Staphylococcus aureus
EIKNRNDEFLFYRNTRLSTVENP

SEQ ID NO: 1720590 - protein, 17 aa, Staphylococcus aureus
FDGVLIPGGFSFGDYLR

SEQ ID NO: 1720591 - protein, 18 aa, Staphylococcus aureus
FLLDLMLNNKSGDTLIKD

SEQ ID NO: 1720592 - protein, 18 aa, Staphylococcus aureus
GITDVDLRLSKQAKFTVN

SEQ ID NO: 1720593 - protein, 17 aa, Staphylococcus aureus
HFGNAPLDTLVSLFLKE

SEQ ID NO: 1720594 - protein, 19 aa, Staphylococcus aureus
IAFVFILAACGNNSSKDKE

SEQ ID NO: 1720595 - protein, 18 aa, Staphylococcus aureus
IKKIINYPGKEDVSVIQV

SEQ ID NO: 1720596 - protein, 19 aa, Staphylococcus aureus
ILPFHRSLRVANYDNQAYA

SEQ ID NO: 1720597 - protein, 18 aa, Staphylococcus aureus
ITGDLLHQGFVSKYIDVY

SEQ ID NO: 1720598 - protein, 18 aa, Staphylococcus aureus
ITICSLALSTALTVFPAS

SEQ ID NO: 1720599 - protein, 23 aa, Staphylococcus aureus
IVICVLLVLITISQILKHFNYGT

SEQ ID NO: 1720600 - protein, 17 aa, Staphylococcus aureus
IVLVIFTNKDNKSDKPN

SEQ ID NO: 1720601 - protein, 35 aa, Staphylococcus aureus; identical to SEQ ID NO: 1594494

SEQ ID NO: 1720602 - protein, 27 aa, Staphylococcus aureus
KDKKVDIFGVPYFYTCIIPKSEPDINQ

SEQ ID NO: 1720603 - protein, 33 aa, Staphylococcus aureus
KELDFKLRQYLIQDFDLYKKFPKASKIKVTMKD

SEQ ID NO: 1720604 - protein, 19 aa, Staphylococcus aureus
KFKDLRAYYTKPSLEFKNE

SEQ ID NO: 1720605 - protein, 17 aa, Staphylococcus aureus
KGHYFVTTFYRNGKLPD

SEQ ID NO: 1720606 - protein, 26 aa, Staphylococcus aureus
KGRVGIVPLLNNQAYWFITINSKENN

SEQ ID NO: 1720607 - protein, 27 aa, Staphylococcus aureus
KHAKKAYYTVYFKNGGKRVIHLNSNIY

SEQ ID NO: 1720608 - protein, 20 aa, Staphylococcus aureus
KIRQQLVNNYGLYKGTSKYG

SEQ ID NO: 1720609 - protein, 28 aa, Staphylococcus aureus
KMKVGLVSVAITMLYIMTNGQAEASETN

SEQ ID NO: 1720610 - protein, 23 aa, Staphylococcus aureus
KSQALQQLPNFQTALNAANNEAN

SEQ ID NO: 1720611 - protein, 17 aa, Staphylococcus aureus
LASTMILVACGNANNEN

SEQ ID NO: 1720612 - protein, 31 aa, Staphylococcus aureus
LDFKIRKMLVEKYRLYKGASDKGRIVINMKD

SEQ ID NO: 1720613 - protein, 21 aa, Staphylococcus aureus
LFISVIILGIFIIGCDSSSDT

SEQ ID NO: 1720614 - protein, 24 aa, Staphylococcus aureus
LKAQRINPVVKKNALEAIREVVNK

SEQ ID NO: 1720615 - protein, 23 aa, Staphylococcus aureus
LKEMDNWPTYYPSKLNKDQIKEE

SEQ ID NO: 1720616 - protein, 24 aa, Staphylococcus aureus
LNSKHELIGILYAGSGKDESEKNF

SEQ ID NO: 1720617 - protein, 18 aa, Staphylococcus aureus
LQQIQNIATNKINLIKAN

SEQ ID NO: 1720618 - protein, 18 aa, Staphylococcus aureus
LYQIYKEDISLKELDYRL

SEQ ID NO: 1720619 - protein, 27 aa, Staphylococcus aureus
MDDFKLDWNKHGFWGYWSGENHVDQKE

SEQ ID NO: 1720620 - protein, 23 aa, Staphylococcus aureus
MITALFIAVISVLLAFHLKQHYD

SEQ ID NO: 1720621 - protein, 23 aa, Staphylococcus aureus
MQTYTVKPGTKLYSVPWGTYKQE

SEQ ID NO: 1720622 - protein, 19 aa, Staphylococcus aureus
NILQNLQFDFIDDPTYDKN

SEQ ID NO: 1720623 - protein, 29 aa, Staphylococcus aureus
NIMRLNGLNNFFIYPGQKLKVTGNASTNS

SEQ ID NO: 1720624 - protein, 25 aa, Staphylococcus aureus
NYEDYIELRQLRYIYDVYFDRDDCI

SEQ ID NO: 1720625 - protein, 21 aa, Staphylococcus aureus
PYYKRMIMMNQYRAKAALKSN

SEQ ID NO: 1720626 - protein, 33 aa, Staphylococcus aureus
QNNTTLKSWIDDGFLPLIYKGEMMDLSRGRAIS

SEQ ID NO: 1720627 - protein, 25 aa, Staphylococcus aureus
QQNKKLHSWLKISTLIDNVKVKDKY

SEQ ID NO: 1720628 - protein, 19 aa, Staphylococcus aureus
QRNKTFKVFLLGDDKNKYK

SEQ ID NO: 1720629 - protein, 18 aa, Staphylococcus aureus
RGFELTNVTGYKYGNKVT

SEQ ID NO: 1720630 - protein, 20 aa, Staphylococcus aureus
SCQALADEPLHSSFIMSKMA

SEQ ID NO: 1720631 - protein, 27 aa, Staphylococcus aureus
SHSGNLYTAGQCTWYVYDKVGGEIGST

SEQ ID NO: 1720632 - protein, 17 aa, Staphylococcus aureus
SQLSYLDLGNKVKALLY

SEQ ID NO: 1720633 - protein, 21 aa, Staphylococcus aureus
SRAMVLYINRNTRTAKGYFLI

SEQ ID NO: 1720634 - protein, 25 aa, Staphylococcus aureus
SSNAKLPVIFWMHGGGYIAGDKQYK

SEQ ID NO: 1720635 - protein, 19 aa, Staphylococcus aureus
TLTAGIGTALVGHAQHADA

SEQ ID NO: 1720636 - protein, 24 aa, Staphylococcus aureus
TNSQPFIDYIHTPILEIKKGKEEP

SEQ ID NO: 1720637 - protein, 27 aa, Staphylococcus aureus
TSYTQGQLLYQNDFQFLKDVLQSVDAK

SEQ ID NO: 1720638 - protein, 46 aa, Staphylococcus aureus
TVIAEKSVAYGPIWRLFKVPENVSHLKIQFVPKNDAITDARGIYQL

SEQ ID NO: 1720639 - protein, 28 aa, Staphylococcus aureus
VDAQGHKHYFYNCYPKNANANGSGQTYV

SEQ ID NO: 1720640 - protein, 32 aa, Staphylococcus aureus
VEGETDPIYKREYKHFYTPEEAQRAQENSDQI

SEQ ID NO: 1720641 - protein, 27 aa, Staphylococcus aureus
VKSVLYFNRGISDIDLRLSKQAEYTVH

SEQ ID NO: 1720642 - protein, 19 aa, Staphylococcus aureus
VVALVCVIALSACGKEQTK

SEQ ID NO: 1720643 - protein, 27 aa, Staphylococcus aureus
WSLEKDDGKLVYNIDLKKGNKKQEVTV

SEQ ID NO: 1720644 - protein, 17 aa, Staphylococcus aureus
YLKGEAMQYDLSTTGGN

SEQ ID NO: 1720645 - protein, 19 aa, Staphylococcus aureus
AAGSLNPYYKRMIMMNQYR

SEQ ID NO: 1720646 - protein, 25 aa, Staphylococcus aureus
ADGNNNIKVILPKVQVKPAARQSVS

SEQ ID NO: 1720647 - protein, 17 aa, Staphylococcus aureus
AGAIITTLALGACGNSN

SEQ ID NO: 1720648 - protein, 24 aa, Staphylococcus aureus
AIEQIKPKVRRKRAALDNIDESNN

SEQ ID NO: 1720649 - protein, 17 aa, Staphylococcus aureus
ALKSRAMVLYINRNTRT

SEQ ID NO: 1720650 - protein, 23 aa, Staphylococcus aureus
ALYISVMILIFAIAGCGKSDETK

SEQ ID NO: 1720651 - protein, 22 aa, Staphylococcus aureus
AVMRFLHPNLQGQRFQFTGLTP

SEQ ID NO: 1720652 - protein, 18 aa, Staphylococcus aureus
CLVSLLTILLLAISNMYV

SEQ ID NO: 1720653 - protein, 17 aa, Staphylococcus aureus
DANYYAKQTYDYYKNTF

SEQ ID NO: 1720654 - protein, 17 aa, Staphylococcus aureus
DQRAGVDANYYAKQTYD

SEQ ID NO: 1720655 - protein, 25 aa, Staphylococcus aureus
DVQGNPSTWFYPLGEKKVERTTPKL

SEQ ID NO: 1720656 - protein, 23 aa, Staphylococcus aureus
EIENFKFFVQYGNFKDLSKYKDG

SEQ ID NO: 1720657 - protein, 25 aa, Staphylococcus aureus
EIMKSRGMYLFLNRNTRTAKGYFIV

SEQ ID NO: 1720658 - protein, 20 aa, Staphylococcus aureus
ELDFKLRKQLIEQHNLYGNI

SEQ ID NO: 1720659 - protein, 18 aa, Staphylococcus aureus
ELIKYYTQLPLTFSNRWL

SEQ ID NO: 1720660 - protein, 31 aa, Staphylococcus aureus
ETMRYLKRLSWYISILILIVVIAGCGKGNET

SEQ ID NO: 1720661 - protein, 24 aa, Staphylococcus aureus
FGTVRPMQIGLVYDALNTEKLDVA

SEQ ID NO: 1720662 - protein, 19 aa, Staphylococcus aureus
FKRYSWSAHIRLWGAESWG

SEQ ID NO: 1720663 - protein, 20 aa, Staphylococcus aureus
FLILLVVIVSSYYGESFVLA

SEQ ID NO: 1720664 - protein, 31 aa, Staphylococcus aureus
FNFDEPAYLPRFVFGHYMKSYLSMYTKKYPN

SEQ ID NO: 1720665 - protein, 21 aa, Staphylococcus aureus
FSHKFFVSKTWINNAPTKEDI

SEQ ID NO: 1720666 - protein, 26 aa, Staphylococcus aureus
FVLTSGTFFVKMNEKQYPDFKNKNLR

SEQ ID NO: 1720667 - protein, 24 aa, Staphylococcus aureus
GEYDYDFFPFKIDKEAMTLKEVDF

SEQ ID NO: 1720668 - protein, 18 aa, Staphylococcus aureus
GFQYNFTSNGTTWSWSYE

SEQ ID NO: 1720669 - protein, 31 aa, Staphylococcus aureus
GIFQSIIEYLKENLNWIWNSLSIEDQHQFNQ

SEQ ID NO: 1720670 - protein, 23 aa, Staphylococcus aureus
GPSFNTAYRYYKNDSHAKEMTPT

SEQ ID NO: 1720671 - protein, 17 aa, Staphylococcus aureus
GTQLNVVTLLGTDKERF

SEQ ID NO: 1720672 - protein, 42 aa, Staphylococcus aureus
HADPHGYLRSHNYSYDQLYDLINEKYLIKMGKVAPWGTQFTT

SEQ ID NO: 1720673 - protein, 24 aa, Staphylococcus aureus
HLYDIKDLYRYYSSESFEFSNISG

SEQ ID NO: 1720674 - protein, 20 aa, Staphylococcus aureus
IALSLIFSLSITPIANAESN

SEQ ID NO: 1720675 - protein, 23 aa, Staphylococcus aureus
IDYKVRNYLLKHKNLYEFNSSPY

SEQ ID NO: 1720676 - protein, 19 aa, Staphylococcus aureus
IILILEIVFHNINYANSQP

SEQ ID NO: 1720677 - protein, 19 aa, Staphylococcus aureus
IILSTTLLLLGTAFTQFPN

SEQ ID NO: 1720678 - protein, 18 aa, Staphylococcus aureus
ILIFVATIALSGCANDDG

SEQ ID NO: 1720679 - protein, 18 aa, Staphylococcus aureus
IRKQLVEKYGLYKGTTKY

SEQ ID NO: 1720680 - protein, 21 aa, Staphylococcus aureus
ITLSFSLLTACGANQHKENNS

SEQ ID NO: 1720681 - protein, 18 aa, Staphylococcus aureus
KDALEWLHKNAYGKEPDN

SEQ ID NO: 1720682 - protein, 22 aa, Staphylococcus aureus
KDRISVIGYPKGAQTKYKMFES

SEQ ID NO: 1720683 - protein, 30 aa, Staphylococcus aureus
KEIARTDLGRYFDRFADKLDKTQTNTEVAE

SEQ ID NO: 1720684 - protein, 30 aa, Staphylococcus aureus
KEKYDTAKYYYNKYYQYKGLIDKTVLTTIG

SEQ ID NO: 1720685 - protein, 27 aa, Staphylococcus aureus
KGKKVDIFGVPYFYTCIIPKSEPDINQ

SEQ ID NO: 1720686 - protein, 24 aa, Staphylococcus aureus
KHYRDNFWATADMKRLAGTTTLDN

SEQ ID NO: 1720687 - protein, 17 aa, Staphylococcus aureus
KLLLKGSGNLKGSSVGY

SEQ ID NO: 1720688 - protein, 22 aa, Staphylococcus aureus
KMTNGQLWKKVKDSLIDSNIIS

SEQ ID NO: 1720689 - protein, 26 aa, Staphylococcus aureus
KNTNHIKSMRWPFQYNIGLKTNDKYV

SEQ ID NO: 1720690 - protein, 25 aa, Staphylococcus aureus
KQNHQLFLLGKDKDKYKKGLEGQNV

SEQ ID NO: 1720691 - protein, 17 aa, Staphylococcus aureus
KRYLFIEYIPDNVLNCK

SEQ ID NO: 1720692 - protein, 20 aa, Staphylococcus aureus
KTSKTPKLLFKGSGDIKGSS

SEQ ID NO: 1720693 - protein, 18 aa, Staphylococcus aureus
KYTAPIKTFAPDSDKILS

SEQ ID NO: 1720694 - protein, 19 aa, Staphylococcus aureus
LDFKLRKHLIDKHDLYKTE

SEQ ID NO: 1720695 - protein, 20 aa, Staphylococcus aureus
LFNLTSYYTDITWQLDESNK

SEQ ID NO: 1720696 - protein, 23 aa, Staphylococcus aureus
LGISFLFLVISITAGCGMGKEAE

SEQ ID NO: 1720697 - protein, 17 aa, Staphylococcus aureus
LIATLLLSGCSTTNNES

SEQ ID NO: 1720698 - protein, 25 aa, Staphylococcus aureus
LIHWISILPVIIFNKGPRVVKYINI

SEQ ID NO: 1720699 - protein, 18 aa, Staphylococcus aureus
LILMTTLLLLGTTATQTS

SEQ ID NO: 1720700 - protein, 20 aa, Staphylococcus aureus
LLIVILIGLLVIAYTHNKKT

SEQ ID NO: 1720701 - protein, 31 aa, Staphylococcus aureus; identical to SEQ ID NO: 1697809

SEQ ID NO: 1720702 - protein, 26 aa, Staphylococcus aureus
LNSARKIPINLWINGKHKTISTDKIA

SEQ ID NO: 1720703 - protein, 19 aa, Staphylococcus aureus
LRKHLIEKYGLYKTLSKDG

SEQ ID NO: 1720704 - protein, 31 aa, Staphylococcus aureus
LTTEKFLDIDLLFKNFTWLDGKSAEFKDLKV

SEQ ID NO: 1720705 - protein, 20 aa, Staphylococcus aureus
LVSTLALTACGEKEKPKKEE

SEQ ID NO: 1720706 - protein, 22 aa, Staphylococcus aureus
LYISILILIVMVAGCGKSDETK

SEQ ID NO: 1720707 - protein, 22 aa, Staphylococcus aureus
MAIMLFLTGCGKSQEKATLEKD

SEQ ID NO: 1720708 - protein, 27 aa, Staphylococcus aureus
NDLKLDYINYWIGKYRSHPYNKKVKVI

SEQ ID NO: 1720709 - protein, 17 aa, Staphylococcus aureus
NDRQLVVSAPSKKPTTP

SEQ ID NO: 1720710 - protein, 24 aa, Staphylococcus aureus
NKSVMYLLVNEGELSTFGPKGRFG

SEQ ID NO: 1720711 - protein, 22 aa, Staphylococcus aureus
NKYMYGGVTLAGDYLEKSRCIP

SEQ ID NO: 1720712 - protein, 24 aa, Staphylococcus aureus
NLENKVLMVGYTFYNTNKDEVEEL

SEQ ID NO: 1720713 - protein, 17 aa, Staphylococcus aureus
NLYFKYNLNNYSSMKVT

SEQ ID NO: 1720714 - protein, 24 aa, Staphylococcus aureus
NNEDTFMGQFLIKMGIQPEVTKDK

SEQ ID NO: 1720715 - protein, 26 aa, Staphylococcus aureus
NQDNGYYSYYYYNGYNNYSYNNYNNG

SEQ ID NO: 1720716 - protein, 31 aa, Staphylococcus aureus
NVDMRGTILMTKMMLPLMMNQGGSIVNTSSF

SEQ ID NO: 1720717 - protein, 25 aa, Staphylococcus aureus
PEEVAKLVVFLASDDSSFITGETIR

SEQ ID NO: 1720718 - protein, 32 aa, Staphylococcus aureus
PELSFASKYRYPALVRSGFNPEFLTYISNEKS

SEQ ID NO: 1720719 - protein, 19 aa, Staphylococcus aureus
PLIQSGFNPSFITTLSHEK

SEQ ID NO: 1720720 - protein, 19 aa, Staphylococcus aureus
PNHIILLNIDGKSADSVEG

SEQ ID NO: 1720721 - protein, 25 aa, Staphylococcus aureus
PNSELIFEFNTMTTKNYQGVTNLII

SEQ ID NO: 1720722 - protein, 30 aa, Staphylococcus aureus
PSVTVVDNLPGFTLINGGKVGVFSHAMVRT

SEQ ID NO: 1720723 - protein, 19 aa, Staphylococcus aureus
QNFIAQHQMPLLSRSNFNP

SEQ ID NO: 1720724 - protein, 26 aa, Staphylococcus aureus
QQTYAKFKAIATPEQLAKVKALIDQY

SEQ ID NO: 1720725 - protein, 28 aa, Staphylococcus aureus
QRDESIYDVVFLFPKSMQLKEVMEDMKP

SEQ ID NO: 1720726 - protein, 19 aa, Staphylococcus aureus
QRKYYINMLKDYYSQESYE

SEQ ID NO: 1720727 - protein, 18 aa, Staphylococcus aureus
QRNKNFKVFLIGDDRNKY

SEQ ID NO: 1720728 - protein, 22 aa, Staphylococcus aureus
RQTQQQIVYKTPKPLAGLNGES

SEQ ID NO: 1720729 - protein, 18 aa, Staphylococcus aureus
SGKDLNISLPLKTKSIAP

SEQ ID NO: 1720730 - protein, 32 aa, Staphylococcus aureus
SGLKILNPNGYWNSTLRWPGSYSVSIQNVDDN

SEQ ID NO: 1720731 - protein, 25 aa, Staphylococcus aureus
SIKSGTKLYTVPWGTSKQVAGSVSG

SEQ ID NO: 1720732 - protein, 19 aa, Staphylococcus aureus
SLATLTILTSVTGIGTTLV

SEQ ID NO: 1720733 - protein, 19 aa, Staphylococcus aureus
SLAVGLGIVAGNAGHEAQA

SEQ ID NO: 1720734 - protein, 24 aa, Staphylococcus aureus
SSDKPYKLFLKYKDKQQTMIGGLE

SEQ ID NO: 1720735 - protein, 20 aa, Staphylococcus aureus
TFRENQKWMTPLGRLGKPEE

SEQ ID NO: 1720736 - protein, 23 aa, Staphylococcus aureus
TKAKADRYVPYTIAVNGTSTPIL

SEQ ID NO: 1720737 - protein, 19 aa, Staphylococcus aureus
TLAGDYLEKSRCIPINLWV

SEQ ID NO: 1720738 - protein, 26 aa, Staphylococcus aureus
TLGICLVLLIILIGGCIIMTKINSRN

SEQ ID NO: 1720739 - protein, 24 aa, Staphylococcus aureus
TMGVLCATQLWQTNNAKALVTESG

SEQ ID NO: 1720740 - protein, 25 aa, Staphylococcus aureus
TNLNDEYVVSPGWTKDEQAKAFEEY

SEQ ID NO: 1720741 - protein, 19 aa, Staphylococcus aureus
TWIINSGMYIQLKGGALKS

SEQ ID NO: 1720742 - protein, 24 aa, Staphylococcus aureus
VAELQNVTIPAIEAIVPQNDPDAN

SEQ ID NO: 1720743 - protein, 19 aa, Staphylococcus aureus
VIKSKYIYWKNIEITKKGD

SEQ ID NO: 1720744 - protein, 22 aa, Staphylococcus aureus
VKAKKIKLPKGKKPLIISIDDM

SEQ ID NO: 1720745 - protein, 24 aa, Staphylococcus aureus
VNGKSGWVSKAYLAVPAAPKKAVA

SEQ ID NO: 1720746 - protein, 18 aa, Staphylococcus aureus
VVAVMFLLAACGNNSDKE

SEQ ID NO: 1720747 - protein, 22 aa, Staphylococcus aureus
YGSLIPLTPLDSSLLRKEQNDT

SEQ ID NO: 1720748 - protein, 18 aa, Staphylococcus aureus
YINMLKDYYSQESYESTN

SEQ ID NO: 1720749 - protein, 25 aa, Staphylococcus aureus
YKKPVELMMNYFKALNSTIANVNED

SEQ ID NO: 1720750 - protein, 26 aa, Staphylococcus aureus
YLEKSRCIPINLWVNGNLKTISTDKV

SEQ ID NO: 1720751 - protein, 20 aa, Staphylococcus aureus
YVNDLAAGSLNPYYKRMIMM

SEQ ID NO: 1720752 - protein, 26 aa, Staphylococcus aureus
AIQFADIYLMALPTKAMREVATQIND

SEQ ID NO: 1720753 - protein, 23 aa, Staphylococcus aureus
APVVAVLVGFIAKQGLKKAIQKY

SEQ ID NO: 1720754 - protein, 21 aa, Staphylococcus aureus
AQEKFLQHDLLFKINGSKIDG

SEQ ID NO: 1720755 - protein, 24 aa, Staphylococcus aureus
ASSDGIWMPIDDKGYFNFDFKTKR

SEQ ID NO: 1720756 - protein, 30 aa, Staphylococcus aureus
ATLSNWIDEGFMPLIYKGEMMDLSRGRAIS

SEQ ID NO: 1720757 - protein, 22 aa, Staphylococcus aureus
DALEWLHKNAYGKEPDKKVADL

SEQ ID NO: 1720758 - protein, 21 aa, Staphylococcus aureus
DAVQFVNKLFNVSSAIILLEY

SEQ ID NO: 1720759 - protein, 24 aa, Staphylococcus aureus
DEEDALKPLIFKTKVTSLEDIDKA

SEQ ID NO: 1720760 - protein, 17 aa, Staphylococcus aureus
DEYKRYFQPLIKEDDKS

SEQ ID NO: 1720761 - protein, 21 aa, Staphylococcus aureus
DKTYDVKFLRIVNENDFKAEF

SEQ ID NO: 1720762 - protein, 24 aa, Staphylococcus aureus
DSNKYIYNIELITVTPEISHWKVK

SEQ ID NO: 1720763 - protein, 22 aa, Staphylococcus aureus
DTKKNIGYHFLDKPKITVKKES

SEQ ID NO: 1720764 - protein, 44 aa, Staphylococcus aureus
EFEKQFGFMLKPWTTVRFMNVIPDWFIYKIALVGKDDKKYKDGP

SEQ ID NO: 1720765 - protein, 22 aa, Staphylococcus aureus
EFEYLVNRKATKRRKLFNGYIE

SEQ ID NO: 1720766 - protein, 22 aa, Staphylococcus aureus
EIENFKFFVQYGDFKDLSKYKD

SEQ ID NO: 1720767 - protein, 23 aa, Staphylococcus aureus
ESGEKFYPTKYLLIYNDNKTVES

SEQ ID NO: 1720768 - protein, 33 aa, Staphylococcus aureus
EVSDNMPYPHGQCTWYVYNRMKQFGTSISGDLG

SEQ ID NO: 1720769 - protein, 23 aa, Staphylococcus aureus
EYRKYYEPLIKKNNLNFKKGMKE

SEQ ID NO: 1720770 - protein, 44 aa, Staphylococcus aureus
FEFEKQFGFLLKPWTTVRFMNVIPNRFIYKIALVGKDEKKYKDG

SEQ ID NO: 1720771 - protein, 23 aa, Staphylococcus aureus
FLSIILVVMGGWYHSAHASDSLS

SEQ ID NO: 1720772 - protein, 21 aa, Staphylococcus aureus
GAYYDYLSAPRFVIKKEVGAG

SEQ ID NO: 1720773 - protein, 28 aa, Staphylococcus aureus
GFDTNDFPITWFYPLGEKKVERTTPKLE

SEQ ID NO: 1720774 - protein, 25 aa, Staphylococcus aureus
GIGMAITLKDFGITDVIILEKGTVG

SEQ ID NO: 1720775 - protein, 28 aa, Staphylococcus aureus
GVCNGFQILTEIGLLPGALLHNDSHLFI

SEQ ID NO: 1720776 - protein, 33 aa, Staphylococcus aureus
INGQTWYYGKLSNGKLAWIKSTDLAKELIKYNQ

SEQ ID NO: 1720777 - protein, 18 aa, Staphylococcus aureus
KEHPLKIKLITYDGRPEL

SEQ ID NO: 1720778 - protein, 20 aa, Staphylococcus aureus
KGMVLYMNRNTRTTNGYYYV

SEQ ID NO: 1720779 - protein, 24 aa, Staphylococcus aureus
KGYFNFDFKTKRFDNLELKEGNDI

SEQ ID NO: 1720780 - protein, 23 aa, Staphylococcus aureus
KKKAQYEAYKKWFEKHKSENPHS

SEQ ID NO: 1720781 - protein, 28 aa, Staphylococcus aureus
KMKVGLVSVAITMLYIMTNGQAEASEAN

SEQ ID NO: 1720782 - protein, 24 aa, Staphylococcus aureus
KNKYIYGGVTLAGDYLEKSRRIPI

SEQ ID NO: 1720783 - protein, 46 aa, Staphylococcus aureus
LEFKNELGIIIKKWTTIRFMNIVPDYFIYKIALVGKDDKKYGEGVH

SEQ ID NO: 1720784 - protein, 20 aa, Staphylococcus aureus
LEHELSYIDVLLDKNADQAT

SEQ ID NO: 1720785 - protein, 20 aa, Staphylococcus aureus
LNISQILTFNFIKDKSYDKD

SEQ ID NO: 1720786 - protein, 17 aa, Staphylococcus aureus
LQQIQNIATNKINLIKA

SEQ ID NO: 1720787 - protein, 17 aa, Staphylococcus aureus
NAKVIMPVYPKIPHQDY

SEQ ID NO: 1720788 - protein, 23 aa, Staphylococcus aureus
NLNWWDYEIGTPRALTNTLILLQ

SEQ ID NO: 1720789 - protein, 17 aa, Staphylococcus aureus
NNYGLYKGTSKYGKIII

SEQ ID NO: 1720790 - protein, 28 aa, Staphylococcus aureus
NSGFRNEYYYLTAIPYTLDEYKRYFQPL

SEQ ID NO: 1720791 - protein, 27 aa, Staphylococcus aureus
NTDSKYAYVLYPGLSKDVFKSKASKVT

SEQ ID NO: 1720792 - protein, 31 aa, Staphylococcus aureus
PIRAGYSLEIKVPLNAIKIPKSVLTKGNNVF

SEQ ID NO: 1720793 - protein, 25 aa, Staphylococcus aureus
QAQKEINPKFKGLRSYYTKSSLEFK

SEQ ID NO: 1720794 - protein, 25 aa, Staphylococcus aureus
QIDLEKPVPYINQLLALNTFAPQNE

SEQ ID NO: 1720795 - protein, 22 aa, Staphylococcus aureus
QKLSTITLLMTGVIALNNGEFR

SEQ ID NO: 1720796 - protein, 23 aa, Staphylococcus aureus
QNAPNEVLSFDDNNIRPSTNRSV

SEQ ID NO: 1720797 - protein, 24 aa, Staphylococcus aureus
QNHQLFLLGKDKEQYKEGLQGQNV

SEQ ID NO: 1720798 - protein, 27 aa, Staphylococcus aureus
RIVVLEYSFADYLAALDMKPVGIADDG

SEQ ID NO: 1720799 - protein, 23 aa, Staphylococcus aureus
RLWLYLVLLAVFIGACGMKKEES

SEQ ID NO: 1720800 - protein, 36 aa, Staphylococcus aureus; identical to SEQ ID NO: 1592633

SEQ ID NO: 1720801 - protein, 21 aa, Staphylococcus aureus
SHGAGFRLQNGEKLNFTVVDP

SEQ ID NO: 1720802 - protein, 27 aa, Staphylococcus aureus
SINTGKVLYAFYQKPELVKTAIKAQET

SEQ ID NO: 1720803 - protein, 23 aa, Staphylococcus aureus
SLGALCVSQIWESNRASAVVSGE

SEQ ID NO: 1720804 - protein, 17 aa, Staphylococcus aureus
SLLAIAAIGITTTTIAS

SEQ ID NO: 1720805 - protein, 26 aa, Staphylococcus aureus
SRKISLSNFKDYWQGKPKLDHITVTY

SEQ ID NO: 1720806 - protein, 30 aa, Staphylococcus aureus
STTEKFLDFDLLFKSINWLDGISAEFKDLK

SEQ ID NO: 1720807 - protein, 21 aa, Staphylococcus aureus
TFEEIFREYYYNNPQYQNLFY

SEQ ID NO: 1720808 - protein, 19 aa, Staphylococcus aureus
TLAGDYLEKSRRIPINLWV

SEQ ID NO: 1720809 - protein, 25 aa, Staphylococcus aureus
TLSNKTYILEMIRQLKSQFQDLERL

SEQ ID NO: 1720810 - protein, 17 aa, Staphylococcus aureus
TNKAPKLLLKGTGNLKG

SEQ ID NO: 1720811 - protein, 20 aa, Staphylococcus aureus
TNPYTIDIIMNKDALQAEVD

SEQ ID NO: 1720812 - protein, 20 aa, Staphylococcus aureus
TTSQALDSIALVAPEHIVRA

SEQ ID NO: 1720813 - protein, 21 aa, Staphylococcus aureus
VDAVLKRFNVALGDIEAVITE

SEQ ID NO: 1720814 - protein, 18 aa, Staphylococcus aureus
VKAKKIKLPKGKKPLIIS

SEQ ID NO: 1720815 - protein, 17 aa, Staphylococcus aureus
VNYALAPQYKYPTPLIQ

SEQ ID NO: 1720816 - protein, 25 aa, Staphylococcus aureus
VSELANPFMAIYYTDAKSDVNQTPV

SEQ ID NO: 1720817 - protein, 20 aa, Staphylococcus aureus
VVALICIIALSACGKEQTKT

SEQ ID NO: 1720818 - protein, 20 aa, Staphylococcus aureus
VVALVCIIALSACGKEQTKT

SEQ ID NO: 1720819 - protein, 20 aa, Staphylococcus aureus
AAGLIKLKKDFGLAGTVKDI

SEQ ID NO: 1720820 - protein, 30 aa, Staphylococcus aureus
AKVNKTYNYKYFYTYKVVKGVKKHFSFSKS

SEQ ID NO: 1720821 - protein, 20 aa, Staphylococcus aureus
ANAERYVPYTIAVNGTSTPN

SEQ ID NO: 1720822 - protein, 21 aa, Staphylococcus aureus
AQAMFIYELRGDGNINLNVHK

SEQ ID NO: 1720823 - protein, 17 aa, Staphylococcus aureus
ASHILIKVKSKKSDKEG

SEQ ID NO: 1720824 - protein, 44 aa, Staphylococcus aureus
EFKNEIGIILKKWTTIRFMNIVPDYFIYKIALVGKDDKKYDEGV

SEQ ID NO: 1720825 - protein, 18 aa, Staphylococcus aureus
ELDFKLRKQLIENHNLYG

SEQ ID NO: 1720826 - protein, 29 aa, Staphylococcus aureus
ELIKYYTQPHLSFSGKWLWQNPNGTIHAT

SEQ ID NO: 1720827 - protein, 26 aa, Staphylococcus aureus
FIEGKDRFIDFIYNGQYNKISLVGSD

SEQ ID NO: 1720828 - protein, 22 aa, Staphylococcus aureus
FLAIIITFTYGNFAEASVVIKE

SEQ ID NO: 1720829 - protein, 24 aa, Staphylococcus aureus
FNTDDFVYKVQLPEGVEYVNNSLT

SEQ ID NO: 1720830 - protein, 18 aa, Staphylococcus aureus
FYKVKKIVRYAGKEDIAI

SEQ ID NO: 1720831 - protein, 21 aa, Staphylococcus aureus
GALCVSQIWESNHASAVVSGE

SEQ ID NO: 1720832 - protein, 20 aa, Staphylococcus aureus
IHWISILPVIIFNKGSRLVK

SEQ ID NO: 1720833 - protein, 20 aa, Staphylococcus aureus
INEPFVIYDGITNGALYHRL

SEQ ID NO: 1720834 - protein, 17 aa, Staphylococcus aureus
ITACTWTSKKWPFTTPE

SEQ ID NO: 1720835 - protein, 25 aa, Staphylococcus aureus
KKEIENFKFFVQYGSFKGIENYENG

SEQ ID NO: 1720836 - protein, 19 aa, Staphylococcus aureus
KKIKLPKGKKPLIISIDDM

SEQ ID NO: 1720837 - protein, 22 aa, Staphylococcus aureus
KNVDMPITNALYRVLFENISVK

SEQ ID NO: 1720838 - protein, 17 aa, Staphylococcus aureus
KSRRIPINLWVNGEHQT

SEQ ID NO: 1720839 - protein, 20 aa, Staphylococcus aureus
LLFLIFLSACTNTRHSESDK

SEQ ID NO: 1720840 - protein, 18 aa, Staphylococcus aureus
LSIFLLILLSSISHKMKT

SEQ ID NO: 1720841 - protein, 22 aa, Staphylococcus aureus
LTSRGMILYMNRNTRTTTGYFS

SEQ ID NO: 1720842 - protein, 22 aa, Staphylococcus aureus
LYISFLILIISIVAGCGTGKEA

SEQ ID NO: 1720843 - protein, 24 aa, Staphylococcus aureus
LYISFLILVISFTAGCGMGKEAEI

SEQ ID NO: 1720844 - protein, 24 aa, Staphylococcus aureus
PMKSKGMVLYMNRNTRTTNGYYYV

SEQ ID NO: 1720845 - protein, 18 aa, Staphylococcus aureus
RDHLLLPIDHNKVPNIKN

SEQ ID NO: 1720846 - protein, 22 aa, Staphylococcus aureus
SKISQLNLLFVKDIKKIDVDVK

SEQ ID NO: 1720847 - protein, 26 aa, Staphylococcus aureus
TLGICLVLLIILIVGYVIMTKINSRS

SEQ ID NO: 1720848 - protein, 25 aa, Staphylococcus aureus
VAVLTGFYVGDFIKLGIKPIAVSDI

SEQ ID NO: 1720849 - protein, 18 aa, Staphylococcus aureus
YEARPRFNKPSETNAYNV

SEQ ID NO: 1720850 - protein, 22 aa, Staphylococcus aureus
YGPRPQFNKTPKYVKYRDAGTG

SEQ ID NO: 1720851 - protein, 18 aa, Staphylococcus aureus
YTAKLYYNIPNGYKYYSL

SEQ ID NO: 1720852 - protein, 35 aa, Staphylococcus aureus
AITDARGIYQLRDGYKYYDFVDSIGLHSGSHVYVE

SEQ ID NO: 1720853 - protein, 24 aa, Staphylococcus aureus
ALYMSVLLLIIFIGGCGNMKEEQK

SEQ ID NO: 1720854 - protein, 28 aa, Staphylococcus aureus
ATKAMPKEMLPILDKPTIQYIVEEAARA

SEQ ID NO: 1720855 - protein, 17 aa, Staphylococcus aureus
ATLALGLLTTGVITSEG

SEQ ID NO: 1720856 - protein, 21 aa, Staphylococcus aureus
AVMRFLHPNLQGQRFQFTGLT

SEQ ID NO: 1720857 - protein, 36 aa, Staphylococcus aureus
DAITDARGIYQLRDGYKYYDFVDSIGLHSGSHVYVE

SEQ ID NO: 1720858 - protein, 22 aa, Staphylococcus aureus
DGKTYTFHLRDDVKFHDGTTFD

SEQ ID NO: 1720859 - protein, 27 aa, Staphylococcus aureus
DNGTIHATLLQLSWFSHIQVFGPESWG

SEQ ID NO: 1720860 - protein, 25 aa, Staphylococcus aureus
DSIALVAPEHIVRAAARDAVKQQYE

SEQ ID NO: 1720861 - protein, 23 aa, Staphylococcus aureus
DYETWRTYMLAQETFTGGVTPVA

SEQ ID NO: 1720862 - protein, 27 aa, Staphylococcus aureus
EKLGADPMTFLGLGGIGDLIVTCISTH

SEQ ID NO: 1720863 - protein, 22 aa, Staphylococcus aureus
ESATTDLYAYADQKKNNISADT

SEQ ID NO: 1720864 - protein, 23 aa, Staphylococcus aureus
FLSIILVVMGGWYHSAHALDSLS

SEQ ID NO: 1720865 - protein, 19 aa, Staphylococcus aureus
GFQYNFTSNGTTWSWSYEA

SEQ ID NO: 1720866 - protein, 24 aa, Staphylococcus aureus
GNKYSLPYFFGTVGILYNKEKYPN

SEQ ID NO: 1720867 - protein, 21 aa, Staphylococcus aureus
HKKRNEVFLKKHKGEAIKKYK

SEQ ID NO: 1720868 - protein, 21 aa, Staphylococcus aureus
KRELGFVLMALNIRKIAAQRA

SEQ ID NO: 1720869 - protein, 25 aa, Staphylococcus aureus
LDDIALVTPDHIVRAAARDAVKQQY

SEQ ID NO: 1720870 - protein, 22 aa, Staphylococcus aureus
LDNINDYTIPTGKKESATTDLY

SEQ ID NO: 1720871 - protein, 31 aa, Staphylococcus aureus
LTLNQLYSYNPGVTPLIFPGDVISLVPQNKV

SEQ ID NO: 1720872 - protein, 26 aa, Staphylococcus aureus
MIEHLKENLNWIWNSLSIEDQHQFNQ

SEQ ID NO: 1720873 - protein, 22 aa, Staphylococcus aureus
MLISIFLLLTMTSKGLSNLRVI

SEQ ID NO: 1720874 - protein, 20 aa, Staphylococcus aureus
NADVAYLLHDGKNEIREIEP

SEQ ID NO: 1720875 - protein, 19 aa, Staphylococcus aureus
NISQILTFNFIKDKSYDKD

SEQ ID NO: 1720876 - protein, 19 aa, Staphylococcus aureus
NKLRDGYLLSDKNYKDWTE

SEQ ID NO: 1720877 - protein, 32 aa, Staphylococcus aureus
NLFLGFVAVILTVCLIGLLILATNEDALAKVH

SEQ ID NO: 1720878 - protein, 25 aa, Staphylococcus aureus
NPKDYNYSQFYWGGKYNVSVSSESN

SEQ ID NO: 1720879 - protein, 25 aa, Staphylococcus aureus
NSELIFEFNTMTTKNYQGMTNLIIK

SEQ ID NO: 1720880 - protein, 24 aa, Staphylococcus aureus
NYLTGFITGPLLSKKYLSDVPIKD

SEQ ID NO: 1720881 - protein, 23 aa, Staphylococcus aureus
PTEKAPKLLLKGSGDLKGSSVGY

SEQ ID NO: 1720882 - protein, 18 aa, Staphylococcus aureus
QAMFIYELRGDGNINLNV

SEQ ID NO: 1720883 - protein, 22 aa, Staphylococcus aureus
RNKYVDIFALKDYETWRTYMLA

SEQ ID NO: 1720884 - protein, 26 aa, Staphylococcus aureus
SFNTDDFVYKIQLPEGVEYVNNSLTK

SEQ ID NO: 1720885 - protein, 20 aa, Staphylococcus aureus
TLNLQTIHDLDVHPIKKPDA

SEQ ID NO: 1720886 - protein, 21 aa, Staphylococcus aureus
TNPYTIDIIMNKDALQAEVDR

SEQ ID NO: 1720887 - protein, 25 aa, Staphylococcus aureus
TVTVVDNLPGYTLINGGKVGVFSHA

SEQ ID NO: 1720888 - protein, 17 aa, Staphylococcus aureus
VKGYPYYIKKEKITLKE

SEQ ID NO: 1720889 - protein, 20 aa, Staphylococcus aureus
VLMLAVIVFAAACGNSSSLD

SEQ ID NO: 1720890 - protein, 22 aa, Staphylococcus aureus
VSSVLAFLALNNAAHAQQHGTQ

SEQ ID NO: 1720891 - protein, 20 aa, Staphylococcus aureus
YARENNVPFFGICLGMQLAT

SEQ ID NO: 1720892 - protein, 21 aa, Staphylococcus aureus
YPARPQFNKTPKYVKYRDAGT

SEQ ID NO: 1720893 - protein, 25 aa, Staphylococcus aureus
YTQRHLTFSNKWLWQKDNGTIHATL

SEQ ID NO: 1720894 - protein, 17 aa, Staphylococcus aureus
GLGIVAGNAGHEAQASE

SEQ ID NO: 1720895 - protein, 19 aa, Staphylococcus aureus
IILSTTLLLLGTASTQFPN

SEQ ID NO: 1720896 - protein, 19 aa, Staphylococcus aureus
ITICTLALSTTFTVLPATS

SEQ ID NO: 1720897 - protein, 23 aa, Staphylococcus aureus
KANERVAIVGYPAPYKNKHHMYQ

SEQ ID NO: 1720898 - protein, 21 aa, Staphylococcus aureus
KPASITAYNNSIRALQSDLTS

SEQ ID NO: 1720899 - protein, 34 aa, Staphylococcus aureus; identical to SEQ ID NO: 1697346

SEQ ID NO: 1720900 - protein, 32 aa, Staphylococcus aureus
LTFLFVCSLIVCGFFAYKIYFPTDAENKSEIP

SEQ ID NO: 1720901 - protein, 27 aa, Staphylococcus aureus
MLGICLVLLIILIVGYVIMTKINSRSA

SEQ ID NO: 1720902 - protein, 22 aa, Staphylococcus aureus
MMKRILVVFLMLAIVLAGCSNK

SEQ ID NO: 1720903 - protein, 17 aa, Staphylococcus aureus
MNIKGMVLYMNRNTRTT

SEQ ID NO: 1720904 - protein, 18 aa, Staphylococcus aureus
NIATKVKFPVTINGFSNV

SEQ ID NO: 1720905 - protein, 18 aa, Staphylococcus aureus
PADHPWRTMPRNAMTVHY

SEQ ID NO: 1720906 - protein, 18 aa, Staphylococcus aureus
PFKIYKFNKKSDGNYYFP

SEQ ID NO: 1720907 - protein, 19 aa, Staphylococcus aureus
QDPHAWLSLDNGIKYVKTI

SEQ ID NO: 1720908 - protein, 28 aa, Staphylococcus aureus
QPDESIYDVVFLFPKSMQLKEVMEDMKP

SEQ ID NO: 1720909 - protein, 17 aa, Staphylococcus aureus
RDNFWATADMTCLPGTT

SEQ ID NO: 1720910 - protein, 20 aa, Staphylococcus aureus
RPYVVTTLFSTKDNFTKDNT

SEQ ID NO: 1720911 - protein, 24 aa, Staphylococcus aureus
SGEGDLAIVKFSPNEQNKHIGEVV

SEQ ID NO: 1720912 - protein, 22 aa, Staphylococcus aureus
SNKNPKLLFKGAGNIKGSSVGY

SEQ ID NO: 1720913 - protein, 25 aa, Staphylococcus aureus
TAKGYYFVRTFYRKDKLPDRKNYKV

SEQ ID NO: 1720914 - protein, 25 aa, Staphylococcus aureus
TGGYYKVKKVIPYAGSADLAIVEVE

SEQ ID NO: 1720915 - protein, 27 aa, Staphylococcus aureus
VGYQNEYFYITYLSRNLKEYRKYYEPL

SEQ ID NO: 1720916 - protein, 24 aa, Staphylococcus aureus
VLGINLLFLVISITAGCGMGKEAE

SEQ ID NO: 1720917 - protein, 18 aa, Staphylococcus aureus
VMPALAYFTFSPKNYEDK

SEQ ID NO: 1720918 - protein, 25 aa, Staphylococcus aureus
VNGKSGWVSKAYLAVPAAPKKAVAQ

SEQ ID NO: 1720919 - protein, 20 aa, Staphylococcus aureus
VTYHNKGLDFAFGLSMTSKN

SEQ ID NO: 1720920 - protein, 17 aa, Staphylococcus aureus
AEDYWFTDPITLEHLRS

SEQ ID NO: 1720921 - protein, 22 aa, Staphylococcus aureus
ALILKMQGFINSKTTYYNYKNT

SEQ ID NO: 1720922 - protein, 34 aa, Staphylococcus aureus; identical to SEQ ID NO: 1589608

SEQ ID NO: 1720923 - protein, 25 aa, Staphylococcus aureus
DIDMNAFQHFAFLDQYKKAHKGTKI

SEQ ID NO: 1720924 - protein, 17 aa, Staphylococcus aureus
DKGYLPKAATHDVMIGL

SEQ ID NO: 1720925 - protein, 20 aa, Staphylococcus aureus
DVDAFFKGKKGIKRKVIETH

SEQ ID NO: 1720926 - protein, 18 aa, Staphylococcus aureus
EIKAYLKQVDKIKDDEEP

SEQ ID NO: 1720927 - protein, 23 aa, Staphylococcus aureus
EMDRYTNFWNQLHWIGNNYKDEN

SEQ ID NO: 1720928 - protein, 17 aa, Staphylococcus aureus
FAFGLSMTSKNIARYEN

SEQ ID NO: 1720929 - protein, 18 aa, Staphylococcus aureus
FFSYEWKGLEIAKKLADQ

SEQ ID NO: 1720930 - protein, 31 aa, Staphylococcus aureus
GLVLIMFVLCGFIFPLTVTALGQVLFPEQAN

SEQ ID NO: 1720931 - protein, 28 aa, Staphylococcus aureus
GYPGDKPVATMWESKGKITYLKGEAMQY

SEQ ID NO: 1720932 - protein, 25 aa, Staphylococcus aureus
HSGNLYTAGQCTWYVYDKVGGEIGS

SEQ ID NO: 1720933 - protein, 18 aa, Staphylococcus aureus
HYAPVTYIQVEAPTGTFI

SEQ ID NO: 1720934 - protein, 20 aa, Staphylococcus aureus
ISKYAGDYIFLSKPSYGKFD

SEQ ID NO: 1720935 - protein, 23 aa, Staphylococcus aureus
IYVYDKDKIIILAYKPLSNDDEV

SEQ ID NO: 1720936 - protein, 18 aa, Staphylococcus aureus
KISQILTFNFIKDKSYDK

SEQ ID NO: 1720937 - protein, 26 aa, Staphylococcus aureus
KNTDHIKAMRWPFQYNIGLKTNDPNV

SEQ ID NO: 1720938 - protein, 17 aa, Staphylococcus aureus
LCNLFILTACSASVDKT

SEQ ID NO: 1720939 - protein, 17 aa, Staphylococcus aureus
LDFKRKGAELANFYTGI

SEQ ID NO: 1720940 - protein, 26 aa, Staphylococcus aureus
LIHWISILPVIIFNKGPRLVKYINIF

SEQ ID NO: 1720941 - protein, 18 aa, Staphylococcus aureus
LKDFGITDVIILEKGTVG

SEQ ID NO: 1720942 - protein, 21 aa, Staphylococcus aureus
LLEDYKYGDPIYKEAKDRLMT

SEQ ID NO: 1720943 - protein, 24 aa, Staphylococcus aureus
NELPPLVHSGFNPSFIATVSHEKG

SEQ ID NO: 1720944 - protein, 23 aa, Staphylococcus aureus
NFNPEFIGVLSRKQNAAKKSKIT

SEQ ID NO: 1720945 - protein, 29 aa, Staphylococcus aureus
NIDTPKNIDFNEKLTYRTASDVVINNAQP

SEQ ID NO: 1720946 - protein, 32 aa, Staphylococcus aureus; identical to SEQ ID NO: 1686194

SEQ ID NO: 1720947 - protein, 18 aa, Staphylococcus aureus
PINLWVNGEHQTISTDKV

SEQ ID NO: 1720948 - protein, 25 aa, Staphylococcus aureus
PNPKDTISSQFYWGSKYNISINSDS

SEQ ID NO: 1720949 - protein, 22 aa, Staphylococcus aureus
RLMTRVLGEDQYLLKKKIDEYE

SEQ ID NO: 1720950 - protein, 19 aa, Staphylococcus aureus
SELANPFMAIYDTDAKSDV

SEQ ID NO: 1720951 - protein, 23 aa, Staphylococcus aureus
SKKESYSVYLTPEIKKFIADNTE

SEQ ID NO: 1720952 - protein, 30 aa, Staphylococcus aureus
SNKNTNMLTFHKYNLYNLTMNEYNDIFNSL

SEQ ID NO: 1720953 - protein, 27 aa, Staphylococcus aureus
SNRLNKFSIRKYTVGTASILVGTTLIF

SEQ ID NO: 1720954 - protein, 24 aa, Staphylococcus aureus
TSISPYKGILRVGAATGFVVGKNT

SEQ ID NO: 1720955 - protein, 34 aa, Staphylococcus aureus
TVIGEKVVAYGPIWRLLKVPENVSHLKIQFVPKN

SEQ ID NO: 1720956 - protein, 17 aa, Staphylococcus aureus
VSSVLAFLALNNAAHAQ

SEQ ID NO: 1720957 - protein, 23 aa, Staphylococcus aureus
VVTSIALLLLSNTVDAAQHITPV

SEQ ID NO: 1720958 - protein, 22 aa, Staphylococcus aureus
YDNIDVFIVLEDNKYQLKKYSV

SEQ ID NO: 1720959 - protein, 24 aa, Staphylococcus aureus
YEGFTYHFESDGTHFAWNYHATGT

SEQ ID NO: 1720960 - protein, 18 aa, Staphylococcus aureus
YYDYIHSPILEIKKGNEE

SEQ ID NO: 1720961 - protein, 26 aa, Staphylococcus aureus
AIQFADIYLMALPTKAMREVASQIND

SEQ ID NO: 1720962 - protein, 34 aa, Staphylococcus aureus
DKSIYLYGTVNGKSGWISKAYLAVPAAPKKAVAQ

SEQ ID NO: 1720963 - protein, 17 aa, Staphylococcus aureus
EARPRFNKPSETNAYNV

SEQ ID NO: 1720964 - protein, 22 aa, Staphylococcus aureus
ELRAKLDIILGDAKDPVRITNE

SEQ ID NO: 1720965 - protein, 22 aa, Staphylococcus aureus
ESIKDVLTKYKNPMYSYNEDGT

SEQ ID NO: 1720966 - protein, 19 aa, Staphylococcus aureus
EVIGIHWGGVPNQFNGAVF

SEQ ID NO: 1720967 - protein, 17 aa, Staphylococcus aureus
FKFFAQYGSFKDLSKYK

SEQ ID NO: 1720968 - protein, 23 aa, Staphylococcus aureus
GEGDLAIVKFSPNEQNKHIGEVV

SEQ ID NO: 1720969 - protein, 19 aa, Staphylococcus aureus
HLFENAYYILVYNEPRNEQ

SEQ ID NO: 1720970 - protein, 23 aa, Staphylococcus aureus
IASSLSCALLLLSAANTEANSAN

SEQ ID NO: 1720971 - protein, 18 aa, Staphylococcus aureus
KDNKGLNFVLTSGTFFVK

SEQ ID NO: 1720972 - protein, 19 aa, Staphylococcus aureus
LRTSLINFLPIQSLLSALK

SEQ ID NO: 1720973 - protein, 20 aa, Staphylococcus aureus
LSTTVLAPLGIYSDKIKDVK

SEQ ID NO: 1720974 - protein, 19 aa, Staphylococcus aureus
MGIPTDIKPFVTTKLISPF

SEQ ID NO: 1720975 - protein, 33 aa, Staphylococcus aureus
NENSKYDTPIPDWYLGSILNRLGDQIYYAKELT

SEQ ID NO: 1720976 - protein, 31 aa, Staphylococcus aureus; identical to SEQ ID NO: 1698306

SEQ ID NO: 1720977 - protein, 24 aa, Staphylococcus aureus
NPKDYNYSQFYWGGKYNVSVSSES

SEQ ID NO: 1720978 - protein, 17 aa, Staphylococcus aureus
PIPLKDLMLHQSGLYKY

SEQ ID NO: 1720979 - protein, 18 aa, Staphylococcus aureus
SIGMFLALGMSNKAYADE

SEQ ID NO: 1720980 - protein, 23 aa, Staphylococcus aureus
SKGKITYLKGEAMQYDLSTTGGN

SEQ ID NO: 1720981 - protein, 27 aa, Staphylococcus aureus
SLNTYYKRTIKISGLKAMYALKSKDFK

SEQ ID NO: 1720982 - protein, 18 aa, Staphylococcus aureus
TYRTASDVVINNAQPEVT

SEQ ID NO: 1720983 - protein, 17 aa, Staphylococcus aureus
VIGIHWGGVPNEFNGAV

SEQ ID NO: 1720984 - protein, 33 aa, Staphylococcus aureus
VINGQTWYYGKLSNGKLAWIKSTDLAKELIKYN

SEQ ID NO: 1720985 - protein, 19 aa, Staphylococcus aureus
VVLEYSFADALAALDVKPV

SEQ ID NO: 1720986 - protein, 17 aa, Staphylococcus aureus
YAPVTYIQVEAPTGTFI

SEQ ID NO: 1720987 - protein, 20 aa, Staphylococcus aureus
YDFSKIYWGAKYNVSISSQS

SEQ ID NO: 1720988 - protein, 20 aa, Staphylococcus aureus
AQAMFIYELRGDGNINLNVH

SEQ ID NO: 1720989 - protein, 18 aa, Staphylococcus aureus
DIGPVRAAYEEGLNNINA

SEQ ID NO: 1720990 - protein, 41 aa, Staphylococcus aureus; identical to SEQ ID NO: 1695093

SEQ ID NO: 1720991 - protein, 36 aa, Staphylococcus aureus; identical to SEQ ID NO: 1695178

SEQ ID NO: 1720992 - protein, 24 aa, Staphylococcus aureus
FLSIILVVMSGWYHSAHASDSLSK

SEQ ID NO: 1720993 - protein, 18 aa, Staphylococcus aureus
GGYYTFELNKKLQPHRMG

SEQ ID NO: 1720994 - protein, 24 aa, Staphylococcus aureus
GTTLPNQFILLTIDKKDVSSVEDS

SEQ ID NO: 1720995 - protein, 24 aa, Staphylococcus aureus
HGGYDPHVWLDPKINQTFAKEIKD

SEQ ID NO: 1720996 - protein, 17 aa, Staphylococcus aureus
IGPVRAAYEEGLNNINA

SEQ ID NO: 1720997 - protein, 23 aa, Staphylococcus aureus
IKKIHEPFVIYDGITNGALYHRL

SEQ ID NO: 1720998 - protein, 22 aa, Staphylococcus aureus
KGIVYTPEQLPAKSKWSHAVDQ

SEQ ID NO: 1720999 - protein, 24 aa, Staphylococcus aureus
KHDLLFHDMFLNDAWKKDLKVEFE

SEQ ID NO: 1721000 - protein, 22 aa, Staphylococcus aureus
KIQEIDRVLASHPDVATIRQNV

SEQ ID NO: 1721001 - protein, 17 aa, Staphylococcus aureus
KLTQDLFMNDYLRVYTN

SEQ ID NO: 1721002 - protein, 17 aa, Staphylococcus aureus
LKELLSPTLAKFIVTTA

SEQ ID NO: 1721003 - protein, 20 aa, Staphylococcus aureus
LRERAIKQHGLYSNGLKQGQ

SEQ ID NO: 1721004 - protein, 27 aa, Staphylococcus aureus
NDPVSKYIPWFKTSKPIPLKDLMLHQS

SEQ ID NO: 1721005 - protein, 34 aa, Staphylococcus aureus
NNSLNWWDYEIGTPRALTNTLLLMDDMLTKDEMK

SEQ ID NO: 1721006 - protein, 19 aa, Staphylococcus aureus
PADHPWRTMPRNAMTVHYS

SEQ ID NO: 1721007 - protein, 17 aa, Staphylococcus aureus
PNQFNGAVFINENVRNF

SEQ ID NO: 1721008 - protein, 23 aa, Staphylococcus aureus
RDTISYIPKVGYYDKITHAHAYG

SEQ ID NO: 1721009 - protein, 25 aa, Staphylococcus aureus
REELQDFWHHLADDLVKTEKLTDTK

SEQ ID NO: 1721010 - protein, 19 aa, Staphylococcus aureus
RLLIAFAVLFSADFTYQSV

SEQ ID NO: 1721011 - protein, 22 aa, Staphylococcus aureus
SIIDDFFMDTNMNRPLNITKFN

SEQ ID NO: 1721012 - protein, 22 aa, Staphylococcus aureus
STNPYTIDIIMNKDALQAEVDR

SEQ ID NO: 1721013 - protein, 24 aa, Staphylococcus aureus
TGGYYKVKKIIPYAGSEDLAIVQV

SEQ ID NO: 1721014 - protein, 32 aa, Staphylococcus aureus
TGSEEMDLPLKELALITGAALLARRRSKKEKE

SEQ ID NO: 1721015 - protein, 24 aa, Staphylococcus aureus
TQAINQLVPLADNSALRTAKTKLD

SEQ ID NO: 1721016 - protein, 17 aa, Staphylococcus aureus
TQDLFMNDYLRVYTNDD

SEQ ID NO: 1721017 - protein, 22 aa, Staphylococcus aureus
TVNDLYIIVKKLSKGDVKKAVV

SEQ ID NO: 1721018 - protein, 27 aa, Staphylococcus aureus
VIHACVLLFIIISIGLVFHRLQTKTNS

SEQ ID NO: 1721019 - protein, 20 aa, Staphylococcus aureus
VVIAMLLVLAGCSNSNDNNE

SEQ ID NO: 1721020 - protein, 22 aa, Staphylococcus aureus
YAKQTYDYYKDTFGRESYDNQG

SEQ ID NO: 1721021 - protein, 19 aa, Staphylococcus aureus
AIKDFWEKVGLKTNVKLVE

SEQ ID NO: 1721022 - protein, 26 aa, Staphylococcus aureus
AKYDVIYNGHTFATSLPAKFVVKDVQ

SEQ ID NO: 1721023 - protein, 24 aa, Staphylococcus aureus
DDHKSLIYRYDATLGTQITTNDIL

SEQ ID NO: 1721024 - protein, 22 aa, Staphylococcus aureus
DFKIRKHLIDHYGLYGEMSSGT

SEQ ID NO: 1721025 - protein, 22 aa, Staphylococcus aureus
DRTSNESLFSRQWDMNKITNNG

SEQ ID NO: 1721026 - protein, 17 aa, Staphylococcus aureus
DVFIVLEDNKYQLKKYS

SEQ ID NO: 1721027 - protein, 17 aa, Staphylococcus aureus
EELYYSVEYKNTATFNK

SEQ ID NO: 1721028 - protein, 18 aa, Staphylococcus aureus
EERKARFLDNQKIKKTPV

SEQ ID NO: 1721029 - protein, 44 aa, Staphylococcus aureus
EFKNEIGIILKKWTTIRFMNVVPDYFIYKIALVGKDDKKYGEGV

SEQ ID NO: 1721030 - protein, 23 aa, Staphylococcus aureus
ESIKDVLTKYKNPMYSYNEDGTE

SEQ ID NO: 1721031 - protein, 21 aa, Staphylococcus aureus
ETINVTYLLSNGYSSSVSAPG

SEQ ID NO: 1721032 - protein, 28 aa, Staphylococcus aureus
EYKKSLDDLIWSFPNLDNERFDNPEYKE

SEQ ID NO: 1721033 - protein, 23 aa, Staphylococcus aureus
EYYVEHLVRDAVGTPLKRCAIVN

SEQ ID NO: 1721034 - protein, 20 aa, Staphylococcus aureus
GVWSHGIGKHYVWSYYSHNK

SEQ ID NO: 1721035 - protein, 20 aa, Staphylococcus aureus
ILLILFVVVSPINSPKTITD

SEQ ID NO: 1721036 - protein, 22 aa, Staphylococcus aureus
ILREFYIFRFIIGKQPYKLNIN

SEQ ID NO: 1721037 - protein, 17 aa, Staphylococcus aureus
IPHHLIDILNPDDTFSA

SEQ ID NO: 1721038 - protein, 22 aa, Staphylococcus aureus
ISLIILSLLISITMSNASASEE

SEQ ID NO: 1721039 - protein, 18 aa, Staphylococcus aureus
IVALVLLAACGGNNDKKV

SEQ ID NO: 1721040 - protein, 31 aa, Staphylococcus aureus
KELDFKIRKLLIEKYRLYKGTSDKGRIVINM

SEQ ID NO: 1721041 - protein, 37 aa, Staphylococcus aureus
KFSIRKYTVGTFSTVIATLVFLGLNTSQAQAAETNQP

SEQ ID NO: 1721042 - protein, 24 aa, Staphylococcus aureus
KGYFNFDFKTKRFDDLELKKNDEI

SEQ ID NO: 1721043 - protein, 27 aa, Staphylococcus aureus
KKKIDEYELYKKWYKSSNKNTNMLTFH

SEQ ID NO: 1721044 - protein, 28 aa, Staphylococcus aureus
KMKVGLVSVAITMLYIMTNGQAEASENQ

SEQ ID NO: 1721045 - protein, 31 aa, Staphylococcus aureus
KRVNKLVLGISFLFLIISIFAGCGTGKEAEI

SEQ ID NO: 1721046 - protein, 18 aa, Staphylococcus aureus
LGLILSITIAFTIIHHPI

SEQ ID NO: 1721047 - protein, 17 aa, Staphylococcus aureus
LIIMMSIINYGCGNNQN

SEQ ID NO: 1721048 - protein, 17 aa, Staphylococcus aureus
LKDFGITDVIILEKGTV

SEQ ID NO: 1721049 - protein, 25 aa, Staphylococcus aureus
LNSKHELIGILYAGSGKDESEKNFG

SEQ ID NO: 1721050 - protein, 17 aa, Staphylococcus aureus
LVLTTLGTGLHSSYLGL

SEQ ID NO: 1721051 - protein, 30 aa, Staphylococcus aureus
NKGHAPHENMIYWFALPAGQTPVGRTEFVT

SEQ ID NO: 1721052 - protein, 28 aa, Staphylococcus aureus
NKLENQILMLGKTFYQNYRDDVESLYSK

SEQ ID NO: 1721053 - protein, 26 aa, Staphylococcus aureus
NTLENQVLMIGYTFYHSNKNEVEDLY

SEQ ID NO: 1721054 - protein, 25 aa, Staphylococcus aureus
NVSTYIIIFLVSSAAFAIFLLSANI

SEQ ID NO: 1721055 - protein, 21 aa, Staphylococcus aureus
PFNDKIPYIKEPKLTKQNIEQ

SEQ ID NO: 1721056 - protein, 31 aa, Staphylococcus aureus
QQAARTGSPIRLMIGFDYPDAFGNGETLVPV

SEQ ID NO: 1721057 - protein, 26 aa, Staphylococcus aureus
RTKIQEIDRVLASHPDVATIRQNVTA

SEQ ID NO: 1721058 - protein, 22 aa, Staphylococcus aureus
SGKDLNISLPLKTKSIAPYETD

SEQ ID NO: 1721059 - protein, 24 aa, Staphylococcus aureus
SGSEGIWMPIDDKGYFNFDFKTKR

SEQ ID NO: 1721060 - protein, 21 aa, Staphylococcus aureus
SLGGNKFYLVKDYNSPTLIGW

SEQ ID NO: 1721061 - protein, 26 aa, Staphylococcus aureus
SLKKIKFDDFDLYRLTKKEYNELHQS

SEQ ID NO: 1721062 - protein, 28 aa, Staphylococcus aureus
SSKRKYDDTLPPLFDELPKEEPKSKPVV

SEQ ID NO: 1721063 - protein, 18 aa, Staphylococcus aureus
TKLYSVPWGTYKQEAGAV

SEQ ID NO: 1721064 - protein, 29 aa, Staphylococcus aureus
TLVASALVLTTLGTGLHSSYLGLNTNKVV

SEQ ID NO: 1721065 - protein, 17 aa, Staphylococcus aureus
TSLALSLLTTGASIVTT

SEQ ID NO: 1721066 - protein, 36 aa, Staphylococcus aureus
VAPNNKFTMYRVFGSKKTELLWVSKAIVQAANDGNQ

SEQ ID NO: 1721067 - protein, 28 aa, Staphylococcus aureus
VDAQGHTHYFYNCYPKNANANGSGQTYV

SEQ ID NO: 1721068 - protein, 21 aa, Staphylococcus aureus
YAKQTYDYYKDTFGRESYDNQ

SEQ ID NO: 1721069 - protein, 20 aa, Staphylococcus aureus
YNDITFINFTKFPISVIDVE

SEQ ID NO: 1721070 - protein, 17 aa, Staphylococcus aureus
YYKGRGFELTNVTGYKY

SEQ ID NO: 1721071 - protein, 20 aa, Staphylococcus aureus
AIFILGILTTSVMITENQSV

SEQ ID NO: 1721072 - protein, 21 aa, Staphylococcus aureus
AIFSFLLTALKYYLDYMKDSL

SEQ ID NO: 1721073 - protein, 17 aa, Staphylococcus aureus
AIMTVLLIGLTACGAES

SEQ ID NO: 1721074 - protein, 26 aa, Staphylococcus aureus
AISKVNESFIYYPQNDLKGLGGEHND

SEQ ID NO: 1721075 - protein, 23 aa, Staphylococcus aureus
AKRGEQFFMDNFGLKVKATNVVG

SEQ ID NO: 1721076 - protein, 21 aa, Staphylococcus aureus
ALNWWDYEIGTPRSLTNTLIL

SEQ ID NO: 1721077 - protein, 25 aa, Staphylococcus aureus
ALYMSVLLLIIFIGGCGNMKDEQKK

SEQ ID NO: 1721078 - protein, 20 aa, Staphylococcus aureus
DLYNKLDMILGYKDEERKKK

SEQ ID NO: 1721079 - protein, 21 aa, Staphylococcus aureus
DNIDVFIVLEDNKYQLKKYSV

SEQ ID NO: 1721080 - protein, 24 aa, Staphylococcus aureus
DSIALVTPDHIVRAAARDAVKQQY

SEQ ID NO: 1721081 - protein, 17 aa, Staphylococcus aureus
FVTTFYRNGKLPDEKNY

SEQ ID NO: 1721082 - protein, 17 aa, Staphylococcus aureus
GINDIELKFAKQAKYTV

SEQ ID NO: 1721083 - protein, 27 aa, Staphylococcus aureus
GITALHRTYFIFPENKNVLYQEIDSKV

SEQ ID NO: 1721084 - protein, 30 aa, Staphylococcus aureus
GIYDFVCEIDTLYAAYFNHSQYGHNAKELR

SEQ ID NO: 1721085 - protein, 19 aa, Staphylococcus aureus
GQRQMELIKILFQKAQEVD

SEQ ID NO: 1721086 - protein, 20 aa, Staphylococcus aureus
GQRVVSYPVNFVAGTIGDFF

SEQ ID NO: 1721087 - protein, 27 aa, Staphylococcus aureus
GTTEEAPLPIAQPLVKIPQGTIQGEIV

SEQ ID NO: 1721088 - protein, 21 aa, Staphylococcus aureus
IFILILIVLMAGCESNKITGD

SEQ ID NO: 1721089 - protein, 17 aa, Staphylococcus aureus
IFLLAMYELGKYVTEQV

SEQ ID NO: 1721090 - protein, 24 aa, Staphylococcus aureus
IGMAITLKDFGITDVIILEKGTVG

SEQ ID NO: 1721091 - protein, 26 aa, Staphylococcus aureus
INHYGSLIPLTPLDSSLLRKEQNDTT

SEQ ID NO: 1721092 - protein, 17 aa, Staphylococcus aureus
INIKEKSNFFVVVNHVK

SEQ ID NO: 1721093 - protein, 23 aa, Staphylococcus aureus
KADALKAITALKLQMDEELKTAR

SEQ ID NO: 1721094 - protein, 33 aa, Staphylococcus aureus
KESHDQFLQHTILFKGFFTDHSWYNDLLVDFDS

SEQ ID NO: 1721095 - protein, 19 aa, Staphylococcus aureus
KEYRKYYEPLIHKNDKEFK

SEQ ID NO: 1721096 - protein, 20 aa, Staphylococcus aureus
KFKDLRAYYTKPSLEFKNEI

SEQ ID NO: 1721097 - protein, 23 aa, Staphylococcus aureus
KNQALQQLPNFQTALNAANNEAN

SEQ ID NO: 1721098 - protein, 21 aa, Staphylococcus aureus
KNVDMPITNALYRVLFENISV

SEQ ID NO: 1721099 - protein, 22 aa, Staphylococcus aureus
KRGEQFFMDNFGLKVKATNVIG

SEQ ID NO: 1721100 - protein, 17 aa, Staphylococcus aureus
KVIMPVYPKIPHQDYQA

SEQ ID NO: 1721101 - protein, 24 aa, Staphylococcus aureus
KVKDRISVIGYPKGAQTKYKMFES

SEQ ID NO: 1721102 - protein, 23 aa, Staphylococcus aureus
LCISLLILIIFVTSCDGDNKIIG

SEQ ID NO: 1721103 - protein, 18 aa, Staphylococcus aureus
LGLVILLSACGQKYDKEI

SEQ ID NO: 1721104 - protein, 21 aa, Staphylococcus aureus
LLFIALTLTTSPLVNGSEKSE

SEQ ID NO: 1721105 - protein, 21 aa, Staphylococcus aureus
LLFLIFLSSCANTRHSESDKN

SEQ ID NO: 1721106 - protein, 18 aa, Staphylococcus aureus
LNGIYYYHPSVESIQKYA

SEQ ID NO: 1721107 - protein, 27 aa, Staphylococcus aureus
LPEDTTHVRWFLNINNEKRYVSKDITI

SEQ ID NO: 1721108 - protein, 18 aa, Staphylococcus aureus
LYYSVEYKNTATFNKLVK

SEQ ID NO: 1721109 - protein, 22 aa, Staphylococcus aureus
MKGGGYYTFELNKKLQPHRMGD

SEQ ID NO: 1721110 - protein, 26 aa, Staphylococcus aureus
MPSNTEILYELGLGKYIVGVSTVDDY

SEQ ID NO: 1721111 - protein, 27 aa, Staphylococcus aureus
MVFIMLLNIITPLFNKNEAFAARDISS

SEQ ID NO: 1721112 - protein, 21 aa, Staphylococcus aureus
NGIANIKALPSGDYILKEIEA

SEQ ID NO: 1721113 - protein, 23 aa, Staphylococcus aureus
NGKHKVDVLLGGGAKYFGKSNGN

SEQ ID NO: 1721114 - protein, 22 aa, Staphylococcus aureus
NLNWWDYEIGTPKSLTNTLILL

SEQ ID NO: 1721115 - protein, 20 aa, Staphylococcus aureus
NPEEQPISILFLGIDDNDGR

SEQ ID NO: 1721116 - protein, 17 aa, Staphylococcus aureus
NSFKVIPSYGHNSHRMH

SEQ ID NO: 1721117 - protein, 17 aa, Staphylococcus aureus
NSNLMEFNILTMGGKSG

SEQ ID NO: 1721118 - protein, 22 aa, Staphylococcus aureus
NTAMGNLKHALAEKDNTKRSVN

SEQ ID NO: 1721119 - protein, 20 aa, Staphylococcus aureus
PDEYRYGFYVKPTLNRLNGG

SEQ ID NO: 1721120 - protein, 26 aa, Staphylococcus aureus
PNEKPTLIYFMATWCPSCIYNEEIFK

SEQ ID NO: 1721121 - protein, 18 aa, Staphylococcus aureus
QRVINHYGSLIPLTPLDS

SEQ ID NO: 1721122 - protein, 18 aa, Staphylococcus aureus
QTLNTAMKGLRDSIANEA

SEQ ID NO: 1721123 - protein, 23 aa, Staphylococcus aureus
QVNDRLSIVGYPNPYKNKHHMFE

SEQ ID NO: 1721124 - protein, 28 aa, Staphylococcus aureus
SIPRDTISYIPKVGYYDKITHAHAYGGP

SEQ ID NO: 1721125 - protein, 35 aa, Staphylococcus aureus
SYTISFKTQGPTIDKLYYAAGGRALEYNQLFMYSQ

SEQ ID NO: 1721126 - protein, 23 aa, Staphylococcus aureus
TQQQIVYKAPKPLAGLNGESHDF

SEQ ID NO: 1721127 - protein, 23 aa, Staphylococcus aureus
VEKNLPGVTLKIKQLPFKQRVSL

SEQ ID NO: 1721128 - protein, 19 aa, Staphylococcus aureus
VFATLLFKTSQDAFESSQD

SEQ ID NO: 1721129 - protein, 27 aa, Staphylococcus aureus
YENEYFYISAIPYNLAEYRDYFEPLLN

SEQ ID NO: 1721130 - protein, 19 aa, Staphylococcus aureus
YGFYVKPTLNRLNGGFFGQ

SEQ ID NO: 1721131 - protein, 18 aa, Staphylococcus aureus
YYVRVNMKAFVEAVNELG

SEQ ID NO: 1721132 - protein, 23 aa, Staphylococcus aureus
AINRVNTLKNRALTDIGVTSTTA

SEQ ID NO: 1721133 - protein, 36 aa, Staphylococcus aureus; identical to SEQ ID NO: 1693945

SEQ ID NO: 1721134 - protein, 26 aa, Staphylococcus aureus
ASLKSSKIFVIPEANIPFKESEQAAI

SEQ ID NO: 1721135 - protein, 17 aa, Staphylococcus aureus
ATLVLGLLATGVITTES

SEQ ID NO: 1721136 - protein, 23 aa, Staphylococcus aureus
DLDNINDYTIPTGKKESATTDLY

SEQ ID NO: 1721137 - protein, 25 aa, Staphylococcus aureus
DNHQTQIIKILSKVKPDPPRIDGNS

SEQ ID NO: 1721138 - protein, 32 aa, Staphylococcus aureus; identical to SEQ ID NO: 1591338

SEQ ID NO: 1721139 - protein, 22 aa, Staphylococcus aureus
DTKKNIGYHFLNKPKITVKKES

SEQ ID NO: 1721140 - protein, 17 aa, Staphylococcus aureus
DYFVPDSELPPLVQSGF

SEQ ID NO: 1721141 - protein, 25 aa, Staphylococcus aureus
EKGIKGVYVILKDSNGKELDRTTTD

SEQ ID NO: 1721142 - protein, 23 aa, Staphylococcus aureus
ESATTDLYAYADQKKNNISADTN

SEQ ID NO: 1721143 - protein, 18 aa, Staphylococcus aureus
EVPVKVYPVANAKAPSRD

SEQ ID NO: 1721144 - protein, 25 aa, Staphylococcus aureus
FTSMAAVTLLSTLSPAALAIDSKNK

SEQ ID NO: 1721145 - protein, 26 aa, Staphylococcus aureus
FTSMAAVTLLSTLSPAALAIDSKNKP

SEQ ID NO: 1721146 - protein, 18 aa, Staphylococcus aureus
GKARTGWLIVDYAGYTWP

SEQ ID NO: 1721147 - protein, 26 aa, Staphylococcus aureus
GMKICLMLYLLIFLSSCSTNNKIVGQ

SEQ ID NO: 1721148 - protein, 19 aa, Staphylococcus aureus
GMVLYMNRNSRTTNGYYYV

SEQ ID NO: 1721149 - protein, 39 aa, Staphylococcus aureus; identical to SEQ ID NO: 1695966

SEQ ID NO: 1721150 - protein, 24 aa, Staphylococcus aureus
GTNNYFGYYSFREAPKTQIYTVKK

SEQ ID NO: 1721151 - protein, 25 aa, Staphylococcus aureus
GTRNVEVPVKVYPVANAKAPSRDVK

SEQ ID NO: 1721152 - protein, 18 aa, Staphylococcus aureus
IGAVVPQVTHKKAARDAI

SEQ ID NO: 1721153 - protein, 22 aa, Staphylococcus aureus
IIGIFIITGCDWQRTSKERSKN

SEQ ID NO: 1721154 - protein, 35 aa, Staphylococcus aureus
KESDSGIFYYQHSKKALGIWFVVDHNRVVEVTVGH

SEQ ID NO: 1721155 - protein, 18 aa, Staphylococcus aureus
KFTAPIKTFAPDSDKILS

SEQ ID NO: 1721156 - protein, 17 aa, Staphylococcus aureus
KGRKFKDFTSKFNIASE

SEQ ID NO: 1721157 - protein, 29 aa, Staphylococcus aureus
KGTNNYFGYYSFREAPKTQIYTVKKVTHL

SEQ ID NO: 1721158 - protein, 24 aa, Staphylococcus aureus
KHYHDNFWVTADMKRLSGTTTLDN

SEQ ID NO: 1721159 - protein, 20 aa, Staphylococcus aureus
KIRQHLVKNYGLYKGTTKYG

SEQ ID NO: 1721160 - protein, 31 aa, Staphylococcus aureus
KKGATVSDYYYWKIIDSLEAQFTGAIDLLED

SEQ ID NO: 1721161 - protein, 23 aa, Staphylococcus aureus
KMEDDKFYTFELTKKLQPHRMGD

SEQ ID NO: 1721162 - protein, 23 aa, Staphylococcus aureus
KNSRVDFGLAQWGLKQKPNESYI

SEQ ID NO: 1721163 - protein, 19 aa, Staphylococcus aureus
KVSIGILSISIGMFLALGM

SEQ ID NO: 1721164 - protein, 18 aa, Staphylococcus aureus
LAIFLLILLSSISHKMKT

SEQ ID NO: 1721165 - protein, 19 aa, Staphylococcus aureus
LALGILTTGMITTTAQPVK

SEQ ID NO: 1721166 - protein, 25 aa, Staphylococcus aureus
LCISLLILIIFATSCGSNKITGDSK

SEQ ID NO: 1721167 - protein, 23 aa, Staphylococcus aureus
LCISLLILIIFVTSCDGDNKITG

SEQ ID NO: 1721168 - protein, 18 aa, Staphylococcus aureus
LDFKLRKQLIEKHNLYGN

SEQ ID NO: 1721169 - protein, 24 aa, Staphylococcus aureus
LDTNDFVYQVQLPEGVEYVNNSLT

SEQ ID NO: 1721170 - protein, 23 aa, Staphylococcus aureus
LDYKARHWLTKEKKLYEFDGSAF

SEQ ID NO: 1721171 - protein, 22 aa, Staphylococcus aureus
LLISVIILTIFIMGCDSQSDTA

SEQ ID NO: 1721172 - protein, 32 aa, Staphylococcus aureus
LNDIKKHTQFIIDEILAIKLPAEVIKASPKVG

SEQ ID NO: 1721173 - protein, 19 aa, Staphylococcus aureus
LPGVTLKIKQLPFKQRVSL

SEQ ID NO: 1721174 - protein, 21 aa, Staphylococcus aureus
LRERAIKQHGLYSNGLKQGQI

SEQ ID NO: 1721175 - protein, 20 aa, Staphylococcus aureus
MYTNVIILSVFIIGCDSSSN

SEQ ID NO: 1721176 - protein, 17 aa, Staphylococcus aureus
NGKHKVDVLLGGGAKYF

SEQ ID NO: 1721177 - protein, 20 aa, Staphylococcus aureus
NIDVFIVLEDNKYQLKKYSV

SEQ ID NO: 1721178 - protein, 26 aa, Staphylococcus aureus
NIKSFALYISILLLIVVVAGCGKSDK

SEQ ID NO: 1721179 - protein, 17 aa, Staphylococcus aureus
NIVVIQPATQVKTDTRN

SEQ ID NO: 1721180 - protein, 25 aa, Staphylococcus aureus
NQNHQLFLLGKDKEKYKEGIEGKDV

SEQ ID NO: 1721181 - protein, 26 aa, Staphylococcus aureus
NSDNKYGYVLYPGLSKDVFKTKKDEV

SEQ ID NO: 1721182 - protein, 17 aa, Staphylococcus aureus
PEMRQVWEPMGNASIFI

SEQ ID NO: 1721183 - protein, 23 aa, Staphylococcus aureus
PTQKAPKLLLKGSGNLKGSSVGY

SEQ ID NO: 1721184 - protein, 19 aa, Staphylococcus aureus
PVAITAPYTPTTDPNANNI

SEQ ID NO: 1721185 - protein, 23 aa, Staphylococcus aureus
QHNYKSLKYYYSKPSIELKNLDG

SEQ ID NO: 1721186 - protein, 26 aa, Staphylococcus aureus
QLGTKAINAIQPNIVKKPAALAQINQ

SEQ ID NO: 1721187 - protein, 24 aa, Staphylococcus aureus
QLRKRYDISTKETPKLLLKGGGDL

SEQ ID NO: 1721188 - protein, 25 aa, Staphylococcus aureus
QNAPNEVLSFDDNGIRPSTNRSVPS

SEQ ID NO: 1721189 - protein, 30 aa, Staphylococcus aureus; identical to SEQ ID NO: 1699202

SEQ ID NO: 1721190 - protein, 19 aa, Staphylococcus aureus
QSWQAYDYVFLTCGTFAYH

SEQ ID NO: 1721191 - protein, 27 aa, Staphylococcus aureus
RASHAVLMYAPKSFLDFQKQLFAAQQD

SEQ ID NO: 1721192 - protein, 21 aa, Staphylococcus aureus
RGISDIDLRLSKQAKYTVYFK

SEQ ID NO: 1721193 - protein, 18 aa, Staphylococcus aureus
RHNGTIINIFDDMSEKDK

SEQ ID NO: 1721194 - protein, 35 aa, Staphylococcus aureus
RYSIRKVSIGILSISIGMFLALGMSNKAYADEIDK

SEQ ID NO: 1721195 - protein, 18 aa, Staphylococcus aureus
SLAALTILTSVTGIGTTL

SEQ ID NO: 1721196 - protein, 25 aa, Staphylococcus aureus
TGKKPASITAYNNSIRALQSDLTSA

SEQ ID NO: 1721197 - protein, 29 aa, Staphylococcus aureus
TVNVVNNLPGFTLINGGKVGVFSHAMVRT

SEQ ID NO: 1721198 - protein, 17 aa, Staphylococcus aureus
TVTFNETLTYKTYTQDF

SEQ ID NO: 1721199 - protein, 27 aa, Staphylococcus aureus
VGTASILVGTTLIFGLSGHEAKAAEHT

SEQ ID NO: 1721200 - protein, 42 aa, Staphylococcus aureus
VHSTITIRPEDYVVFIPPVGNQIRALIFYNNVVASNMSNAVT

SEQ ID NO: 1721201 - protein, 19 aa, Staphylococcus aureus
VKNYGLYKGTTKYGKITIN

SEQ ID NO: 1721202 - protein, 18 aa, Staphylococcus aureus
VLLFCYSQNHIATANVGV

SEQ ID NO: 1721203 - protein, 17 aa, Staphylococcus aureus
YDYVFLTCGTFAYHDPY

SEQ ID NO: 1721204 - protein, 21 aa, Staphylococcus aureus
YGSLIPLTPLDSSLLRKEQND

SEQ ID NO: 1721205 - protein, 27 aa, Staphylococcus aureus
AGANKPLPEMWPYGVNDSRSWDYKIRN

SEQ ID NO: 1721206 - protein, 17 aa, Staphylococcus aureus
AGTQLYHIVATNAYHKD

SEQ ID NO: 1721207 - protein, 19 aa, Staphylococcus aureus
ALQQIQNIATNKINLIKAN

SEQ ID NO: 1721208 - protein, 30 aa, Staphylococcus aureus
ASSKGAPYNLPTTPWNTLKASDAKEIALIT

SEQ ID NO: 1721209 - protein, 25 aa, Staphylococcus aureus
ATGLPTDGFTYKWNNAATGTNDANW

SEQ ID NO: 1721210 - protein, 20 aa, Staphylococcus aureus
DDIPPTINNPVGLNAKYYRG

SEQ ID NO: 1721211 - protein, 27 aa, Staphylococcus aureus
DNTNEAINIYFVPSDLVNPTISVGNYT

SEQ ID NO: 1721212 - protein, 19 aa, Staphylococcus aureus
DSRSWDYKIRNRSGQVIYD

SEQ ID NO: 1721213 - protein, 32 aa, Staphylococcus aureus
ELSFASKYRYPALVRSGFNPEFLTYLSNEKSN

SEQ ID NO: 1721214 - protein, 22 aa, Staphylococcus aureus
ENLDMLISSLSFADYEKYEEPE

SEQ ID NO: 1721215 - protein, 18 aa, Staphylococcus aureus
EQFFKDNFGLKVKATNVV

SEQ ID NO: 1721216 - protein, 20 aa, Staphylococcus aureus
ESEKNFGVYFTPQLKEFIQN

SEQ ID NO: 1721217 - protein, 18 aa, Staphylococcus aureus
EYYKGRGFELTNVTGYKY

SEQ ID NO: 1721218 - protein, 44 aa, Staphylococcus aureus
FEFEKQFGFMLKPWTTVRFMNVIPNRFIYKIALVGKDEKKYKDG

SEQ ID NO: 1721219 - protein, 18 aa, Staphylococcus aureus
FFIVSPLLLATIATDFTP

SEQ ID NO: 1721220 - protein, 24 aa, Staphylococcus aureus
FGHVERFIQNPPHGATVAWHDNPD

SEQ ID NO: 1721221 - protein, 33 aa, Staphylococcus aureus
FNFDEPAYLPRFVFGHYMKSYLSMFTKKYPNIS

SEQ ID NO: 1721222 - protein, 26 aa, Staphylococcus aureus
FTSMAALTLLSTLSPAALAIDSKNKP

SEQ ID NO: 1721223 - protein, 27 aa, Staphylococcus aureus
GIPHRYSTHYLLLEALREQLKIKPGHF

SEQ ID NO: 1721224 - protein, 19 aa, Staphylococcus aureus
GKVGVFSHAMVRTSMFDSG

SEQ ID NO: 1721225 - protein, 24 aa, Staphylococcus aureus
GTKAKADRYVPYTIAVNGTSTPIL

SEQ ID NO: 1721226 - protein, 24 aa, Staphylococcus aureus
GTQKVKPTIYFKLYKQDDNQNTTP

SEQ ID NO: 1721227 - protein, 21 aa, Staphylococcus aureus
GVPKVYTFIGKGDASYTISFK

SEQ ID NO: 1721228 - protein, 18 aa, Staphylococcus aureus
HDYRFIDRENADSGTFNY

SEQ ID NO: 1721229 - protein, 23 aa, Staphylococcus aureus
HGGTAISWIIKPLSRKHAVLVKK

SEQ ID NO: 1721230 - protein, 19 aa, Staphylococcus aureus
IEFKIKKGIKWHDGNELKI

SEQ ID NO: 1721231 - protein, 17 aa, Staphylococcus aureus
IGQQWTEPKYFHGRISA

SEQ ID NO: 1721232 - protein, 18 aa, Staphylococcus aureus
IISKIKPATTVKATALQQ

SEQ ID NO: 1721233 - protein, 25 aa, Staphylococcus aureus
ISKVNESFIYYPQNDLKGLGGEHND

SEQ ID NO: 1721234 - protein, 18 aa, Staphylococcus aureus
IVLVIFTNKDNKSDKPND

SEQ ID NO: 1721235 - protein, 22 aa, Staphylococcus aureus
KADALKAITALKLQMDEELKTA

SEQ ID NO: 1721236 - protein, 30 aa, Staphylococcus aureus
KEIARTDLGRYFDRFADKLDKTQTNAEVAE

SEQ ID NO: 1721237 - protein, 25 aa, Staphylococcus aureus
KELEQAVALIRTMPQRQQTSRRSSR

SEQ ID NO: 1721238 - protein, 37 aa, Staphylococcus aureus
KFSIRKYTVGTFSTVIATLVFLGFNTSQAHAAETNQP

SEQ ID NO: 1721239 - protein, 17 aa, Staphylococcus aureus
KLYSVPWGTYKQEAGAV

SEQ ID NO: 1721240 - protein, 30 aa, Staphylococcus aureus
KRVNKLVLGISLLFLVISITAGCGMGKEAE

SEQ ID NO: 1721241 - protein, 22 aa, Staphylococcus aureus
KSFRKYFAKGYSYNSTGLSFLK

SEQ ID NO: 1721242 - protein, 17 aa, Staphylococcus aureus
LAQLQNIYDTAIGQIDQ

SEQ ID NO: 1721243 - protein, 18 aa, Staphylococcus aureus
LDFKLRKHLIDKHNLYKT

SEQ ID NO: 1721244 - protein, 17 aa, Staphylococcus aureus
LFLLAMYELGKYVTEQV

SEQ ID NO: 1721245 - protein, 22 aa, Staphylococcus aureus
LKDHKVDIFGISYSGLCNTKYM

SEQ ID NO: 1721246 - protein, 18 aa, Staphylococcus aureus
LNAKYYRGDEVSFTMGVS

SEQ ID NO: 1721247 - protein, 24 aa, Staphylococcus aureus
LYISFLILVISFTAGCGIGKEAEV

SEQ ID NO: 1721248 - protein, 21 aa, Staphylococcus aureus
MKGGGYYTFELNKKLQPHRMG

SEQ ID NO: 1721249 - protein, 30 aa, Staphylococcus aureus
MMGNIKSFALYISILLLIVVVAGCGKSDKT

SEQ ID NO: 1721250 - protein, 32 aa, Staphylococcus aureus; identical to SEQ ID NO: 1687289

SEQ ID NO: 1721251 - protein, 25 aa, Staphylococcus aureus
NFTDKDWQITGIPRTLHIENSTNRT

SEQ ID NO: 1721252 - protein, 22 aa, Staphylococcus aureus
NIDDFMDDPLSYVKTPSNKVLG

SEQ ID NO: 1721253 - protein, 27 aa, Staphylococcus aureus
NSNNYQWYMHNNRLTVSAGDKVKAGDQ

SEQ ID NO: 1721254 - protein, 27 aa, Staphylococcus aureus
NTEAVRKIMFALNRFMGNKYSNIDLGL

SEQ ID NO: 1721255 - protein, 24 aa, Staphylococcus aureus
NVLSSSSIKLFKADNTPLTITNTT

SEQ ID NO: 1721256 - protein, 25 aa, Staphylococcus aureus
QITTNDILTLLKATTTVPGLRNNIA

SEQ ID NO: 1721257 - protein, 24 aa, Staphylococcus aureus
QLGTKAINAIQPNIVKKPASLAQT

SEQ ID NO: 1721258 - protein, 20 aa, Staphylococcus aureus
QPKGRKFKDFTSKFNIASEA

SEQ ID NO: 1721259 - protein, 25 aa, Staphylococcus aureus
RALEYNQLFMYSQLYVESTQDYQQR

SEQ ID NO: 1721260 - protein, 32 aa, Staphylococcus aureus
RNRSGQVIYDWPTVHINSLKDLARASDYFSEA

SEQ ID NO: 1721261 - protein, 28 aa, Staphylococcus aureus
RQFTLNGQVIQIMDIINPSNGFGGQPVT

SEQ ID NO: 1721262 - protein, 37 aa, Staphylococcus aureus; identical to SEQ ID NO: 1592037

SEQ ID NO: 1721263 - protein, 22 aa, Staphylococcus aureus
RSFYSIRKSTLGVASVIVSTLF

SEQ ID NO: 1721264 - protein, 18 aa, Staphylococcus aureus
SKQAGHPVFYVYAGNQGN

SEQ ID NO: 1721265 - protein, 29 aa, Staphylococcus aureus
SSKRKYDDTLPPLFDELPKEEPKSKPVVE

SEQ ID NO: 1721266 - protein, 28 aa, Staphylococcus aureus
TAKQTGDGYQWVIKFNKGHAPHENMIYW

SEQ ID NO: 1721267 - protein, 23 aa, Staphylococcus aureus
TATYKVVRTVPKQVFETARGVLY

SEQ ID NO: 1721268 - protein, 24 aa, Staphylococcus aureus
TFNYVKGIFDKINTLLGSNDPINN

SEQ ID NO: 1721269 - protein, 17 aa, Staphylococcus aureus
TQLYHIVATNAYHKDTE

SEQ ID NO: 1721270 - protein, 19 aa, Staphylococcus aureus
TTKNYQGMTNLIIKNADND

SEQ ID NO: 1721271 - protein, 25 aa, Staphylococcus aureus
TVSLFFFTFLIKNNLAYADVGVINL

SEQ ID NO: 1721272 - protein, 35 aa, Staphylococcus aureus
TYQREMDLYQIRWNGFYWAGANYKNFKTRTFKSTY

SEQ ID NO: 1721273 - protein, 23 aa, Staphylococcus aureus
VGYKNEYFYITYSSRSLKEYRKY

SEQ ID NO: 1721274 - protein, 29 aa, Staphylococcus aureus
VIIVLIGALGFAIYAAINHSTSSSNNQEQ

SEQ ID NO: 1721275 - protein, 19 aa, Staphylococcus aureus
VKDALEWLHKNAYGKEPDK

SEQ ID NO: 1721276 - protein, 19 aa, Staphylococcus aureus
VNTLKNRALNDIGVTSTTA

SEQ ID NO: 1721277 - protein, 24 aa, Staphylococcus aureus
VPVTVNVYQFEFPQTSYTTTVGGT

SEQ ID NO: 1721278 - protein, 18 aa, Staphylococcus aureus
YFVTTFYRNGKLPDEKNY

SEQ ID NO: 1721279 - protein, 19 aa, Staphylococcus aureus
YHIVATNAYHKDTEDFYIT

SEQ ID NO: 1721280 - protein, 25 aa, Staphylococcus aureus
AADAVYKAQLYLSSYGPKQYVEHLN

SEQ ID NO: 1721281 - protein, 19 aa, Staphylococcus aureus
AAIDAIQVDATVKPKANQA

SEQ ID NO: 1721282 - protein, 26 aa, Staphylococcus aureus
AIEQIKPKVRRKRAALDSIEENNKNQ

SEQ ID NO: 1721283 - protein, 26 aa, Staphylococcus aureus
ASALVLTTLGTGLHSSYLGLNTNKVV

SEQ ID NO: 1721284 - protein, 20 aa, Staphylococcus aureus
ATLAVGLIAPLANPFIEISK

SEQ ID NO: 1721285 - protein, 18 aa, Staphylococcus aureus
AVDAAQKQGLHDIQVVKS

SEQ ID NO: 1721286 - protein, 17 aa, Staphylococcus aureus
AYDLTLDGSAKLNNMTS

SEQ ID NO: 1721287 - protein, 17 aa, Staphylococcus aureus
DLRLGMDSSWMNRKGDG

SEQ ID NO: 1721288 - protein, 17 aa, Staphylococcus aureus
DMLPEDTTHVRWFLNIN

SEQ ID NO: 1721289 - protein, 17 aa, Staphylococcus aureus
EADAAVDAAQKQGLHDI

SEQ ID NO: 1721290 - protein, 20 aa, Staphylococcus aureus
ENEYFYITTIPYNLTEYRDY

SEQ ID NO: 1721291 - protein, 20 aa, Staphylococcus aureus
ENFKFFVQYGNFKDLSKYKD

SEQ ID NO: 1721292 - protein, 17 aa, Staphylococcus aureus
EYRKYYEPLIHKKDKEF

SEQ ID NO: 1721293 - protein, 19 aa, Staphylococcus aureus
GGYYTFELNKKLQPHRMGD

SEQ ID NO: 1721294 - protein, 23 aa, Staphylococcus aureus
GKTYKGIMPNWEPGKKVHLVGHS

SEQ ID NO: 1721295 - protein, 29 aa, Staphylococcus aureus
GNKYSNIDLGLTQWGFKQLPNESYIDYIK

SEQ ID NO: 1721296 - protein, 22 aa, Staphylococcus aureus
GSAPVAITAPYTPTTDPNANNI

SEQ ID NO: 1721297 - protein, 25 aa, Staphylococcus aureus
GTFNYVKGIFDKINTLLGSNDPINN

SEQ ID NO: 1721298 - protein, 26 aa, Staphylococcus aureus
GTTEEAPLPIAQPLVKIPQGTIQGEI

SEQ ID NO: 1721299 - protein, 17 aa, Staphylococcus aureus
GVYYDYIHSPILEIKKG

SEQ ID NO: 1721300 - protein, 26 aa, Staphylococcus aureus
GYENPDLGTFFLMATTSRIIGHDARE

SEQ ID NO: 1721301 - protein, 19 aa, Staphylococcus aureus
HGIVFNASLPLYKDAIHQK

SEQ ID NO: 1721302 - protein, 22 aa, Staphylococcus aureus
HYGSLIPLTPLDNSLLRKEQND

SEQ ID NO: 1721303 - protein, 25 aa, Staphylococcus aureus
IEGKDRFIDFIYNGQYNKISLVGSD

SEQ ID NO: 1721304 - protein, 24 aa, Staphylococcus aureus
IENLKNIPLIPKSKLPDILHHKFL

SEQ ID NO: 1721305 - protein, 17 aa, Staphylococcus aureus
IINSLTFTSNAPNRNYA

SEQ ID NO: 1721306 - protein, 17 aa, Staphylococcus aureus
IKIIQPETKIKPAAREK

SEQ ID NO: 1721307 - protein, 17 aa, Staphylococcus aureus
ILDKNFINAIKYDNVKF

SEQ ID NO: 1721308 - protein, 25 aa, Staphylococcus aureus
IPHRYSTHYLLLEALREQLKIKPGH

SEQ ID NO: 1721309 - protein, 23 aa, Staphylococcus aureus
KDYNYTYVIKNGNGYYYVTPNSD

SEQ ID NO: 1721310 - protein, 20 aa, Staphylococcus aureus
KYDNLYKFFKDNEKKYQYTG

SEQ ID NO: 1721311 - protein, 21 aa, Staphylococcus aureus
LCISLLILSIFVTSCDGDNKI

SEQ ID NO: 1721312 - protein, 36 aa, Staphylococcus aureus; identical to SEQ ID NO: 1591163

SEQ ID NO: 1721313 - protein, 37 aa, Staphylococcus aureus; identical to SEQ ID NO: 1594602

SEQ ID NO: 1721314 - protein, 18 aa, Staphylococcus aureus
LKEIEAPAPYTFDKDKEY

SEQ ID NO: 1721315 - protein, 21 aa, Staphylococcus aureus
LPSGDYILKEIEAPAPYTFDK

SEQ ID NO: 1721316 - protein, 21 aa, Staphylococcus aureus
LYISVMILMFAIAGCGKGNET

SEQ ID NO: 1721317 - protein, 18 aa, Staphylococcus aureus
MEFNILTMGGKSGAMVGY

SEQ ID NO: 1721318 - protein, 23 aa, Staphylococcus aureus
NHNRIIHSELLRFAGIGESKVET

SEQ ID NO: 1721319 - protein, 22 aa, Staphylococcus aureus
NLYTSGQCTYYVFDRVGGKIGS

SEQ ID NO: 1721320 - protein, 22 aa, Staphylococcus aureus
NNYTNPPLTNPILEGLEGSSSK

SEQ ID NO: 1721321 - protein, 25 aa, Staphylococcus aureus
NQDNGYYSYYYYNGYNNYNYNNYNN

SEQ ID NO: 1721322 - protein, 17 aa, Staphylococcus aureus
NRGVYYDYIHSPILEIK

SEQ ID NO: 1721323 - protein, 27 aa, Staphylococcus aureus
PENVSHLKIQFVPKNDAITDARGIYQL

SEQ ID NO: 1721324 - protein, 19 aa, Staphylococcus aureus
QAMFIYELRGDGNINLNVH

SEQ ID NO: 1721325 - protein, 25 aa, Staphylococcus aureus
QLGTKAINAIQPNIVKKPAALAQTN

SEQ ID NO: 1721326 - protein, 19 aa, Staphylococcus aureus
QLISYKYLNDKVKSVLKSE

SEQ ID NO: 1721327 - protein, 19 aa, Staphylococcus aureus
QPKGRKFKDFTSKFNIASE

SEQ ID NO: 1721328 - protein, 31 aa, Staphylococcus aureus
SDLKKYPYIKRMIWPFQYNISLKTKDSNVDL

SEQ ID NO: 1721329 - protein, 18 aa, Staphylococcus aureus
SIAALTILTSVTGVGTTM

SEQ ID NO: 1721330 - protein, 19 aa, Staphylococcus aureus
SIKKIINYPGKEDVSVIQV

SEQ ID NO: 1721331 - protein, 21 aa, Staphylococcus aureus
SIYLYGTVNGKSGWISKAYLA

SEQ ID NO: 1721332 - protein, 23 aa, Staphylococcus aureus
TDQQKAFYQVLHLKGITEEQRNQ

SEQ ID NO: 1721333 - protein, 17 aa, Staphylococcus aureus
TEFEVAYAPPYSHPKDL

SEQ ID NO: 1721334 - protein, 38 aa, Staphylococcus aureus
TGNSPARLMPDKILDLKYKLRVNNVPTPRTVTFNDTLT

SEQ ID NO: 1721335 - protein, 18 aa, Staphylococcus aureus
TLNYLKTLENRGWDFDGS

SEQ ID NO: 1721336 - protein, 18 aa, Staphylococcus aureus
TLVASALVLTTLGTGLHS

SEQ ID NO: 1721337 - protein, 26 aa, Staphylococcus aureus
TVNGKSGWISKAYLAVPAAPKKAVAQ

SEQ ID NO: 1721338 - protein, 23 aa, Staphylococcus aureus
VAELQNVTIPAIEAIVPQNDPDA

SEQ ID NO: 1721339 - protein, 30 aa, Staphylococcus aureus
VKLMYKGQPMTFRLLLVDTPETKHPKKGVE

SEQ ID NO: 1721340 - protein, 24 aa, Staphylococcus aureus
VLGIIFLFLVISITAGCGIGKEAK

SEQ ID NO: 1721341 - protein, 25 aa, Staphylococcus aureus
VLGISFLFLIISIFAGCGTGKEAEI

SEQ ID NO: 1721342 - protein, 18 aa, Staphylococcus aureus
VLNCKPDFWKTLKYKKDK

SEQ ID NO: 1721343 - protein, 25 aa, Staphylococcus aureus
YENEYFYITTIPYNLTEYRDYFEPL

SEQ ID NO: 1721344 - protein, 21 aa, Staphylococcus aureus
YGPRPQFNKTPKYVKYRDAGT

SEQ ID NO: 1721345 - protein, 27 aa, Staphylococcus aureus
YHKDTEDFYITLKIIDVKQPEGDQRVY

SEQ ID NO: 1721346 - protein, 20 aa, Staphylococcus aureus
AKQTYDYYKDTFGRESYDNQ

SEQ ID NO: 1721347 - protein, 33 aa, Staphylococcus aureus
ARGTHTKEVLFPDKSLKLSYKVNVANIDTPKNI

SEQ ID NO: 1721348 - protein, 26 aa, Staphylococcus aureus
CSMAGLYACAHYCGVWAIVNPIAGGV

SEQ ID NO: 1721349 - protein, 19 aa, Staphylococcus aureus
DFSKIYWGAKYNVSISSQS

SEQ ID NO: 1721350 - protein, 18 aa, Staphylococcus aureus
DKSIYLYGSVNGKSGWVS

SEQ ID NO: 1721351 - protein, 21 aa, Staphylococcus aureus
EAFTNALEDILSKATEDISDQ

SEQ ID NO: 1721352 - protein, 28 aa, Staphylococcus aureus
EASLKSSKIFVIPEANIPFKESEQAAIV

SEQ ID NO: 1721353 - protein, 17 aa, Staphylococcus aureus
EFEAFKKRSPKYNPGMN

SEQ ID NO: 1721354 - protein, 26 aa, Staphylococcus aureus
EKPMANVLVTLTYPDGTTKSVRTDAN

SEQ ID NO: 1721355 - protein, 23 aa, Staphylococcus aureus
ELDIKIRKILSDKYKIYYKDSEI

SEQ ID NO: 1721356 - protein, 34 aa, Staphylococcus aureus
ESDSGIFYYQHSKKSLGIWFVVDHNRVVEVTVGH

SEQ ID NO: 1721357 - protein, 21 aa, Staphylococcus aureus
ESELKHYYNKPILERKNVTGF

SEQ ID NO: 1721358 - protein, 27 aa, Staphylococcus aureus
FEVKQEAATLWYHPHPSPNTAKQVYNG

SEQ ID NO: 1721359 - protein, 18 aa, Staphylococcus aureus
FIKGGDGFDFGHVERFIQ

SEQ ID NO: 1721360 - protein, 22 aa, Staphylococcus aureus
FLSIILVVMSGLYHSAHASDSL

SEQ ID NO: 1721361 - protein, 21 aa, Staphylococcus aureus
FSFLALLLSFTSYAKAEDLHD

SEQ ID NO: 1721362 - protein, 24 aa, Staphylococcus aureus
GILILITLLYVIYTDKIEVREKID

SEQ ID NO: 1721363 - protein, 20 aa, Staphylococcus aureus
GKVGVFSHAMVRTSMFDSGD

SEQ ID NO: 1721364 - protein, 20 aa, Staphylococcus aureus
GLKQAIAGLTPDLAPLQAAK

SEQ ID NO: 1721365 - protein, 18 aa, Staphylococcus aureus
GNLLGPTLKLKKGDKVKI

SEQ ID NO: 1721366 - protein, 18 aa, Staphylococcus aureus
GSAPVAITAPYTPTTDPN

SEQ ID NO: 1721367 - protein, 24 aa, Staphylococcus aureus
IASSLSCVLLLLSAANTEANSANK

SEQ ID NO: 1721368 - protein, 32 aa, Staphylococcus aureus
IGKSKSEQIYYRALTEYLTSNSNFKDCKDALY

SEQ ID NO: 1721369 - protein, 21 aa, Staphylococcus aureus
IISLFLLVFSANFSNAYANEE

SEQ ID NO: 1721370 - protein, 27 aa, Staphylococcus aureus
INDQEKLIYWNPWDTELSIQDADSSLL

SEQ ID NO: 1721371 - protein, 20 aa, Staphylococcus aureus
IVITLFIFSSNHTVLSNGDV

SEQ ID NO: 1721372 - protein, 23 aa, Staphylococcus aureus
KALNWWDYEIGTPRSLTNTLILL

SEQ ID NO: 1721373 - protein, 21 aa, Staphylococcus aureus
KDGHTISTFWGDAKNWEGQAS

SEQ ID NO: 1721374 - protein, 19 aa, Staphylococcus aureus
KDNKGLNFVLTSGTFFVKM

SEQ ID NO: 1721375 - protein, 23 aa, Staphylococcus aureus
KEGKIRLRLLNGSNARDLNLKLS

SEQ ID NO: 1721376 - protein, 35 aa, Staphylococcus aureus
KESDSGIFYYQHSKKSLGIWFVVDHNRVVEVTVGH

SEQ ID NO: 1721377 - protein, 17 aa, Staphylococcus aureus
KLKGISFENSNGEWAYK

SEQ ID NO: 1721378 - protein, 19 aa, Staphylococcus aureus
KLTQDLFMNDYLRVYTNDD

SEQ ID NO: 1721379 - protein, 26 aa, Staphylococcus aureus
KNNETQYYHFFSIKDPADVYYTKKKA

SEQ ID NO: 1721380 - protein, 23 aa, Staphylococcus aureus
LDIKARNFLINKKNLYEFNSSPY

SEQ ID NO: 1721381 - protein, 17 aa, Staphylococcus aureus
LFENAYYILVYNEPRNE

SEQ ID NO: 1721382 - protein, 20 aa, Staphylococcus aureus
LFISAIILSIFIISCNSSSD

SEQ ID NO: 1721383 - protein, 22 aa, Staphylococcus aureus
LGALCVSQIWESNRASAVVSGE

SEQ ID NO: 1721384 - protein, 17 aa, Staphylococcus aureus
LINGGKVGVFSHAMVRT

SEQ ID NO: 1721385 - protein, 22 aa, Staphylococcus aureus
LITLFSIMFMVPNDTFAEGKHN

SEQ ID NO: 1721386 - protein, 24 aa, Staphylococcus aureus
LKEIDFKLRKYLIDNYGLYGEMST

SEQ ID NO: 1721387 - protein, 25 aa, Staphylococcus aureus
LKKIKFDDFDLYRLTKKEYNELHQS

SEQ ID NO: 1721388 - protein, 21 aa, Staphylococcus aureus
LLFLIFLSACANTRHSESDKN

SEQ ID NO: 1721389 - protein, 26 aa, Staphylococcus aureus
LNAINPIAPVTVVKQAARDAVSHDAQ

SEQ ID NO: 1721390 - protein, 19 aa, Staphylococcus aureus
LRTSLINFLPIHSLLSALK

SEQ ID NO: 1721391 - protein, 20 aa, Staphylococcus aureus
LRTSLINFLPIQSLLSALKN

SEQ ID NO: 1721392 - protein, 28 aa, Staphylococcus aureus
LVGDNAPALYPNYWGGNKFKVIEELRKQ

SEQ ID NO: 1721393 - protein, 31 aa, Staphylococcus aureus
NFGASLKADQFKYEVTLPQGVTYVNNSLTTT

SEQ ID NO: 1721394 - protein, 19 aa, Staphylococcus aureus
NRGVYYDYIHSPILEIKKG

SEQ ID NO: 1721395 - protein, 25 aa, Staphylococcus aureus
NYDYTKLVFAKPIYNDPSLVKSDTN

SEQ ID NO: 1721396 - protein, 26 aa, Staphylococcus aureus
PENVSHLKIQFVPKNDAITDARGIYQ

SEQ ID NO: 1721397 - protein, 33 aa, Staphylococcus aureus
PVTVTDIPLDPSALVYLVIPTSQTRDGGSEADQ

SEQ ID NO: 1721398 - protein, 20 aa, Staphylococcus aureus
QNIISKIKPATTVKATALQQ

SEQ ID NO: 1721399 - protein, 18 aa, Staphylococcus aureus
QVYNGLSGLLYIEDDKKN

SEQ ID NO: 1721400 - protein, 20 aa, Staphylococcus aureus
RAYYTKPSLEFKNEIGIILK

SEQ ID NO: 1721401 - protein, 19 aa, Staphylococcus aureus
RKRYHIPTKQAPELKLKGS

SEQ ID NO: 1721402 - protein, 20 aa, Staphylococcus aureus
RVNTLKNRALNDIGVTSTTA

SEQ ID NO: 1721403 - protein, 17 aa, Staphylococcus aureus
SAIILLEYDGVVHIGYD

SEQ ID NO: 1721404 - protein, 19 aa, Staphylococcus aureus
SIAALTILTSITGVGTTMV

SEQ ID NO: 1721405 - protein, 21 aa, Staphylococcus aureus
SIILLIVPDLIRLSKTFLIES

SEQ ID NO: 1721406 - protein, 42 aa, Staphylococcus aureus
SKNGTLIDSRYLNSALYYLEDYIIYAIGLTNKYEYGDNIYKE

SEQ ID NO: 1721407 - protein, 23 aa, Staphylococcus aureus
STNPYTIDIIMNKDALQAEVDRR

SEQ ID NO: 1721408 - protein, 17 aa, Staphylococcus aureus
STTITTLPSGWTSNLTK

SEQ ID NO: 1721409 - protein, 28 aa, Staphylococcus aureus
TKAMPKEMLPILDKPTIQYIIEEAARAG

SEQ ID NO: 1721410 - protein, 27 aa, Staphylococcus aureus
TLGICLVLLIILIGGCVIMTKTNGRNA

SEQ ID NO: 1721411 - protein, 19 aa, Staphylococcus aureus
TSLALSLLTTGASIVTTQS

SEQ ID NO: 1721412 - protein, 24 aa, Staphylococcus aureus
VGYKNEYFYITYSSRSLKEYRKYY

SEQ ID NO: 1721413 - protein, 23 aa, Staphylococcus aureus
AKGHYFVTTFYRNGKLPDEKNYK

SEQ ID NO: 1721414 - protein, 20 aa, Staphylococcus aureus
ALQQIQNIATNKINLIKANN

SEQ ID NO: 1721415 - protein, 20 aa, Staphylococcus aureus
AMTQLKQGIANKAQIKGSEN

SEQ ID NO: 1721416 - protein, 48 aa, Staphylococcus aureus; identical to SEQ ID NO: 1594168

SEQ ID NO: 1721417 - protein, 47 aa, Staphylococcus aureus; identical to SEQ ID NO: 1591503

SEQ ID NO: 1721418 - protein, 24 aa, Staphylococcus aureus
ATTSFNVTIKPLRDKYRVGTSSTA

SEQ ID NO: 1721419 - protein, 18 aa, Staphylococcus aureus
AVFISHESIGYLADCYGF

SEQ ID NO: 1721420 - protein, 37 aa, Staphylococcus aureus
DAITDARGIYQLRDGYKYYDFVDSIGLHSGSHVYVER

SEQ ID NO: 1721421 - protein, 18 aa, Staphylococcus aureus
DKKLVVSAPTKKPTSPTT

SEQ ID NO: 1721422 - protein, 25 aa, Staphylococcus aureus
DKNRPVTYAGFKWNGKAFACSMAGL

SEQ ID NO: 1721423 - protein, 26 aa, Staphylococcus aureus
DRHPTRGSILQTVNGPFGHVAYVEKV

SEQ ID NO: 1721424 - protein, 24 aa, Staphylococcus aureus
EDNSYYYPVIKDGKIVYTLTLSPK

SEQ ID NO: 1721425 - protein, 17 aa, Staphylococcus aureus
EERAIERGPKGFNFNDN

SEQ ID NO: 1721426 - protein, 19 aa, Staphylococcus aureus
EKLLSFFAQAKSYRDALAA

SEQ ID NO: 1721427 - protein, 17 aa, Staphylococcus aureus
EKQIYIYNSTWGRGLDI

SEQ ID NO: 1721428 - protein, 32 aa, Staphylococcus aureus
ENSKYDTPIPDWYLGSILNRLGDQIYYAKELT

SEQ ID NO: 1721429 - protein, 23 aa, Staphylococcus aureus
EQLDQAMERLINGIQDKDQVKQS

SEQ ID NO: 1721430 - protein, 23 aa, Staphylococcus aureus
ESELKHYYNKPILERKNVTGFKY

SEQ ID NO: 1721431 - protein, 17 aa, Staphylococcus aureus
EYRKYYEPLIHKNDKEF

SEQ ID NO: 1721432 - protein, 23 aa, Staphylococcus aureus
FSYDLFYTGYGLPESFLKIYKDN

SEQ ID NO: 1721433 - protein, 32 aa, Staphylococcus aureus; identical to SEQ ID NO: 1590348

SEQ ID NO: 1721434 - protein, 30 aa, Staphylococcus aureus; identical to SEQ ID NO: 1590349

SEQ ID NO: 1721435 - protein, 25 aa, Staphylococcus aureus
GMTIGLAMNSVYYYKKEKDGSTFSK

SEQ ID NO: 1721436 - protein, 17 aa, Staphylococcus aureus
GNAVFISHESIGYLADC

SEQ ID NO: 1721437 - protein, 38 aa, Staphylococcus aureus
GNSPARLMPDKILDLKYKLRVNNVPTPRTVTFNDTLTY

SEQ ID NO: 1721438 - protein, 26 aa, Staphylococcus aureus
GTASILVGTTLIFGLGNQEAKAAENT

SEQ ID NO: 1721439 - protein, 17 aa, Staphylococcus aureus
GTIINIFDDMSEKDKEE

SEQ ID NO: 1721440 - protein, 20 aa, Staphylococcus aureus
GYPVGTYINASSKGAPYNLP

SEQ ID NO: 1721441 - protein, 27 aa, Staphylococcus aureus
HDTANNLITYTFTDYVDRFNSVQMGIN

SEQ ID NO: 1721442 - protein, 32 aa, Staphylococcus aureus; identical to SEQ ID NO: 1591640

SEQ ID NO: 1721443 - protein, 21 aa, Staphylococcus aureus
IIDDFFMDTNMNRPLNITKFN

SEQ ID NO: 1721444 - protein, 17 aa, Staphylococcus aureus
ISLLLGILATGVNTTTE

SEQ ID NO: 1721445 - protein, 17 aa, Staphylococcus aureus
KAPKLLLKGSGNLKGSS

SEQ ID NO: 1721446 - protein, 18 aa, Staphylococcus aureus
KEIENFKFFVQYGNFKDF

SEQ ID NO: 1721447 - protein, 27 aa, Staphylococcus aureus
KELRKAMLYAIDREKWIKAFFNGYASE

SEQ ID NO: 1721448 - protein, 20 aa, Staphylococcus aureus
KGMVLYMNRNSRTTNGYYYV

SEQ ID NO: 1721449 - protein, 17 aa, Staphylococcus aureus
KKLVVSAPTKKPTSPTT

SEQ ID NO: 1721450 - protein, 18 aa, Staphylococcus aureus
KKNKNFLLDLMFNNKNGD

SEQ ID NO: 1721451 - protein, 17 aa, Staphylococcus aureus
KLPVRLVSYSPVPEDHA

SEQ ID NO: 1721452 - protein, 22 aa, Staphylococcus aureus
KNVELLGKMYKTYFFKKGESKS

SEQ ID NO: 1721453 - protein, 18 aa, Staphylococcus aureus
KNVNYQYAVPSYSPTHYV

SEQ ID NO: 1721454 - protein, 24 aa, Staphylococcus aureus
KVKSGDYFTIKYSDTVQVYGLNPE

SEQ ID NO: 1721455 - protein, 19 aa, Staphylococcus aureus
KYYEPLIHKNDKEFKEGME

SEQ ID NO: 1721456 - protein, 18 aa, Staphylococcus aureus
LDGTRLLDQAKQTAKQQL

SEQ ID NO: 1721457 - protein, 26 aa, Staphylococcus aureus
LDSIALVAPEHIVRAAARDAVKQQYE

SEQ ID NO: 1721458 - protein, 18 aa, Staphylococcus aureus
LFLLAMYELGKYVTEQVY

SEQ ID NO: 1721459 - protein, 17 aa, Staphylococcus aureus
LGFVLMALNIRKIAAQR

SEQ ID NO: 1721460 - protein, 18 aa, Staphylococcus aureus
LIGQQWTEPKYFHGRISA

SEQ ID NO: 1721461 - protein, 18 aa, Staphylococcus aureus
LKMANFHKYNLEELSMKE

SEQ ID NO: 1721462 - protein, 17 aa, Staphylococcus aureus
LPIIIQDKTFVSKKLNY

SEQ ID NO: 1721463 - protein, 24 aa, Staphylococcus aureus
LTGFILILLLEGIFTNSASAIEYS

SEQ ID NO: 1721464 - protein, 17 aa, Staphylococcus aureus
MNVKGMVLYMNRNSRTT

SEQ ID NO: 1721465 - protein, 47 aa, Staphylococcus aureus
MTAKQTGDGYQWVIKFNKGHAPHQNMIFWFALPADQVPVGRTDFVTV

SEQ ID NO: 1721466 - protein, 20 aa, Staphylococcus aureus
MTTKNYQGMTNLIIKNADND

SEQ ID NO: 1721467 - protein, 23 aa, Staphylococcus aureus
NAGLKVLSAPSLDYGLIGFVSHD

SEQ ID NO: 1721468 - protein, 30 aa, Staphylococcus aureus; identical to SEQ ID NO: 1698203

SEQ ID NO: 1721469 - protein, 21 aa, Staphylococcus aureus
NAVTILPDDIPPTINNPVGLN

SEQ ID NO: 1721470 - protein, 26 aa, Staphylococcus aureus
NFTDKDWQITGIPRTLHIENSTNRTN

SEQ ID NO: 1721471 - protein, 22 aa, Staphylococcus aureus
NHNRIIHSELLRFAGIGESKVE

SEQ ID NO: 1721472 - protein, 32 aa, Staphylococcus aureus; identical to SEQ ID NO: 1593061

SEQ ID NO: 1721473 - protein, 22 aa, Staphylococcus aureus
NTKDGIKPLLAKKWDVSEDGKT

SEQ ID NO: 1721474 - protein, 19 aa, Staphylococcus aureus
PEDHAYIRFPVSDGTQELK

SEQ ID NO: 1721475 - protein, 17 aa, Staphylococcus aureus
PINLWLDGKQNTVPLET

SEQ ID NO: 1721476 - protein, 19 aa, Staphylococcus aureus
PINLWVNGEHQTISTDKVS

SEQ ID NO: 1721477 - protein, 20 aa, Staphylococcus aureus
PVKHVIPEIVAHSHYTVQGQ

SEQ ID NO: 1721478 - protein, 17 aa, Staphylococcus aureus
RENADSGTFNYVKGIFD

SEQ ID NO: 1721479 - protein, 18 aa, Staphylococcus aureus
RLLIAFAVLFSADFIYQS

SEQ ID NO: 1721480 - protein, 44 aa, Staphylococcus aureus
RNIELVGNLLPGDYFGTIRFGRKEQLFEIRVKPHTPRITTTAEE

SEQ ID NO: 1721481 - protein, 18 aa, Staphylococcus aureus
RTSLINFLPIHSLLSALK

SEQ ID NO: 1721482 - protein, 18 aa, Staphylococcus aureus
SFFAQAKSYRDALAAKQL

SEQ ID NO: 1721483 - protein, 28 aa, Staphylococcus aureus
SGFRNEYYYLTAIPYTLDEYKKYFQPLI

SEQ ID NO: 1721484 - protein, 20 aa, Staphylococcus aureus
SILAQLQNIYDTAIGQIDQD

SEQ ID NO: 1721485 - protein, 19 aa, Staphylococcus aureus
SILLIVVLVLSACGKSSNK

SEQ ID NO: 1721486 - protein, 19 aa, Staphylococcus aureus
SKRYLFIEYIPDNVLNCKP

SEQ ID NO: 1721487 - protein, 22 aa, Staphylococcus aureus
SLKELDFKLRKQLIDKHDLYKT

SEQ ID NO: 1721488 - protein, 27 aa, Staphylococcus aureus
TELNTAMTALKRAIADKADTKASGNYV

SEQ ID NO: 1721489 - protein, 31 aa, Staphylococcus aureus
TGSEEMDLPLKELALITGAALLARRRSKKEK

SEQ ID NO: 1721490 - protein, 23 aa, Staphylococcus aureus
TIVLLIIILSLLLVRNEHLDRFN

SEQ ID NO: 1721491 - protein, 17 aa, Staphylococcus aureus
TQKAPKLLLKGSGNLKG

SEQ ID NO: 1721492 - protein, 31 aa, Staphylococcus aureus
TSNLNNMNFLRWVNFPQDYTVTWTNAKIANR

SEQ ID NO: 1721493 - protein, 18 aa, Staphylococcus aureus
TTKKAPKLLLKGSGNLKG

SEQ ID NO: 1721494 - protein, 23 aa, Staphylococcus aureus
TTNEATIAAITPDANVKPQAKQA

SEQ ID NO: 1721495 - protein, 29 aa, Staphylococcus aureus
VKTPSNKVLGFYPTSANTNAFRPGGVNPL

SEQ ID NO: 1721496 - protein, 23 aa, Staphylococcus aureus
VTTTLLLGSILMNPVANAADSDI

SEQ ID NO: 1721497 - protein, 21 aa, Staphylococcus aureus
WFISVIILGIFIIGCDSSSDT

SEQ ID NO: 1721498 - protein, 27 aa, Staphylococcus aureus
YDDNYSLTTLIQNLFNLNSDISDYEQP

SEQ ID NO: 1721499 - protein, 17 aa, Staphylococcus aureus
YDNLYKFFKENEKKYQY

SEQ ID NO: 1721500 - protein, 23 aa, Staphylococcus aureus
YENAYPILKKYKIPATGFIITGH

SEQ ID NO: 1721501 - protein, 27 aa, Staphylococcus aureus
YLDKPRNIPINIWINGNHKTISTNKVS

SEQ ID NO: 1721502 - protein, 29 aa, Staphylococcus aureus
AINVKSIDQFLYFDLIYSIKDTKLGNYDN

SEQ ID NO: 1721503 - protein, 30 aa, Staphylococcus aureus; identical to SEQ ID NO: 1591506

SEQ ID NO: 1721504 - protein, 17 aa, Staphylococcus aureus
CLVSLLTILLLAISNMY

SEQ ID NO: 1721505 - protein, 30 aa, Staphylococcus aureus
CSVVFSLFFFLLLFLVIFFADDTDSGENNK

SEQ ID NO: 1721506 - protein, 51 aa, Staphylococcus aureus; identical to SEQ ID NO: 1591507

SEQ ID NO: 1721507 - protein, 34 aa, Staphylococcus aureus; identical to SEQ ID NO: 1592206

SEQ ID NO: 1721508 - protein, 19 aa, Staphylococcus aureus
DFKIRKHLIDHYGLYGEMS

SEQ ID NO: 1721509 - protein, 27 aa, Staphylococcus aureus
DGDRIIETAPTDYLSWGVGAVGNPRFI

SEQ ID NO: 1721510 - protein, 24 aa, Staphylococcus aureus
DGMALLFRHFYATSLHKQFMYNSQ

SEQ ID NO: 1721511 - protein, 20 aa, Staphylococcus aureus
DLRLSKQAKYTVYFKNGTKK

SEQ ID NO: 1721512 - protein, 25 aa, Staphylococcus aureus
DNALNAVTRAKAALNGADNLRNAKT

SEQ ID NO: 1721513 - protein, 29 aa, Staphylococcus aureus
DSGTFNYVKGIFDKINTLLGSNDPINNKD

SEQ ID NO: 1721514 - protein, 21 aa, Staphylococcus aureus
DTISYIPKVGYYDKITHAHAY

SEQ ID NO: 1721515 - protein, 17 aa, Staphylococcus aureus
EQFFKDNFGLKVKATNV

SEQ ID NO: 1721516 - protein, 18 aa, Staphylococcus aureus
EVIGIHWGGVPNQFNGAV

SEQ ID NO: 1721517 - protein, 17 aa, Staphylococcus aureus
EVQESIFTKADKRELIT

SEQ ID NO: 1721518 - protein, 33 aa, Staphylococcus aureus
FASNLANMNFLRWVNFPQDYTVTWTNAKIANRP

SEQ ID NO: 1721519 - protein, 24 aa, Staphylococcus aureus
FGHVERFIQNPPHGATVAWHDSPD

SEQ ID NO: 1721520 - protein, 23 aa, Staphylococcus aureus
GANKPLQQMWEYGVNDPDRSHDF

SEQ ID NO: 1721521 - protein, 19 aa, Staphylococcus aureus
GEQFFKDNFGLKVKATNVV

SEQ ID NO: 1721522 - protein, 24 aa, Staphylococcus aureus
GKDSPLKYWPKFDKKQLAISTLDF

SEQ ID NO: 1721523 - protein, 24 aa, Staphylococcus aureus
GMTIGLAMNSVYYYKKEKDGSTFS

SEQ ID NO: 1721524 - protein, 28 aa, Staphylococcus aureus
GNTTDAINIYFVPSDLVNPTISVGNYTN

SEQ ID NO: 1721525 - protein, 20 aa, Staphylococcus aureus
GPGMSLTHPNQSYDSFRKEV

SEQ ID NO: 1721526 - protein, 27 aa, Staphylococcus aureus
GRALEYNQLFMYSQLYVESTQDHQQRL

SEQ ID NO: 1721527 - protein, 28 aa, Staphylococcus aureus
GTQITTNDILTLLKATTTVPGLRNNIAG

SEQ ID NO: 1721528 - protein, 23 aa, Staphylococcus aureus
GVASVIVSTLFLITSQHQAQAAE

SEQ ID NO: 1721529 - protein, 44 aa, Staphylococcus aureus; identical to SEQ ID NO: 1594366

SEQ ID NO: 1721530 - protein, 17 aa, Staphylococcus aureus
HALAEKDNTKRSVNYTD

SEQ ID NO: 1721531 - protein, 25 aa, Staphylococcus aureus
HGKDSPLKYWPKFDKKQLAISTLDF

SEQ ID NO: 1721532 - protein, 27 aa, Staphylococcus aureus
HSRQYAKRQMTWFKNKMSVHWLDKENM

SEQ ID NO: 1721533 - protein, 17 aa, Staphylococcus aureus
IAKIEAIQPATTTKDNA

SEQ ID NO: 1721534 - protein, 18 aa, Staphylococcus aureus
IALSLILSLSVTPIANAE

SEQ ID NO: 1721535 - protein, 25 aa, Staphylococcus aureus
IDGLVTKLQAALIDNQAAIAELDAK

SEQ ID NO: 1721536 - protein, 20 aa, Staphylococcus aureus
IFLFLLLNSNSEDSGNITIT

SEQ ID NO: 1721537 - protein, 30 aa, Staphylococcus aureus
IGKSKSEQIYYRALTEYLTSNSNFKDCKDA

SEQ ID NO: 1721538 - protein, 18 aa, Staphylococcus aureus
IINSLTFTSNAPNRNYAT

SEQ ID NO: 1721539 - protein, 20 aa, Staphylococcus aureus
INSAYIIKVVSKYTPTSDGE

SEQ ID NO: 1721540 - protein, 27 aa, Staphylococcus aureus
IPNRLNKFSIRKYSVGTASILVGTTLI

SEQ ID NO: 1721541 - protein, 24 aa, Staphylococcus aureus
ITTNDILTMLKATTTVPGLRNNIT

SEQ ID NO: 1721542 - protein, 30 aa, Staphylococcus aureus; identical to SEQ ID NO: 1590360

SEQ ID NO: 1721543 - protein, 29 aa, Staphylococcus aureus
KDNLSADLGIYKPKYNLGDYVWEDTNKNG

SEQ ID NO: 1721544 - protein, 23 aa, Staphylococcus aureus
KEIENFKFFVQYGSFKGIENYEN

SEQ ID NO: 1721545 - protein, 31 aa, Staphylococcus aureus
KEKYDTAKYYYNTYYKYKGAIDKAVLTLLGD

SEQ ID NO: 1721546 - protein, 24 aa, Staphylococcus aureus
KESATTDLYAYADQKKNNISADTN

SEQ ID NO: 1721547 - protein, 38 aa, Staphylococcus aureus; identical to SEQ ID NO: 1591543

SEQ ID NO: 1721548 - protein, 38 aa, Staphylococcus aureus; identical to SEQ ID NO: 1594506

SEQ ID NO: 1721549 - protein, 32 aa, Staphylococcus aureus
KIRNRSGQVIYSWPTVHVYSLEDLSRASDYFS

SEQ ID NO: 1721550 - protein, 30 aa, Staphylococcus aureus
KKGATVSDYYYWKIIDSLEAQFTGAIDLLE

SEQ ID NO: 1721551 - protein, 26 aa, Staphylococcus aureus
KNTDGSISLIIFPSPYYSPAFTKGEK

SEQ ID NO: 1721552 - protein, 32 aa, Staphylococcus aureus
KVPVNISGIPLDPSALVYLVAPTNQTTNGGSE

SEQ ID NO: 1721553 - protein, 28 aa, Staphylococcus aureus
KYNSLKQAIAGLTPDLAPLQTAKTQLQN

SEQ ID NO: 1721554 - protein, 19 aa, Staphylococcus aureus
LDFKLRKKLMEEEKLYGAV

SEQ ID NO: 1721555 - protein, 19 aa, Staphylococcus aureus
LDGTRLLDQAKQTAKQQLN

SEQ ID NO: 1721556 - protein, 17 aa, Staphylococcus aureus
LIPNLPNGDYRVEFSNL

SEQ ID NO: 1721557 - protein, 33 aa, Staphylococcus aureus; identical to SEQ ID NO: 1594626

SEQ ID NO: 1721558 - protein, 21 aa, Staphylococcus aureus
LRAKLDIILGDAKDPVRITNE

SEQ ID NO: 1721559 - protein, 25 aa, Staphylococcus aureus
LTGFILILLLEGIFTNSASAIEYSD

SEQ ID NO: 1721560 - protein, 24 aa, Staphylococcus aureus
MCISLLIVIIFVTSCGGGNKITGD

SEQ ID NO: 1721561 - protein, 33 aa, Staphylococcus aureus
MIKVGTHKKLTFVLWVLLIGSVGFGIYKNFTAI

SEQ ID NO: 1721562 - protein, 19 aa, Staphylococcus aureus
NAQHMNFQFVGTYGPNKDV

SEQ ID NO: 1721563 - protein, 30 aa, Staphylococcus aureus
NASSKGAPYNLPTTPWNTLKASDSKEIALM

SEQ ID NO: 1721564 - protein, 41 aa, Staphylococcus aureus; identical to SEQ ID NO: 1594693

SEQ ID NO: 1721565 - protein, 24 aa, Staphylococcus aureus
NQKNESTLHLSFEKGIKGTVDKNG

SEQ ID NO: 1721566 - protein, 22 aa, Staphylococcus aureus
NRGVYYDYIHSPILEIKKGNEE

SEQ ID NO: 1721567 - protein, 20 aa, Staphylococcus aureus
NRKGMIPNRLNKFSIRKYSV

SEQ ID NO: 1721568 - protein, 33 aa, Staphylococcus aureus
NSLNWWDYEIGTPRALTNTLLLMDDMLTKDEMK

SEQ ID NO: 1721569 - protein, 20 aa, Staphylococcus aureus
PARPQFNKTPKYVKYRDAGT

SEQ ID NO: 1721570 - protein, 23 aa, Staphylococcus aureus
PDDIEMLQDLVLAATNEAMNKAD

SEQ ID NO: 1721571 - protein, 24 aa, Staphylococcus aureus
PEGDQRVYRMSTYDITTDEISKVK

SEQ ID NO: 1721572 - protein, 17 aa, Staphylococcus aureus
PKVYTFIGQGDASYTIS

SEQ ID NO: 1721573 - protein, 23 aa, Staphylococcus aureus
PNEPSYEEYLNAKRATEEMENNP

SEQ ID NO: 1721574 - protein, 18 aa, Staphylococcus aureus
QDPHAWLSLDNGIKYVKT

SEQ ID NO: 1721575 - protein, 17 aa, Staphylococcus aureus
QESIFTKADKRELITAK

SEQ ID NO: 1721576 - protein, 35 aa, Staphylococcus aureus; identical to SEQ ID NO: 1591578

SEQ ID NO: 1721577 - protein, 18 aa, Staphylococcus aureus
QLHRQILEQAIVDGLKIY

SEQ ID NO: 1721578 - protein, 17 aa, Staphylococcus aureus
QVLRQTKVPAVLLELGY

SEQ ID NO: 1721579 - protein, 22 aa, Staphylococcus aureus
RALKLLEAAGLIKLKKDFGLAG

SEQ ID NO: 1721580 - protein, 24 aa, Staphylococcus aureus
RASDYFSEAGATPATKAFGRQTFE

SEQ ID NO: 1721581 - protein, 17 aa, Staphylococcus aureus
RGEQFFMDNFGLKVKAT

SEQ ID NO: 1721582 - protein, 18 aa, Staphylococcus aureus
RKHLIDHYGLYGEMSSGT

SEQ ID NO: 1721583 - protein, 25 aa, Staphylococcus aureus
RNELQAFFDANYHDYRFIDRENADS

SEQ ID NO: 1721584 - protein, 26 aa, Staphylococcus aureus
RTTDKYGYYNYAGYSNFIVTSNDTGG

SEQ ID NO: 1721585 - protein, 27 aa, Staphylococcus aureus
SGTFNYVKGIFDKINTLLGSNDPINNK

SEQ ID NO: 1721586 - protein, 20 aa, Staphylococcus aureus
SIKKIINYPGKEDVSVIQVE

SEQ ID NO: 1721587 - protein, 19 aa, Staphylococcus aureus
SILAQLQNIYDTAIGQIDQ

SEQ ID NO: 1721588 - protein, 23 aa, Staphylococcus aureus
SKVKQAFINANRDAISFAEGDIS

SEQ ID NO: 1721589 - protein, 23 aa, Staphylococcus aureus
SLFNDKIPYIKEPKLTKQNIEQA

SEQ ID NO: 1721590 - protein, 21 aa, Staphylococcus aureus
SNEKGWIAGWHTNLDIVADNT

SEQ ID NO: 1721591 - protein, 29 aa, Staphylococcus aureus
SNENFTDKDWQITGIPRTLHIENSTNRTN

SEQ ID NO: 1721592 - protein, 23 aa, Staphylococcus aureus
SNKYIYNIELITVTPEISHWKVK

SEQ ID NO: 1721593 - protein, 18 aa, Staphylococcus aureus
SVTSIQPLRINLTSNENF

SEQ ID NO: 1721594 - protein, 21 aa, Staphylococcus aureus
TAKNALNGDAKLIAAQNAAKQ

SEQ ID NO: 1721595 - protein, 26 aa, Staphylococcus aureus
TATYKVVRTVPKHVFETARGVLYPGV

SEQ ID NO: 1721596 - protein, 18 aa, Staphylococcus aureus
TDGGLSWSDDHKSLIYRY

SEQ ID NO: 1721597 - protein, 26 aa, Staphylococcus aureus
TDGNDNIKVILPKVQVKPAARQSVGV

SEQ ID NO: 1721598 - protein, 30 aa, Staphylococcus aureus; identical to SEQ ID NO: 1591595

SEQ ID NO: 1721599 - protein, 20 aa, Staphylococcus aureus
TKEHPLKIKLITYDGRPELS

SEQ ID NO: 1721600 - protein, 24 aa, Staphylococcus aureus
TNHVKAMRWPFQYNIGLKTNDKYV

SEQ ID NO: 1721601 - protein, 20 aa, Staphylococcus aureus
TNKAPKLLLKGTGNLKGSSV

SEQ ID NO: 1721602 - protein, 24 aa, Staphylococcus aureus
TNLNWWDYEIGTPRALTNTLILLN

SEQ ID NO: 1721603 - protein, 20 aa, Staphylococcus aureus
TQNIVVIQPATQVKTDARNA

SEQ ID NO: 1721604 - protein, 32 aa, Staphylococcus aureus
TSNLNNMNFLRWVNFPQDYTVTWTNAKIANRP

SEQ ID NO: 1721605 - protein, 17 aa, Staphylococcus aureus
VGAVASVLILGACGNSN

SEQ ID NO: 1721606 - protein, 42 aa, Staphylococcus aureus
VNVAKTGTAHLFKVPTDADRLDLQFIPDNTAVADASRITTNK

SEQ ID NO: 1721607 - protein, 23 aa, Staphylococcus aureus
VQHLNVDVTYPGISAAKRVPVTV

SEQ ID NO: 1721608 - protein, 28 aa, Staphylococcus aureus
YDFVCEIDTLYAAYFNHSQYGHNAKELR

SEQ ID NO: 1721609 - protein, 27 aa, Staphylococcus aureus
YDNHQTQIIKILSKVKPDPPRIDGNSV

SEQ ID NO: 1721610 - protein, 19 aa, Staphylococcus aureus
YHIVASNAYHKDTEDFYIS

SEQ ID NO: 1721611 - protein, 26 aa, Staphylococcus aureus
YHKDTEDFYITLKIIDVKQPEGDQRV

SEQ ID NO: 1721612 - protein, 34 aa, Staphylococcus aureus
YSIRKYKVGIFSTLIGTVLLLSNPNGAQALTTDN

SEQ ID NO: 1721613 - protein, 18 aa, Staphylococcus aureus
YYEPLIHKNDKEFKEGME

SEQ ID NO: 1721614 - protein, 17 aa, Staphylococcus aureus
YYNKPILERKNVTGFKY

SEQ ID NO: 1721615 - protein, 36 aa, Staphylococcus aureus
AITDARGIYQLKDGYKYYSFVDSIGLHSGSHVYVER

SEQ ID NO: 1721616 - protein, 23 aa, Staphylococcus aureus
AKQDIIQAVTTRKQQIKKSNASL

SEQ ID NO: 1721617 - protein, 22 aa, Staphylococcus aureus
ALILKMQGFISSRTTYYNYKKT

SEQ ID NO: 1721618 - protein, 21 aa, Staphylococcus aureus
ALLFFTSLVISPLNVKANENI

SEQ ID NO: 1721619 - protein, 24 aa, Staphylococcus aureus
ALYMSVFLLIIFIVGCRNMKDEQK

SEQ ID NO: 1721620 - protein, 22 aa, Staphylococcus aureus
AQPEVTLTADPFSVAVEMNKDA

SEQ ID NO: 1721621 - protein, 19 aa, Staphylococcus aureus
AVQQLNRTGTTTGKKPASI

SEQ ID NO: 1721622 - protein, 22 aa, Staphylococcus aureus
AYHKDTEDFYISLKIVDVKQPE

SEQ ID NO: 1721623 - protein, 29 aa, Staphylococcus aureus
AYKELEQAVALIRTMPQRQQTSRRSSRIQ

SEQ ID NO: 1721624 - protein, 26 aa, Staphylococcus aureus
CVILIFALILVLFTPNVLAESQPDPT

SEQ ID NO: 1721625 - protein, 24 aa, Staphylococcus aureus
DAKRIVVLEYSFADALAALDVKPV

SEQ ID NO: 1721626 - protein, 18 aa, Staphylococcus aureus
DAKRTAYSQAVNAAATIL

SEQ ID NO: 1721627 - protein, 18 aa, Staphylococcus aureus
DCSGLIQWVYDKAGISLP

SEQ ID NO: 1721628 - protein, 27 aa, Staphylococcus aureus
DEITSFLETFFQLYPTATEKELTYYVS

SEQ ID NO: 1721629 - protein, 34 aa, Staphylococcus aureus; identical to SEQ ID NO: 1591429

SEQ ID NO: 1721630 - protein, 35 aa, Staphylococcus aureus; identical to SEQ ID NO: 1591939

SEQ ID NO: 1721631 - protein, 26 aa, Staphylococcus aureus
DGNQFYSINAGFRKYPSTKESLKDYS

SEQ ID NO: 1721632 - protein, 19 aa, Staphylococcus aureus
DLRLSKQAKYTVYFKNGTK

SEQ ID NO: 1721633 - protein, 20 aa, Staphylococcus aureus
DMETRGMVLYINRNTRTTKG

SEQ ID NO: 1721634 - protein, 18 aa, Staphylococcus aureus
DRENADSGTFNYVKGIFD

SEQ ID NO: 1721635 - protein, 18 aa, Staphylococcus aureus
DSVFAMGNPLGLQFANSV

SEQ ID NO: 1721636 - protein, 21 aa, Staphylococcus aureus
DTTSQALDSIALVAPEHIVRA

SEQ ID NO: 1721637 - protein, 17 aa, Staphylococcus aureus
DVFAVPELIDIKGGIYS

SEQ ID NO: 1721638 - protein, 18 aa, Staphylococcus aureus
DVIGYTKPDGTQCTVGGC

SEQ ID NO: 1721639 - protein, 17 aa, Staphylococcus aureus
DYFSEAGATPATKAFGR

SEQ ID NO: 1721640 - protein, 31 aa, Staphylococcus aureus
EENKDSFWYDLFPKKDLVPFIPYKFVNIYGD

SEQ ID NO: 1721641 - protein, 51 aa, Staphylococcus aureus; identical to SEQ ID NO: 1594244

SEQ ID NO: 1721642 - protein, 23 aa, Staphylococcus aureus
EKLLSFFAQAKSYRDALPAKQLG

SEQ ID NO: 1721643 - protein, 20 aa, Staphylococcus aureus
ELDFKLRKKLMEEEKLYGAV

SEQ ID NO: 1721644 - protein, 23 aa, Staphylococcus aureus
ELDYLTRHYLVKNKKLYEFNNSP

SEQ ID NO: 1721645 - protein, 21 aa, Staphylococcus aureus
ERLQKWYDKGYLPKAATHDVM

SEQ ID NO: 1721646 - protein, 28 aa, Staphylococcus aureus
ERLTQAINQLVPLADNSALRTAKTKLDE

SEQ ID NO: 1721647 - protein, 36 aa, Staphylococcus aureus
ERNIELVGNLLPGDYFGTIRFGRKEQLFEIRVKPHT

SEQ ID NO: 1721648 - protein, 18 aa, Staphylococcus aureus
EVIGIHWGGVPNEFNGAV

SEQ ID NO: 1721649 - protein, 19 aa, Staphylococcus aureus
EVPVKVYPVANAKAPSRDV

SEQ ID NO: 1721650 - protein, 20 aa, Staphylococcus aureus
EVQESIFTKADKRELITAKN

SEQ ID NO: 1721651 - protein, 17 aa, Staphylococcus aureus
EYRKYYEPLIQKNDKEF

SEQ ID NO: 1721652 - protein, 25 aa, Staphylococcus aureus
FGRKEQLFEIRVKPHTPRITTTAEE

SEQ ID NO: 1721653 - protein, 18 aa, Staphylococcus aureus
FNQQYYGVPIAYPNETFV

SEQ ID NO: 1721654 - protein, 26 aa, Staphylococcus aureus
FVLTTGTFFVKMNEKQYPDFKNKNLR

SEQ ID NO: 1721655 - protein, 17 aa, Staphylococcus aureus
GATLLLAGCGSQNLAPL

SEQ ID NO: 1721656 - protein, 17 aa, Staphylococcus aureus
GGAWFQDPLKIHFEFID

SEQ ID NO: 1721657 - protein, 26 aa, Staphylococcus aureus
GIPHRYSTHYLLLEALREQLKIKPGH

SEQ ID NO: 1721658 - protein, 25 aa, Staphylococcus aureus
GKIDRPSIGIGLINLKDIPEEEREQ

SEQ ID NO: 1721659 - protein, 31 aa, Staphylococcus aureus; identical to SEQ ID NO: 1592235

SEQ ID NO: 1721660 - protein, 20 aa, Staphylococcus aureus
GNVTLQYRDGSSTTLDATNV

SEQ ID NO: 1721661 - protein, 21 aa, Staphylococcus aureus
GPQLNVVTLLGTDKERFKDDE

SEQ ID NO: 1721662 - protein, 19 aa, Staphylococcus aureus
GQSEPIVLVIFTNKDNKSD

SEQ ID NO: 1721663 - protein, 19 aa, Staphylococcus aureus
HGSGFSSVVTVSDALPNGG

SEQ ID NO: 1721664 - protein, 32 aa, Staphylococcus aureus; identical to SEQ ID NO: 1595931

SEQ ID NO: 1721665 - protein, 35 aa, Staphylococcus aureus
HNTITIRPQDYVVFIPPVGKQIRAVVYYNKVVASN

SEQ ID NO: 1721666 - protein, 23 aa, Staphylococcus aureus
HVILIFALILVISTPNVLAESQP

SEQ ID NO: 1721667 - protein, 18 aa, Staphylococcus aureus
IAEKPFSKQAGHPVFYVY

SEQ ID NO: 1721668 - protein, 19 aa, Staphylococcus aureus
IALSLSLLTACGANQHKEN

SEQ ID NO: 1721669 - protein, 19 aa, Staphylococcus aureus
IFLLAMYELGKYVTEQVYI

SEQ ID NO: 1721670 - protein, 19 aa, Staphylococcus aureus
IFSLTLTLLITPLVYSDSK

SEQ ID NO: 1721671 - protein, 18 aa, Staphylococcus aureus
ILILVATIALSGCANDDG

SEQ ID NO: 1721672 - protein, 17 aa, Staphylococcus aureus
ILVISVVILTSCQSSSS

SEQ ID NO: 1721673 - protein, 21 aa, Staphylococcus aureus
INGLPHLTQLQKDNLKHQVEQ

SEQ ID NO: 1721674 - protein, 17 aa, Staphylococcus aureus
INLKDIPEEEREQLHTD

SEQ ID NO: 1721675 - protein, 22 aa, Staphylococcus aureus
IVICVLLVLITISQILKHFNYG

SEQ ID NO: 1721676 - protein, 45 aa, Staphylococcus aureus; identical to SEQ ID NO: 1592410

SEQ ID NO: 1721677 - protein, 17 aa, Staphylococcus aureus
KEIEEFKFFVQYGNFKE

SEQ ID NO: 1721678 - protein, 33 aa, Staphylococcus aureus
KESHDQFLQHTILFKGFFTNHSWYNDLLVDFDS

SEQ ID NO: 1721679 - protein, 29 aa, Staphylococcus aureus
KGQSFNIGDIKQYFTLSNGQAIPSSSFTN

SEQ ID NO: 1721680 - protein, 29 aa, Staphylococcus aureus
KKDTQLIIDEILAIKLPAEVIKASPKVGQ

SEQ ID NO: 1721681 - protein, 24 aa, Staphylococcus aureus
KKHPKVLILMGVPGSYLVATDKSY

SEQ ID NO: 1721682 - protein, 18 aa, Staphylococcus aureus
KKNKNFLLDLMLNNKNGD

SEQ ID NO: 1721683 - protein, 17 aa, Staphylococcus aureus
KLLLKGSGDLKGSSVGY

SEQ ID NO: 1721684 - protein, 28 aa, Staphylococcus aureus
KNTDGSISLIIFPSPYYSPAFTKGEKVD

SEQ ID NO: 1721685 - protein, 19 aa, Staphylococcus aureus
KQTYDYYKDTFGRESYDNQ

SEQ ID NO: 1721686 - protein, 34 aa, Staphylococcus aureus
KSNNLLGLTHERYSYIFDTLKKNKQEFLKDIEEI

SEQ ID NO: 1721687 - protein, 26 aa, Staphylococcus aureus
KSVLYFNRGISDIDLRLSKQAEYTVH

SEQ ID NO: 1721688 - protein, 19 aa, Staphylococcus aureus
KVKQFKFSGLTDAPIDYKA

SEQ ID NO: 1721689 - protein, 24 aa, Staphylococcus aureus
LAIMGRYVLTPEIFDYLKTQKEGA

SEQ ID NO: 1721690 - protein, 17 aa, Staphylococcus aureus
LASALVLGACGSHDGDK

SEQ ID NO: 1721691 - protein, 17 aa, Staphylococcus aureus
LASTLVLGACGSNDGDK

SEQ ID NO: 1721692 - protein, 26 aa, Staphylococcus aureus
LATKHPFFEYARSFDFIIVSDIGLIN

SEQ ID NO: 1721693 - protein, 26 aa, Staphylococcus aureus
LDKSRNIPINIWINGNHKTISTNKVS

SEQ ID NO: 1721694 - protein, 19 aa, Staphylococcus aureus
LDSPRIIPINLIINGKHQT

SEQ ID NO: 1721695 - protein, 18 aa, Staphylococcus aureus
LDVFGIPYFYTCLVPKNE

SEQ ID NO: 1721696 - protein, 18 aa, Staphylococcus aureus
LDYTLLFKSFFISHSQYN

SEQ ID NO: 1721697 - protein, 18 aa, Staphylococcus aureus
LFLLAMYELGKYVTEKVY

SEQ ID NO: 1721698 - protein, 17 aa, Staphylococcus aureus
LGLVILLSACGQKYDKE

SEQ ID NO: 1721699 - protein, 19 aa, Staphylococcus aureus
LINIIILGVSNNASAQGDI

SEQ ID NO: 1721700 - protein, 28 aa, Staphylococcus aureus
LKELDFKIRKLLIKKYKLYEGAADKGRI

SEQ ID NO: 1721701 - protein, 19 aa, Staphylococcus aureus
LKMANFHKYNLEELSMKEY

SEQ ID NO: 1721702 - protein, 24 aa, Staphylococcus aureus
LLSVTFMLLFFSLHSVSAKPDPRP

SEQ ID NO: 1721703 - protein, 19 aa, Staphylococcus aureus
LLVLGIGKVLNSTILNKDG

SEQ ID NO: 1721704 - protein, 32 aa, Staphylococcus aureus
LQEAARTRNPIRLMIGFDYPDGYGNSETLVPV

SEQ ID NO: 1721705 - protein, 28 aa, Staphylococcus aureus
LSNKLNKYSIRKFTVGTASILIGSLMYL

SEQ ID NO: 1721706 - protein, 29 aa, Staphylococcus aureus
LSWSDDHKSLIYRYDATLGTQITTNDILT

SEQ ID NO: 1721707 - protein, 20 aa, Staphylococcus aureus
MGIPTDIKPFVTTKLISPFG

SEQ ID NO: 1721708 - protein, 18 aa, Staphylococcus aureus
MGNLRQAVADKDQVKRTE

SEQ ID NO: 1721709 - protein, 21 aa, Staphylococcus aureus
MGNPLGLQFANSVTSGIISAS

SEQ ID NO: 1721710 - protein, 17 aa, Staphylococcus aureus
MRMFFSGAVEVELDKQG

SEQ ID NO: 1721711 - protein, 33 aa, Staphylococcus aureus; identical to SEQ ID NO: 1596974

SEQ ID NO: 1721712 - protein, 32 aa, Staphylococcus aureus; identical to SEQ ID NO: 1591569

SEQ ID NO: 1721713 - protein, 17 aa, Staphylococcus aureus
NAVKTFSEYKKDALAKI

SEQ ID NO: 1721714 - protein, 21 aa, Staphylococcus aureus
NAVTILPDDIPPTINNPVGIN

SEQ ID NO: 1721715 - protein, 18 aa, Staphylococcus aureus
NELTQVRPLRIMSPHSVE

SEQ ID NO: 1721716 - protein, 19 aa, Staphylococcus aureus
NFKFFAQYGSFKDLSKYKE

SEQ ID NO: 1721717 - protein, 26 aa, Staphylococcus aureus
NIDDFVDDPLSYVKTPSNKVLGFYPT

SEQ ID NO: 1721718 - protein, 27 aa, Staphylococcus aureus
NIDTPKNIDFNEKLTYRTASDVVINNA

SEQ ID NO: 1721719 - protein, 21 aa, Staphylococcus aureus
NKNPKLLFKGAGNIKGSSVGY

SEQ ID NO: 1721720 - protein, 23 aa, Staphylococcus aureus
NMESRGMVLYINRNTRTTKGNFI

SEQ ID NO: 1721721 - protein, 25 aa, Staphylococcus aureus
NSLKKVATLALANLLLVGALTDNSA

SEQ ID NO: 1721722 - protein, 26 aa, Staphylococcus aureus
NYEDYIELRQLRYIYDVYFDRDDRIT

SEQ ID NO: 1721723 - protein, 20 aa, Staphylococcus aureus
PFSKQAGHPVFYVYAGNQGN

SEQ ID NO: 1721724 - protein, 19 aa, Staphylococcus aureus
PLIQSGFNPSFITTLSHER

SEQ ID NO: 1721725 - protein, 19 aa, Staphylococcus aureus
PNETSLNLTFATAGKETSQ

SEQ ID NO: 1721726 - protein, 17 aa, Staphylococcus aureus
PNIVKKPAALAQINQHY

SEQ ID NO: 1721727 - protein, 19 aa, Staphylococcus aureus
PTDGGLSWSDDHKSLIYRY

SEQ ID NO: 1721728 - protein, 23 aa, Staphylococcus aureus
PVTVNVYQFEFPQTTYTTTVGGT

SEQ ID NO: 1721729 - protein, 23 aa, Staphylococcus aureus
QEKFLQHDLLFKINGSKILKTEF

SEQ ID NO: 1721730 - protein, 21 aa, Staphylococcus aureus
QHLNVDVTYPGISAAKRVPVT

SEQ ID NO: 1721731 - protein, 23 aa, Staphylococcus aureus
QKNESTLHLSFEKGIKGTVDKNG

SEQ ID NO: 1721732 - protein, 20 aa, Staphylococcus aureus
QLDQAMERLINGIQDKDQVK

SEQ ID NO: 1721733 - protein, 20 aa, Staphylococcus aureus
QMRQAIEFVKKHKLKHLLVE

SEQ ID NO: 1721734 - protein, 18 aa, Staphylococcus aureus
QNFIAQHQMPLLSRSNFN

SEQ ID NO: 1721735 - protein, 28 aa, Staphylococcus aureus
QNKIFQYIHLQYLRTDAGRINFMNLIEN

SEQ ID NO: 1721736 - protein, 20 aa, Staphylococcus aureus
QPEVTLTADPFSVAVEMNKD

SEQ ID NO: 1721737 - protein, 20 aa, Staphylococcus aureus
QSFESQITQAPLVTDVTTIN

SEQ ID NO: 1721738 - protein, 17 aa, Staphylococcus aureus
QYFTLSNGQAIPSSSFT

SEQ ID NO: 1721739 - protein, 19 aa, Staphylococcus aureus
RAYYTKPSLEFKNEIGIIL

SEQ ID NO: 1721740 - protein, 26 aa, Staphylococcus aureus
RNELQAFFDANYHDYRFIDRENADSG

SEQ ID NO: 1721741 - protein, 19 aa, Staphylococcus aureus
RQFLGHDLIFPIPYSEYKE

SEQ ID NO: 1721742 - protein, 31 aa, Staphylococcus aureus; identical to SEQ ID NO: 1591689

SEQ ID NO: 1721743 - protein, 17 aa, Staphylococcus aureus
SFGDYLRSGAMASVAPV

SEQ ID NO: 1721744 - protein, 27 aa, Staphylococcus aureus
SGLKSTTITTLPSGWTSNLTKSDKKNG

SEQ ID NO: 1721745 - protein, 39 aa, Staphylococcus aureus
SGNSPARLMPDKILDLKYKLRVNNVPTPRTVTFNDTLTY

SEQ ID NO: 1721746 - protein, 17 aa, Staphylococcus aureus
SIAALTILTSVTGVGTT

SEQ ID NO: 1721747 - protein, 31 aa, Staphylococcus aureus
SIATVLLLLGGLVFAIFAYVDHSNKAKERML

SEQ ID NO: 1721748 - protein, 19 aa, Staphylococcus aureus
SIITAFMNKNQNIRGYLAS

SEQ ID NO: 1721749 - protein, 26 aa, Staphylococcus aureus
SINTGKVLYTFYQNPTLVKTAIKAQE

SEQ ID NO: 1721750 - protein, 41 aa, Staphylococcus aureus
SKNGTLIDSRYLNSALYYLEDYIIYAIGLTNKYEYGDNIYK

SEQ ID NO: 1721751 - protein, 19 aa, Staphylococcus aureus
SLAALTILTSVTGIGITLV

SEQ ID NO: 1721752 - protein, 23 aa, Staphylococcus aureus
SLKQAIAGLTPDLAPLQTAKTQL

SEQ ID NO: 1721753 - protein, 17 aa, Staphylococcus aureus
SLNTAMGNLKHALAEKD

SEQ ID NO: 1721754 - protein, 30 aa, Staphylococcus aureus; identical to SEQ ID NO: 1592305

SEQ ID NO: 1721755 - protein, 20 aa, Staphylococcus aureus
STHYLLLEELRKQLKIKPGH

SEQ ID NO: 1721756 - protein, 35 aa, Staphylococcus aureus
SYTISFKTQGPTVNKLYYAAGGRALEYNQLFMYSQ

SEQ ID NO: 1721757 - protein, 24 aa, Staphylococcus aureus
TAEQLRGTALQKVPVNISGIPLDP

SEQ ID NO: 1721758 - protein, 24 aa, Staphylococcus aureus
TARQGLTLDRQPALTTLHGASNLN

SEQ ID NO: 1721759 - protein, 30 aa, Staphylococcus aureus; identical to SEQ ID NO: 1594901

SEQ ID NO: 1721760 - protein, 17 aa, Staphylococcus aureus
TDQKLQEAARTRNPIRL

SEQ ID NO: 1721761 - protein, 24 aa, Staphylococcus aureus
TIVLLIIILSLLLVRNEHLDRFNP

SEQ ID NO: 1721762 - protein, 29 aa, Staphylococcus aureus
TKRLAQDPALKYQFLRLDQPQNISIDKIN

SEQ ID NO: 1721763 - protein, 37 aa, Staphylococcus aureus; identical to SEQ ID NO: 1594933

SEQ ID NO: 1721764 - protein, 24 aa, Staphylococcus aureus
TLGICLVLLIILIGGCVIMTKTNG

SEQ ID NO: 1721765 - protein, 28 aa, Staphylococcus aureus
TLGICLVLLIILIVGYVIMTKANGQNAQ

SEQ ID NO: 1721766 - protein, 17 aa, Staphylococcus aureus
TNHQVFSGETFTNTITA

SEQ ID NO: 1721767 - protein, 46 aa, Staphylococcus aureus; identical to SEQ ID NO: 1594955

SEQ ID NO: 1721768 - protein, 34 aa, Staphylococcus aureus; identical to SEQ ID NO: 1594964

SEQ ID NO: 1721769 - protein, 25 aa, Staphylococcus aureus
TSVLLIIILSLLLVRNEHLDRFNPL

SEQ ID NO: 1721770 - protein, 18 aa, Staphylococcus aureus
TTSFNVTVKPLRDKYRVG

SEQ ID NO: 1721771 - protein, 23 aa, Staphylococcus aureus
VDFKIRKHLIDHYGLYGEMSSGT

SEQ ID NO: 1721772 - protein, 18 aa, Staphylococcus aureus
VEDRKYALAYTPEKFYDR

SEQ ID NO: 1721773 - protein, 31 aa, Staphylococcus aureus
VGVGALKRFVATVLLLLVFISGCGNDKYVKE

SEQ ID NO: 1721774 - protein, 23 aa, Staphylococcus aureus
VKRELGFVLMALNIRKIAAQRAV

SEQ ID NO: 1721775 - protein, 26 aa, Staphylococcus aureus
VKTPSNKVLGFYPTNANTNAFRPGGV

SEQ ID NO: 1721776 - protein, 19 aa, Staphylococcus aureus
VNVAKTGTAHLFKVPTDAD

SEQ ID NO: 1721777 - protein, 24 aa, Staphylococcus aureus
VNVKPDSELIINFTTMQTNSKQGA

SEQ ID NO: 1721778 - protein, 24 aa, Staphylococcus aureus
VRGQNNQWTIANKPDYVTLDAQTG

SEQ ID NO: 1721779 - protein, 17 aa, Staphylococcus aureus
VSPLLLATIATDFTPVP

SEQ ID NO: 1721780 - protein, 24 aa, Staphylococcus aureus
VSTYIIIFLVSSAAFAIFLLSANV

SEQ ID NO: 1721781 - protein, 17 aa, Staphylococcus aureus
YDKDKIIILAYKPLSND

SEQ ID NO: 1721782 - protein, 23 aa, Staphylococcus aureus
YDTKKIPINLWIDSIRTVVPLDI

SEQ ID NO: 1721783 - protein, 20 aa, Staphylococcus aureus
YKQLNMKGYFYDFDSLKGMQ

SEQ ID NO: 1721784 - protein, 17 aa, Staphylococcus aureus
YYGLKPDSAEYDGNGTV

SEQ ID NO: 1721785 - protein, 25 aa, Staphylococcus aureus
ADQTAIINSLTFTSNAPNRNYATAS

SEQ ID NO: 1721786 - protein, 18 aa, Staphylococcus aureus
AEDYWFTDPITLEHLRSK

SEQ ID NO: 1721787 - protein, 27 aa, Staphylococcus aureus
AGAGANKPLQQMWEYGVNDPDRSHDFK

SEQ ID NO: 1721788 - protein, 23 aa, Staphylococcus aureus
AIANLDTLRDLNQPQRDALRNQI

SEQ ID NO: 1721789 - protein, 19 aa, Staphylococcus aureus
AKQDIIQAVTTRKQQIKKS

SEQ ID NO: 1721790 - protein, 17 aa, Staphylococcus aureus
ALLAAHLQSDQLIILTA

SEQ ID NO: 1721791 - protein, 18 aa, Staphylococcus aureus
ALNLNKEELLKEKPDLIL

SEQ ID NO: 1721792 - protein, 17 aa, Staphylococcus aureus
AMDQLKQAIADHDTIVA

SEQ ID NO: 1721793 - protein, 18 aa, Staphylococcus aureus
AMTGLKRGVANHNQVVQS

SEQ ID NO: 1721794 - protein, 24 aa, Staphylococcus aureus
ASEDELMIYILTKKNIQEKEFKKE

SEQ ID NO: 1721795 - protein, 28 aa, Staphylococcus aureus
ASLKADQFKYEVTLPQGVTYVNNSLTTT

SEQ ID NO: 1721796 - protein, 21 aa, Staphylococcus aureus
ASSIALLLLSNTVDAAQHITP

SEQ ID NO: 1721797 - protein, 26 aa, Staphylococcus aureus
ATARNEITAILNNKLQEIQATPDATD

SEQ ID NO: 1721798 - protein, 17 aa, Staphylococcus aureus
AVFISHESIGYLADCYG

SEQ ID NO: 1721799 - protein, 20 aa, Staphylococcus aureus
AVQQLNRTGTTTGKKPASIT

SEQ ID NO: 1721800 - protein, 24 aa, Staphylococcus aureus
AVTDLNQLNGLNNPQRQALESQIN

SEQ ID NO: 1721801 - protein, 33 aa, Staphylococcus aureus; identical to SEQ ID NO: 1592344

SEQ ID NO: 1721802 - protein, 22 aa, Staphylococcus aureus
DAKAFFSYEWKGLEIAKNLADQ

SEQ ID NO: 1721803 - protein, 17 aa, Staphylococcus aureus
DAKRTAYSQAVNAAATI

SEQ ID NO: 1721804 - protein, 22 aa, Staphylococcus aureus
DAVQFVNKLFNVSSAIILLEYD

SEQ ID NO: 1721805 - protein, 25 aa, Staphylococcus aureus
DDHKSLIYRYDATLGTQITTNDILT

SEQ ID NO: 1721806 - protein, 26 aa, Staphylococcus aureus
DEKQSIITAFMNKNQNIRGYLASTDP

SEQ ID NO: 1721807 - protein, 35 aa, Staphylococcus aureus; identical to SEQ ID NO: 1592931

SEQ ID NO: 1721808 - protein, 35 aa, Staphylococcus aureus; identical to SEQ ID NO: 1590301

SEQ ID NO: 1721809 - protein, 18 aa, Staphylococcus aureus
DFGDINSAYIIKVVSKYT

SEQ ID NO: 1721810 - protein, 24 aa, Staphylococcus aureus
DGETYTVKFETPAGYLPTKVNGTT

SEQ ID NO: 1721811 - protein, 37 aa, Staphylococcus aureus; identical to SEQ ID NO: 1594201

SEQ ID NO: 1721812 - protein, 37 aa, Staphylococcus aureus; identical to SEQ ID NO: 1591509

SEQ ID NO: 1721813 - protein, 20 aa, Staphylococcus aureus
DGLSKGLYPGLKINSYRVFG

SEQ ID NO: 1721814 - protein, 23 aa, Staphylococcus aureus
DGLVTKLQAALIDNQAAIAELDT

SEQ ID NO: 1721815 - protein, 23 aa, Staphylococcus aureus
DHLNMDYFKMKPVGLIGNSGGIV

SEQ ID NO: 1721816 - protein, 17 aa, Staphylococcus aureus
DKSIYLYGTVNGKSGWI

SEQ ID NO: 1721817 - protein, 25 aa, Staphylococcus aureus
DLTAELSLNLFIDPTTVTKQGKQKV

SEQ ID NO: 1721818 - protein, 27 aa, Staphylococcus aureus
DRNELQAFFDANYHDYRFIDRENADSG

SEQ ID NO: 1721819 - protein, 18 aa, Staphylococcus aureus
DSPRIIPINLIINGKHQT

SEQ ID NO: 1721820 - protein, 40 aa, Staphylococcus aureus
DSQSYYDTLWTKKDYDLIFYRTYSDALMPYNFISSVFKNN

SEQ ID NO: 1721821 - protein, 21 aa, Staphylococcus aureus
DTGYFFNQAYKKDGAINKGEY

SEQ ID NO: 1721822 - protein, 17 aa, Staphylococcus aureus
DVFGISYNGQCNTKYIY

SEQ ID NO: 1721823 - protein, 21 aa, Staphylococcus aureus
DYETWHTYMLAQETFTGGVTP

SEQ ID NO: 1721824 - protein, 19 aa, Staphylococcus aureus
EGDQRVYRTSTYDLTTDEI

SEQ ID NO: 1721825 - protein, 25 aa, Staphylococcus aureus
EGTQKVKPTIYFKLYKQDDNQNTTP

SEQ ID NO: 1721826 - protein, 20 aa, Staphylococcus aureus
EHELSYIDVLLDKNADKLQK

SEQ ID NO: 1721827 - protein, 18 aa, Staphylococcus aureus
EKQIYIYNSTWGRGLDIV

SEQ ID NO: 1721828 - protein, 18 aa, Staphylococcus aureus
EKSRRIPINLWVNGEHQT

SEQ ID NO: 1721829 - protein, 20 aa, Staphylococcus aureus
EPFKIYKFNKKSDGNYYFPV

SEQ ID NO: 1721830 - protein, 20 aa, Staphylococcus aureus
ERLQKWYDKGYLPKAATHDV

SEQ ID NO: 1721831 - protein, 24 aa, Staphylococcus aureus
ETNTPLFIKKVYGGNLDASIESFL

SEQ ID NO: 1721832 - protein, 32 aa, Staphylococcus aureus
FGASLKADQFKYEVTLPQGVTYINDSLTTTFP

SEQ ID NO: 1721833 - protein, 17 aa, Staphylococcus aureus
FLLDLMLNNKSGDTLIK

SEQ ID NO: 1721834 - protein, 36 aa, Staphylococcus aureus
FSIRKFNVGIFSALIATVTFISINPTTASAAEQNQP

SEQ ID NO: 1721835 - protein, 33 aa, Staphylococcus aureus
FSIRKFNVGIFSALIATVTFISTNPTTASAAEQ

SEQ ID NO: 1721836 - protein, 17 aa, Staphylococcus aureus
FTDPITLEHLRSKLKKE

SEQ ID NO: 1721837 - protein, 26 aa, Staphylococcus aureus
FTSMAAVTLLSTLSPAALAIDSNNKP

SEQ ID NO: 1721838 - protein, 61 aa, Staphylococcus aureus; identical to SEQ ID NO: 1594310

SEQ ID NO: 1721839 - protein, 18 aa, Staphylococcus aureus
GDMLPEDTTHVRWFLNIN

SEQ ID NO: 1721840 - protein, 23 aa, Staphylococcus aureus
GEYAYDFFPFKIDKEAMTLKEVD

SEQ ID NO: 1721841 - protein, 19 aa, Staphylococcus aureus
GIPHHLIDILNPDDTFSAY

SEQ ID NO: 1721842 - protein, 18 aa, Staphylococcus aureus
GLIKLKKDFGLAGTVKAI

SEQ ID NO: 1721843 - protein, 18 aa, Staphylococcus aureus
GMVLYINRNTRTTKGNFI

SEQ ID NO: 1721844 - protein, 23 aa, Staphylococcus aureus
GPNKDVVGISTRLIRVTYDNRQT

SEQ ID NO: 1721845 - protein, 19 aa, Staphylococcus aureus
GSVTSIQPLRINLTSNENF

SEQ ID NO: 1721846 - protein, 25 aa, Staphylococcus aureus
GTASILVGTTLIFGLGNQEAKAAES

SEQ ID NO: 1721847 - protein, 18 aa, Staphylococcus aureus
GYTILATGTPDGVHNTIT

SEQ ID NO: 1721848 - protein, 24 aa, Staphylococcus aureus
HLQSDQLIILTAVDHVYINYGKEN

SEQ ID NO: 1721849 - protein, 32 aa, Staphylococcus aureus
HLTLNQLYSYNPGVTPLIFPGDVISLVPQNKV

SEQ ID NO: 1721850 - protein, 19 aa, Staphylococcus aureus
ICVKSCSLLFMLNGNPKPE

SEQ ID NO: 1721851 - protein, 18 aa, Staphylococcus aureus
IDANSVTYKAGLTNQEIK

SEQ ID NO: 1721852 - protein, 17 aa, Staphylococcus aureus
IDAQGNYHYTWTGNWNP

SEQ ID NO: 1721853 - protein, 26 aa, Staphylococcus aureus
IDTPKNIDFNEKLTYRTASDVVINNA

SEQ ID NO: 1721854 - protein, 26 aa, Staphylococcus aureus
IEGAQKIYDLFKPILEKKDKKLSDDI

SEQ ID NO: 1721855 - protein, 31 aa, Staphylococcus aureus
IELVGNLLPGDYFGTIRFGRKEQLFEIRVKP

SEQ ID NO: 1721856 - protein, 17 aa, Staphylococcus aureus
IGAVVPQVTHKQAARDA

SEQ ID NO: 1721857 - protein, 24 aa, Staphylococcus aureus
IGEYDYDFFPFKIVKEAMSLKEID

SEQ ID NO: 1721858 - protein, 29 aa, Staphylococcus aureus
IGKSKSEQIYYRALTEYLTSNSNFKDCKD

SEQ ID NO: 1721859 - protein, 22 aa, Staphylococcus aureus
IILLFLSIISMSTLSKVQASED

SEQ ID NO: 1721860 - protein, 18 aa, Staphylococcus aureus
IIQKPIRTVQEVQSALTN

SEQ ID NO: 1721861 - protein, 21 aa, Staphylococcus aureus
IKINHFCVVPQINSFKVIPPY

SEQ ID NO: 1721862 - protein, 18 aa, Staphylococcus aureus
ILFTLVLAGCGQNQSEKN

SEQ ID NO: 1721863 - protein, 35 aa, Staphylococcus aureus
ILVTTPHQVFLNWFGQDPAFDYFKTMDSTTVATVV

SEQ ID NO: 1721864 - protein, 25 aa, Staphylococcus aureus
INNEDTFMGQFLLKMGIQPEVTKDK

SEQ ID NO: 1721865 - protein, 17 aa, Staphylococcus aureus
IPEIVAHSHYTVQGQDF

SEQ ID NO: 1721866 - protein, 25 aa, Staphylococcus aureus
IPHRYSTHYLLLEELRKQLKIEPGH

SEQ ID NO: 1721867 - protein, 29 aa, Staphylococcus aureus
IQNATGLPTDGFTYKWNNAATGTNDANWA

SEQ ID NO: 1721868 - protein, 27 aa, Staphylococcus aureus
IQQADYTFASLDIFNDLKKRAQTILAE

SEQ ID NO: 1721869 - protein, 29 aa, Staphylococcus aureus
IQQADYTFASLDIFNDLKRRAQTILDENR

SEQ ID NO: 1721870 - protein, 30 aa, Staphylococcus aureus
IRAGYSLEIKVPLNAIKIPKSVLTKGNNVF

SEQ ID NO: 1721871 - protein, 21 aa, Staphylococcus aureus
IRKHKLGAASVFLGTMIVVGM

SEQ ID NO: 1721872 - protein, 21 aa, Staphylococcus aureus
ISKYAGDYIFLSKPSYGKFDF

SEQ ID NO: 1721873 - protein, 43 aa, Staphylococcus aureus; identical to SEQ ID NO: 1591853

SEQ ID NO: 1721874 - protein, 47 aa, Staphylococcus aureus
ITTNKDGYKYYSFIDNVGLFSGSHLYVKNRDLAPKATNNKEFTINTE

SEQ ID NO: 1721875 - protein, 29 aa, Staphylococcus aureus
IYDFVCEIDTLYAAYFNHSQYGHNAKELR

SEQ ID NO: 1721876 - protein, 25 aa, Staphylococcus aureus
KADGKFSHFAYVKPNNQSLSSVTVT

SEQ ID NO: 1721877 - protein, 21 aa, Staphylococcus aureus
KAFGRQTFEYINGERPTESPG

SEQ ID NO: 1721878 - protein, 22 aa, Staphylococcus aureus
KAKADRYVPYTIAVNGTSTPIL

SEQ ID NO: 1721879 - protein, 17 aa, Staphylococcus aureus
KARTGWLIVDYAGYTWP

SEQ ID NO: 1721880 - protein, 19 aa, Staphylococcus aureus
KELEQAVALIRTMPQRQQT

SEQ ID NO: 1721881 - protein, 20 aa, Staphylococcus aureus
KEQIYNYWKKKNPSLVTNSQ

SEQ ID NO: 1721882 - protein, 17 aa, Staphylococcus aureus
KFLAHDLIYNISDKKLK

SEQ ID NO: 1721883 - protein, 27 aa, Staphylococcus aureus
KIDSLVDQAYSVYFAYVTDAQHKTEAL

SEQ ID NO: 1721884 - protein, 20 aa, Staphylococcus aureus
KIQEIDRVLASHPDVATIRQ

SEQ ID NO: 1721885 - protein, 26 aa, Staphylococcus aureus
KKIDEYELYKKWYKSSNKNTNMLTFH

SEQ ID NO: 1721886 - protein, 17 aa, Staphylococcus aureus
KLLLKGTGNLKGSSVGY

SEQ ID NO: 1721887 - protein, 24 aa, Staphylococcus aureus
KMKVGLVSVAITMLYIMTNGEAEA

SEQ ID NO: 1721888 - protein, 25 aa, Staphylococcus aureus
KNQSEPIILVIFTNKDNKSDKPNDK

SEQ ID NO: 1721889 - protein, 17 aa, Staphylococcus aureus
KNYGLYKGTTKYGKITF

SEQ ID NO: 1721890 - protein, 20 aa, Staphylococcus aureus
KPDSELIINFTTMQTNSKQG

SEQ ID NO: 1721891 - protein, 17 aa, Staphylococcus aureus
KQGIANKAQIKGSENYH

SEQ ID NO: 1721892 - protein, 29 aa, Staphylococcus aureus
KQHTQFIVDEILAIKLPAEAMKVSPKVIQ

SEQ ID NO: 1721893 - protein, 39 aa, Staphylococcus aureus
KQIADGYYWGIIENLENQFYNIFHLLDQHKYAEKEYKDA

SEQ ID NO: 1721894 - protein, 23 aa, Staphylococcus aureus
KQKSFWVAILSAIFLFAQNIAEA

SEQ ID NO: 1721895 - protein, 25 aa, Staphylococcus aureus
KQRITTAFMNKNQNIRGYLASSNPV

SEQ ID NO: 1721896 - protein, 17 aa, Staphylococcus aureus
KRALASYSNLNNAQSTA

SEQ ID NO: 1721897 - protein, 22 aa, Staphylococcus aureus
KRGEQFFMDNFGLKVKATNVVG

SEQ ID NO: 1721898 - protein, 24 aa, Staphylococcus aureus
KTEIKNFKFFAQYSNFKDLMNYKD

SEQ ID NO: 1721899 - protein, 18 aa, Staphylococcus aureus
KVATLALANLLLVGALTD

SEQ ID NO: 1721900 - protein, 22 aa, Staphylococcus aureus
KVKQAFINANRDVITLAEGDIS

SEQ ID NO: 1721901 - protein, 26 aa, Staphylococcus aureus
KVMAIGEVIAERKIRYTFTDYIDNKK

SEQ ID NO: 1721902 - protein, 19 aa, Staphylococcus aureus
KVSPKVIQPAPKVCTPIKK

SEQ ID NO: 1721903 - protein, 26 aa, Staphylococcus aureus
KYEDIKARLTLYSYIDKQAVPNETSL

SEQ ID NO: 1721904 - protein, 18 aa, Staphylococcus aureus
KYTAPIKTFAPESDKILS

SEQ ID NO: 1721905 - protein, 19 aa, Staphylococcus aureus
LASALVLGACGSNDGDKKE

SEQ ID NO: 1721906 - protein, 17 aa, Staphylococcus aureus
LCSLFILTACSTSVDKT

SEQ ID NO: 1721907 - protein, 26 aa, Staphylococcus aureus
LDNAMGAVQQYIDEQHLGVISSTNYI

SEQ ID NO: 1721908 - protein, 22 aa, Staphylococcus aureus
LFISVIILTIFIMGCDSQSDTA

SEQ ID NO: 1721909 - protein, 28 aa, Staphylococcus aureus
LGYENPDLGTFFLMATTSRIIGHDAREE

SEQ ID NO: 1721910 - protein, 17 aa, Staphylococcus aureus
LIATILLSGCSTTNNES

SEQ ID NO: 1721911 - protein, 17 aa, Staphylococcus aureus
LIAVLVLSGCSTIENES

SEQ ID NO: 1721912 - protein, 19 aa, Staphylococcus aureus
LINIIILGVSNSASAQGDI

SEQ ID NO: 1721913 - protein, 18 aa, Staphylococcus aureus
LINIITLSVSNSASAQGD

SEQ ID NO: 1721914 - protein, 21 aa, Staphylococcus aureus
LLFIALTWTTSPLVNGSEKSE

SEQ ID NO: 1721915 - protein, 19 aa, Staphylococcus aureus
LLIMLLVVAGCSFGGNHKL

SEQ ID NO: 1721916 - protein, 17 aa, Staphylococcus aureus
LLIVPDLIRLSKTFLIE

SEQ ID NO: 1721917 - protein, 19 aa, Staphylococcus aureus
LMEFNILTMGGKSGAMVGY

SEQ ID NO: 1721918 - protein, 48 aa, Staphylococcus aureus
LMTAKQTGDGYQWVIKFNKGHAPHQNMIFWFALPADQVPVGRTDFVTV

SEQ ID NO: 1721919 - protein, 17 aa, Staphylococcus aureus
LNYLKTLENRGWDFDGS

SEQ ID NO: 1721920 - protein, 18 aa, Staphylococcus aureus
LRLLFLLAMYELGKYVTE

SEQ ID NO: 1721921 - protein, 18 aa, Staphylococcus aureus
LSNKTYILEMIRQLKNQF

SEQ ID NO: 1721922 - protein, 30 aa, Staphylococcus aureus; identical to SEQ ID NO: 1594634

SEQ ID NO: 1721923 - protein, 17 aa, Staphylococcus aureus
LVDINGNLVGINSMKIA

SEQ ID NO: 1721924 - protein, 17 aa, Staphylococcus aureus
MERLINGIQDKDQVKQS

SEQ ID NO: 1721925 - protein, 24 aa, Staphylococcus aureus
MLGISFLFLVISITAGCGMGKEAE

SEQ ID NO: 1721926 - protein, 18 aa, Staphylococcus aureus
MNIKGMVLYMNRNTRTTN

SEQ ID NO: 1721927 - protein, 17 aa, Staphylococcus aureus
MSGLILTGAIGTAGLVS

SEQ ID NO: 1721928 - protein, 41 aa, Staphylococcus aureus; identical to SEQ ID NO: 1594664

SEQ ID NO: 1721929 - protein, 18 aa, Staphylococcus aureus
NAVKTFSEYKKDALAKIE

SEQ ID NO: 1721930 - protein, 24 aa, Staphylococcus aureus
NDDLARVTALVQNYRKVSDRNKAD

SEQ ID NO: 1721931 - protein, 18 aa, Staphylococcus aureus
NDYTIPTGKKESATTDLY

SEQ ID NO: 1721932 - protein, 25 aa, Staphylococcus aureus
NEKIQKLLAFQTLYIGIDPKRGPSL

SEQ ID NO: 1721933 - protein, 31 aa, Staphylococcus aureus
NELIKYYTQPHLSLSGKWLWQKPNGTIHATL

SEQ ID NO: 1721934 - protein, 32 aa, Staphylococcus aureus; identical to SEQ ID NO: 1592806

SEQ ID NO: 1721935 - protein, 20 aa, Staphylococcus aureus
NGGHTAGIGGSWAVQDGQDY

SEQ ID NO: 1721936 - protein, 24 aa, Staphylococcus aureus
NGLRQVVNRTYRIGTTKRVEVSQG

SEQ ID NO: 1721937 - protein, 21 aa, Staphylococcus aureus
NGNVTLHYRDGSSTTLDATNV

SEQ ID NO: 1721938 - protein, 23 aa, Staphylococcus aureus
NGTDAINYITFDPNTNTNGITAA

SEQ ID NO: 1721939 - protein, 25 aa, Staphylococcus aureus
NHPKYKLELVKFNNWPDLMDALNSG

SEQ ID NO: 1721940 - protein, 19 aa, Staphylococcus aureus
NMESRGMVLYINRNTRTTK

SEQ ID NO: 1721941 - protein, 40 aa, Staphylococcus aureus; identical to SEQ ID NO: 1592150

SEQ ID NO: 1721942 - protein, 23 aa, Staphylococcus aureus
NPTKPIGLFYTKEQADKFTKEKG

SEQ ID NO: 1721943 - protein, 24 aa, Staphylococcus aureus
NQTQPANAPAAQPAAPVAANAQTQ

SEQ ID NO: 1721944 - protein, 18 aa, Staphylococcus aureus
NRKGMIPNRLNKFSIRKY

SEQ ID NO: 1721945 - protein, 21 aa, Staphylococcus aureus
NSILAQLQNIYDTAIGQIDQD

SEQ ID NO: 1721946 - protein, 17 aa, Staphylococcus aureus
NTAMTGLKRGVANHNQV

SEQ ID NO: 1721947 - protein, 17 aa, Staphylococcus aureus
NVTPFKYAAGAKAGERI

SEQ ID NO: 1721948 - protein, 23 aa, Staphylococcus aureus
NYDVPFQLQLLFVESGNGIIIST

SEQ ID NO: 1721949 - protein, 21 aa, Staphylococcus aureus
PASKQAGHPVFYVYAGNQGNA

SEQ ID NO: 1721950 - protein, 18 aa, Staphylococcus aureus
PEGWHEWVQAAKAKPVYG

SEQ ID NO: 1721951 - protein, 25 aa, Staphylococcus aureus
PNRLNKFSIRKYSVGTASILVGTTL

SEQ ID NO: 1721952 - protein, 23 aa, Staphylococcus aureus
PNSELIFEFNTMPTKNGQGATNV

SEQ ID NO: 1721953 - protein, 28 aa, Staphylococcus aureus
PSVTVVDNLPGFTLINGGKVGVLSHAMV

SEQ ID NO: 1721954 - protein, 23 aa, Staphylococcus aureus
PTNKAPKFILKGTGDLKGSSVGY

SEQ ID NO: 1721955 - protein, 27 aa, Staphylococcus aureus
QFTLNGQVIQILDIINPSNGYGGQPVT

SEQ ID NO: 1721956 - protein, 18 aa, Staphylococcus aureus
QHMNFQFTNSYGPSKDVV

SEQ ID NO: 1721957 - protein, 21 aa, Staphylococcus aureus
QHNYKSLKYYYSKPSIELINV

SEQ ID NO: 1721958 - protein, 25 aa, Staphylococcus aureus
QIDKSIYLFGTVNGKSGWVSKAYLA

SEQ ID NO: 1721959 - protein, 25 aa, Staphylococcus aureus
QIELEKPVPYINQLLALNTFAPQNE

SEQ ID NO: 1721960 - protein, 17 aa, Staphylococcus aureus
QMGINYSIYMDADTIPV

SEQ ID NO: 1721961 - protein, 24 aa, Staphylococcus aureus
QNAPNEVLSFDDNSIRPSTNRSVP

SEQ ID NO: 1721962 - protein, 28 aa, Staphylococcus aureus
QNATGLPTDGFTYKWNNAATGTNDANWA

SEQ ID NO: 1721963 - protein, 27 aa, Staphylococcus aureus
QNIAEKPFSKQAGHPVFYVYAGNQGNA

SEQ ID NO: 1721964 - protein, 22 aa, Staphylococcus aureus
QNQYQYVPPQQQAPTKQRPAKE

SEQ ID NO: 1721965 - protein, 22 aa, Staphylococcus aureus
QPHLSLSNKWLWQKPNGSIHAT

SEQ ID NO: 1721966 - protein, 28 aa, Staphylococcus aureus
QQADYTFASLDIFNDLKRRAQTILDENR

SEQ ID NO: 1721967 - protein, 24 aa, Staphylococcus aureus
QSLNNAMKGLRYSIANETTVKASQ

SEQ ID NO: 1721968 - protein, 36 aa, Staphylococcus aureus; identical to SEQ ID NO: 1592462

SEQ ID NO: 1721969 - protein, 17 aa, Staphylococcus aureus
RAVVYYNKVVASNMSNA

SEQ ID NO: 1721970 - protein, 48 aa, Staphylococcus aureus
RITTNKDGYKYYSFIDNVGLFSGSHLYVKNRDLAPKATNNKEFTINTE

SEQ ID NO: 1721971 - protein, 34 aa, Staphylococcus aureus
RNIELVGNLLPGDYFGTIRFGRKEQLFEIRVKPH

SEQ ID NO: 1721972 - protein, 19 aa, Staphylococcus aureus
RPYVVTTLFSTKDNFTKDN

SEQ ID NO: 1721973 - protein, 24 aa, Staphylococcus aureus
RVILIFALILVISTPNVLAESQPD

SEQ ID NO: 1721974 - protein, 30 aa, Staphylococcus aureus; identical to SEQ ID NO: 1594822

SEQ ID NO: 1721975 - protein, 26 aa, Staphylococcus aureus
SDDHKSLIYRYDATLGTQITTNDILT

SEQ ID NO: 1721976 - protein, 26 aa, Staphylococcus aureus
SDGKFHGQRLNDVILTYVASTGKMRA

SEQ ID NO: 1721977 - protein, 26 aa, Staphylococcus aureus
SFNTDDFVYKVQLPEGVEYVNNSLTK

SEQ ID NO: 1721978 - protein, 25 aa, Staphylococcus aureus
SGLPTDGFTYKWNRDTTGTNDANWA

SEQ ID NO: 1721979 - protein, 19 aa, Staphylococcus aureus
SHNVYMLSTVLYPNWGQYK

SEQ ID NO: 1721980 - protein, 35 aa, Staphylococcus aureus
SIMAELEALYPPSYSSYIDFLYTCRQKIKLLDMNH

SEQ ID NO: 1721981 - protein, 26 aa, Staphylococcus aureus
SINTGKVLYAFYQKPELVKTAIKAQE

SEQ ID NO: 1721982 - protein, 26 aa, Staphylococcus aureus
SLDTDEFVYKIQLPEGVEYVNNSLTK

SEQ ID NO: 1721983 - protein, 32 aa, Staphylococcus aureus
SLNLQTIHDLDVHPIKKPDAGKRLMMILHASL

SEQ ID NO: 1721984 - protein, 21 aa, Staphylococcus aureus
SLVLTAVLLTSVSPLTNANEI

SEQ ID NO: 1721985 - protein, 17 aa, Staphylococcus aureus
SNEKGWIAGWHTNLDIV

SEQ ID NO: 1721986 - protein, 23 aa, Staphylococcus aureus
SNNYTNPPLTNPILEGLEGSSSK

SEQ ID NO: 1721987 - protein, 24 aa, Staphylococcus aureus
SSLFVATLTTATLVSSPAANALSS

SEQ ID NO: 1721988 - protein, 21 aa, Staphylococcus aureus
STVSHFMAFNPKNDVLNQRTI

SEQ ID NO: 1721989 - protein, 26 aa, Staphylococcus aureus
SWLTSRKQLQPYGQYHGGGAHYGVDY

SEQ ID NO: 1721990 - protein, 20 aa, Staphylococcus aureus
TAGQCTWYVFDRRAQAGSPI

SEQ ID NO: 1721991 - protein, 25 aa, Staphylococcus aureus
TARQGLTLDRQPAFTTLHGASNLNQ

SEQ ID NO: 1721992 - protein, 23 aa, Staphylococcus aureus
TARQGLTLDRQPALTTLHGASNL

SEQ ID NO: 1721993 - protein, 17 aa, Staphylococcus aureus
TATIKNGTAMPTNLAGG

SEQ ID NO: 1721994 - protein, 24 aa, Staphylococcus aureus
TDKVNGYSLINNGKIGFVNSELRR

SEQ ID NO: 1721995 - protein, 19 aa, Staphylococcus aureus
TEKAPKLLLKGSGDLKGSS

SEQ ID NO: 1721996 - protein, 28 aa, Staphylococcus aureus
TELNTAMGQLQHAIADKTNTLASSKYVN

SEQ ID NO: 1721997 - protein, 29 aa, Staphylococcus aureus
TELNTAMGQLQHAIADKTTTLASSKFVNA

SEQ ID NO: 1721998 - protein, 25 aa, Staphylococcus aureus
TELNTAMGTLKHAIADKTNTLASSK

SEQ ID NO: 1721999 - protein, 24 aa, Staphylococcus aureus
TFSEYKKDALAKIADAYNAKVNEA

SEQ ID NO: 1722000 - protein, 19 aa, Staphylococcus aureus
TFSEYKKDALAKIEDAYNA

SEQ ID NO: 1722001 - protein, 25 aa, Staphylococcus aureus
TIEQQIYVNPLKKTATNTKVDIAGS

SEQ ID NO: 1722002 - protein, 24 aa, Staphylococcus aureus
TKIQEIDRVLASHPDVATIRQNVT

SEQ ID NO: 1722003 - protein, 37 aa, Staphylococcus aureus; identical to SEQ ID NO: 1594932

SEQ ID NO: 1722004 - protein, 19 aa, Staphylococcus aureus
TLAVGLIAPLANPFIEISK

SEQ ID NO: 1722005 - protein, 22 aa, Staphylococcus aureus
TMGVICATQLWHSNHANALVSE

SEQ ID NO: 1722006 - protein, 17 aa, Staphylococcus aureus
TMIDVTFKYLTKDKLND

SEQ ID NO: 1722007 - protein, 22 aa, Staphylococcus aureus
TNAQHMNFQFVGTYGPNKDVVG

SEQ ID NO: 1722008 - protein, 21 aa, Staphylococcus aureus
TNILQNLQFDFIDDPTYDKNV

SEQ ID NO: 1722009 - protein, 44 aa, Staphylococcus aureus; identical to SEQ ID NO: 1592486

SEQ ID NO: 1722010 - protein, 17 aa, Staphylococcus aureus
TPLKRCAIVNRHNGTII

SEQ ID NO: 1722011 - protein, 27 aa, Staphylococcus aureus
TQITTNDILTMLKATTTVPGLRNNITG

SEQ ID NO: 1722012 - protein, 25 aa, Staphylococcus aureus
TSETNWKYKFKDLPKYDEGKKIEYT

SEQ ID NO: 1722013 - protein, 20 aa, Staphylococcus aureus
TTIKPRTLNRMAVNTVAAPQ

SEQ ID NO: 1722014 - protein, 17 aa, Staphylococcus aureus
TTKKAPKLLLKGSGNLK

SEQ ID NO: 1722015 - protein, 43 aa, Staphylococcus aureus
TTNKDGYKYYSFIDNVGLFSGSHLYVKNRDLAPKATNNKEYTI

SEQ ID NO: 1722016 - protein, 39 aa, Staphylococcus aureus
TTNSPARLMPDKILDLKYKLRVNNVPTPRTVTFNDTLTY

SEQ ID NO: 1722017 - protein, 17 aa, Staphylococcus aureus
TVYVNQPKKTYTKETFV

SEQ ID NO: 1722018 - protein, 31 aa, Staphylococcus aureus
TYTKETFVTNLTGYKFNPDAKNFKIYEVTDQ

SEQ ID NO: 1722019 - protein, 17 aa, Staphylococcus aureus
VAILIILGLVKTIQDHE

SEQ ID NO: 1722020 - protein, 18 aa, Staphylococcus aureus
VALIRTMPQRQQTSRRSS

SEQ ID NO: 1722021 - protein, 17 aa, Staphylococcus aureus
VAMSGLILTGAIGTAGL

SEQ ID NO: 1722022 - protein, 27 aa, Staphylococcus aureus
VAPKRVNAKMRFAVAQPAAVASNNVND

SEQ ID NO: 1722023 - protein, 17 aa, Staphylococcus aureus
VEAAKKAAIAKIEAIQP

SEQ ID NO: 1722024 - protein, 19 aa, Staphylococcus aureus
VETNGIATLKGVQPHIVIK

SEQ ID NO: 1722025 - protein, 20 aa, Staphylococcus aureus
VEVPVKVYPVANAKAPSRDV

SEQ ID NO: 1722026 - protein, 26 aa, Staphylococcus aureus
VGTASILIGSLMYLGTQQEAEAAENN

SEQ ID NO: 1722027 - protein, 19 aa, Staphylococcus aureus
VGTVNYDVPFQLQLLFVES

SEQ ID NO: 1722028 - protein, 41 aa, Staphylococcus aureus; identical to SEQ ID NO: 1594073

SEQ ID NO: 1722029 - protein, 20 aa, Staphylococcus aureus
VKELKPLLKWSEVPANAVGD

SEQ ID NO: 1722030 - protein, 19 aa, Staphylococcus aureus
VKGIFDKINTLLGSNDPIN

SEQ ID NO: 1722031 - protein, 28 aa, Staphylococcus aureus
VKTPSNKVLGFYPTSANTNAFRPGGVNP

SEQ ID NO: 1722032 - protein, 27 aa, Staphylococcus aureus
VNKDNKAFYFLLRDDDYFAKVVNGQAR

SEQ ID NO: 1722033 - protein, 33 aa, Staphylococcus aureus; identical to SEQ ID NO: 1595025

SEQ ID NO: 1722034 - protein, 24 aa, Staphylococcus aureus
VPVTVNVYQFEFPQTTYTTTVGGT

SEQ ID NO: 1722035 - protein, 24 aa, Staphylococcus aureus
VRGQNNQWTIANKPDYVTLDAHTG

SEQ ID NO: 1722036 - protein, 25 aa, Staphylococcus aureus
VRGQNNQWTIANKPDYVTLDAHTGK

SEQ ID NO: 1722037 - protein, 30 aa, Staphylococcus aureus
VTEKPKPWDVYAFPYYYVYNDFSDHYPIKA

SEQ ID NO: 1722038 - protein, 23 aa, Staphylococcus aureus
VVKTAIKLIINNRGKAKNVIQQV

SEQ ID NO: 1722039 - protein, 25 aa, Staphylococcus aureus
VVSDLLNVALFFESDLHTLPPHFEI

SEQ ID NO: 1722040 - protein, 29 aa, Staphylococcus aureus
YFSNRMFEKEWILALSPQGGYTYTFGTSL

SEQ ID NO: 1722041 - protein, 19 aa, Staphylococcus aureus
YHDYRFIDRENADSGTFNY

SEQ ID NO: 1722042 - protein, 19 aa, Staphylococcus aureus
YILEMIRQLKNQFQDLERL

SEQ ID NO: 1722043 - protein, 17 aa, Staphylococcus aureus
YISFIQPSIKFMNIIDG

SEQ ID NO: 1722044 - protein, 26 aa, Staphylococcus aureus
YKELEQAVALIRTMPQRQQTSRRSNR

SEQ ID NO: 1722045 - protein, 17 aa, Staphylococcus aureus
YNRPFFEYTNQSGYKEE

SEQ ID NO: 1722046 - protein, 26 aa, Staphylococcus aureus
YVYDKDKIIILAYKPLSNDEVHYYAY

SEQ ID NO: 1722047 - protein, 27 aa, Staphylococcus aureus
AADAVYKAQLYLSPYGPKQYVEHLNQN

SEQ ID NO: 1722048 - protein, 19 aa, Staphylococcus aureus
AAGLIKLKKDFGLAGTVKD

SEQ ID NO: 1722049 - protein, 29 aa, Staphylococcus aureus
AAKRVPVTVNVYQFEFPQTSYTTTVGGTL

SEQ ID NO: 1722050 - protein, 26 aa, Staphylococcus aureus
ADGNNNIKVILPKVQVKPAARQSVSA

SEQ ID NO: 1722051 - protein, 25 aa, Staphylococcus aureus
ADQIPSGYTILATGTPDGVHNTVTI

SEQ ID NO: 1722052 - protein, 27 aa, Staphylococcus aureus
ADQTAIINSLTFTSNAPNRNYATASAN

SEQ ID NO: 1722053 - protein, 27 aa, Staphylococcus aureus
ADQTTIINSLTFTSNAPNRNYATASAN

SEQ ID NO: 1722054 - protein, 23 aa, Staphylococcus aureus
ADSSLLHLSFNRDYNWYGSMIGY

SEQ ID NO: 1722055 - protein, 23 aa, Staphylococcus aureus
AEGPKYPTMEQHTIYGETVKGPE

SEQ ID NO: 1722056 - protein, 25 aa, Staphylococcus aureus
AESPGVPKVYTFIGQGDASYTISFK

SEQ ID NO: 1722057 - protein, 60 aa, Staphylococcus aureus
AGAGANKPLPEMWPYGVNDSRSWDYKIRNRSGQVIYDWPTVHINSLKDLARASDYFSEAG

SEQ ID NO: 1722058 - protein, 25 aa, Staphylococcus aureus
AGANKPLPEMWPYGVNDSRSWDYKI

SEQ ID NO: 1722059 - protein, 19 aa, Staphylococcus aureus
AIKIIQPETKIKPAAREKI

SEQ ID NO: 1722060 - protein, 17 aa, Staphylococcus aureus
AILSAIFLFAQNIAKAI

SEQ ID NO: 1722061 - protein, 23 aa, Staphylococcus aureus
AINRVNTLKNRALNDIGVTSTTA

SEQ ID NO: 1722062 - protein, 26 aa, Staphylococcus aureus
AISKVNESFIYYPKNDLKGLGGEHND

SEQ ID NO: 1722063 - protein, 25 aa, Staphylococcus aureus
AKDKLMTRILGEDQYLLKKKIDEYE

SEQ ID NO: 1722064 - protein, 17 aa, Staphylococcus aureus
AKDLVSKAKEKAYQDIL

SEQ ID NO: 1722065 - protein, 23 aa, Staphylococcus aureus
AKDRISVIGYPKGAQTKYKMFES

SEQ ID NO: 1722066 - protein, 25 aa, Staphylococcus aureus
AKMKDRISVIGYPKGAQTKYKMFES

SEQ ID NO: 1722067 - protein, 26 aa, Staphylococcus aureus
AKQTGDGYQWVIKFNKGHAPHENMIY

SEQ ID NO: 1722068 - protein, 29 aa, Staphylococcus aureus
AKVNKTYNYKYFYTYKVVKGVKKHFSFSK

SEQ ID NO: 1722069 - protein, 26 aa, Staphylococcus aureus
ALPSGDYILKEIEAPAPYTFDKDKEY

SEQ ID NO: 1722070 - protein, 17 aa, Staphylococcus aureus
ALQLRFILDWNSQATRD

SEQ ID NO: 1722071 - protein, 23 aa, Staphylococcus aureus
ALYISILILIVIVAGCDKSDETK

SEQ ID NO: 1722072 - protein, 19 aa, Staphylococcus aureus
AMNYITFDPNTNTNGITAA

SEQ ID NO: 1722073 - protein, 27 aa, Staphylococcus aureus
AQAGSPISTYWSDAKYWASNAANDGYQ

SEQ ID NO: 1722074 - protein, 22 aa, Staphylococcus aureus
AQALDHAMELLRNSIADNQATL

SEQ ID NO: 1722075 - protein, 23 aa, Staphylococcus aureus
AQTLDHAMELLRNSVADNQTTLA

SEQ ID NO: 1722076 - protein, 37 aa, Staphylococcus aureus; identical to SEQ ID NO: 1594166

SEQ ID NO: 1722077 - protein, 24 aa, Staphylococcus aureus
ARQGLTLDRQPAFTTLHGASNLNQ

SEQ ID NO: 1722078 - protein, 19 aa, Staphylococcus aureus
ASDYFSEAGATPATKAFGR

SEQ ID NO: 1722079 - protein, 29 aa, Staphylococcus aureus
ASSKGAPYNLPTTPWNTLKASDAKEIALI

SEQ ID NO: 1722080 - protein, 21 aa, Staphylococcus aureus
ASVFLGTMIVVGMGQEKEAAA

SEQ ID NO: 1722081 - protein, 19 aa, Staphylococcus aureus
ATAPTSVAPKRLNAKMRFA

SEQ ID NO: 1722082 - protein, 24 aa, Staphylococcus aureus
ATDNWNQIMLPITPNILIEFQEDK

SEQ ID NO: 1722083 - protein, 25 aa, Staphylococcus aureus
ATDNWNQIMLPITPNILIEFQEDKI

SEQ ID NO: 1722084 - protein, 19 aa, Staphylococcus aureus
ATGDYNFPKKPFKYGIHYS

SEQ ID NO: 1722085 - protein, 22 aa, Staphylococcus aureus
ATLSVSLLAPLANPLLENAKAA

SEQ ID NO: 1722086 - protein, 19 aa, Staphylococcus aureus
AVTILPDDIPPTINNPVGL

SEQ ID NO: 1722087 - protein, 30 aa, Staphylococcus aureus
AYKELEQAVALIRTMPQRQQTSRRSSRIQT

SEQ ID NO: 1722088 - protein, 19 aa, Staphylococcus aureus
AYTAKLYYNIPNGYKYYSL

SEQ ID NO: 1722089 - protein, 37 aa, Staphylococcus aureus
DAITDARGIYQLRDGYKYYDFVDSIGLHSGSHLYVER

SEQ ID NO: 1722090 - protein, 25 aa, Staphylococcus aureus
DALANLDTLRDLNQPQRDALRNQIN

SEQ ID NO: 1722091 - protein, 42 aa, Staphylococcus aureus
DAVLGEKVVAYGPIWRLFKVPENVSHLKIQFSPKNDAITDAR

SEQ ID NO: 1722092 - protein, 20 aa, Staphylococcus aureus
DDELIYSIKLSITNKKEKNS

SEQ ID NO: 1722093 - protein, 22 aa, Staphylococcus aureus
DDIEMLQDLVLAATNEAMNKAD

SEQ ID NO: 1722094 - protein, 24 aa, Staphylococcus aureus
DDKGGYLIPNLPNGDYRVEFSNLP

SEQ ID NO: 1722095 - protein, 23 aa, Staphylococcus aureus
DDKIKVIGYPLPAQHNFKQFEST

SEQ ID NO: 1722096 - protein, 30 aa, Staphylococcus aureus
DDNSKMSSFYNYNLYNFTMKEYNDIRLSLK

SEQ ID NO: 1722097 - protein, 26 aa, Staphylococcus aureus
DEEEALKPIIFKTKVTSFDNIESAIT

SEQ ID NO: 1722098 - protein, 35 aa, Staphylococcus aureus; identical to SEQ ID NO: 1591716

SEQ ID NO: 1722099 - protein, 18 aa, Staphylococcus aureus
DFMDDPLSYVKTPSNKVL

SEQ ID NO: 1722100 - protein, 17 aa, Staphylococcus aureus
DFYTFELNKKLQTHRMG

SEQ ID NO: 1722101 - protein, 19 aa, Staphylococcus aureus
DGLNAILGFLVLTGVIQDP

SEQ ID NO: 1722102 - protein, 27 aa, Staphylococcus aureus
DGYHFIEPGSGFLACGYVAKGRMEEPL

SEQ ID NO: 1722103 - protein, 24 aa, Staphylococcus aureus
DINPSVLAHYWGGNKMNIRQDLEE

SEQ ID NO: 1722104 - protein, 21 aa, Staphylococcus aureus
DKSIYLYGSVNGKSGWVSKAY

SEQ ID NO: 1722105 - protein, 26 aa, Staphylococcus aureus
DLMPESGKKFYPTKYLLIYNDNKTVE

SEQ ID NO: 1722106 - protein, 21 aa, Staphylococcus aureus
DLNQLNGLNNPQRQALESQIN

SEQ ID NO: 1722107 - protein, 17 aa, Staphylococcus aureus
DLQLAYKELEQAVALIR

SEQ ID NO: 1722108 - protein, 25 aa, Staphylococcus aureus
DNALNAVTRAKAALNGAENLRNAKT

SEQ ID NO: 1722109 - protein, 27 aa, Staphylococcus aureus
DNLSADLGIYKPKYNLGDYVWEDTNKN

SEQ ID NO: 1722110 - protein, 26 aa, Staphylococcus aureus
DNTNEAINIYFVPSDLVNPTISVGNY

SEQ ID NO: 1722111 - protein, 31 aa, Staphylococcus aureus
DQFLENTLLYKKFFTDLINFEDLLINFNSKE

SEQ ID NO: 1722112 - protein, 24 aa, Staphylococcus aureus
DQIPSGYTILATGTPDGVHNTITI

SEQ ID NO: 1722113 - protein, 25 aa, Staphylococcus aureus
DQNHQLFLLGKDKDKYKEGLQGQNV

SEQ ID NO: 1722114 - protein, 17 aa, Staphylococcus aureus
DRLTLAINQLVPLADNS

SEQ ID NO: 1722115 - protein, 30 aa, Staphylococcus aureus
DSGTFNYVKGIFDKINTLLGSNDPINNKDL

SEQ ID NO: 1722116 - protein, 17 aa, Staphylococcus aureus
DSKKASHILIKVKSKKS

SEQ ID NO: 1722117 - protein, 26 aa, Staphylococcus aureus
DSLTDGQLWLGVKNPLIDAQIISGNK

SEQ ID NO: 1722118 - protein, 17 aa, Staphylococcus aureus
DYILKEIEAPAPYTFDK

SEQ ID NO: 1722119 - protein, 19 aa, Staphylococcus aureus
DYKVRNYLLKHKNLYEFNS

SEQ ID NO: 1722120 - protein, 24 aa, Staphylococcus aureus
EDGKTYTFHLRDDVKFHDGTTFDA

SEQ ID NO: 1722121 - protein, 21 aa, Staphylococcus aureus
EEVQESIFTKADKRELITAKN

SEQ ID NO: 1722122 - protein, 17 aa, Staphylococcus aureus
EFEAFKKRSPKYNPGMS

SEQ ID NO: 1722123 - protein, 18 aa, Staphylococcus aureus
EFEAFKKRSPKYNPGMSD

SEQ ID NO: 1722124 - protein, 25 aa, Staphylococcus aureus
EFKIDWNKHGFWGYWSGENHVDKKE

SEQ ID NO: 1722125 - protein, 44 aa, Staphylococcus aureus
EFKNEIGIILKKWTTIRFMNIVPDYFIYKIALVGKDDKKYGEGV

SEQ ID NO: 1722126 - protein, 21 aa, Staphylococcus aureus
EGDLAIVKFSPNEQNKHIGEV

SEQ ID NO: 1722127 - protein, 18 aa, Staphylococcus aureus
EGISQMMPMIKETPFKDS

SEQ ID NO: 1722128 - protein, 25 aa, Staphylococcus aureus
EHKESFYYDLFYIKGNLPDQYLQIY

SEQ ID NO: 1722129 - protein, 18 aa, Staphylococcus aureus
EIGKGISTYWWNANNWDN

SEQ ID NO: 1722130 - protein, 27 aa, Staphylococcus aureus
EKEKGIVPVRAAYVEGLENINAASTTG

SEQ ID NO: 1722131 - protein, 27 aa, Staphylococcus aureus
EKELKYIYGKIIILDKDGTAKDVNLEN

SEQ ID NO: 1722132 - protein, 28 aa, Staphylococcus aureus
EKYNGLKQAIAGLTPDLAPLQAAKTQLQ

SEQ ID NO: 1722133 - protein, 30 aa, Staphylococcus aureus
ELIKYYTQPHLSFSGKWLWQNPNGTIHATL

SEQ ID NO: 1722134 - protein, 31 aa, Staphylococcus aureus
ELSFASKYRYPALVRSGFNPEFLTYLSNEKS

SEQ ID NO: 1722135 - protein, 19 aa, Staphylococcus aureus
EMDRYTNYWNRLHWIGNNH

SEQ ID NO: 1722136 - protein, 27 aa, Staphylococcus aureus
ENGTIHVTLLQLSWFSHIQVFGPESWG

SEQ ID NO: 1722137 - protein, 26 aa, Staphylococcus aureus
ENPRGFINPLPHISYVRGKNNVKFLK

SEQ ID NO: 1722138 - protein, 25 aa, Staphylococcus aureus
ENVSHLKIQFVPKNDAITDARGIYQ

SEQ ID NO: 1722139 - protein, 18 aa, Staphylococcus aureus
ERKKIPINLWINGVQKEV

SEQ ID NO: 1722140 - protein, 17 aa, Staphylococcus aureus
ERNVAIAALNKIVNAIK

SEQ ID NO: 1722141 - protein, 24 aa, Staphylococcus aureus
ESVKHHAIIDRNTGKIIKTGGAIT

SEQ ID NO: 1722142 - protein, 24 aa, Staphylococcus aureus
ETQRQYYIYMLKDYYSQESYESTN

SEQ ID NO: 1722143 - protein, 24 aa, Staphylococcus aureus
EVKNRNDEFLFYRTTRLSTVENPE

SEQ ID NO: 1722144 - protein, 21 aa, Staphylococcus aureus
EWQSVYPYLKDGTLDEVMEHK

SEQ ID NO: 1722145 - protein, 19 aa, Staphylococcus aureus
FEFDFKRKPYDNLKLNPDD

SEQ ID NO: 1722146 - protein, 21 aa, Staphylococcus aureus
FENELKAILPFHRSLRVANYD

SEQ ID NO: 1722147 - protein, 25 aa, Staphylococcus aureus
FETARGVLYPGVSDMYDAKQYVKPV

SEQ ID NO: 1722148 - protein, 20 aa, Staphylococcus aureus
FFTGHQWYNDLLVDLGSKDT

SEQ ID NO: 1722149 - protein, 19 aa, Staphylococcus aureus
FIGQGDASYTISFKTQGPT

SEQ ID NO: 1722150 - protein, 22 aa, Staphylococcus aureus
FILLSFIALTLITSPFVNCSEK

SEQ ID NO: 1722151 - protein, 18 aa, Staphylococcus aureus
FLLDLMFNNKNGDTLIKD

SEQ ID NO: 1722152 - protein, 19 aa, Staphylococcus aureus
FLLGKDKEEYKEGIEGKDV

SEQ ID NO: 1722153 - protein, 17 aa, Staphylococcus aureus
FLVGDGMGPSFNTAYRY

SEQ ID NO: 1722154 - protein, 19 aa, Staphylococcus aureus
FPLTVTALGQVLFPEQANG

SEQ ID NO: 1722155 - protein, 23 aa, Staphylococcus aureus
FSEYKKDALAKIADAYNAKVNEA

SEQ ID NO: 1722156 - protein, 24 aa, Staphylococcus aureus
FTDKDWQITGIPRTLHIENSTNRT

SEQ ID NO: 1722157 - protein, 19 aa, Staphylococcus aureus
FTDQKLQEAARTRNPIRLM

SEQ ID NO: 1722158 - protein, 18 aa, Staphylococcus aureus
GALAVASSLFTWDNKADA

SEQ ID NO: 1722159 - protein, 29 aa, Staphylococcus aureus
GASFNTDDFVYKIQLPEGVEYVNNSLTKD

SEQ ID NO: 1722160 - protein, 19 aa, Staphylococcus aureus
GAYYDYLNAPRFVIKKEVG

SEQ ID NO: 1722161 - protein, 52 aa, Staphylococcus aureus
GDASYTISFKTQGPTIDKLYYAAGGRALEYNQLFMYSQLYVESTQDYQQRLN

SEQ ID NO: 1722162 - protein, 26 aa, Staphylococcus aureus
GETLVPVNLTVLPEIQHNIKFFKNDD

SEQ ID NO: 1722163 - protein, 35 aa, Staphylococcus aureus
GFDFGHVERFIQNPPHGATVAWHDNPDTWKNTVGN

SEQ ID NO: 1722164 - protein, 35 aa, Staphylococcus aureus
GFDFGHVERFIQNPPHGATVAWHDSPDTWKNTVGN

SEQ ID NO: 1722165 - protein, 18 aa, Staphylococcus aureus
GFSNIVSNEFVFYNASKI

SEQ ID NO: 1722166 - protein, 21 aa, Staphylococcus aureus
GGAPVAITAPYTPTTDPNNNN

SEQ ID NO: 1722167 - protein, 23 aa, Staphylococcus aureus
GHAEAFFPSKLPLINLRMNNRNH

SEQ ID NO: 1722168 - protein, 20 aa, Staphylococcus aureus
GHVERFIQNPPHGATVAWHD

SEQ ID NO: 1722169 - protein, 18 aa, Staphylococcus aureus
GIANIKALPSGDYILKEI

SEQ ID NO: 1722170 - protein, 17 aa, Staphylococcus aureus
GIFYYQNAKKTLGIWFV

SEQ ID NO: 1722171 - protein, 21 aa, Staphylococcus aureus
GIGVGVAAGFVVALQGRDDKS

SEQ ID NO: 1722172 - protein, 25 aa, Staphylococcus aureus
GIKNTTITTLPSGWTSNLTKSDNKN

SEQ ID NO: 1722173 - protein, 18 aa, Staphylococcus aureus
GITDVDLRLSKQAKYTVN

SEQ ID NO: 1722174 - protein, 26 aa, Staphylococcus aureus
GKLIKYISILLIVVLVLSACGKSSNK

SEQ ID NO: 1722175 - protein, 19 aa, Staphylococcus aureus
GLKQAIAGLTPDLAPLQAA

SEQ ID NO: 1722176 - protein, 24 aa, Staphylococcus aureus
GLPTDGFTYKWNRDTTGTNDANWS

SEQ ID NO: 1722177 - protein, 31 aa, Staphylococcus aureus
GLRILEPNGYWNSTLRWPGSYSVSIQNVDDN

SEQ ID NO: 1722178 - protein, 22 aa, Staphylococcus aureus
GLRQVVNRTYRIGTTKRVEVSQ

SEQ ID NO: 1722179 - protein, 23 aa, Staphylococcus aureus
GLTALTILTILTSLGFAENISNQ

SEQ ID NO: 1722180 - protein, 28 aa, Staphylococcus aureus
GLVLIMFVLCGFIFPLTVTALGQVLFPE

SEQ ID NO: 1722181 - protein, 18 aa, Staphylococcus aureus
GMVLYINRNTRTTKGNFV

SEQ ID NO: 1722182 - protein, 19 aa, Staphylococcus aureus
GNGSSAADYFKLSNGSAIP

SEQ ID NO: 1722183 - protein, 31 aa, Staphylococcus aureus; identical to SEQ ID NO: 1592971

SEQ ID NO: 1722184 - protein, 19 aa, Staphylococcus aureus
GNYHYTWTGNWNPSQLTQN

SEQ ID NO: 1722185 - protein, 22 aa, Staphylococcus aureus
GPNKDVVGISTRLIRVTYDNRQ

SEQ ID NO: 1722186 - protein, 23 aa, Staphylococcus aureus
GQEVIIIWNSWDNGFMTQDAKNN

SEQ ID NO: 1722187 - protein, 17 aa, Staphylococcus aureus
GQLWKKVKDSLIDSKII

SEQ ID NO: 1722188 - protein, 24 aa, Staphylococcus aureus
GQNAPNEVLSFDDNNIRPSTNRSV

SEQ ID NO: 1722189 - protein, 18 aa, Staphylococcus aureus
GQSEPIVLVIFTNKDNKS

SEQ ID NO: 1722190 - protein, 21 aa, Staphylococcus aureus
GQVIQIMDIINPSNGFGGQPV

SEQ ID NO: 1722191 - protein, 22 aa, Staphylococcus aureus
GRINFMNLIENPFTYKPRKKPI

SEQ ID NO: 1722192 - protein, 23 aa, Staphylococcus aureus
GRINFMNLIENPFTYKPRKKPID

SEQ ID NO: 1722193 - protein, 24 aa, Staphylococcus aureus
GRKEQLFEIRVKPHTPRITTTAEE

SEQ ID NO: 1722194 - protein, 17 aa, Staphylococcus aureus
GSAPVAITAPYTPTTDP

SEQ ID NO: 1722195 - protein, 23 aa, Staphylococcus aureus
GSKAKAERYVPYTIAVNGTSTPN

SEQ ID NO: 1722196 - protein, 20 aa, Staphylococcus aureus
GSVTSIQPLRINLTSNENFT

SEQ ID NO: 1722197 - protein, 19 aa, Staphylococcus aureus
GTIINIFDDMSEKDKEEFE

SEQ ID NO: 1722198 - protein, 28 aa, Staphylococcus aureus
GTTEEAPLPIAQPLVKIPEGTIQGVTAE

SEQ ID NO: 1722199 - protein, 26 aa, Staphylococcus aureus
GYENPDLGTFFLMDTTSRIIGHDARE

SEQ ID NO: 1722200 - protein, 37 aa, Staphylococcus aureus
GYPGDKPVATMWESKGKITYLKGEAMQYDLSTTGGNS

SEQ ID NO: 1722201 - protein, 17 aa, Staphylococcus aureus
GYYTFELNKKLQPHRMG

SEQ ID NO: 1722202 - protein, 20 aa, Staphylococcus aureus
HADYIFIATGDYNFPKKPFK

SEQ ID NO: 1722203 - protein, 27 aa, Staphylococcus aureus
HDTANNLITYTFTDYVDRFNSVKMGIN

SEQ ID NO: 1722204 - protein, 17 aa, Staphylococcus aureus
HIVATNAYHKDTEDFYI

SEQ ID NO: 1722205 - protein, 19 aa, Staphylococcus aureus
HYAPVTYIQVEAPTGTFIA

SEQ ID NO: 1722206 - protein, 20 aa, Staphylococcus aureus
HYFVTTFYRNGKLPDEKNYK

SEQ ID NO: 1722207 - protein, 22 aa, Staphylococcus aureus
IASSLSCALLLLSAANTEANSA

SEQ ID NO: 1722208 - protein, 17 aa, Staphylococcus aureus
IATKVKFPVTINGFSNV

SEQ ID NO: 1722209 - protein, 28 aa, Staphylococcus aureus
ICDNLLLTICHTAFEKLSIFPNMNLHMW

SEQ ID NO: 1722210 - protein, 24 aa, Staphylococcus aureus
IDVEIKHFFDYNLPNKALNDGDID

SEQ ID NO: 1722211 - protein, 19 aa, Staphylococcus aureus
IILILEIVFHNINYANALP

SEQ ID NO: 1722212 - protein, 19 aa, Staphylococcus aureus
IILSMALIIIGTATIQSPH

SEQ ID NO: 1722213 - protein, 17 aa, Staphylococcus aureus
IILTTTLLLLGTTATQT

SEQ ID NO: 1722214 - protein, 27 aa, Staphylococcus aureus
IKPKSTAPKRLNTRMRMAAVQPSSTDS

SEQ ID NO: 1722215 - protein, 23 aa, Staphylococcus aureus
IKQILRLLFLLAMYELGKYVTEQ

SEQ ID NO: 1722216 - protein, 19 aa, Staphylococcus aureus
ILGFLVLTGVIQDPTTKGI

SEQ ID NO: 1722217 - protein, 17 aa, Staphylococcus aureus
ILGSLLILSACSNNDEK

SEQ ID NO: 1722218 - protein, 19 aa, Staphylococcus aureus
ILIFMLVMSGCGMKDNDKQ

SEQ ID NO: 1722219 - protein, 19 aa, Staphylococcus aureus
INAVKTFSEYKKDALAKIA

SEQ ID NO: 1722220 - protein, 21 aa, Staphylococcus aureus
INEPFVIYDGITNGALYHRLK

SEQ ID NO: 1722221 - protein, 26 aa, Staphylococcus aureus
IPNKPDHPFVFWATLKNAASLLDAGV

SEQ ID NO: 1722222 - protein, 17 aa, Staphylococcus aureus
IQHNIKFFKNDDGQNIA

SEQ ID NO: 1722223 - protein, 30 aa, Staphylococcus aureus; identical to SEQ ID NO: 1583202

SEQ ID NO: 1722224 - protein, 18 aa, Staphylococcus aureus
IRQHLVKNYGLYKGTTKY

SEQ ID NO: 1722225 - protein, 19 aa, Staphylococcus aureus
IRQHLVKNYGLYKGTTKYG

SEQ ID NO: 1722226 - protein, 25 aa, Staphylococcus aureus
ISIVGYPEPYVNKFQMYESTGKVLS

SEQ ID NO: 1722227 - protein, 17 aa, Staphylococcus aureus
ISLLLGILATGVSTTTE

SEQ ID NO: 1722228 - protein, 17 aa, Staphylococcus aureus
ISYKYLNDKVKSVLKSE

SEQ ID NO: 1722229 - protein, 18 aa, Staphylococcus aureus
ITICSLALSTALTIFPAS

SEQ ID NO: 1722230 - protein, 42 aa, Staphylococcus aureus
ITKTATYKVVRTVPKHVFETARGVLYPGVSDMYDAKQYVKPV

SEQ ID NO: 1722231 - protein, 29 aa, Staphylococcus aureus
ITKTATYKVVRTVPKQVFETARGVLYPGV

SEQ ID NO: 1722232 - protein, 17 aa, Staphylococcus aureus
ITMKGGGYYTFELNKKL

SEQ ID NO: 1722233 - protein, 24 aa, Staphylococcus aureus
ITTNDILTLLKATTTVPGLRNNIA

SEQ ID NO: 1722234 - protein, 25 aa, Staphylococcus aureus
IVQILLVVIIIIFGCKIVQTYIEDK

SEQ ID NO: 1722235 - protein, 18 aa, Staphylococcus aureus
IYLYGSVNGKSGWVSKAY

SEQ ID NO: 1722236 - protein, 17 aa, Staphylococcus aureus
IYSIKKIIDYPGKEDVS

SEQ ID NO: 1722237 - protein, 26 aa, Staphylococcus aureus
KADTLDIIPKLMLQGSVDLLNEVATS

SEQ ID NO: 1722238 - protein, 17 aa, Staphylococcus aureus
KAFFSYEWKGLEIAKKL

SEQ ID NO: 1722239 - protein, 27 aa, Staphylococcus aureus
KAIEQIKPKVRRKRAALDNIDESNNNQ

SEQ ID NO: 1722240 - protein, 18 aa, Staphylococcus aureus
KAKVIMPVYPKIPHQDYQ

SEQ ID NO: 1722241 - protein, 22 aa, Staphylococcus aureus
KALNWWDYEIGTPRSLTNTLIL

SEQ ID NO: 1722242 - protein, 23 aa, Staphylococcus aureus
KAQEKFLQHDLLFKINGSKIDGS

SEQ ID NO: 1722243 - protein, 18 aa, Staphylococcus aureus
KDALEWLHKNAYGKEPDK

SEQ ID NO: 1722244 - protein, 23 aa, Staphylococcus aureus
KDALEWLHKNAYGKEPDKKVADL

SEQ ID NO: 1722245 - protein, 29 aa, Staphylococcus aureus
KDDFGKKYIIFPNPMYGSWEATIYNNNYK

SEQ ID NO: 1722246 - protein, 21 aa, Staphylococcus aureus
KDKVLGLFADKNMPLAIDASK

SEQ ID NO: 1722247 - protein, 22 aa, Staphylococcus aureus
KDKVLGLFADKNMPLAIDASKD

SEQ ID NO: 1722248 - protein, 26 aa, Staphylococcus aureus
KDLESIIDDFFIETKLNRPKHITRYD

SEQ ID NO: 1722249 - protein, 18 aa, Staphylococcus aureus
KDLQLAYKELEQAVALIR

SEQ ID NO: 1722250 - protein, 17 aa, Staphylococcus aureus
KDNGKIIKNHKWMTGNE

SEQ ID NO: 1722251 - protein, 29 aa, Staphylococcus aureus
KEIARTDLGRYFDRFADNLDKTQTNTEVA

SEQ ID NO: 1722252 - protein, 19 aa, Staphylococcus aureus
KEIKAYLKQVDKIKNDEEP

SEQ ID NO: 1722253 - protein, 26 aa, Staphylococcus aureus
KELDFKLRQYLIQDFDLYKKFPKDSK

SEQ ID NO: 1722254 - protein, 18 aa, Staphylococcus aureus
KENKKFLLDLMLNNKSGD

SEQ ID NO: 1722255 - protein, 24 aa, Staphylococcus aureus
KETATTDLYAYADQKKNNISADTN

SEQ ID NO: 1722256 - protein, 20 aa, Staphylococcus aureus
KFAVANLIIVSTVFSSVTPA

SEQ ID NO: 1722257 - protein, 25 aa, Staphylococcus aureus
KFLTLKEFLYYKKKGKFPKRSVWIN

SEQ ID NO: 1722258 - protein, 37 aa, Staphylococcus aureus
KFSIRKYTVGTFSTVIATLVFLGLNTSQAQATETNQP

SEQ ID NO: 1722259 - protein, 29 aa, Staphylococcus aureus
KGATVSDYYYWKIIDSLEAQFTGAIDLLE

SEQ ID NO: 1722260 - protein, 19 aa, Staphylococcus aureus
KGKITYLKGEAMQYDLSTT

SEQ ID NO: 1722261 - protein, 26 aa, Staphylococcus aureus
KGKKVDIFGVPYFYTCIIPKSEPDIN

SEQ ID NO: 1722262 - protein, 24 aa, Staphylococcus aureus
KGKTLPNHIILLNIDRQSADSFEG

SEQ ID NO: 1722263 - protein, 21 aa, Staphylococcus aureus
KGQSEPIVLVIFTNKDNKSDK

SEQ ID NO: 1722264 - protein, 29 aa, Staphylococcus aureus
KGQSFNIGDIKQYFTLSNGQAIPNGTFTN

SEQ ID NO: 1722265 - protein, 27 aa, Staphylococcus aureus
KHAKKAYYTVYFKNGGKRVIHLNSNVY

SEQ ID NO: 1722266 - protein, 18 aa, Staphylococcus aureus
KHDKIIILPATSNTINKI

SEQ ID NO: 1722267 - protein, 17 aa, Staphylococcus aureus
KHYLIFDKNRKFTRIQI

SEQ ID NO: 1722268 - protein, 20 aa, Staphylococcus aureus
KILTATLAVGLIAPLANPFI

SEQ ID NO: 1722269 - protein, 25 aa, Staphylococcus aureus
KIMRSRGMYLFLNRNTRTAKGYFIV

SEQ ID NO: 1722270 - protein, 33 aa, Staphylococcus aureus
KIRNRSGQVIYDWPTVHIYSLEDLSRASDYFSE

SEQ ID NO: 1722271 - protein, 25 aa, Staphylococcus aureus
KKIDEYELYKKWYKSSNKNTNMLTF

SEQ ID NO: 1722272 - protein, 19 aa, Staphylococcus aureus
KKNKNFLLDLMFNNKNGDT

SEQ ID NO: 1722273 - protein, 25 aa, Staphylococcus aureus
KKSLDDLIWSFPNLDNERFDNPEYK

SEQ ID NO: 1722274 - protein, 23 aa, Staphylococcus aureus
KLCLCLIILSVFIGACGMKKEES

SEQ ID NO: 1722275 - protein, 20 aa, Staphylococcus aureus
KLIGQQWTEPKYFHGRISAV

SEQ ID NO: 1722276 - protein, 21 aa, Staphylococcus aureus
KLKEERIVGTAGGGMVAVTVT

SEQ ID NO: 1722277 - protein, 18 aa, Staphylococcus aureus
KLRDGYLLSDKNYKDWTE

SEQ ID NO: 1722278 - protein, 24 aa, Staphylococcus aureus
KMCLCLIILSVFIGACGMKKEESS

SEQ ID NO: 1722279 - protein, 24 aa, Staphylococcus aureus
KMEDDKFYTFELTKKLQPHRMGDT

SEQ ID NO: 1722280 - protein, 23 aa, Staphylococcus aureus
KMKVGLVSVAITMLYIMTNGEAH

SEQ ID NO: 1722281 - protein, 28 aa, Staphylococcus aureus
KNKYMYGGVTLAGDYLEKSRCIPINLWV

SEQ ID NO: 1722282 - protein, 28 aa, Staphylococcus aureus
KQHTQFIVDEILAIKLPAEATKVSPNVG

SEQ ID NO: 1722283 - protein, 24 aa, Staphylococcus aureus
KQLRKRYNIPTKKAPKLLIKGDGD

SEQ ID NO: 1722284 - protein, 18 aa, Staphylococcus aureus
KRGEQFFMDNFSLKVKAT

SEQ ID NO: 1722285 - protein, 31 aa, Staphylococcus aureus
KRGPSLYSIIPMIEMMFGVHFIKGGMYGMAQ

SEQ ID NO: 1722286 - protein, 23 aa, Staphylococcus aureus
KSVMYLLVNEGELSTYGPKGRFG

SEQ ID NO: 1722287 - protein, 19 aa, Staphylococcus aureus
KTIGIFGFGRIGQLVAERL

SEQ ID NO: 1722288 - protein, 24 aa, Staphylococcus aureus
KTNHVKAMRWPFQYNIGLKTNDPN

SEQ ID NO: 1722289 - protein, 17 aa, Staphylococcus aureus
KTPEVGAIFQTAAGPYG

SEQ ID NO: 1722290 - protein, 21 aa, Staphylococcus aureus
KTRYQGIWKHIDDKGYFEFDF

SEQ ID NO: 1722291 - protein, 19 aa, Staphylococcus aureus
KVEAYHPKYPTNIGQINQN

SEQ ID NO: 1722292 - protein, 33 aa, Staphylococcus aureus
KVPVNISGIPLDPSALVYLVAPTNQTTNGGSEA

SEQ ID NO: 1722293 - protein, 35 aa, Staphylococcus aureus
KVPVTVTDIPLDPSALVYLVIPTSQTRDGGSEADQ

SEQ ID NO: 1722294 - protein, 35 aa, Staphylococcus aureus
KVVNAKYDVIYNGHTFATSLPAKFVVKDVQPAKPT

SEQ ID NO: 1722295 - protein, 24 aa, Staphylococcus aureus
KYDVIYNGHTFATSLPAKFVVKDV

SEQ ID NO: 1722296 - protein, 27 aa, Staphylococcus aureus
KYEDIKSRLTLYSYIDKKTVPNETSLN

SEQ ID NO: 1722297 - protein, 26 aa, Staphylococcus aureus
KYIYGGVTFAGDYLEKSRRIPINLWV

SEQ ID NO: 1722298 - protein, 27 aa, Staphylococcus aureus
KYNGLKQAIAGLTPDLAPLQAAKTQLQ

SEQ ID NO: 1722299 - protein, 21 aa, Staphylococcus aureus
LALGILTTGMITTTAQPVKAS

SEQ ID NO: 1722300 - protein, 17 aa, Staphylococcus aureus
LAVAIIIGTIITVVFSQ

SEQ ID NO: 1722301 - protein, 23 aa, Staphylococcus aureus
LDDIALVTPDHIVRAAARDAVKQ

SEQ ID NO: 1722302 - protein, 30 aa, Staphylococcus aureus
LDFKIRKMLVEKYRLYKGASDKGRIVINMK

SEQ ID NO: 1722303 - protein, 19 aa, Staphylococcus aureus
LDFKLRKHLIDKHNLYKTE

SEQ ID NO: 1722304 - protein, 17 aa, Staphylococcus aureus
LDFKLRKQLIEKHNLYG

SEQ ID NO: 1722305 - protein, 22 aa, Staphylococcus aureus
LDNINDYTIPTGKKETATTDLY

SEQ ID NO: 1722306 - protein, 19 aa, Staphylococcus aureus
LEDYKYGDPIYKEAKDRLM

SEQ ID NO: 1722307 - protein, 18 aa, Staphylococcus aureus
LEELFNRFNGEDFYGEAE

SEQ ID NO: 1722308 - protein, 45 aa, Staphylococcus aureus
LEFEKQFGFMLKPWTTVRFMNVIPDWFIYKIALVGKDDKKYKDGP

SEQ ID NO: 1722309 - protein, 45 aa, Staphylococcus aureus
LEFKNELGIIIKKWTTIRFMNIVPDYFIYKIALVGKDDKKYGEGV

SEQ ID NO: 1722310 - protein, 17 aa, Staphylococcus aureus
LEKEVKDLKPSKDDKKD

SEQ ID NO: 1722311 - protein, 18 aa, Staphylococcus aureus
LEKKVEEIPFKKERKFNP

SEQ ID NO: 1722312 - protein, 19 aa, Staphylococcus aureus
LEKSRCIPINLWVNGNHKT

SEQ ID NO: 1722313 - protein, 19 aa, Staphylococcus aureus
LENTLLYKKFFTDLINFED

SEQ ID NO: 1722314 - protein, 25 aa, Staphylococcus aureus
LERNKKGFFLMVEGASIDKSAHSND

SEQ ID NO: 1722315 - protein, 22 aa, Staphylococcus aureus
LGALCVSQIWESNHASAVVSGE

SEQ ID NO: 1722316 - protein, 17 aa, Staphylococcus aureus
LGGSVTSIQPLRINLTS

SEQ ID NO: 1722317 - protein, 23 aa, Staphylococcus aureus
LGGTLRLGLYPCSIKEGTLAQAV

SEQ ID NO: 1722318 - protein, 24 aa, Staphylococcus aureus
LGVASVIVSTLFLITSQHQAQAAE

SEQ ID NO: 1722319 - protein, 25 aa, Staphylococcus aureus
LGVASVIVSTLFLITSQHQAQAAEN

SEQ ID NO: 1722320 - protein, 20 aa, Staphylococcus aureus
LKPDLIIADVSRHKKIKSEL

SEQ ID NO: 1722321 - protein, 17 aa, Staphylococcus aureus
LLFLLAMYELGKYVTEQ

SEQ ID NO: 1722322 - protein, 49 aa, Staphylococcus aureus; identical to SEQ ID NO: 1591558

SEQ ID NO: 1722323 - protein, 33 aa, Staphylococcus aureus; identical to SEQ ID NO: 1697782

SEQ ID NO: 1722324 - protein, 22 aa, Staphylococcus aureus
LNEYQLSQLFTDDKLQQAARTG

SEQ ID NO: 1722325 - protein, 46 aa, Staphylococcus aureus; identical to SEQ ID NO: 1593032

SEQ ID NO: 1722326 - protein, 22 aa, Staphylococcus aureus
LNSKHELIGILYAGSGKDESEK

SEQ ID NO: 1722327 - protein, 18 aa, Staphylococcus aureus
LPEIQHNIKFFKNDDGQN

SEQ ID NO: 1722328 - protein, 20 aa, Staphylococcus aureus
LPGVTLKIKQLPFKQKVSLE

SEQ ID NO: 1722329 - protein, 19 aa, Staphylococcus aureus
LPSGDYILKEIEAPAPYTF

SEQ ID NO: 1722330 - protein, 21 aa, Staphylococcus aureus
LRGTALQKVPVTVTDIPLDPS

SEQ ID NO: 1722331 - protein, 24 aa, Staphylococcus aureus
LSNNYTNPPLTNPILKGIEGSSSK

SEQ ID NO: 1722332 - protein, 17 aa, Staphylococcus aureus
LTFLTASSNNGGLNIDV

SEQ ID NO: 1722333 - protein, 25 aa, Staphylococcus aureus
LTHGTNAIDYITFDPNTNTNGITAA

SEQ ID NO: 1722334 - protein, 38 aa, Staphylococcus aureus; identical to SEQ ID NO: 1591765

SEQ ID NO: 1722335 - protein, 23 aa, Staphylococcus aureus
LTLAINQLVPLADNSALRTAKTK

SEQ ID NO: 1722336 - protein, 26 aa, Staphylococcus aureus
LTQAINQLVPLADNSALRTAKTKLDE

SEQ ID NO: 1722337 - protein, 31 aa, Staphylococcus aureus
LTTEKFLDFDLLFKNFTWLDGKSAEFKDLKV

SEQ ID NO: 1722338 - protein, 18 aa, Staphylococcus aureus
LTVYSPYQSNLIRPILND

SEQ ID NO: 1722339 - protein, 17 aa, Staphylococcus aureus
LVSTLALTACGEKEKPK

SEQ ID NO: 1722340 - protein, 22 aa, Staphylococcus aureus
LWGNANNWNYAAKSAGFKVDKT

SEQ ID NO: 1722341 - protein, 22 aa, Staphylococcus aureus
LWGNANNWNYAAKVAGFKVDKT

SEQ ID NO: 1722342 - protein, 25 aa, Staphylococcus aureus
LWGNANNWNYAAKVAGFKVDKTPEV

SEQ ID NO: 1722343 - protein, 22 aa, Staphylococcus aureus
LWLYLVLLAVFIGACGMKKEES

SEQ ID NO: 1722344 - protein, 20 aa, Staphylococcus aureus
LYISIMALSIFIIGCDKSSV

SEQ ID NO: 1722345 - protein, 20 aa, Staphylococcus aureus
LYKKFFTDLINFEDLLINFN

SEQ ID NO: 1722346 - protein, 17 aa, Staphylococcus aureus
MESRSMVLYINRNTRTT

SEQ ID NO: 1722347 - protein, 17 aa, Staphylococcus aureus
MMPMIKETPFKDSNQND

SEQ ID NO: 1722348 - protein, 21 aa, Staphylococcus aureus
MSVMILLAGCGKSEEKATLEK

SEQ ID NO: 1722349 - protein, 19 aa, Staphylococcus aureus
MTRVLGEDQYLLKKKIDEY

SEQ ID NO: 1722350 - protein, 26 aa, Staphylococcus aureus
MTTKNYQGMTNLIIKNADNYTVIGEK

SEQ ID NO: 1722351 - protein, 30 aa, Staphylococcus aureus
MTVAGVVLILVAAYLFAKPHIDNYLHDKDK

SEQ ID NO: 1722352 - protein, 26 aa, Staphylococcus aureus
MVFIMLLNIITPLFNKNEAFAARDIS

SEQ ID NO: 1722353 - protein, 21 aa, Staphylococcus aureus
MYTNVIILSVFIIGCDRSSVT

SEQ ID NO: 1722354 - protein, 20 aa, Staphylococcus aureus
NADIILPKSTAPKSLNTRMR

SEQ ID NO: 1722355 - protein, 18 aa, Staphylococcus aureus
NADVAYLLHDGKNEIREI

SEQ ID NO: 1722356 - protein, 29 aa, Staphylococcus aureus
NAGQNFLPTHQMPLLARGNFNPEFISVLS

SEQ ID NO: 1722357 - protein, 39 aa, Staphylococcus aureus
NAGTQLYHIVASNAYHKDTEDFYISLKIVDVKQPEGDQR

SEQ ID NO: 1722358 - protein, 40 aa, Staphylococcus aureus; identical to SEQ ID NO: 1592021

SEQ ID NO: 1722359 - protein, 26 aa, Staphylococcus aureus
NAGTQLYHIVATNAYHKDTEDFYITL

SEQ ID NO: 1722360 - protein, 24 aa, Staphylococcus aureus
NAINPIAPVTVVKQAARDAVTHDA

SEQ ID NO: 1722361 - protein, 27 aa, Staphylococcus aureus
NAKYDVIYNGHTFATSLPAKFVVKDVQ

SEQ ID NO: 1722362 - protein, 28 aa, Staphylococcus aureus
NAKYDVIYNGHTFATSLPAKFVVKDVQP

SEQ ID NO: 1722363 - protein, 20 aa, Staphylococcus aureus
NAQHMNFQFVGTYGPNKDVV

SEQ ID NO: 1722364 - protein, 33 aa, Staphylococcus aureus
NASSKGAPYNLPTTPWNTLKASDSKEIALMTAK

SEQ ID NO: 1722365 - protein, 27 aa, Staphylococcus aureus
NAVDQDQFIKFYRGDKFKIASPITPLV

SEQ ID NO: 1722366 - protein, 29 aa, Staphylococcus aureus
NAYHKDTEDFYITLKIIDVKQPEGDQRVY

SEQ ID NO: 1722367 - protein, 27 aa, Staphylococcus aureus
NDEKQSIITAFMNKNQNIRGYLASTDP

SEQ ID NO: 1722368 - protein, 21 aa, Staphylococcus aureus
NDIVIKKGQDYNLLNGISAFD

SEQ ID NO: 1722369 - protein, 20 aa, Staphylococcus aureus
NDLSKLLTKALDNFKLEVKK

SEQ ID NO: 1722370 - protein, 25 aa, Staphylococcus aureus
NEKIQKLLAFQTLYIGIDPKRVPSL

SEQ ID NO: 1722371 - protein, 19 aa, Staphylococcus aureus
NELIKYYTQKPLTFSNRWL

SEQ ID NO: 1722372 - protein, 19 aa, Staphylococcus aureus
NEPFVIYDGITNGALYHRL

SEQ ID NO: 1722373 - protein, 23 aa, Staphylococcus aureus
NGGYYTFELNKKLQPHRMGDVID

SEQ ID NO: 1722374 - protein, 24 aa, Staphylococcus aureus
NGSAPVAITAPYTPTTDPNANNIG

SEQ ID NO: 1722375 - protein, 24 aa, Staphylococcus aureus
NGTDAINYITFDPNTNTNGITAVW

SEQ ID NO: 1722376 - protein, 23 aa, Staphylococcus aureus
NHQTQIIKILSKVKPDPPRIDGN

SEQ ID NO: 1722377 - protein, 17 aa, Staphylococcus aureus
NIRLLKDYGVSIYPANI

SEQ ID NO: 1722378 - protein, 24 aa, Staphylococcus aureus
NKDVTKIKIYQAPKDYVLNKGYDV

SEQ ID NO: 1722379 - protein, 29 aa, Staphylococcus aureus
NKTGQSYIFAKNKLYPIPGGSIMGIPTDI

SEQ ID NO: 1722380 - protein, 20 aa, Staphylococcus aureus
NKYVDIFALKDYETWHTYML

SEQ ID NO: 1722381 - protein, 23 aa, Staphylococcus aureus
NLGGSVTSIQPLRINLTSNENFT

SEQ ID NO: 1722382 - protein, 18 aa, Staphylococcus aureus
NLIFPNQVLKVSGSSNST

SEQ ID NO: 1722383 - protein, 23 aa, Staphylococcus aureus
NLKANYDNAIANAAHELDKVQGN

SEQ ID NO: 1722384 - protein, 23 aa, Staphylococcus aureus
NLNDEYVVSPGWTKDEQAKAFEE

SEQ ID NO: 1722385 - protein, 18 aa, Staphylococcus aureus
NLTSYYTDITWQLDESNK

SEQ ID NO: 1722386 - protein, 25 aa, Staphylococcus aureus
NNETQYYHFFSIKDPADVYYTKKKA

SEQ ID NO: 1722387 - protein, 22 aa, Staphylococcus aureus
NNKIVPAQDYLALKSQIKVDDK

SEQ ID NO: 1722388 - protein, 23 aa, Staphylococcus aureus
NQKLPVRLVSYSPVPEDHAYIRF

SEQ ID NO: 1722389 - protein, 17 aa, Staphylococcus aureus
NRTGTTTGKKPASITAY

SEQ ID NO: 1722390 - protein, 25 aa, Staphylococcus aureus
NSELIFEFNTMTTKNYQGMTNLVIK

SEQ ID NO: 1722391 - protein, 17 aa, Staphylococcus aureus
NTLKNRALTDIGVTSTT

SEQ ID NO: 1722392 - protein, 19 aa, Staphylococcus aureus
NVAPYSGVTWMGAGTGFVV

SEQ ID NO: 1722393 - protein, 18 aa, Staphylococcus aureus
NVNYALAPQYKYPTPLIQ

SEQ ID NO: 1722394 - protein, 17 aa, Staphylococcus aureus
NVNYQYAVPSYSPTHYV

SEQ ID NO: 1722395 - protein, 18 aa, Staphylococcus aureus
NVTPFKYAAGAKAGDRIK

SEQ ID NO: 1722396 - protein, 27 aa, Staphylococcus aureus
PAESPGVPKVYTFIGQGDASYTISFKT

SEQ ID NO: 1722397 - protein, 20 aa, Staphylococcus aureus
PASITAYNNSIRALQSDLTS

SEQ ID NO: 1722398 - protein, 22 aa, Staphylococcus aureus
PASKQAGHPVFYVYAGNQGNAS

SEQ ID NO: 1722399 - protein, 24 aa, Staphylococcus aureus
PDEYRYGFYVKPTLNRLNGGFFGQ

SEQ ID NO: 1722400 - protein, 17 aa, Staphylococcus aureus
PDHIVRAAARDAVKQQY

SEQ ID NO: 1722401 - protein, 26 aa, Staphylococcus aureus
PEDTTHVRWFLNINNEKRYVSKDITI

SEQ ID NO: 1722402 - protein, 23 aa, Staphylococcus aureus
PEQKFKKLSNIVGNYWQKEQGYD

SEQ ID NO: 1722403 - protein, 17 aa, Staphylococcus aureus
PINLWVNGNHKTISTDK

SEQ ID NO: 1722404 - protein, 23 aa, Staphylococcus aureus
PKDYNYSQFYWGGKYNVSVSSES

SEQ ID NO: 1722405 - protein, 27 aa, Staphylococcus aureus
PNPKDYNYSYFYWGAKYNVSVSSESND

SEQ ID NO: 1722406 - protein, 26 aa, Staphylococcus aureus
PNRLNKFSIRKYSVGTASILVGTTLI

SEQ ID NO: 1722407 - protein, 32 aa, Staphylococcus aureus
PNSELIFEFNTMTTKNYQGMTNLIIKNADNDT

SEQ ID NO: 1722408 - protein, 24 aa, Staphylococcus aureus
PSQSLMINHYFAVPGYHAHKFVTP

SEQ ID NO: 1722409 - protein, 29 aa, Staphylococcus aureus
PTESPGVPKVYTFIGKGDASYTISFKTQG

SEQ ID NO: 1722410 - protein, 68 aa, Staphylococcus aureus; identical to SEQ ID NO: 1594752

SEQ ID NO: 1722411 - protein, 30 aa, Staphylococcus aureus
PTVTVVDNLPGFTLINGGKVGVFSHAMVRT

SEQ ID NO: 1722412 - protein, 30 aa, Staphylococcus aureus
PTVTVVDNLPGYTLINGGKVGVFSHAMVRT

SEQ ID NO: 1722413 - protein, 32 aa, Staphylococcus aureus
PVTVTDIPLDPSALVYLVIPTSQTRDGGSEAD

SEQ ID NO: 1722414 - protein, 20 aa, Staphylococcus aureus
QAAITPYYTYNGYIGNNSNF

SEQ ID NO: 1722415 - protein, 28 aa, Staphylococcus aureus
QADYTFASLDIFNGLKRRAQTILDENRN

SEQ ID NO: 1722416 - protein, 27 aa, Staphylococcus aureus
QALDDIALVTPDHIVRAAARDAVKQQY

SEQ ID NO: 1722417 - protein, 17 aa, Staphylococcus aureus
QARVKPAADTEVENAYN

SEQ ID NO: 1722418 - protein, 18 aa, Staphylococcus aureus
QDILKNRPGIHYAPPILE

SEQ ID NO: 1722419 - protein, 24 aa, Staphylococcus aureus
QGQRFQFTGLTPREMICFGQTQGR

SEQ ID NO: 1722420 - protein, 24 aa, Staphylococcus aureus
QIDLEKPVPYINQLLALNTFAPQN

SEQ ID NO: 1722421 - protein, 36 aa, Staphylococcus aureus; identical to SEQ ID NO: 1594776

SEQ ID NO: 1722422 - protein, 26 aa, Staphylococcus aureus
QLGTKAINAIQPNIVKKPAALAQTNQ

SEQ ID NO: 1722423 - protein, 28 aa, Staphylococcus aureus
QNIAEKPFSKQAGHPVFYVYAGNQGNAS

SEQ ID NO: 1722424 - protein, 24 aa, Staphylococcus aureus
QNIDQATKLQPIAELVDQATQLNQ

SEQ ID NO: 1722425 - protein, 27 aa, Staphylococcus aureus
QQQFVKKPIPTLFLHGFGGSANSEKFM

SEQ ID NO: 1722426 - protein, 23 aa, Staphylococcus aureus
QRITTAFMNKNQNIRGYLASSNP

SEQ ID NO: 1722427 - protein, 19 aa, Staphylococcus aureus
QSFESQITQAPLVTDVTTI

SEQ ID NO: 1722428 - protein, 22 aa, Staphylococcus aureus
QTIRLMEEFLRNGNKEEIAYHK

SEQ ID NO: 1722429 - protein, 18 aa, Staphylococcus aureus
QVALNQLANNKKLALQNI

SEQ ID NO: 1722430 - protein, 35 aa, Staphylococcus aureus
QVINAKYDVIYNGHTFATSLPAKFVVKDVQPAKPT

SEQ ID NO: 1722431 - protein, 24 aa, Staphylococcus aureus
QVNDRLSIVGYPKPYKNKHHMFES

SEQ ID NO: 1722432 - protein, 18 aa, Staphylococcus aureus
QWTEPKYFHGRISAVNYN

SEQ ID NO: 1722433 - protein, 24 aa, Staphylococcus aureus
RALEYNQLFMYSQLYVESTQDYQQ

SEQ ID NO: 1722434 - protein, 24 aa, Staphylococcus aureus
RASDYFSEAGATPATKAFGRQNFE

SEQ ID NO: 1722435 - protein, 25 aa, Staphylococcus aureus
RASDYFSEAGATPATKAFGRQNFEY

SEQ ID NO: 1722436 - protein, 17 aa, Staphylococcus aureus
RELGFVLMALNIRKIAA

SEQ ID NO: 1722437 - protein, 18 aa, Staphylococcus aureus
RGINDIELKFAKQAKYTI

SEQ ID NO: 1722438 - protein, 20 aa, Staphylococcus aureus
RGITDVDLRLSKQAKYTVVF

SEQ ID NO: 1722439 - protein, 18 aa, Staphylococcus aureus
RGTALQKVPVNISGIPLD

SEQ ID NO: 1722440 - protein, 19 aa, Staphylococcus aureus
RGTALQKVPVTVTDIPLDP

SEQ ID NO: 1722441 - protein, 21 aa, Staphylococcus aureus
RGYRRVVPSPQPISIVELDSI

SEQ ID NO: 1722442 - protein, 18 aa, Staphylococcus aureus
RHNNTSPWVKEASAANVA

SEQ ID NO: 1722443 - protein, 27 aa, Staphylococcus aureus
RKNGRKSVFLMLNIKKGIFKTHPNLRQ

SEQ ID NO: 1722444 - protein, 17 aa, Staphylococcus aureus
RLLKDYGVSIYPANISE

SEQ ID NO: 1722445 - protein, 27 aa, Staphylococcus aureus
RLTQAINQLVPLADNSALRTAKTKLDE

SEQ ID NO: 1722446 - protein, 22 aa, Staphylococcus aureus
RNEITTTLNNKLQAIQATPDAT

SEQ ID NO: 1722447 - protein, 24 aa, Staphylococcus aureus
RNTKDGIKPLLAKKWDVSEDGKTY

SEQ ID NO: 1722448 - protein, 18 aa, Staphylococcus aureus
RNYLLKHKNLYEFNSSPY

SEQ ID NO: 1722449 - protein, 18 aa, Staphylococcus aureus
RQVVNRTYRIGTTKRVEV

SEQ ID NO: 1722450 - protein, 23 aa, Staphylococcus aureus
RSFYSIRKSTLGVASVIVSTLFL

SEQ ID NO: 1722451 - protein, 27 aa, Staphylococcus aureus
RSGQVIYDWPTVHINSLKDLAHASDYF

SEQ ID NO: 1722452 - protein, 26 aa, Staphylococcus aureus
RVPVTVNVYQFEFPQTTYTTTVGGTL

SEQ ID NO: 1722453 - protein, 17 aa, Staphylococcus aureus
RYGTMYISMDETLARVV

SEQ ID NO: 1722454 - protein, 18 aa, Staphylococcus aureus
SAAKRVPVTVNVYQFEFP

SEQ ID NO: 1722455 - protein, 30 aa, Staphylococcus aureus
SDRQKADLNMFFLFVITGNLIGKATEKEWR

SEQ ID NO: 1722456 - protein, 34 aa, Staphylococcus aureus
SFASNLANMNFLRWVNFPQDYTVTWTNAKIANRP

SEQ ID NO: 1722457 - protein, 34 aa, Staphylococcus aureus
SFLIDSMAGFLLIGLITLLLIPMMNQMQASINHK

SEQ ID NO: 1722458 - protein, 27 aa, Staphylococcus aureus
SFSIGDIKQYFTLSNGQPIPSGTFTNI

SEQ ID NO: 1722459 - protein, 26 aa, Staphylococcus aureus
SGLKSTTITTLPSGWTSNLTKSDKKN

SEQ ID NO: 1722460 - protein, 21 aa, Staphylococcus aureus
SGYPVGTYINASSKGAPYNLP

SEQ ID NO: 1722461 - protein, 20 aa, Staphylococcus aureus
SHNVYMLSTVLYPNWGQYKR

SEQ ID NO: 1722462 - protein, 18 aa, Staphylococcus aureus
SIAALTILTSVTGAGTTI

SEQ ID NO: 1722463 - protein, 19 aa, Staphylococcus aureus
SIKKIIDYPGKEDVSVIQV

SEQ ID NO: 1722464 - protein, 19 aa, Staphylococcus aureus
SILIVIVLVLSACGKSSNK

SEQ ID NO: 1722465 - protein, 33 aa, Staphylococcus aureus
SIRKFSVGASSILIATLLFLSDGQAQAAEKQVN

SEQ ID NO: 1722466 - protein, 23 aa, Staphylococcus aureus
SISPYKGILRVGAGTGFVVGKNT

SEQ ID NO: 1722467 - protein, 19 aa, Staphylococcus aureus
SKRYLFIEYIPDNVLNCKS

SEQ ID NO: 1722468 - protein, 30 aa, Staphylococcus aureus
SKYDTPISDTYYWGVIKNLESQFAEAIDLL

SEQ ID NO: 1722469 - protein, 17 aa, Staphylococcus aureus
SLAALTILTSVTGVGTT

SEQ ID NO: 1722470 - protein, 17 aa, Staphylococcus aureus
SLLAIAAIGITTTTLAS

SEQ ID NO: 1722471 - protein, 24 aa, Staphylococcus aureus
SLRKILVVSLSILTILSMVLDFNF

SEQ ID NO: 1722472 - protein, 19 aa, Staphylococcus aureus
SMAALAILTSVTELSAAVV

SEQ ID NO: 1722473 - protein, 41 aa, Staphylococcus aureus; identical to SEQ ID NO: 1593095

SEQ ID NO: 1722474 - protein, 25 aa, Staphylococcus aureus
SNNDEIFIETPFSGINESVKHHAII

SEQ ID NO: 1722475 - protein, 24 aa, Staphylococcus aureus
SQEKFLQHDLLFKINGSKILKTEF

SEQ ID NO: 1722476 - protein, 22 aa, Staphylococcus aureus
SSLFVATLTTATLVSSPAANAL

SEQ ID NO: 1722477 - protein, 31 aa, Staphylococcus aureus
STITIRPEDYVVFIPPVGNQIRALIFYNNVV

SEQ ID NO: 1722478 - protein, 24 aa, Staphylococcus aureus
STNAQHMNFQFVGTYGPNKDVVGI

SEQ ID NO: 1722479 - protein, 17 aa, Staphylococcus aureus
STYWWNANNWDNAAAAD

SEQ ID NO: 1722480 - protein, 24 aa, Staphylococcus aureus
SVWLVLLFSVMGLWQVSNAAEQHT

SEQ ID NO: 1722481 - protein, 36 aa, Staphylococcus aureus
SYTISFKTQGPTVNKLYYAAGGRALEYNQLFMYSQL

SEQ ID NO: 1722482 - protein, 20 aa, Staphylococcus aureus
TAHLFKVPTDADRLDLQFIP

SEQ ID NO: 1722483 - protein, 24 aa, Staphylococcus aureus
TASILVGTTLIFGIGSQEAKAAEV

SEQ ID NO: 1722484 - protein, 24 aa, Staphylococcus aureus
TASILVGTTLIFGLGNQEAKAAEN

SEQ ID NO: 1722485 - protein, 24 aa, Staphylococcus aureus
TASILVGTTLIFGLGNQEAKAAES

SEQ ID NO: 1722486 - protein, 23 aa, Staphylococcus aureus
TEALNLRAKIDLILGDEKDPIRV

SEQ ID NO: 1722487 - protein, 25 aa, Staphylococcus aureus
TELNTAMTALKRAIADKADTKASGN

SEQ ID NO: 1722488 - protein, 18 aa, Staphylococcus aureus
TFDLTRPLEENRKNIKVV

SEQ ID NO: 1722489 - protein, 17 aa, Staphylococcus aureus
TGDQFLENTLLYKKFFT

SEQ ID NO: 1722490 - protein, 24 aa, Staphylococcus aureus
TGLPTDGFTYKWNNAATGTNDANW

SEQ ID NO: 1722491 - protein, 39 aa, Staphylococcus aureus
TGNSPARLMPDKILDLKYKLRVNNVPTPRTVTFNDTLTY

SEQ ID NO: 1722492 - protein, 37 aa, Staphylococcus aureus
TGTAHLFKVPTDADRLDLQFIPDNTAVADASRITTNK

SEQ ID NO: 1722493 - protein, 18 aa, Staphylococcus aureus
TGTTLPNHYILLSVDGKS

SEQ ID NO: 1722494 - protein, 24 aa, Staphylococcus aureus
TIEQQIYVNPLKKSATNTKVDIAG

SEQ ID NO: 1722495 - protein, 20 aa, Staphylococcus aureus
TIKQRALNRMAVNTVAAPQQ

SEQ ID NO: 1722496 - protein, 18 aa, Staphylococcus aureus
TILTSALILTGCASDQSD

SEQ ID NO: 1722497 - protein, 17 aa, Staphylococcus aureus
TKNYQGMTNLVIKNADN

SEQ ID NO: 1722498 - protein, 27 aa, Staphylococcus aureus
TKTATYKVVRTVPKQVFETARGVLYPG

SEQ ID NO: 1722499 - protein, 21 aa, Staphylococcus aureus
TLLIVPDLIRLSKTFLIESRE

SEQ ID NO: 1722500 - protein, 17 aa, Staphylococcus aureus
TLNTAMKGLRDSIANEA

SEQ ID NO: 1722501 - protein, 30 aa, Staphylococcus aureus
TLTAKKSYFILNDKIVFLGTGIKSTASSKN

SEQ ID NO: 1722502 - protein, 28 aa, Staphylococcus aureus
TLVASALVLTTLGTGFHSSYLGLDTNKV

SEQ ID NO: 1722503 - protein, 17 aa, Staphylococcus aureus
TLVASALVLTTLGTGLH

SEQ ID NO: 1722504 - protein, 21 aa, Staphylococcus aureus
TMGVICATQLLYSNHANALVT

SEQ ID NO: 1722505 - protein, 22 aa, Staphylococcus aureus
TNADVAYLLHDGKNEIREIEPV

SEQ ID NO: 1722506 - protein, 18 aa, Staphylococcus aureus
TNHQVFTGETFTNTITAN

SEQ ID NO: 1722507 - protein, 22 aa, Staphylococcus aureus
TQALQQLPNFQTALNAANNEAN

SEQ ID NO: 1722508 - protein, 28 aa, Staphylococcus aureus
TQITTNDILTMLKATTTVPGLRNNITGN

SEQ ID NO: 1722509 - protein, 20 aa, Staphylococcus aureus
TQKAPKLLLKGSGNLKGSSV

SEQ ID NO: 1722510 - protein, 18 aa, Staphylococcus aureus
TQNNIRLLKDYGVSIYPA

SEQ ID NO: 1722511 - protein, 29 aa, Staphylococcus aureus
TSVAPKRLNAKMRFAVAQPAAVASNNVND

SEQ ID NO: 1722512 - protein, 18 aa, Staphylococcus aureus
TTALGATLLLGACGGGNS

SEQ ID NO: 1722513 - protein, 35 aa, Staphylococcus aureus; identical to SEQ ID NO: 1592492

SEQ ID NO: 1722514 - protein, 34 aa, Staphylococcus aureus; identical to SEQ ID NO: 1592871

SEQ ID NO: 1722515 - protein, 17 aa, Staphylococcus aureus
TTLLAVAIIIGTIITVV

SEQ ID NO: 1722516 - protein, 21 aa, Staphylococcus aureus
TTLSVSLLAPLANPLLENAKA

SEQ ID NO: 1722517 - protein, 23 aa, Staphylococcus aureus
TTNKYNYSSYAGYTNTILSTTDS

SEQ ID NO: 1722518 - protein, 46 aa, Staphylococcus aureus
TVIGEKVVAYGPIWRLLKVPENVSHLKIQFVPKNDAITDARGIYQL

SEQ ID NO: 1722519 - protein, 18 aa, Staphylococcus aureus
TVKMKYYGKYTFELDKKL

SEQ ID NO: 1722520 - protein, 19 aa, Staphylococcus aureus
TYHNKGLDFAFGLSMTSKN

SEQ ID NO: 1722521 - protein, 17 aa, Staphylococcus aureus
TYRTASDVVINNAQPEV

SEQ ID NO: 1722522 - protein, 32 aa, Staphylococcus aureus; identical to SEQ ID NO: 1592877

SEQ ID NO: 1722523 - protein, 24 aa, Staphylococcus aureus
VAELQNVTIPAIEAIVPQNDPNAN

SEQ ID NO: 1722524 - protein, 17 aa, Staphylococcus aureus
VASSLFTWDNKADAIVT

SEQ ID NO: 1722525 - protein, 17 aa, Staphylococcus aureus
VAYLLHDGKNEIREIEP

SEQ ID NO: 1722526 - protein, 23 aa, Staphylococcus aureus
VDFKIRKHLIDHYGLYGEMSTGT

SEQ ID NO: 1722527 - protein, 23 aa, Staphylococcus aureus
VDQALQNILNAKQALNGDERVAL

SEQ ID NO: 1722528 - protein, 23 aa, Staphylococcus aureus
VEDRKYALVYTPEKFYDRKQITV

SEQ ID NO: 1722529 - protein, 21 aa, Staphylococcus aureus
VEFKRYSWSAHIRLWGAESWG

SEQ ID NO: 1722530 - protein, 19 aa, Staphylococcus aureus
VEKNLPGVTLKIKQLPFKQ

SEQ ID NO: 1722531 - protein, 27 aa, Staphylococcus aureus
VFETARGVLYPGVSDMYDAKQYVKPVN

SEQ ID NO: 1722532 - protein, 41 aa, Staphylococcus aureus; identical to SEQ ID NO: 1592886

SEQ ID NO: 1722533 - protein, 17 aa, Staphylococcus aureus
VHQLNRTGTTTGKKPAS

SEQ ID NO: 1722534 - protein, 24 aa, Staphylococcus aureus
VILIIIVFALYLKIGHDEKEQYYN

SEQ ID NO: 1722535 - protein, 23 aa, Staphylococcus aureus
VKDRISVIGYPKGAQTKYKMFES

SEQ ID NO: 1722536 - protein, 17 aa, Staphylococcus aureus
VKPEEKLYKIGDYVWED

SEQ ID NO: 1722537 - protein, 23 aa, Staphylococcus aureus
VKSGDYFTIKYSDTVQVYGLNPE

SEQ ID NO: 1722538 - protein, 26 aa, Staphylococcus aureus
VKTPSNKVLGFYPTSANTNAFRPGGV

SEQ ID NO: 1722539 - protein, 19 aa, Staphylococcus aureus
VLAILFVVISACGNKEKEA

SEQ ID NO: 1722540 - protein, 24 aa, Staphylococcus aureus
VLGISLLFLVISITAGCGMGKEAE

SEQ ID NO: 1722541 - protein, 22 aa, Staphylococcus aureus
VLSSSSIKLFKADNTPLTITNT

SEQ ID NO: 1722542 - protein, 17 aa, Staphylococcus aureus
VMPALAYFTFSPKNYED

SEQ ID NO: 1722543 - protein, 21 aa, Staphylococcus aureus
VNDLYLIVKKLSQGDVKKAVV

SEQ ID NO: 1722544 - protein, 36 aa, Staphylococcus aureus; identical to SEQ ID NO: 1590579

SEQ ID NO: 1722545 - protein, 18 aa, Staphylococcus aureus
VPKVYTFIGKGDASYTIS

SEQ ID NO: 1722546 - protein, 20 aa, Staphylococcus aureus
VPNETSLNLTFATAGKETSQ

SEQ ID NO: 1722547 - protein, 28 aa, Staphylococcus aureus
VPTDADRLDLQFIPDNTAVADASRITTN

SEQ ID NO: 1722548 - protein, 24 aa, Staphylococcus aureus
VPVKHVIPEIVAHSHYTVQGQDFP

SEQ ID NO: 1722549 - protein, 19 aa, Staphylococcus aureus
VPVKRVIPEIVAHSHYTVQ

SEQ ID NO: 1722550 - protein, 19 aa, Staphylococcus aureus
VQMGINYSIYMDADTIPVS

SEQ ID NO: 1722551 - protein, 26 aa, Staphylococcus aureus
VQQNKKLHSWLKISTLIDNVKVKDKY

SEQ ID NO: 1722552 - protein, 22 aa, Staphylococcus aureus
VSSVLAFLAFNNAAHAQQQGTQ

SEQ ID NO: 1722553 - protein, 23 aa, Staphylococcus aureus
VSTLTGYKFNPDAKNFKIYEVTD

SEQ ID NO: 1722554 - protein, 17 aa, Staphylococcus aureus
VTDLNQLNGLNNPQRQA

SEQ ID NO: 1722555 - protein, 32 aa, Staphylococcus aureus; identical to SEQ ID NO: 1689151

SEQ ID NO: 1722556 - protein, 17 aa, Staphylococcus aureus
VTIHFAEQESEAFDLCI

SEQ ID NO: 1722557 - protein, 19 aa, Staphylococcus aureus
VTTFTRRNNTSPWVKEASA

SEQ ID NO: 1722558 - protein, 26 aa, Staphylococcus aureus
VTTFTRRNNTSPWVKEASAATVAGIA

SEQ ID NO: 1722559 - protein, 17 aa, Staphylococcus aureus
VTVKPLRDKYRVGTSST

SEQ ID NO: 1722560 - protein, 21 aa, Staphylococcus aureus
VTVNVYQFEFPQTSYTTTVGG

SEQ ID NO: 1722561 - protein, 31 aa, Staphylococcus aureus
VTVTDIPLDPSALVYLVIPTSQTRDGGSEAD

SEQ ID NO: 1722562 - protein, 18 aa, Staphylococcus aureus
VVALMFVLAACGNNSEKE

SEQ ID NO: 1722563 - protein, 19 aa, Staphylococcus aureus
VVEDIYGFEYKSEQGRGIP

SEQ ID NO: 1722564 - protein, 19 aa, Staphylococcus aureus
VVFILILVVAVAGCGQKDT

SEQ ID NO: 1722565 - protein, 27 aa, Staphylococcus aureus
VVGTVNYDVPFQLQLLFVESGNGITIS

SEQ ID NO: 1722566 - protein, 25 aa, Staphylococcus aureus
VVRGQNNQWTIANKPDYVTLDAQTG

SEQ ID NO: 1722567 - protein, 20 aa, Staphylococcus aureus
YAKRSLWIKFKEGISQLLSP

SEQ ID NO: 1722568 - protein, 17 aa, Staphylococcus aureus
YDFYDYDPYQLAANNAK

SEQ ID NO: 1722569 - protein, 31 aa, Staphylococcus aureus
YGMLFDAKNFYFNYPFLFGNDDYIFKKNGRE

SEQ ID NO: 1722570 - protein, 23 aa, Staphylococcus aureus
YGPRPQFNKTPKYVKYRDAGTGI

SEQ ID NO: 1722571 - protein, 20 aa, Staphylococcus aureus
YIQSPYFIPDQAFLDSIKIA

SEQ ID NO: 1722572 - protein, 34 aa, Staphylococcus aureus
YKDNKGLNFVLTTGTFFLKMNEKQYPDFKNKNLR

SEQ ID NO: 1722573 - protein, 27 aa, Staphylococcus aureus
YKELEQAVALIRTMPQRQQTSRRSNRI

SEQ ID NO: 1722574 - protein, 17 aa, Staphylococcus aureus
YLLLGRQIQRDQIFKID

SEQ ID NO: 1722575 - protein, 29 aa, Staphylococcus aureus
YNSTTDFYNTYVYKKGMPEFEIATSDVPE

SEQ ID NO: 1722576 - protein, 22 aa, Staphylococcus aureus
YPARPQFNKTPKYVKYRDAGTG

SEQ ID NO: 1722577 - protein, 43 aa, Staphylococcus aureus; identical to SEQ ID NO: 1592905

SEQ ID NO: 1722578 - protein, 25 aa, Staphylococcus aureus
YSGEGDLAIVKFSPNEQNKHIGEVV

SEQ ID NO: 1722579 - protein, 34 aa, Staphylococcus aureus
YSIRKYKVGIFSTLIGTVLLLSNPNGAQALTTDH

SEQ ID NO: 1722580 - protein, 17 aa, Staphylococcus aureus
YSLVCEVDTLFASYYGH

SEQ ID NO: 1722581 - protein, 20 aa, Staphylococcus aureus
YTFDITRPLEEHRKNIPVVK

SEQ ID NO: 1722582 - protein, 32 aa, Staphylococcus aureus; identical to SEQ ID NO: 1592680

SEQ ID NO: 1722583 - protein, 25 aa, Staphylococcus aureus
YTQRHLTFSNKWLWQKENGTIHVTL

SEQ ID NO: 1722584 - protein, 35 aa, Staphylococcus aureus
YTVIGEKVVAYGPIWRLLKVPENVSHLKIQFVPKN

SEQ ID NO: 1722585 - protein, 18 aa, Staphylococcus aureus
YYAFNRRAQLGRSIGSLW

SEQ ID NO: 1722586 - protein, 18 aa, Staphylococcus aureus
YYNQVVYVNPMDKDLKGA

SEQ ID NO: 1722587 - protein, 23 aa, Staphylococcus aureus
AAGIGMAITLKDFGIKDVIILEK

SEQ ID NO: 1722588 - protein, 23 aa, Staphylococcus aureus
AAGIGMAITLKDFGITDVIILEK

SEQ ID NO: 1722589 - protein, 22 aa, Staphylococcus aureus
AAGLIKLKKDFGLAGTLKDITS

SEQ ID NO: 1722590 - protein, 27 aa, Staphylococcus aureus
AARNRTPIQLMIGFDYPDSHGNAETLV

SEQ ID NO: 1722591 - protein, 28 aa, Staphylococcus aureus
AARTGSPIRLMIGFDYPDAFGNGETLVP

SEQ ID NO: 1722592 - protein, 17 aa, Staphylococcus aureus
ADKPASKQAGHPVFYVY

SEQ ID NO: 1722593 - protein, 18 aa, Staphylococcus aureus
ADPNATPADPWAAAAGNG

SEQ ID NO: 1722594 - protein, 26 aa, Staphylococcus aureus
ADQTAIINSLTFTSNAPNRNYATASA

SEQ ID NO: 1722595 - protein, 17 aa, Staphylococcus aureus
ADSYVPYTIAVNGTTTP

SEQ ID NO: 1722596 - protein, 17 aa, Staphylococcus aureus
ADYFKLSNGSAIPDATI

SEQ ID NO: 1722597 - protein, 18 aa, Staphylococcus aureus
AEADAAVDAAQKQGLHDI

SEQ ID NO: 1722598 - protein, 18 aa, Staphylococcus aureus
AEELLKQTTYPTMDPNTI

SEQ ID NO: 1722599 - protein, 17 aa, Staphylococcus aureus
AEKPFSKQAGHPVFYVY

SEQ ID NO: 1722600 - protein, 33 aa, Staphylococcus aureus
AEKTVEGGPTLRLFKVPDNVRNLKIQFVSKNDA

SEQ ID NO: 1722601 - protein, 18 aa, Staphylococcus aureus
AELDYSCSAFLMYIGIDI

SEQ ID NO: 1722602 - protein, 17 aa, Staphylococcus aureus
AEQLRGTALQKVPVNIS

SEQ ID NO: 1722603 - protein, 17 aa, Staphylococcus aureus
AEQLRGTALQKVPVTVS

SEQ ID NO: 1722604 - protein, 19 aa, Staphylococcus aureus
AESPGVPKVYTFIGQGDAS

SEQ ID NO: 1722605 - protein, 32 aa, Staphylococcus aureus
AETLVPVNLTVLPEIQHNIKFFKNDDGQNIAD

SEQ ID NO: 1722606 - protein, 24 aa, Staphylococcus aureus
AETVNDLYLIVKKLSQGDVKKAVV

SEQ ID NO: 1722607 - protein, 20 aa, Staphylococcus aureus
AEVTPSLKAERLAKISVSPS

SEQ ID NO: 1722608 - protein, 17 aa, Staphylococcus aureus
AFGNGETLVPVNLTVLP

SEQ ID NO: 1722609 - protein, 20 aa, Staphylococcus aureus
AFGRQTFEYINGERPTESPG

SEQ ID NO: 1722610 - protein, 20 aa, Staphylococcus aureus
AFRENQKWMTPLGRLGKPEE

SEQ ID NO: 1722611 - protein, 19 aa, Staphylococcus aureus
AFVKGYPYYIKKEKITLKE

SEQ ID NO: 1722612 - protein, 26 aa, Staphylococcus aureus
AGANKPLPEMWPYGVNDSRSWDYKIR

SEQ ID NO: 1722613 - protein, 25 aa, Staphylococcus aureus
AGANKPLQQMWEYGVNDPDRSHDFK

SEQ ID NO: 1722614 - protein, 25 aa, Staphylococcus aureus
AGANKPLQQMWEYGVNDPHRSHDFK

SEQ ID NO: 1722615 - protein, 23 aa, Staphylococcus aureus
AGDRIKVIGYPHPYKNKYVLHES

SEQ ID NO: 1722616 - protein, 26 aa, Staphylococcus aureus
AGHWYCYVYCYLRDDFRLLKLNRVIH

SEQ ID NO: 1722617 - protein, 17 aa, Staphylococcus aureus
AGLKVLSAPSIDYGLIG

SEQ ID NO: 1722618 - protein, 17 aa, Staphylococcus aureus
AGQGYRGYGAFVKNDSS

SEQ ID NO: 1722619 - protein, 24 aa, Staphylococcus aureus
AGRGYRRVVPSPQPISIIELESIK

SEQ ID NO: 1722620 - protein, 17 aa, Staphylococcus aureus
AGSLNPYYKRMIMMNQY

SEQ ID NO: 1722621 - protein, 39 aa, Staphylococcus aureus
AGTQLYHITATNAYHKDSEDFYISLKIIDVKQPEGDQRV

SEQ ID NO: 1722622 - protein, 19 aa, Staphylococcus aureus
AGTQLYHIVASNAYHKDTE

SEQ ID NO: 1722623 - protein, 24 aa, Staphylococcus aureus
AGTQLYHIVATNAYHKDTEDFYIT

SEQ ID NO: 1722624 - protein, 24 aa, Staphylococcus aureus
AIANLDTLRDLNQPQRDALRNQIN

SEQ ID NO: 1722625 - protein, 18 aa, Staphylococcus aureus
AIDAIQVDATVKPKANQA

SEQ ID NO: 1722626 - protein, 32 aa, Staphylococcus aureus
AIEAARQHRIPVIFIRLVLDKHFDDVSSSNKV

SEQ ID NO: 1722627 - protein, 21 aa, Staphylococcus aureus
AIEMYYSLQNYYNTRIETIKV

SEQ ID NO: 1722628 - protein, 22 aa, Staphylococcus aureus
AIFSFLLTALKYYLDYMKDSLN

SEQ ID NO: 1722629 - protein, 19 aa, Staphylococcus aureus
AIFVLGILTTSAMITENQS

SEQ ID NO: 1722630 - protein, 19 aa, Staphylococcus aureus
AIINSLTFTSNAPNRNYAT

SEQ ID NO: 1722631 - protein, 36 aa, Staphylococcus aureus
AIKMNKIFRILTVSLFFFTFLIKNNLAYADVGVINL

SEQ ID NO: 1722632 - protein, 18 aa, Staphylococcus aureus
AINRVNTLKNRALTDIGV

SEQ ID NO: 1722633 - protein, 35 aa, Staphylococcus aureus
AITDTRGIYQLKDGYKYYDFVDSIGLHSGSHVYVE

SEQ ID NO: 1722634 - protein, 27 aa, Staphylococcus aureus
AKADTLDIIPKLMLQGSVDLLNEVATS

SEQ ID NO: 1722635 - protein, 18 aa, Staphylococcus aureus
AKGHYFVTTFYRNGKLPD

SEQ ID NO: 1722636 - protein, 24 aa, Staphylococcus aureus
AKGIVYTPEQLPAKSKWSHAVDQG

SEQ ID NO: 1722637 - protein, 30 aa, Staphylococcus aureus
AKGQSFNIGDIKQYFTLSNGQAIPNGTFTN

SEQ ID NO: 1722638 - protein, 31 aa, Staphylococcus aureus
AKGQSFNIGDIKQYFTLSNGQAIPSSSFTNI

SEQ ID NO: 1722639 - protein, 22 aa, Staphylococcus aureus
AKPLKPFVTEKYYNVLFSDNRE

SEQ ID NO: 1722640 - protein, 27 aa, Staphylococcus aureus
AKQTGDGYQWVIKFNKGHAPHENMIFW

SEQ ID NO: 1722641 - protein, 18 aa, Staphylococcus aureus
AKRIVVLEYSFADALAAL

SEQ ID NO: 1722642 - protein, 17 aa, Staphylococcus aureus
AKSPNHNLFGIKGAFEE

SEQ ID NO: 1722643 - protein, 30 aa, Staphylococcus aureus
AKVKKAYDYKYFYSYKVVKGVKKYFSFSQS

SEQ ID NO: 1722644 - protein, 26 aa, Staphylococcus aureus
AKVNKAYNYKYFYSYSVVNGVKKYFS

SEQ ID NO: 1722645 - protein, 27 aa, Staphylococcus aureus
AKVNKAYNYKYFYSYSVVNGVKKYFSF

SEQ ID NO: 1722646 - protein, 27 aa, Staphylococcus aureus
AKVNRAYDYKYYYSYKVVKGVKKYFSF

SEQ ID NO: 1722647 - protein, 25 aa, Staphylococcus aureus
AKYDVIYNGHTFATSLPAKFVVKDV

SEQ ID NO: 1722648 - protein, 28 aa, Staphylococcus aureus
ALEAIREVVNKQIEIIKNADADASAKEI

SEQ ID NO: 1722649 - protein, 22 aa, Staphylococcus aureus
ALEYNQLFMYSQLYVESTQDHQ

SEQ ID NO: 1722650 - protein, 18 aa, Staphylococcus aureus
ALGILTTGMITTTAQPVK

SEQ ID NO: 1722651 - protein, 19 aa, Staphylococcus aureus
ALKLLEAAGLIKLKKDFGL

SEQ ID NO: 1722652 - protein, 20 aa, Staphylococcus aureus
ALKLLEAAGLIKLKKDFGLA

SEQ ID NO: 1722653 - protein, 18 aa, Staphylococcus aureus
ALKSRAMVLYINRNTRTA

SEQ ID NO: 1722654 - protein, 50 aa, Staphylococcus aureus
ALMTAKQTGDGYQWVIKFNKGHAPHQNMIFWFALPADQVPVGRTDFVTVN

SEQ ID NO: 1722655 - protein, 22 aa, Staphylococcus aureus
ALNAVTRAKAALNGADNLRNAK

SEQ ID NO: 1722656 - protein, 20 aa, Staphylococcus aureus
ALNLRAKIDLILGDEKDPIR

SEQ ID NO: 1722657 - protein, 23 aa, Staphylococcus aureus
ALNWWDYEIGTPKSLTNTLILLN

SEQ ID NO: 1722658 - protein, 27 aa, Staphylococcus aureus
ALPSGDYILKEIEAPAPYTFDKDKEYP

SEQ ID NO: 1722659 - protein, 20 aa, Staphylococcus aureus
ALQQIQNIATHKINLIKSNN

SEQ ID NO: 1722660 - protein, 21 aa, Staphylococcus aureus
ALQQIQNIATNKINLIKANNE

SEQ ID NO: 1722661 - protein, 20 aa, Staphylococcus aureus
ALQQLPNFQTALNSANNEAN

SEQ ID NO: 1722662 - protein, 19 aa, Staphylococcus aureus
AMTQLKQGIANKAQIKGSE

SEQ ID NO: 1722663 - protein, 25 aa, Staphylococcus aureus
AMYMSVLLLIIFIGGCGNMKDEQKK

SEQ ID NO: 1722664 - protein, 17 aa, Staphylococcus aureus
ANGTPTPVLAPDTVTKA

SEQ ID NO: 1722665 - protein, 26 aa, Staphylococcus aureus
ANIQCDQLIILTAIDYVYINFNTENQ

SEQ ID NO: 1722666 - protein, 22 aa, Staphylococcus aureus
ANKPLPEMWPYGVNDSRSWDYK

SEQ ID NO: 1722667 - protein, 23 aa, Staphylococcus aureus
ANNRFSHVAFIKPNNGKTTSVTV

SEQ ID NO: 1722668 - protein, 26 aa, Staphylococcus aureus
ANQNFLPTHQMPILARGNFNPEFISV

SEQ ID NO: 1722669 - protein, 25 aa, Staphylococcus aureus
ANSFVIAGHRWSAYDELLFIRNTTR

SEQ ID NO: 1722670 - protein, 20 aa, Staphylococcus aureus
APKLLLKCTGDLKGSSIGHK

SEQ ID NO: 1722671 - protein, 18 aa, Staphylococcus aureus
APKVYTFIGKGDASYTIS

SEQ ID NO: 1722672 - protein, 26 aa, Staphylococcus aureus
APNNKFTMYRVFGSKKNRTALGIKSD

SEQ ID NO: 1722673 - protein, 26 aa, Staphylococcus aureus
AQAINAIQPNIVKKPAALAQINQHYN

SEQ ID NO: 1722674 - protein, 22 aa, Staphylococcus aureus
AQALDHAMELLRNSVADNQATL

SEQ ID NO: 1722675 - protein, 24 aa, Staphylococcus aureus
AQKEIKPKFKGLRSYYTKSSLEFK

SEQ ID NO: 1722676 - protein, 23 aa, Staphylococcus aureus
AQQNAFYQVLNMPNLNADQRNGF

SEQ ID NO: 1722677 - protein, 33 aa, Staphylococcus aureus
ARGTHTKEVLFPDKSLKLSYKVNVTNIDTPKNI

SEQ ID NO: 1722678 - protein, 19 aa, Staphylococcus aureus
ARQIYPFIGNKTQALQQLP

SEQ ID NO: 1722679 - protein, 20 aa, Staphylococcus aureus
ASAKLKLELLPNVQNPVISV

SEQ ID NO: 1722680 - protein, 27 aa, Staphylococcus aureus
ASDAVYKAQLYLTPYGPKQYVEHLNQN

SEQ ID NO: 1722681 - protein, 17 aa, Staphylococcus aureus
ASDYFSEAGATPATKAF

SEQ ID NO: 1722682 - protein, 22 aa, Staphylococcus aureus
ASDYFSEAGATPATKAFGRQNF

SEQ ID NO: 1722683 - protein, 22 aa, Staphylococcus aureus
ASFNLQTIQGLDVHPVKKPEAE

SEQ ID NO: 1722684 - protein, 27 aa, Staphylococcus aureus
ASFNTDDFVYKIQLPEGVEYVNNSLTK

SEQ ID NO: 1722685 - protein, 27 aa, Staphylococcus aureus
ASFNTDDFVYKVQLPEGVEYVNNSLTK

SEQ ID NO: 1722686 - protein, 24 aa, Staphylococcus aureus
ASHAVLMYAPKSFLDFQKQLFAAQ

SEQ ID NO: 1722687 - protein, 22 aa, Staphylococcus aureus
ASILVGTTLIFGIGSQEAKAAE

SEQ ID NO: 1722688 - protein, 19 aa, Staphylococcus aureus
ASKQAGHPVFYVYAGNQGN

SEQ ID NO: 1722689 - protein, 23 aa, Staphylococcus aureus
ASKSDLFMYTGDNLDPVAKKVAS

SEQ ID NO: 1722690 - protein, 22 aa, Staphylococcus aureus
ASLALGILTTGMITTTAQPVKA

SEQ ID NO: 1722691 - protein, 20 aa, Staphylococcus aureus
ASLALGLITTGASIVTTQAA

SEQ ID NO: 1722692 - protein, 22 aa, Staphylococcus aureus
ASLALGLITTGASIVTTQAAKA

SEQ ID NO: 1722693 - protein, 28 aa, Staphylococcus aureus
ASNKGAPYNLPTSPWNTLKASAAKEIVL

SEQ ID NO: 1722694 - protein, 25 aa, Staphylococcus aureus
ASSDGIWMTIKDKGYFDFDFKTKRF

SEQ ID NO: 1722695 - protein, 25 aa, Staphylococcus aureus
ASSKGAPYNLPTTPWNTLKASDAKE

SEQ ID NO: 1722696 - protein, 26 aa, Staphylococcus aureus
ASSKGAPYNLPTTPWNTLKASDSKEI

SEQ ID NO: 1722697 - protein, 20 aa, Staphylococcus aureus
ASVFLGTMIVVGMGQEKEAA

SEQ ID NO: 1722698 - protein, 37 aa, Staphylococcus aureus
ASYTISFKTQGPTIDKLYYAAGGRALEYNQLFMYSQL

SEQ ID NO: 1722699 - protein, 26 aa, Staphylococcus aureus
ATARNEITTILNNKLQEIQATPDATD

SEQ ID NO: 1722700 - protein, 28 aa, Staphylococcus aureus
ATELNTAMIALKRAIADKADTKASGNYV

SEQ ID NO: 1722701 - protein, 24 aa, Staphylococcus aureus
ATKAFGRQTFEYINGERPTESPGV

SEQ ID NO: 1722702 - protein, 20 aa, Staphylococcus aureus
ATLAVGLMAPLANPFIEISK

SEQ ID NO: 1722703 - protein, 17 aa, Staphylococcus aureus
ATLWYHPHPSPNTAKQV

SEQ ID NO: 1722704 - protein, 24 aa, Staphylococcus aureus
ATNEATIAAITPDANVKSTAKQAI

SEQ ID NO: 1722705 - protein, 36 aa, Staphylococcus aureus
ATRRGIWQVKPILQGWDHVDFIGVDFLDFKRKGSEL

SEQ ID NO: 1722706 - protein, 26 aa, Staphylococcus aureus
ATSFDKPYRLFLKYSDKQQTIIGGHE

SEQ ID NO: 1722707 - protein, 19 aa, Staphylococcus aureus
AVHQLNRTGTTTGKKPASI

SEQ ID NO: 1722708 - protein, 24 aa, Staphylococcus aureus
AVLTGFYVGDFIKLGIKPIAVSDI

SEQ ID NO: 1722709 - protein, 28 aa, Staphylococcus aureus
AVNKDNKAFYFLLRDDDYFAKVVNGQVR

SEQ ID NO: 1722710 - protein, 26 aa, Staphylococcus aureus
AVNTSAPRMRAFSLAAVAADAPAAGT

SEQ ID NO: 1722711 - protein, 22 aa, Staphylococcus aureus
AVQFVNKLFNVPSAIILLEYDG

SEQ ID NO: 1722712 - protein, 19 aa, Staphylococcus aureus
AVQLVKFDDYWQGKPALDK

SEQ ID NO: 1722713 - protein, 27 aa, Staphylococcus aureus
AYHKDSEDFYISLKIIDVKQPEGDQRV

SEQ ID NO: 1722714 - protein, 23 aa, Staphylococcus aureus
AYHKDTEDFYISLKIVDVKQPEG

SEQ ID NO: 1722715 - protein, 25 aa, Staphylococcus aureus
CENEYFYITTIPYNLTEYRDYFEPL

SEQ ID NO: 1722716 - protein, 26 aa, Staphylococcus aureus
CINDNVEVWLIKKGFNIYNRYTLHRF

SEQ ID NO: 1722717 - protein, 26 aa, Staphylococcus aureus
CINDNVEVWLIKKGFNIYNRYTLNRF

SEQ ID NO: 1722718 - protein, 27 aa, Staphylococcus aureus
CIVVLEYSFADYLAALDMKPVGIADDG

SEQ ID NO: 1722719 - protein, 19 aa, Staphylococcus aureus
DADNMTLDSGFYKTPKYSL

SEQ ID NO: 1722720 - protein, 35 aa, Staphylococcus aureus; identical to SEQ ID NO: 1591428

SEQ ID NO: 1722721 - protein, 24 aa, Staphylococcus aureus
DAIKWLHHNVYGKDPDKKVADLTT

SEQ ID NO: 1722722 - protein, 24 aa, Staphylococcus aureus
DAIYQLKKFIGLCNQSIKYNEDIL

SEQ ID NO: 1722723 - protein, 17 aa, Staphylococcus aureus
DAKAFFSYEWKGLEIAK

SEQ ID NO: 1722724 - protein, 24 aa, Staphylococcus aureus
DAKRIVILEYSFADALAALDVKPV

SEQ ID NO: 1722725 - protein, 20 aa, Staphylococcus aureus
DALEWLHKNAYGKEPGKKVA

SEQ ID NO: 1722726 - protein, 17 aa, Staphylococcus aureus
DALNGDAKLIAAQNAAK

SEQ ID NO: 1722727 - protein, 18 aa, Staphylococcus aureus
DALNGDAKLIAAQNAAKQ

SEQ ID NO: 1722728 - protein, 20 aa, Staphylococcus aureus
DAMNYITFDPNTNTNGITAA

SEQ ID NO: 1722729 - protein, 18 aa, Staphylococcus aureus
DANWAAMNKPNVAKVVNA

SEQ ID NO: 1722730 - protein, 17 aa, Staphylococcus aureus
DANYYAKQTYDYYKDTF

SEQ ID NO: 1722731 - protein, 28 aa, Staphylococcus aureus
DASWLTSRKQLQPYGQYHGGGAHYGVDY

SEQ ID NO: 1722732 - protein, 17 aa, Staphylococcus aureus
DATITWVSGQAPNKDNT

SEQ ID NO: 1722733 - protein, 17 aa, Staphylococcus aureus
DDFFMDTNMNRPLNITK

SEQ ID NO: 1722734 - protein, 25 aa, Staphylococcus aureus
DDHKSLIYRYDATLGTAITTNDILT

SEQ ID NO: 1722735 - protein, 20 aa, Staphylococcus aureus
DDIALVTPDHIVRATARDAV

SEQ ID NO: 1722736 - protein, 25 aa, Staphylococcus aureus
DDKLKQIIENFKFFGQYANLKELKK

SEQ ID NO: 1722737 - protein, 20 aa, Staphylococcus aureus
DDVLKEKYKLHGEYSKAYKN

SEQ ID NO: 1722738 - protein, 23 aa, Staphylococcus aureus
DEEDALKPLIFKTKVTSLEDIEK

SEQ ID NO: 1722739 - protein, 26 aa, Staphylococcus aureus
DEKQRIITAFMNKNQNIRGYLASSNP

SEQ ID NO: 1722740 - protein, 27 aa, Staphylococcus aureus
DEKQRIITAFMNKNQNIRGYLASTDPL

SEQ ID NO: 1722741 - protein, 18 aa, Staphylococcus aureus
DELQNVTIPAIEAIVPQK

SEQ ID NO: 1722742 - protein, 18 aa, Staphylococcus aureus
DELYLSKRLAEIHTQVPI

SEQ ID NO: 1722743 - protein, 35 aa, Staphylococcus aureus
DENGKYRFDNLDSGKYKVIFEKPAGLIQTGTNTTE

SEQ ID NO: 1722744 - protein, 35 aa, Staphylococcus aureus; identical to SEQ ID NO: 1593597

SEQ ID NO: 1722745 - protein, 23 aa, Staphylococcus aureus
DEQNIIINFYKEKTIKDVIEDIQ

SEQ ID NO: 1722746 - protein, 23 aa, Staphylococcus aureus
DETDFWKWYKQQTDFNFDEPAYL

SEQ ID NO: 1722747 - protein, 19 aa, Staphylococcus aureus
DFAFGLSMTSKNIARYENI

SEQ ID NO: 1722748 - protein, 33 aa, Staphylococcus aureus
DFDGSYGWQCFDLVNVYWNHIYGHGLKGYGAKD

SEQ ID NO: 1722749 - protein, 26 aa, Staphylococcus aureus
DFGHVERFIQNPPHGATVAWHDSPDT

SEQ ID NO: 1722750 - protein, 27 aa, Staphylococcus aureus
DFVCEIDTLYAAYFNHSQYGHNAKELR

SEQ ID NO: 1722751 - protein, 24 aa, Staphylococcus aureus
DGETYTVKFETPAGYLPTKENGTT

SEQ ID NO: 1722752 - protein, 18 aa, Staphylococcus aureus
DGFTYKWNRDTTGTNDAN

SEQ ID NO: 1722753 - protein, 31 aa, Staphylococcus aureus
DGQRQFTLNGQVIQIMDIINPSNGFGGQPVT

SEQ ID NO: 1722754 - protein, 43 aa, Staphylococcus aureus
DGVHNTITIPPEDFTVFIPPVGKQIRALIYYNKVVASNMSNAV

SEQ ID NO: 1722755 - protein, 45 aa, Staphylococcus aureus
DGVHNTITIPPEDFTVFIPPVGKQIRALIYYNKVVASNMSNAVTI

SEQ ID NO: 1722756 - protein, 17 aa, Staphylococcus aureus
DGWGFLFSKGNAEEYLT

SEQ ID NO: 1722757 - protein, 21 aa, Staphylococcus aureus
DHKSLIYRYDATLGTQITTND

SEQ ID NO: 1722758 - protein, 20 aa, Staphylococcus aureus
DHQYYQISLLGPDKDKFKEG

SEQ ID NO: 1722759 - protein, 25 aa, Staphylococcus aureus
DIGPREQVNFLLLDKNNETQYYHFF

SEQ ID NO: 1722760 - protein, 19 aa, Staphylococcus aureus
DIKQIKITEVGPYEDTADL

SEQ ID NO: 1722761 - protein, 17 aa, Staphylococcus aureus
DIKQYFTLSNGQAIPNG

SEQ ID NO: 1722762 - protein, 24 aa, Staphylococcus aureus
DINSSVLAHYWGGNKMNIRQDLEE

SEQ ID NO: 1722763 - protein, 18 aa, Staphylococcus aureus
DIPPTINNPVGINAKYYR

SEQ ID NO: 1722764 - protein, 25 aa, Staphylococcus aureus
DKAIQSINQALANKLKEIEASNATD

SEQ ID NO: 1722765 - protein, 32 aa, Staphylococcus aureus
DKATLSNWIDEGFMPLIYKGEMMDLSRGRAIS

SEQ ID NO: 1722766 - protein, 21 aa, Staphylococcus aureus
DKFKISQILTFNFIKDKSYDK

SEQ ID NO: 1722767 - protein, 26 aa, Staphylococcus aureus
DKFMDRILSEDQYLLEKKKALYEKYK

SEQ ID NO: 1722768 - protein, 25 aa, Staphylococcus aureus
DKGYFDFDFKTKRFDNLELKKNDDI

SEQ ID NO: 1722769 - protein, 18 aa, Staphylococcus aureus
DKGYLPKVATHDVMIGLF

SEQ ID NO: 1722770 - protein, 18 aa, Staphylococcus aureus
DKMKSWYERFGFGKSTKG

SEQ ID NO: 1722771 - protein, 19 aa, Staphylococcus aureus
DKTLEVGAIFQTAAGPYGH

SEQ ID NO: 1722772 - protein, 27 aa, Staphylococcus aureus
DKYEDIKARLTLYSYIDKQAVPNETSL

SEQ ID NO: 1722773 - protein, 23 aa, Staphylococcus aureus
DKYNYVIPKEGSNLWFDNMVIPK

SEQ ID NO: 1722774 - protein, 21 aa, Staphylococcus aureus
DLEKPVPYINQLLALNTFAPQ

SEQ ID NO: 1722775 - protein, 25 aa, Staphylococcus aureus
DLESIIDDFFIETKLNRPKHITRYD

SEQ ID NO: 1722776 - protein, 24 aa, Staphylococcus aureus
DLESIIDDFFIETKLNRPQHITRY

SEQ ID NO: 1722777 - protein, 25 aa, Staphylococcus aureus
DLETIISEFFRDIKKERPKDIPMLT

SEQ ID NO: 1722778 - protein, 26 aa, Staphylococcus aureus
DLKLDYINYWIGKYRSHPYNKKVKVI

SEQ ID NO: 1722779 - protein, 21 aa, Staphylococcus aureus
DLKMANFHKYNLEELSMKEYN

SEQ ID NO: 1722780 - protein, 17 aa, Staphylococcus aureus
DLKRRAQTILAENRNNV

SEQ ID NO: 1722781 - protein, 18 aa, Staphylococcus aureus
DLSKLLTKALDNFKLEVK

SEQ ID NO: 1722782 - protein, 19 aa, Staphylococcus aureus
DLSKLLTKALDNFKLEVKK

SEQ ID NO: 1722783 - protein, 24 aa, Staphylococcus aureus
DLYNKLDMILGYEEDERKSKKPIN

SEQ ID NO: 1722784 - protein, 17 aa, Staphylococcus aureus
DMMPESGEKFYPTKYLL

SEQ ID NO: 1722785 - protein, 24 aa, Staphylococcus aureus
DMNVKGMVLYMIRNTRTTNGYYYV

SEQ ID NO: 1722786 - protein, 25 aa, Staphylococcus aureus
DMTGKIYLQVKLKGQIDKEQLVFQN

SEQ ID NO: 1722787 - protein, 24 aa, Staphylococcus aureus
DNALNAVTRAKAALNGADNLRNAK

SEQ ID NO: 1722788 - protein, 26 aa, Staphylococcus aureus
DNALNAVTRAKAALNGAENLRNAKTS

SEQ ID NO: 1722789 - protein, 24 aa, Staphylococcus aureus
DNALNAVTRAKAALNGAENLRNTK

SEQ ID NO: 1722790 - protein, 25 aa, Staphylococcus aureus
DNALNAVTRAKAALNGAENLRNTKT

SEQ ID NO: 1722791 - protein, 44 aa, Staphylococcus aureus
DNDAILGEKVVAYGPIWRLFKVPENVSHLKIQFSPKNDAITDVR

SEQ ID NO: 1722792 - protein, 31 aa, Staphylococcus aureus
DNDALLKRMDYWPTYYPSKLNKDPIKEEMLA

SEQ ID NO: 1722793 - protein, 28 aa, Staphylococcus aureus
DNGTIHATLLQFSWYSHIQVYGPESWGN

SEQ ID NO: 1722794 - protein, 21 aa, Staphylococcus aureus
DNINDYTIPTGKKETATTDLY

SEQ ID NO: 1722795 - protein, 28 aa, Staphylococcus aureus
DNLSADLGIYKPKYNLGDYVWEDTNKNG

SEQ ID NO: 1722796 - protein, 23 aa, Staphylococcus aureus
DNRNAYGVYFTPEIKRFIAENID

SEQ ID NO: 1722797 - protein, 25 aa, Staphylococcus aureus
DNRQTEDLTILSKVKPDPPRIDANS

SEQ ID NO: 1722798 - protein, 22 aa, Staphylococcus aureus
DNSHNILIKVLKTREIHYLLIY

SEQ ID NO: 1722799 - protein, 33 aa, Staphylococcus aureus
DPKRVPSLYSIIPMIEMMFGVHFIKGGMYGMAQ

SEQ ID NO: 1722800 - protein, 22 aa, Staphylococcus aureus
DQALQNILNAKQALNGDERVAL

SEQ ID NO: 1722801 - protein, 23 aa, Staphylococcus aureus
DQGMQNIVVIQPATQVKTDARNT

SEQ ID NO: 1722802 - protein, 23 aa, Staphylococcus aureus
DQGTQNILAIQPATQVKTDARNT

SEQ ID NO: 1722803 - protein, 23 aa, Staphylococcus aureus
DQIPSGYSILATGTPDGVHNTIT

SEQ ID NO: 1722804 - protein, 23 aa, Staphylococcus aureus
DQIPSGYTILATGTPDGVHNTVT

SEQ ID NO: 1722805 - protein, 23 aa, Staphylococcus aureus
DQQSAFYEILNMPNLNEAQRNGF

SEQ ID NO: 1722806 - protein, 17 aa, Staphylococcus aureus
DQRVYRTSTYDLTTDEI

SEQ ID NO: 1722807 - protein, 27 aa, Staphylococcus aureus
DRGISDIDLRLSKQAKYTVYFKNGTKK

SEQ ID NO: 1722808 - protein, 21 aa, Staphylococcus aureus
DRYENFWNNLHWIGYNIKNQK

SEQ ID NO: 1722809 - protein, 19 aa, Staphylococcus aureus
DSKIIINMKDGGYYTFELN

SEQ ID NO: 1722810 - protein, 40 aa, Staphylococcus aureus
DSQSYYDTLWTKKDYDLIFYRTYSDALMPYNFMSSVFKNN

SEQ ID NO: 1722811 - protein, 20 aa, Staphylococcus aureus
DSRSWDYKIRNRSGQVIYDW

SEQ ID NO: 1722812 - protein, 33 aa, Staphylococcus aureus; identical to SEQ ID NO: 1592521

SEQ ID NO: 1722813 - protein, 27 aa, Staphylococcus aureus
DTIYKREYKHFYTPEEAQRAQENSDQI

SEQ ID NO: 1722814 - protein, 23 aa, Staphylococcus aureus
DTKKNIGYHFLDKPKITIKKESH

SEQ ID NO: 1722815 - protein, 22 aa, Staphylococcus aureus
DTKKNIGYHFLNKAKITVKKES

SEQ ID NO: 1722816 - protein, 22 aa, Staphylococcus aureus
DTKKNIGYHFLNKPKITSKKRK

SEQ ID NO: 1722817 - protein, 28 aa, Staphylococcus aureus
DTKNNSRTLIFPYVPDKAVYNAIVKVVV

SEQ ID NO: 1722818 - protein, 32 aa, Staphylococcus aureus
DTTSQALDSIALVAPEHIVRAAARDAVKQQYE

SEQ ID NO: 1722819 - protein, 21 aa, Staphylococcus aureus
DTWKHTVGNTHKTAVVTLPNG

SEQ ID NO: 1722820 - protein, 25 aa, Staphylococcus aureus
DVEPTSIISILVAAADALSAARQGA

SEQ ID NO: 1722821 - protein, 18 aa, Staphylococcus aureus
DVFIVLEDNKYQLKKYSV

SEQ ID NO: 1722822 - protein, 25 aa, Staphylococcus aureus
DVKATLTMPAYIDPENVKKTGNVTL

SEQ ID NO: 1722823 - protein, 19 aa, Staphylococcus aureus
DVKYKDGIGNYYANLNGSI

SEQ ID NO: 1722824 - protein, 18 aa, Staphylococcus aureus
DVLTKYKNPMYSYNENGT

SEQ ID NO: 1722825 - protein, 24 aa, Staphylococcus aureus
DVNQKHFDLIKSDKNLSIIRKNGR

SEQ ID NO: 1722826 - protein, 25 aa, Staphylococcus aureus
DVQGNPSTWFYPLGKKKVERTTPKL

SEQ ID NO: 1722827 - protein, 17 aa, Staphylococcus aureus
DVTFKYLTKDKLNDIKK

SEQ ID NO: 1722828 - protein, 17 aa, Staphylococcus aureus
DVTNSVNITFPNPNQYK

SEQ ID NO: 1722829 - protein, 19 aa, Staphylococcus aureus
DYKARHWLTKEKSYTSLMV

SEQ ID NO: 1722830 - protein, 17 aa, Staphylococcus aureus
DYRFIDRENAVSGTFNY

SEQ ID NO: 1722831 - protein, 22 aa, Staphylococcus aureus
DYTKLVFAKPIYNDPSLVKSDT

SEQ ID NO: 1722832 - protein, 22 aa, Staphylococcus aureus
DYVATQLQYYGLKPDSAEYDGN

SEQ ID NO: 1722833 - protein, 29 aa, Staphylococcus aureus
EAARTRNPIRLMIGFDYPDAYGNSETLVP

SEQ ID NO: 1722834 - protein, 25 aa, Staphylococcus aureus
EAINRVNTLKNRALTDIGVTSTTAM

SEQ ID NO: 1722835 - protein, 27 aa, Staphylococcus aureus
EAKSSALPLVILAAVARYGINYAIKTY

SEQ ID NO: 1722836 - protein, 22 aa, Staphylococcus aureus
EALNLRAKIDLILGDEKDPIRV

SEQ ID NO: 1722837 - protein, 26 aa, Staphylococcus aureus
EASQYGLRPQFNKTPKYVKYRDAGTG

SEQ ID NO: 1722838 - protein, 17 aa, Staphylococcus aureus
EDAFVKGYPYYIKKEKI

SEQ ID NO: 1722839 - protein, 17 aa, Staphylococcus aureus
EDEVVFDKGYMAPLYGS

SEQ ID NO: 1722840 - protein, 17 aa, Staphylococcus aureus
EDITVTAHILIDGETTP

SEQ ID NO: 1722841 - protein, 17 aa, Staphylococcus aureus
EDKYLSERTKRLKLKQL

SEQ ID NO: 1722842 - protein, 25 aa, Staphylococcus aureus
EDNSYYYPVIKDGKIVYTLTLSPKN

SEQ ID NO: 1722843 - protein, 24 aa, Staphylococcus aureus
EDTADLLVTTAMTKNINSQLSTHV

SEQ ID NO: 1722844 - protein, 17 aa, Staphylococcus aureus
EDYNYTYVIKNGNGYYY

SEQ ID NO: 1722845 - protein, 18 aa, Staphylococcus aureus
EEFEAFKKRSPKYNPGMN

SEQ ID NO: 1722846 - protein, 18 aa, Staphylococcus aureus
EEFEAFKKRSPKYNPGMS

SEQ ID NO: 1722847 - protein, 17 aa, Staphylococcus aureus
EEKEAFTNALEDILSKA

SEQ ID NO: 1722848 - protein, 25 aa, Staphylococcus aureus
EEKTEALAMIKQITDQAKKGITDAT

SEQ ID NO: 1722849 - protein, 43 aa, Staphylococcus aureus
EFEKQFGFMLKPWTTVRFMNVIPDWFIYKIALVGKDDMKYKDG

SEQ ID NO: 1722850 - protein, 20 aa, Staphylococcus aureus
EFKRYSWSAHIRLWGAESWG

SEQ ID NO: 1722851 - protein, 17 aa, Staphylococcus aureus
EFNTMTTKNYQGMTNLI

SEQ ID NO: 1722852 - protein, 17 aa, Staphylococcus aureus
EGDQRVYRTSTYDLTTD

SEQ ID NO: 1722853 - protein, 17 aa, Staphylococcus aureus
EGETDPIYKREYKHFYT

SEQ ID NO: 1722854 - protein, 17 aa, Staphylococcus aureus
EGETDTIYKREYKHFYT

SEQ ID NO: 1722855 - protein, 17 aa, Staphylococcus aureus
EGIKAGDYFDFTLSDNV

SEQ ID NO: 1722856 - protein, 20 aa, Staphylococcus aureus
EGISQIFPMIKETPFKTTQD

SEQ ID NO: 1722857 - protein, 23 aa, Staphylococcus aureus
EGKRGFAVYFSPEIKKFIADNLD

SEQ ID NO: 1722858 - protein, 19 aa, Staphylococcus aureus
EGLNFDRQGQLFLLDVFEG

SEQ ID NO: 1722859 - protein, 33 aa, Staphylococcus aureus
EHHLTLNHLYSYNPGVTPLIFPGDVISLVPQNK

SEQ ID NO: 1722860 - protein, 25 aa, Staphylococcus aureus
EHKESFYYDLFYIKGNLPDQCLQIY

SEQ ID NO: 1722861 - protein, 22 aa, Staphylococcus aureus
EHKKRNEVFLKKHKGEAIKKYK

SEQ ID NO: 1722862 - protein, 52 aa, Staphylococcus aureus
EIALITAKQTGDGYQWVIKFNKGHAPHENMIYWFALPADQVPVGRTDFVTVN

SEQ ID NO: 1722863 - protein, 22 aa, Staphylococcus aureus
EIENFKFFVQYGNFKDLSKYKD

SEQ ID NO: 1722864 - protein, 39 aa, Staphylococcus aureus
EIGIILKKWTTIRFMNIVPDYFIYKIALVGKDDKKYDEG

SEQ ID NO: 1722865 - protein, 23 aa, Staphylococcus aureus
EIGQQRPTFIPTLAPKEEKETNI

SEQ ID NO: 1722866 - protein, 18 aa, Staphylococcus aureus
EIPTLDPIRSIAPSVYSI

SEQ ID NO: 1722867 - protein, 18 aa, Staphylococcus aureus
EITTALNNKLQEIQATPD

SEQ ID NO: 1722868 - protein, 30 aa, Staphylococcus aureus; identical to SEQ ID NO: 1662878

SEQ ID NO: 1722869 - protein, 31 aa, Staphylococcus aureus; identical to SEQ ID NO: 1713177

SEQ ID NO: 1722870 - protein, 26 aa, Staphylococcus aureus
EKGIKGVYVILKDSNGKELDRTTTDE

SEQ ID NO: 1722871 - protein, 23 aa, Staphylococcus aureus
EKKYKFSKPYTFSSAVLVIRENK

SEQ ID NO: 1722872 - protein, 25 aa, Staphylococcus aureus
EKLESIPAYYQLHGDKIIGFDTEGG

SEQ ID NO: 1722873 - protein, 26 aa, Staphylococcus aureus
EKLGADPMTFLGLGGIGDVIVTCTST

SEQ ID NO: 1722874 - protein, 27 aa, Staphylococcus aureus
EKNAAKDLVLKVKEKAYQDILNAQTTN

SEQ ID NO: 1722875 - protein, 29 aa, Staphylococcus aureus
EKYDTAKYYYNKYYQYKGLIDKTVLTTIG

SEQ ID NO: 1722876 - protein, 28 aa, Staphylococcus aureus
EKYDTAKYYYNTYYKYKGAIDQTVLTVL

SEQ ID NO: 1722877 - protein, 29 aa, Staphylococcus aureus
EKYNGLKQAIAGLTPDLAPLQAAKTQLQN

SEQ ID NO: 1722878 - protein, 30 aa, Staphylococcus aureus
ELDFKIRKLLIEKYRLYKGTSDKGRIVINM

SEQ ID NO: 1722879 - protein, 20 aa, Staphylococcus aureus
ELDFKLRKQLIEKHNLYGNM

SEQ ID NO: 1722880 - protein, 23 aa, Staphylococcus aureus
ELENKVLMLGHAFPNQHEARENL

SEQ ID NO: 1722881 - protein, 30 aa, Staphylococcus aureus
ELIKYYNQPHFSLSGKWLWQKPNGSIHATL

SEQ ID NO: 1722882 - protein, 18 aa, Staphylococcus aureus
ELIKYYTQKPLTFSNRWL

SEQ ID NO: 1722883 - protein, 17 aa, Staphylococcus aureus
ELKHYYNKPILERKNVT

SEQ ID NO: 1722884 - protein, 18 aa, Staphylococcus aureus
ELKKPITYKAGATSDSKL

SEQ ID NO: 1722885 - protein, 17 aa, Staphylococcus aureus
ELLEGQEYIWEVLSRDD

SEQ ID NO: 1722886 - protein, 27 aa, Staphylococcus aureus
ELNTAMGQLQHAIADKTTTLASSKFVN

SEQ ID NO: 1722887 - protein, 28 aa, Staphylococcus aureus
ELNTAMGQLQHAIADKTTTLASSKFVNA

SEQ ID NO: 1722888 - protein, 24 aa, Staphylococcus aureus
ELNTAMTALKRAIADKAETKASGN

SEQ ID NO: 1722889 - protein, 20 aa, Staphylococcus aureus
ENAACHLAIGSAYAFNIQGG

SEQ ID NO: 1722890 - protein, 20 aa, Staphylococcus aureus
ENAYPILKKYKISATGFIIT

SEQ ID NO: 1722891 - protein, 17 aa, Staphylococcus aureus
ENESISIIGYPNPNGNK

SEQ ID NO: 1722892 - protein, 27 aa, Staphylococcus aureus
ENFTDKDWQITGIPRTLHIENSTNRPN

SEQ ID NO: 1722893 - protein, 28 aa, Staphylococcus aureus
ENFTDKGWQITGIPRTLHIENSTNRTNN

SEQ ID NO: 1722894 - protein, 26 aa, Staphylococcus aureus
ENGLHQGDFFDFTLSKNVNTHGVSTA

SEQ ID NO: 1722895 - protein, 26 aa, Staphylococcus aureus
ENGNRYYWYDMMPDPGFTQSKYLMIY

SEQ ID NO: 1722896 - protein, 27 aa, Staphylococcus aureus
ENGTIHATLLQLSWFSHIQVFGPESWG

SEQ ID NO: 1722897 - protein, 21 aa, Staphylococcus aureus
ENLDMLISSLSFADYEKYEEP

SEQ ID NO: 1722898 - protein, 41 aa, Staphylococcus aureus; identical to SEQ ID NO: 1595533

SEQ ID NO: 1722899 - protein, 30 aa, Staphylococcus aureus; identical to SEQ ID NO: 1595534

SEQ ID NO: 1722900 - protein, 23 aa, Staphylococcus aureus
EQIKPKVIRKRAALDSIEENNKN

SEQ ID NO: 1722901 - protein, 24 aa, Staphylococcus aureus
EQQNAFYEILHLPNLTEEQRNGFI

SEQ ID NO: 1722902 - protein, 27 aa, Staphylococcus aureus
ERLTQAINQLVPLADNSALKTAKTKLD

SEQ ID NO: 1722903 - protein, 35 aa, Staphylococcus aureus
ERNIELVGNLLPGDYFGTIRFGRKEQLFEIRVKPH

SEQ ID NO: 1722904 - protein, 21 aa, Staphylococcus aureus
ERQFYHYASTVEPATVIFTKT

SEQ ID NO: 1722905 - protein, 25 aa, Staphylococcus aureus
ERQTQQQIVYKKPKPLAGLNGESHD

SEQ ID NO: 1722906 - protein, 21 aa, Staphylococcus aureus
ESELKHYYNKPFFERKNVTGY

SEQ ID NO: 1722907 - protein, 21 aa, Staphylococcus aureus
ESISIIGYPNPNGNKLQMYES

SEQ ID NO: 1722908 - protein, 31 aa, Staphylococcus aureus
ESKYDSPMSNWYYWGKVKSLESQFADAIDII

SEQ ID NO: 1722909 - protein, 81 aa, Staphylococcus aureus
ESPGAPKVYTFIGKGDASYTISFKTQGPTTNKLYYAAGGRALEYNQLFMYSQLYLESTQDYQLRLDGLRQTVNRTYRIGTT

SEQ ID NO: 1722910 - protein, 17 aa, Staphylococcus aureus
ESPGVPKVYTFIGQGDA

SEQ ID NO: 1722911 - protein, 22 aa, Staphylococcus aureus
ETATTDLYAYADQKKNNISADT

SEQ ID NO: 1722912 - protein, 28 aa, Staphylococcus aureus
ETLVPVNLTVLPEIQHNIKFFKNDDGQN

SEQ ID NO: 1722913 - protein, 28 aa, Staphylococcus aureus
ETNYDYTKLVFAKPIYNDPSLVKSDTND

SEQ ID NO: 1722914 - protein, 25 aa, Staphylococcus aureus
ETYNLQKLLAPYHKAKTLERQVYEL

SEQ ID NO: 1722915 - protein, 25 aa, Staphylococcus aureus
EVAELQNVTIPAIEAIVPQNDPNAN

SEQ ID NO: 1722916 - protein, 25 aa, Staphylococcus aureus
EVKANERIAIVGYPAPYKNKHHMYQ

SEQ ID NO: 1722917 - protein, 38 aa, Staphylococcus aureus
EYKQYRERYLKAGLSPVKFYDYNLYDFTMKEYNDIHHS

SEQ ID NO: 1722918 - protein, 18 aa, Staphylococcus aureus
EYLADVDGILVPGGFGFR

SEQ ID NO: 1722919 - protein, 19 aa, Staphylococcus aureus
EYQLSQLFTDDKLQQAART

SEQ ID NO: 1722920 - protein, 18 aa, Staphylococcus aureus
FAFGLSMTSKNIARYENI

SEQ ID NO: 1722921 - protein, 19 aa, Staphylococcus aureus
FDCSGLIQWVYDKAGISLP

SEQ ID NO: 1722922 - protein, 34 aa, Staphylococcus aureus; identical to SEQ ID NO: 1594272

SEQ ID NO: 1722923 - protein, 18 aa, Staphylococcus aureus
FEEIFREYYYNNPQYQNL

SEQ ID NO: 1722924 - protein, 45 aa, Staphylococcus aureus; identical to SEQ ID NO: 1695440

SEQ ID NO: 1722925 - protein, 20 aa, Staphylococcus aureus
FFIVSPLLLATIATGFTPVP

SEQ ID NO: 1722926 - protein, 20 aa, Staphylococcus aureus
FFLLLSVALLYSCSKHNEKA

SEQ ID NO: 1722927 - protein, 18 aa, Staphylococcus aureus
FFNDGNMLKPWFVNSVEN

SEQ ID NO: 1722928 - protein, 19 aa, Staphylococcus aureus
FFSYEWKGLEIAKKLADDE

SEQ ID NO: 1722929 - protein, 18 aa, Staphylococcus aureus
FFSYEWKGLEIAKNLADQ

SEQ ID NO: 1722930 - protein, 17 aa, Staphylococcus aureus
FFVEINENRPLNIPALV

SEQ ID NO: 1722931 - protein, 25 aa, Staphylococcus aureus
FGHVERFIQNPPHGATVAWHDNPDT

SEQ ID NO: 1722932 - protein, 25 aa, Staphylococcus aureus
FGHVERFIQNPPHGATVAWHDSPDT

SEQ ID NO: 1722933 - protein, 17 aa, Staphylococcus aureus
FHKTPMGGYFIVGYIND

SEQ ID NO: 1722934 - protein, 24 aa, Staphylococcus aureus
FILLLFIALTWTTSPLVNGSEKSE

SEQ ID NO: 1722935 - protein, 19 aa, Staphylococcus aureus
FILLSFIALTLITSPFVNC

SEQ ID NO: 1722936 - protein, 22 aa, Staphylococcus aureus
FIRILVLVLTITSVTGVIETRN

SEQ ID NO: 1722937 - protein, 18 aa, Staphylococcus aureus
FKFFAQYGSFKDLSKYKD

SEQ ID NO: 1722938 - protein, 35 aa, Staphylococcus aureus
FKIRNRSGQVIYDWPTVHIYSLEDLSRASDYFSEA

SEQ ID NO: 1722939 - protein, 29 aa, Staphylococcus aureus
FKTQGPTVNKLYYAAGGRALEYNQLFMYS

SEQ ID NO: 1722940 - protein, 21 aa, Staphylococcus aureus
FLAIIITFTYGNFAEASVVIK

SEQ ID NO: 1722941 - protein, 19 aa, Staphylococcus aureus
FLDDAKYYLSAYPNETIVM

SEQ ID NO: 1722942 - protein, 21 aa, Staphylococcus aureus
FLILLVVIVSSYYGENFVLAD

SEQ ID NO: 1722943 - protein, 17 aa, Staphylococcus aureus
FLNNFIYFFSSSKEIKN

SEQ ID NO: 1722944 - protein, 24 aa, Staphylococcus aureus
FLSIILVVMGGWYHSAHASDSLSK

SEQ ID NO: 1722945 - protein, 22 aa, Staphylococcus aureus
FLSIILVVMSGLYHSAHASNSL

SEQ ID NO: 1722946 - protein, 23 aa, Staphylococcus aureus
FLSIILVVMSGWYHSAHASDSLS

SEQ ID NO: 1722947 - protein, 22 aa, Staphylococcus aureus
FNIGDIKQYFTLSNGQAIPNGT

SEQ ID NO: 1722948 - protein, 25 aa, Staphylococcus aureus
FNIGDIKQYFTLSNGQAIPSSSFTN

SEQ ID NO: 1722949 - protein, 25 aa, Staphylococcus aureus
FNKTVMYLLVNEGELSTFGPKGRFG

SEQ ID NO: 1722950 - protein, 18 aa, Staphylococcus aureus
FNLSYLFIAHDLSVVKHI

SEQ ID NO: 1722951 - protein, 23 aa, Staphylococcus aureus
FNSYDAGYRLYNGETLNFVIVDP

SEQ ID NO: 1722952 - protein, 24 aa, Staphylococcus aureus
FNTDDFVYQVQLPEGVEYVNNSLT

SEQ ID NO: 1722953 - protein, 17 aa, Staphylococcus aureus
FNVTVKPLRDKYRVGTS

SEQ ID NO: 1722954 - protein, 18 aa, Staphylococcus aureus
FPYNGVVSFKDATGFAIE

SEQ ID NO: 1722955 - protein, 17 aa, Staphylococcus aureus
FQYNFTSNGTTWSWSYE

SEQ ID NO: 1722956 - protein, 18 aa, Staphylococcus aureus
FRYDHYLQLFNEISNRKV

SEQ ID NO: 1722957 - protein, 26 aa, Staphylococcus aureus
FSIGDIKQYFTLSNGQPIPSGTFTNI

SEQ ID NO: 1722958 - protein, 34 aa, Staphylococcus aureus
FSIRKFNVGIFSALIATVTFISTNPTTASAAEQN

SEQ ID NO: 1722959 - protein, 25 aa, Staphylococcus aureus
FSKSIFPSCRVAYMVLPYSIMKKYH

SEQ ID NO: 1722960 - protein, 18 aa, Staphylococcus aureus
FSNLVSNEFAFLHPHKIT

SEQ ID NO: 1722961 - protein, 24 aa, Staphylococcus aureus
FSYDLFYTGYGLPESFLKIYKDNK

SEQ ID NO: 1722962 - protein, 23 aa, Staphylococcus aureus
FTDKDWQITGIPRTLHIENSTNR

SEQ ID NO: 1722963 - protein, 27 aa, Staphylococcus aureus
FVSTLTGYKFNPNAKNFKIYEVTDQNQ

SEQ ID NO: 1722964 - protein, 18 aa, Staphylococcus aureus
GADNMTLDSGFYKTPKYN

SEQ ID NO: 1722965 - protein, 27 aa, Staphylococcus aureus
GAGANKPLPQMWPNGVNDSRSWDFKIR

SEQ ID NO: 1722966 - protein, 26 aa, Staphylococcus aureus
GAGANKPLQQMWEYGVNDPDRSHDFK

SEQ ID NO: 1722967 - protein, 26 aa, Staphylococcus aureus
GAGANKPLQQMWEYGVNDPHRSHDFK

SEQ ID NO: 1722968 - protein, 22 aa, Staphylococcus aureus
GALAVASSLFTWDNKADAIVTK

SEQ ID NO: 1722969 - protein, 23 aa, Staphylococcus aureus
GANKPLQQMWEYGVNDPHRSHDF

SEQ ID NO: 1722970 - protein, 21 aa, Staphylococcus aureus
GASGLFQTMPGWGPTNTVDQQ

SEQ ID NO: 1722971 - protein, 29 aa, Staphylococcus aureus
GASLKADQFKYEVTLPQGVTYVNNSLTTT

SEQ ID NO: 1722972 - protein, 20 aa, Staphylococcus aureus
GAYYDYLSAPRFVIKKEVGA

SEQ ID NO: 1722973 - protein, 52 aa, Staphylococcus aureus
GDASYTISFKTQGPTIDKLYYAAGGRALEYNQLFMYSQLYVESTQDQQQRLN

SEQ ID NO: 1722974 - protein, 26 aa, Staphylococcus aureus
GDPHALKAFPFAINQDNYPNGGFTAE

SEQ ID NO: 1722975 - protein, 25 aa, Staphylococcus aureus
GDRIIETAPTDYLSWGVGAVGNPRF

SEQ ID NO: 1722976 - protein, 18 aa, Staphylococcus aureus
GDSLYKIALEHHLTLNHL

SEQ ID NO: 1722977 - protein, 22 aa, Staphylococcus aureus
GEQQFYHYASSVKPARVIFTDS

SEQ ID NO: 1722978 - protein, 17 aa, Staphylococcus aureus
GERPTESPGVPKVYTFI

SEQ ID NO: 1722979 - protein, 31 aa, Staphylococcus aureus
GETLVPVNLTVLPEIQHNIKFFKNDDGQNIA

SEQ ID NO: 1722980 - protein, 23 aa, Staphylococcus aureus
GEVYHVFYHPLITDPKVAFTGDT

SEQ ID NO: 1722981 - protein, 41 aa, Staphylococcus aureus
GFDFGHVERFIQNPPHGSTVAWHDSPDTWKHTVGNTHKTAV

SEQ ID NO: 1722982 - protein, 18 aa, Staphylococcus aureus
GGAPVAITAPYTPTTDPN

SEQ ID NO: 1722983 - protein, 43 aa, Staphylococcus aureus
GGDDFDFGHVERFIQNPPHGATVAWHDSPDTWKHTVGNTHKTV

SEQ ID NO: 1722984 - protein, 18 aa, Staphylococcus aureus
GGVQGLNEYQISQLFSDE

SEQ ID NO: 1722985 - protein, 21 aa, Staphylococcus aureus
GGYYKVKKVIPYTGSADLAIV

SEQ ID NO: 1722986 - protein, 26 aa, Staphylococcus aureus
GHSFKHWPKSTLTITPSFTSNGFGMP

SEQ ID NO: 1722987 - protein, 24 aa, Staphylococcus aureus
GIASVTLGTLLISGGVTAANAAQH

SEQ ID NO: 1722988 - protein, 25 aa, Staphylococcus aureus
GIASVTLGTLLISGGVTPAANAAQH

SEQ ID NO: 1722989 - protein, 34 aa, Staphylococcus aureus
GIEHDFIPGYYQFHIYPVFPIPERRRFLYQIKNI

SEQ ID NO: 1722990 - protein, 22 aa, Staphylococcus aureus
GIGVGVATGFVVALQGRDDKSV

SEQ ID NO: 1722991 - protein, 22 aa, Staphylococcus aureus
GIGVGVVAGFVVALQGRDDKSV

SEQ ID NO: 1722992 - protein, 25 aa, Staphylococcus aureus
GIKNTTITTLPNGWTSNLTKADKNN

SEQ ID NO: 1722993 - protein, 23 aa, Staphylococcus aureus
GIKNTTITTLPNGWTSNLTKSDN

SEQ ID NO: 1722994 - protein, 25 aa, Staphylococcus aureus
GIKSTTITTLPSGWTSNLTKADKNN

SEQ ID NO: 1722995 - protein, 17 aa, Staphylococcus aureus
GINDIELKFAKQAKYTI

SEQ ID NO: 1722996 - protein, 18 aa, Staphylococcus aureus
GISIAKLKSLNNLTSNLI

SEQ ID NO: 1722997 - protein, 17 aa, Staphylococcus aureus
GIYQLRDGYKYYDFVDS

SEQ ID NO: 1722998 - protein, 20 aa, Staphylococcus aureus
GKILEDGKIRYTFTNDVEHK

SEQ ID NO: 1722999 - protein, 17 aa, Staphylococcus aureus
GKITYLKGEAMQYDLST

SEQ ID NO: 1723000 - protein, 27 aa, Staphylococcus aureus
GKTYEGIYKDWKPGQKIHLVGHSMGGQ

SEQ ID NO: 1723001 - protein, 20 aa, Staphylococcus aureus
GKVLYAFYQNPKVVKAAITT

SEQ ID NO: 1723002 - protein, 29 aa, Staphylococcus aureus
GKYQFLQSTWDSVAPAKYKGVSPANAPES

SEQ ID NO: 1723003 - protein, 26 aa, Staphylococcus aureus
GLCISLLILIIFVTSCGGNKITGDSK

SEQ ID NO: 1723004 - protein, 17 aa, Staphylococcus aureus
GLIKLKKDFGLAGTVKD

SEQ ID NO: 1723005 - protein, 30 aa, Staphylococcus aureus
GLKILNPNGYWNSTLTWPGSYSVSIQNVDD

SEQ ID NO: 1723006 - protein, 19 aa, Staphylococcus aureus
GLNAKYYRGDEVSFTMGVS

SEQ ID NO: 1723007 - protein, 20 aa, Staphylococcus aureus
GLPNSRALIWQQFDYNNSRE

SEQ ID NO: 1723008 - protein, 18 aa, Staphylococcus aureus
GLQLEGLNFDRQGQLFLL

SEQ ID NO: 1723009 - protein, 31 aa, Staphylococcus aureus
GLSWSDDHKSLIYRYDATLGTAITTNDILTM

SEQ ID NO: 1723010 - protein, 18 aa, Staphylococcus aureus
GMVLYMNRNTRSAKGFYY

SEQ ID NO: 1723011 - protein, 18 aa, Staphylococcus aureus
GNGYKSYIQPLKVEDQKN

SEQ ID NO: 1723012 - protein, 22 aa, Staphylococcus aureus
GNQIRALIFYNNVVASNMSNAV

SEQ ID NO: 1723013 - protein, 24 aa, Staphylococcus aureus
GNQNIMAVAWYQNSAEAKALYLQG

SEQ ID NO: 1723014 - protein, 26 aa, Staphylococcus aureus
GNQPKVRIFEYLGNNEDIAKSVYANT

SEQ ID NO: 1723015 - protein, 27 aa, Staphylococcus aureus
GNTTDAINIYFVPSDLVNPTISVGNYT

SEQ ID NO: 1723016 - protein, 24 aa, Staphylococcus aureus
GPSFNTAYRYYKNDPHAKEMTPTA

SEQ ID NO: 1723017 - protein, 22 aa, Staphylococcus aureus
GPSFNTAYRYYKNDSHTKEMTP

SEQ ID NO: 1723018 - protein, 25 aa, Staphylococcus aureus
GQEVIMIWNPWDRGFMTQDAESNII

SEQ ID NO: 1723019 - protein, 26 aa, Staphylococcus aureus
GQHNYKSLKYYYSKPSIELKNLDGLY

SEQ ID NO: 1723020 - protein, 25 aa, Staphylococcus aureus
GQNFIAQHQMPLLSRSNFNPEFLSV

SEQ ID NO: 1723021 - protein, 23 aa, Staphylococcus aureus
GQVYHVFYHPLITEPKVAFTGDT

SEQ ID NO: 1723022 - protein, 28 aa, Staphylococcus aureus
GRALEYNQLFMYSQLYLESTQDYQLRLD

SEQ ID NO: 1723023 - protein, 27 aa, Staphylococcus aureus
GRALEYNQLFMYSQLYVESTQDYQQRL

SEQ ID NO: 1723024 - protein, 22 aa, Staphylococcus aureus
GRGYRRVVPSPQPISIVELDSI

SEQ ID NO: 1723025 - protein, 22 aa, Staphylococcus aureus
GSGYPVGTYINASSKGAPYNLP

SEQ ID NO: 1723026 - protein, 17 aa, Staphylococcus aureus
GSLAITGRVSMNQAFNS

SEQ ID NO: 1723027 - protein, 23 aa, Staphylococcus aureus
GSVYFIIIFYNKNGTKLSTEIVK

SEQ ID NO: 1723028 - protein, 36 aa, Staphylococcus aureus
GTAHLFKVPTDADRLDLQFIPDNTAVADASRITTNK

SEQ ID NO: 1723029 - protein, 25 aa, Staphylococcus aureus
GTASILIGSLMYLGTQQEAEAAENN

SEQ ID NO: 1723030 - protein, 26 aa, Staphylococcus aureus
GTFNYVKGIFEKINTLLGSNDPINNK

SEQ ID NO: 1723031 - protein, 19 aa, Staphylococcus aureus
GTMIDVTFKYLTKDKLNDI

SEQ ID NO: 1723032 - protein, 24 aa, Staphylococcus aureus
GTNNYFSYYSFREAPKTQIYTVKK

SEQ ID NO: 1723033 - protein, 18 aa, Staphylococcus aureus
GTPLKRCAIVNRHNGKII

SEQ ID NO: 1723034 - protein, 23 aa, Staphylococcus aureus
GTQKVKPTIYFKLYKQDDNQNTT

SEQ ID NO: 1723035 - protein, 24 aa, Staphylococcus aureus
GTRNVEVPVKVYPVANAKAPSRDL

SEQ ID NO: 1723036 - protein, 27 aa, Staphylococcus aureus
GTTEEAPLPIAQPLVKLPQIGTQGEIV

SEQ ID NO: 1723037 - protein, 23 aa, Staphylococcus aureus
GTVKGAYKTYAYVVSYTPTNGDE

SEQ ID NO: 1723038 - protein, 26 aa, Staphylococcus aureus
GTVNYDVPFQFRLIFVESDNGITITT

SEQ ID NO: 1723039 - protein, 23 aa, Staphylococcus aureus
GTVRPMQIGLVYDALNSGKLDVA

SEQ ID NO: 1723040 - protein, 20 aa, Staphylococcus aureus
GVASVIVSTLFLITSQHQAQ

SEQ ID NO: 1723041 - protein, 22 aa, Staphylococcus aureus
GVASVIVSTLFLITSQHQAQAA

SEQ ID NO: 1723042 - protein, 43 aa, Staphylococcus aureus
GVHSTITIRPEDYVVFIPPVGHQIRALIYYNNVVASNMSNAVT

SEQ ID NO: 1723043 - protein, 38 aa, Staphylococcus aureus; identical to SEQ ID NO: 1593277

SEQ ID NO: 1723044 - protein, 17 aa, Staphylococcus aureus
GVLYPGVSDMYDAKQYV

SEQ ID NO: 1723045 - protein, 18 aa, Staphylococcus aureus
GVLYPGVSDMYDAKQYVK

SEQ ID NO: 1723046 - protein, 24 aa, Staphylococcus aureus
GWVSKAYLFDTAKPTPTPTPKPST

SEQ ID NO: 1723047 - protein, 17 aa, Staphylococcus aureus
GYDVYFSPEIKKFIADN

SEQ ID NO: 1723048 - protein, 28 aa, Staphylococcus aureus
GYENEYFYISAIPYNLAEYRDYFEPLLN

SEQ ID NO: 1723049 - protein, 19 aa, Staphylococcus aureus
GYPVGTYINASSKGAPYNL

SEQ ID NO: 1723050 - protein, 17 aa, Staphylococcus aureus
GYTILATGTPDGVHNTI

SEQ ID NO: 1723051 - protein, 19 aa, Staphylococcus aureus
GYYKVKKVIPYTGSADLAI

SEQ ID NO: 1723052 - protein, 44 aa, Staphylococcus aureus
HADPHGYLRSHNYSYDQLYDLINEKYLIKMGKVAPWRTQSTTTP

SEQ ID NO: 1723053 - protein, 17 aa, Staphylococcus aureus
HAIADKTNTLASSKYVN

SEQ ID NO: 1723054 - protein, 36 aa, Staphylococcus aureus
HAIRKKSIGVASVLVGTLIGFGLLSSKEADASENSV

SEQ ID NO: 1723055 - protein, 27 aa, Staphylococcus aureus
HAQKFVTPLVFQAISRNAVYTDTFIEE

SEQ ID NO: 1723056 - protein, 22 aa, Staphylococcus aureus
HDLLFHDMFLNDASKKDFKVEF

SEQ ID NO: 1723057 - protein, 19 aa, Staphylococcus aureus
HFSVVPQINSFKVIPPYGH

SEQ ID NO: 1723058 - protein, 20 aa, Staphylococcus aureus
HGATVAWHDNPDTWKNTVGN

SEQ ID NO: 1723059 - protein, 20 aa, Staphylococcus aureus
HGATVAWHDSPDTWKNTVGN

SEQ ID NO: 1723060 - protein, 23 aa, Staphylococcus aureus
HGGYDPHVWLDPKINQTFAKEIK

SEQ ID NO: 1723061 - protein, 25 aa, Staphylococcus aureus
HGIVFNASLPLYKDAIHQKGSMRSN

SEQ ID NO: 1723062 - protein, 21 aa, Staphylococcus aureus
HGNVTLHYRDGSSTALDATNV

SEQ ID NO: 1723063 - protein, 21 aa, Staphylococcus aureus
HGNVTLQYRDGSSTTLDATNV

SEQ ID NO: 1723064 - protein, 25 aa, Staphylococcus aureus
HGQVYHVFYHPLITDPKVAFTGDTH

SEQ ID NO: 1723065 - protein, 20 aa, Staphylococcus aureus
HGSTVAWHDSPDTWKHTVGN

SEQ ID NO: 1723066 - protein, 18 aa, Staphylococcus aureus
HITATNAYHKDSEDFYIS

SEQ ID NO: 1723067 - protein, 17 aa, Staphylococcus aureus
HITATNAYHKDTEDFYI

SEQ ID NO: 1723068 - protein, 24 aa, Staphylococcus aureus
HKDGRLFVCYLGDFKSTGGIFAAT

SEQ ID NO: 1723069 - protein, 24 aa, Staphylococcus aureus
HKDSEDFYISLKIIDVKQPEGDQR

SEQ ID NO: 1723070 - protein, 25 aa, Staphylococcus aureus
HKDTEDFYITLKIIDVKQPEGDQRV

SEQ ID NO: 1723071 - protein, 17 aa, Staphylococcus aureus
HKYWAKDLMLYITSKDT

SEQ ID NO: 1723072 - protein, 17 aa, Staphylococcus aureus
HMNFQFTNSYGPSKDVV

SEQ ID NO: 1723073 - protein, 30 aa, Staphylococcus aureus
HNAADAVYKAQLYLSPYGPKQYVEHLNQNT

SEQ ID NO: 1723074 - protein, 32 aa, Staphylococcus aureus
HNAADAVYKAQLYLSPYGPKQYVEHLNQNTGN

SEQ ID NO: 1723075 - protein, 28 aa, Staphylococcus aureus
HNAQRVTLKYKWKFGEGIKAGDYFDFTL

SEQ ID NO: 1723076 - protein, 25 aa, Staphylococcus aureus
HNGNYKYVFSFKDPNANGKYSIVTV

SEQ ID NO: 1723077 - protein, 39 aa, Staphylococcus aureus
HNTITIRPQDYVVFIPPVGKQIRAVVYYNKVVASNMSNA

SEQ ID NO: 1723078 - protein, 23 aa, Staphylococcus aureus
HNTKVLSTMIYDIALELISTIPF

SEQ ID NO: 1723079 - protein, 18 aa, Staphylococcus aureus
HNVDIVNISFGFPKYNYK

SEQ ID NO: 1723080 - protein, 21 aa, Staphylococcus aureus
HNYKSLKYYYSKPSIELKNLD

SEQ ID NO: 1723081 - protein, 27 aa, Staphylococcus aureus
HPDPHIIGLVALPYLNASRDFGNAHYS

SEQ ID NO: 1723082 - protein, 26 aa, Staphylococcus aureus
HPSQSLMINHYFAVPGYHAHKFVTPG

SEQ ID NO: 1723083 - protein, 26 aa, Staphylococcus aureus
HSRQYAKRQMTWFKNKMSVHWLDKDN

SEQ ID NO: 1723084 - protein, 26 aa, Staphylococcus aureus
HSRQYAKRQMTWFKNKMSVHWLNKEN

SEQ ID NO: 1723085 - protein, 24 aa, Staphylococcus aureus
HVILIFVLILVISTPNVLAESQPD

SEQ ID NO: 1723086 - protein, 22 aa, Staphylococcus aureus
HYHDNFWVTADMKRLSGTTTLD

SEQ ID NO: 1723087 - protein, 23 aa, Staphylococcus aureus
HYSSLIPLTPLDSSLLRKEQNDT

SEQ ID NO: 1723088 - protein, 17 aa, Staphylococcus aureus
IAALTILTSVTGVSTTM

SEQ ID NO: 1723089 - protein, 24 aa, Staphylococcus aureus
IAEKPFSKQAGHPVFYVYAGNQGN

SEQ ID NO: 1723090 - protein, 18 aa, Staphylococcus aureus
IAKIEAIQPATTTKDNAK

SEQ ID NO: 1723091 - protein, 20 aa, Staphylococcus aureus
IALSLIFSLSITPIANGESN

SEQ ID NO: 1723092 - protein, 17 aa, Staphylococcus aureus
IAPVLTGNLKPNTDSNA

SEQ ID NO: 1723093 - protein, 17 aa, Staphylococcus aureus
IATLKGVQPHIVIKPEA

SEQ ID NO: 1723094 - protein, 21 aa, Staphylococcus aureus
IAVMLFLTGCGKSQEKATLEK

SEQ ID NO: 1723095 - protein, 29 aa, Staphylococcus aureus
ICDNLLLTICHTAFEKLSIFPNMNLRMWE

SEQ ID NO: 1723096 - protein, 19 aa, Staphylococcus aureus
ICVKSCSLLFMLNGNPRPE

SEQ ID NO: 1723097 - protein, 19 aa, Staphylococcus aureus
ICVKSCSLLFMLNGSPRPE

SEQ ID NO: 1723098 - protein, 17 aa, Staphylococcus aureus
IDANSVTYKAGLTNQEI

SEQ ID NO: 1723099 - protein, 17 aa, Staphylococcus aureus
IDAQNIISKIKPATTVK

SEQ ID NO: 1723100 - protein, 21 aa, Staphylococcus aureus
IDDFVDDPLSYVKTPSNKVLG

SEQ ID NO: 1723101 - protein, 18 aa, Staphylococcus aureus
IDEFFGEIGQQRPTFIPT

SEQ ID NO: 1723102 - protein, 23 aa, Staphylococcus aureus
IDLEKPVPYINQLLALNTFAPQN

SEQ ID NO: 1723103 - protein, 23 aa, Staphylococcus aureus
IDQFKLMFKDGEIIDFSAGKGEA

SEQ ID NO: 1723104 - protein, 17 aa, Staphylococcus aureus
IDQSPEIAIVNQVKQTA

SEQ ID NO: 1723105 - protein, 18 aa, Staphylococcus aureus
IDQSPEIAIVNQVKQTAT

SEQ ID NO: 1723106 - protein, 22 aa, Staphylococcus aureus
IDRVNALKNRALTDIGVTSTTA

SEQ ID NO: 1723107 - protein, 25 aa, Staphylococcus aureus
IDSLVDQAYSVYFAYVTDAQHKTEA

SEQ ID NO: 1723108 - protein, 25 aa, Staphylococcus aureus
IDTVHEYFNGLYIITPFQNVEDSLE

SEQ ID NO: 1723109 - protein, 24 aa, Staphylococcus aureus
IDYKVRNYLLKHKNLYEFNSSPYE

SEQ ID NO: 1723110 - protein, 22 aa, Staphylococcus aureus
IEGYLKDHSAWDATMYSFGTIP

SEQ ID NO: 1723111 - protein, 17 aa, Staphylococcus aureus
IFIITGCDWQRTSKEPS

SEQ ID NO: 1723112 - protein, 22 aa, Staphylococcus aureus
IFYNTLFDENAACHLAIGSAYA

SEQ ID NO: 1723113 - protein, 18 aa, Staphylococcus aureus
IGAVVPQVTHKQAARDAI

SEQ ID NO: 1723114 - protein, 31 aa, Staphylococcus aureus
IGEKVVAYGPIWRLLKVPENVSHLKIQFVPK

SEQ ID NO: 1723115 - protein, 21 aa, Staphylococcus aureus
IGIFIITGCDWQRTSKERSKN

SEQ ID NO: 1723116 - protein, 20 aa, Staphylococcus aureus
IGMAITLKDFGITDVIILEK

SEQ ID NO: 1723117 - protein, 17 aa, Staphylococcus aureus
IGQGDASYTISFKTQGP

SEQ ID NO: 1723118 - protein, 26 aa, Staphylococcus aureus
IHEDYDYTLMVFAQPITNNPDDYVDE

SEQ ID NO: 1723119 - protein, 17 aa, Staphylococcus aureus
IIDDFFMDTNMNRPLNI

SEQ ID NO: 1723120 - protein, 17 aa, Staphylococcus aureus
IIDDFFMETKQNRPKSI

SEQ ID NO: 1723121 - protein, 22 aa, Staphylococcus aureus
IIKGSLAFALVSGVIVCSGLTS

SEQ ID NO: 1723122 - protein, 20 aa, Staphylococcus aureus
IIKHHFVVPGYHAHKFVTPG

SEQ ID NO: 1723123 - protein, 17 aa, Staphylococcus aureus
IILAYKPLSNDDEVHYY

SEQ ID NO: 1723124 - protein, 20 aa, Staphylococcus aureus
IILILEIVFHNINYANALPD

SEQ ID NO: 1723125 - protein, 18 aa, Staphylococcus aureus
IILLEYDGVVHIGYDNNL

SEQ ID NO: 1723126 - protein, 21 aa, Staphylococcus aureus
IILLFLSIISMSTLSKVQASE

SEQ ID NO: 1723127 - protein, 20 aa, Staphylococcus aureus
IILSTTLLLLGTAFTQFPNT

SEQ ID NO: 1723128 - protein, 17 aa, Staphylococcus aureus
IINIFDDMSEKDKEEFE

SEQ ID NO: 1723129 - protein, 24 aa, Staphylococcus aureus
IINSLTFTETVPNRSYARASANEI

SEQ ID NO: 1723130 - protein, 17 aa, Staphylococcus aureus
IIQKPIRSVQEVQTALT

SEQ ID NO: 1723131 - protein, 18 aa, Staphylococcus aureus
IIQKPIRSVQEVQTALTN

SEQ ID NO: 1723132 - protein, 17 aa, Staphylococcus aureus
IISKIKPATTVKTTALQ

SEQ ID NO: 1723133 - protein, 17 aa, Staphylococcus aureus
IKAYLKQVDKIKDDEEP

SEQ ID NO: 1723134 - protein, 35 aa, Staphylococcus aureus
IKDADNWTLDSGFYKTPKYSLGDYVWYDSNKDGKQ

SEQ ID NO: 1723135 - protein, 22 aa, Staphylococcus aureus
IKDVDAFFKGKKGIKRKVIETH

SEQ ID NO: 1723136 - protein, 31 aa, Staphylococcus aureus
IKEANSNNYQWYMHNNRLTVSAGDKVKAGDQ

SEQ ID NO: 1723137 - protein, 17 aa, Staphylococcus aureus
IKHFSVVPQINSFKVIP

SEQ ID NO: 1723138 - protein, 23 aa, Staphylococcus aureus
IKINHFCVVPQINSFKAIPPYGH

SEQ ID NO: 1723139 - protein, 18 aa, Staphylococcus aureus
IKKIINYPGKEDVSVIKV

SEQ ID NO: 1723140 - protein, 23 aa, Staphylococcus aureus
IKNTTITTLPSGWTSNLTKSDNK

SEQ ID NO: 1723141 - protein, 20 aa, Staphylococcus aureus
IKNVNYQYAVPSYSPTHYVP

SEQ ID NO: 1723142 - protein, 22 aa, Staphylococcus aureus
IKQILRLIFLLAMYELGKYVTE

SEQ ID NO: 1723143 - protein, 17 aa, Staphylococcus aureus
IKSKYIYWKNIEITKKG

SEQ ID NO: 1723144 - protein, 18 aa, Staphylococcus aureus
ILDKNFINAIKYDNVKFN

SEQ ID NO: 1723145 - protein, 31 aa, Staphylococcus aureus
ILTAKKSYFILNDKIVFLGTGIKSTDSSKNP

SEQ ID NO: 1723146 - protein, 24 aa, Staphylococcus aureus
ILVSSILVYFTIEKNNKEINVAIL

SEQ ID NO: 1723147 - protein, 34 aa, Staphylococcus aureus
ILVTTPHQVFLNWFGQDPAFDYFKTMDSTTVATV

SEQ ID NO: 1723148 - protein, 19 aa, Staphylococcus aureus
IMFMLILVVAVAGCGQKDT

SEQ ID NO: 1723149 - protein, 28 aa, Staphylococcus aureus
IMSLNGLNNFFIYPGQKLKVTGNATSSN

SEQ ID NO: 1723150 - protein, 23 aa, Staphylococcus aureus
INAQNIISKIKPATTVKATALQQ

SEQ ID NO: 1723151 - protein, 26 aa, Staphylococcus aureus
INDNVEVWLIKKGFNIYNRYTLHRFN

SEQ ID NO: 1723152 - protein, 32 aa, Staphylococcus aureus
INEQTWYYGKLSNGKLAWIKSTDLAKELIKYN

SEQ ID NO: 1723153 - protein, 19 aa, Staphylococcus aureus
INMNMYTRLLLLDENDHLT

SEQ ID NO: 1723154 - protein, 17 aa, Staphylococcus aureus
INPTQVMDIAYTEKVGN

SEQ ID NO: 1723155 - protein, 17 aa, Staphylococcus aureus
INQLVPLADNSALKTAK

SEQ ID NO: 1723156 - protein, 21 aa, Staphylococcus aureus
INSLTFTETVPNRSYARASAN

SEQ ID NO: 1723157 - protein, 25 aa, Staphylococcus aureus
INTGKVLYTFYQNPTLVKTAIKAQE

SEQ ID NO: 1723158 - protein, 17 aa, Staphylococcus aureus
INTTLTFDDPAISTDEN

SEQ ID NO: 1723159 - protein, 18 aa, Staphylococcus aureus
INTTLTFDDPAISTDENR

SEQ ID NO: 1723160 - protein, 26 aa, Staphylococcus aureus
IPHRYSTHYLLLEALREQLKIKPGHF

SEQ ID NO: 1723161 - protein, 18 aa, Staphylococcus aureus
IPHRYSTHYLLLEELRKQ

SEQ ID NO: 1723162 - protein, 17 aa, Staphylococcus aureus
IQEANSNNYQWYMHNNR

SEQ ID NO: 1723163 - protein, 18 aa, Staphylococcus aureus
IQIDDWMTVFGDPNYAMT

SEQ ID NO: 1723164 - protein, 17 aa, Staphylococcus aureus
IQPAPKVCTPIKKEETH

SEQ ID NO: 1723165 - protein, 20 aa, Staphylococcus aureus
IRKHKLGAASVFLGTMIVVG

SEQ ID NO: 1723166 - protein, 17 aa, Staphylococcus aureus
IRKLGVGIASVTLGTLL

SEQ ID NO: 1723167 - protein, 28 aa, Staphylococcus aureus
IRKNGRKSVFLMLNIKKGIFMTHPNLRQ

SEQ ID NO: 1723168 - protein, 17 aa, Staphylococcus aureus
IRKQLVEKYGLYKGTTK

SEQ ID NO: 1723169 - protein, 25 aa, Staphylococcus aureus
IRPEDYVVFIPPVGNQIRALIFYNN

SEQ ID NO: 1723170 - protein, 19 aa, Staphylococcus aureus
ISDGQRQYTLNGQVIQVLD

SEQ ID NO: 1723171 - protein, 17 aa, Staphylococcus aureus
ISDWNRVGWGEIPMSLG

SEQ ID NO: 1723172 - protein, 19 aa, Staphylococcus aureus
ISLIILSLLISITMSNASA

SEQ ID NO: 1723173 - protein, 28 aa, Staphylococcus aureus
ISNRLNKFSIRKYTVGTASILVGTTLIF

SEQ ID NO: 1723174 - protein, 17 aa, Staphylococcus aureus
ISQILTFNFIKDKSYDK

SEQ ID NO: 1723175 - protein, 18 aa, Staphylococcus aureus
ISTFSKSIFPSCRVAYMV

SEQ ID NO: 1723176 - protein, 18 aa, Staphylococcus aureus
ITAEPWLEISKKGLQLEG

SEQ ID NO: 1723177 - protein, 29 aa, Staphylococcus aureus
ITAKQTGDGYQWVIKFNKGHAPHENMIYW

SEQ ID NO: 1723178 - protein, 25 aa, Staphylococcus aureus
ITALHRTYFVFAENKKVLYQEIDSK

SEQ ID NO: 1723179 - protein, 24 aa, Staphylococcus aureus
ITDQQKAFYQVLHLKGITEEQRNQ

SEQ ID NO: 1723180 - protein, 19 aa, Staphylococcus aureus
ITIFLMGINITLYTTKKID

SEQ ID NO: 1723181 - protein, 22 aa, Staphylococcus aureus
ITLLIVPDLIRLSKTFLIESRE

SEQ ID NO: 1723182 - protein, 21 aa, Staphylococcus aureus
ITLSFLLLTACGANQNKENNS

SEQ ID NO: 1723183 - protein, 23 aa, Staphylococcus aureus
ITTNDILTMLKATTTVPGLRNNI

SEQ ID NO: 1723184 - protein, 46 aa, Staphylococcus aureus
ITTNKDGYKYYSFIDNVGLFSGSHLYVKNRDLAPKATNNKEYTINT

SEQ ID NO: 1723185 - protein, 18 aa, Staphylococcus aureus
IVALVLLAACGINNDKKV

SEQ ID NO: 1723186 - protein, 18 aa, Staphylococcus aureus
IVIGIQLYKDREKMYYFA

SEQ ID NO: 1723187 - protein, 19 aa, Staphylococcus aureus
IVLILFVVVSPINSPKTIA

SEQ ID NO: 1723188 - protein, 18 aa, Staphylococcus aureus
IVLVHGFNGFTDDINPSV

SEQ ID NO: 1723189 - protein, 18 aa, Staphylococcus aureus
IVPDLIRLNKTFLIESRE

SEQ ID NO: 1723190 - protein, 18 aa, Staphylococcus aureus
IVPDLIRLSKTFLIESRE

SEQ ID NO: 1723191 - protein, 24 aa, Staphylococcus aureus
IVVFILFFNVYDLSYAQGDIGVGN

SEQ ID NO: 1723192 - protein, 19 aa, Staphylococcus aureus
IYLYGTVNGKSGWVSKAYL

SEQ ID NO: 1723193 - protein, 20 aa, Staphylococcus aureus
IYNGHTFATSLPAKFVVKDV

SEQ ID NO: 1723194 - protein, 28 aa, Staphylococcus aureus
IYVKWQKYMIDELPGLPMFQGKSITIVN

SEQ ID NO: 1723195 - protein, 24 aa, Staphylococcus aureus
IYVYDKDKIIILAYKPLSNDDEVH

SEQ ID NO: 1723196 - protein, 24 aa, Staphylococcus aureus
KADGKFSHFAYVKPNNQSLSSVTV

SEQ ID NO: 1723197 - protein, 18 aa, Staphylococcus aureus
KAEHFHIFMGNDNDALLK

SEQ ID NO: 1723198 - protein, 20 aa, Staphylococcus aureus
KAFFSYEWKGLEIAKKLADE

SEQ ID NO: 1723199 - protein, 25 aa, Staphylococcus aureus
KAGERIKVIGYPHPYKNKYVLYEST

SEQ ID NO: 1723200 - protein, 28 aa, Staphylococcus aureus
KAIEQIKPKVRRKRAALDSIEENNKNQL

SEQ ID NO: 1723201 - protein, 27 aa, Staphylococcus aureus
KAIQFADIYLMALPTKAMREVASQIND

SEQ ID NO: 1723202 - protein, 24 aa, Staphylococcus aureus
KALNWWDYEIGTPRALTNTLILLN

SEQ ID NO: 1723203 - protein, 20 aa, Staphylococcus aureus
KAPKLLLKGSGNLKGSSVGY

SEQ ID NO: 1723204 - protein, 35 aa, Staphylococcus aureus
KAPVTVTGIPLDPSSLVYIVYPNEHTRDGGTEADQ

SEQ ID NO: 1723205 - protein, 19 aa, Staphylococcus aureus
KASHILIKVKSKKSDKEGL

SEQ ID NO: 1723206 - protein, 27 aa, Staphylococcus aureus
KATARNEITTILNNKLQEIQATPDATD

SEQ ID NO: 1723207 - protein, 27 aa, Staphylococcus aureus
KATARNEITTILNNKLQEIQATPDVTD

SEQ ID NO: 1723208 - protein, 20 aa, Staphylococcus aureus
KDALEWLHKNAYGKDPDKKV

SEQ ID NO: 1723209 - protein, 19 aa, Staphylococcus aureus
KDALNGDAKLIAAQNAAKQ

SEQ ID NO: 1723210 - protein, 24 aa, Staphylococcus aureus
KDKLMTRVLGEDQYLLKKKIDEYK

SEQ ID NO: 1723211 - protein, 20 aa, Staphylococcus aureus
KDLPKFIQFSDHYIAPKKAE

SEQ ID NO: 1723212 - protein, 29 aa, Staphylococcus aureus
KDNDTIDSGFYKPTYNLGDYVWEDTNKNG

SEQ ID NO: 1723213 - protein, 26 aa, Staphylococcus aureus
KDNKGLNFVLTTGTFFVKMNKKQYPD

SEQ ID NO: 1723214 - protein, 17 aa, Staphylococcus aureus
KDPRDYFVPDSELPPLV

SEQ ID NO: 1723215 - protein, 52 aa, Staphylococcus aureus
KEIALITAKQTGDGYQWVIKFNKGHAPHENMIYWFALPAGQTPVGRTEFVTV

SEQ ID NO: 1723216 - protein, 30 aa, Staphylococcus aureus
KEIARTDLGRYFDRFADKLDKTQTNAEVDE

SEQ ID NO: 1723217 - protein, 25 aa, Staphylococcus aureus
KEIENFKFFLQYGNFKDFKDYKDGD

SEQ ID NO: 1723218 - protein, 24 aa, Staphylococcus aureus
KEIENFKFFVQYGDFKDLSKYKDG

SEQ ID NO: 1723219 - protein, 24 aa, Staphylococcus aureus
KEIENFKFFVQYGNFKDYKNGDIS

SEQ ID NO: 1723220 - protein, 26 aa, Staphylococcus aureus
KEIEYARVWYQLISTRNDLKGIKNVY

SEQ ID NO: 1723221 - protein, 20 aa, Staphylococcus aureus
KEIKAYLKQVDKIKDDEEPI

SEQ ID NO: 1723222 - protein, 53 aa, Staphylococcus aureus
KEIVLMTAKQTGDGYQWVIKFNKGHAPHENMIFWFALPADQVPVGRTDFVTVN

SEQ ID NO: 1723223 - protein, 30 aa, Staphylococcus aureus
KEKYDTAKYYYNKYYQYKGLIDQTVLTTIG

SEQ ID NO: 1723224 - protein, 32 aa, Staphylococcus aureus
KELDFKIRKLLIEKYRLYKGTSDKGRIVINMK

SEQ ID NO: 1723225 - protein, 19 aa, Staphylococcus aureus
KELDFKLRKQLISQSGLYS

SEQ ID NO: 1723226 - protein, 25 aa, Staphylococcus aureus
KELDFKLRKYLIEKYGLYKTISKDG

SEQ ID NO: 1723227 - protein, 25 aa, Staphylococcus aureus
KELEQAVALIRTMPQRQQTSRRSNR

SEQ ID NO: 1723228 - protein, 18 aa, Staphylococcus aureus
KENKALELLIFNQENKNV

SEQ ID NO: 1723229 - protein, 29 aa, Staphylococcus aureus
KEPWSQPPSGYKWYDPKTFKAGSYGSEKG

SEQ ID NO: 1723230 - protein, 25 aa, Staphylococcus aureus
KESFYYDLFCIKGNLPDQYLQIYND

SEQ ID NO: 1723231 - protein, 19 aa, Staphylococcus aureus
KEYRKYYEPLIRKNDKEFK

SEQ ID NO: 1723232 - protein, 22 aa, Staphylococcus aureus
KFAVANLIIVSTVFSSVTPAIA

SEQ ID NO: 1723233 - protein, 22 aa, Staphylococcus aureus
KFAVTNLIIVSTVFSSVTPAIA

SEQ ID NO: 1723234 - protein, 19 aa, Staphylococcus aureus
KFPVTINGFSNLVSNEFAF

SEQ ID NO: 1723235 - protein, 20 aa, Staphylococcus aureus
KFSIRKYTVGTFSTVIATLV

SEQ ID NO: 1723236 - protein, 37 aa, Staphylococcus aureus
KFSIRKYTVGTFSTVIATLVFLGLNTSHAQAAETNQL

SEQ ID NO: 1723237 - protein, 22 aa, Staphylococcus aureus
KGAYYDYLSAPRFVIKKEVGAG

SEQ ID NO: 1723238 - protein, 53 aa, Staphylococcus aureus
KGDASYTISFKTQGPTIDKLYYAAGGRALEYNQLFMYSQLYVESTQDYQQRLN

SEQ ID NO: 1723239 - protein, 30 aa, Staphylococcus aureus
KGDGLNVINPIAPVTVVKQAARDAVSHDAQ

SEQ ID NO: 1723240 - protein, 20 aa, Staphylococcus aureus
KGDTFKITVPKELNLNGVTS

SEQ ID NO: 1723241 - protein, 28 aa, Staphylococcus aureus
KGHAPHENMIYWFALPAGQTPVGRTEFV

SEQ ID NO: 1723242 - protein, 24 aa, Staphylococcus aureus
KGIVYTPEQLPAKSKWSHAVDQGI

SEQ ID NO: 1723243 - protein, 22 aa, Staphylococcus aureus
KGKITYLKGEAMQYDLSTTGGN

SEQ ID NO: 1723244 - protein, 18 aa, Staphylococcus aureus
KGLGIISHRTINASAAEE

SEQ ID NO: 1723245 - protein, 22 aa, Staphylococcus aureus
KGPVMWGFFGHCSIAIDDKTIL

SEQ ID NO: 1723246 - protein, 18 aa, Staphylococcus aureus
KGQDYNLLNGISAFDKED

SEQ ID NO: 1723247 - protein, 29 aa, Staphylococcus aureus
KGQSFNIGDIKQYFTLSNGQAIPSGTFTN

SEQ ID NO: 1723248 - protein, 17 aa, Staphylococcus aureus
KGRLTKSFASNLANMNF

SEQ ID NO: 1723249 - protein, 25 aa, Staphylococcus aureus
KGSELANFYIGIINDLLSVEATEGK

SEQ ID NO: 1723250 - protein, 24 aa, Staphylococcus aureus
KGSLRYIHDIWGYIAPNTKKEKQP

SEQ ID NO: 1723251 - protein, 20 aa, Staphylococcus aureus
KGYREGNIATFIFNSQQIDV

SEQ ID NO: 1723252 - protein, 20 aa, Staphylococcus aureus
KHKEINPTYPKMQTFHEFSV

SEQ ID NO: 1723253 - protein, 20 aa, Staphylococcus aureus
KIEFKIKKGIKWHDGNELKI

SEQ ID NO: 1723254 - protein, 41 aa, Staphylococcus aureus
KIKKNKIGAVLLVGLFGLLFFILVLRISYIMITGHSNGQDL

SEQ ID NO: 1723255 - protein, 28 aa, Staphylococcus aureus
KIKVGLVSVAITMLYIMTNGQAEASEKE

SEQ ID NO: 1723256 - protein, 18 aa, Staphylococcus aureus
KINHFCVVPQINSFKVIP

SEQ ID NO: 1723257 - protein, 23 aa, Staphylococcus aureus
KIQEIDRVLASHPDVATIRQNVT

SEQ ID NO: 1723258 - protein, 34 aa, Staphylococcus aureus
KIRNRSGQVIYDWPTVHINSLKDLARASDYFSEA

SEQ ID NO: 1723259 - protein, 38 aa, Staphylococcus aureus
KIRNRSGQVIYEWPTVHINSLRDLARAGDYFSEANAPA

SEQ ID NO: 1723260 - protein, 19 aa, Staphylococcus aureus
KKAQYEAYKKWFEKHKSEN

SEQ ID NO: 1723261 - protein, 28 aa, Staphylococcus aureus
KKDTQLIIDEILAIKLPAEVIKASPKVG

SEQ ID NO: 1723262 - protein, 23 aa, Staphylococcus aureus
KKEIENFKFFAQYGNFIDLTKYK

SEQ ID NO: 1723263 - protein, 17 aa, Staphylococcus aureus
KKGMISNRLNKFSIRKY

SEQ ID NO: 1723264 - protein, 23 aa, Staphylococcus aureus
KKPASITAYNNSMHALQAELTSA

SEQ ID NO: 1723265 - protein, 26 aa, Staphylococcus aureus
KKTNHIKAMRWPFQYNIGLKTNDKYV

SEQ ID NO: 1723266 - protein, 22 aa, Staphylococcus aureus
KKYDIFKEKISLKELDFKLRKH

SEQ ID NO: 1723267 - protein, 20 aa, Staphylococcus aureus
KKYTAPIKTFAPDSDKILSS

SEQ ID NO: 1723268 - protein, 22 aa, Staphylococcus aureus
KLCLCLIILSIFIGGCGMKKEE

SEQ ID NO: 1723269 - protein, 24 aa, Staphylococcus aureus
KLCLCLMILSVFISACGMKKEESS

SEQ ID NO: 1723270 - protein, 28 aa, Staphylococcus aureus
KLNNIRILPYYIITLNNSIFEKVIKNLT

SEQ ID NO: 1723271 - protein, 33 aa, Staphylococcus aureus
KLQEAARTRNPIRLMIGFDYPDGYGNSETLVPV

SEQ ID NO: 1723272 - protein, 20 aa, Staphylococcus aureus
KMGINYSIYMDADTIPVDKK

SEQ ID NO: 1723273 - protein, 21 aa, Staphylococcus aureus
KMGINYSIYMDADTIPVDKKD

SEQ ID NO: 1723274 - protein, 27 aa, Staphylococcus aureus
KMKVGLVSVAITMLYIMTNGQADASEK

SEQ ID NO: 1723275 - protein, 27 aa, Staphylococcus aureus
KMKVGLVSVAITMLYIMTNGQAEASEN

SEQ ID NO: 1723276 - protein, 17 aa, Staphylococcus aureus
KNAYGKDPDKKVADLKT

SEQ ID NO: 1723277 - protein, 26 aa, Staphylococcus aureus
KNGTPISNGYFWGKIDSLESQFSKAL

SEQ ID NO: 1723278 - protein, 23 aa, Staphylococcus aureus
KNHLIPKFEAYYKSAKNLPDDTM

SEQ ID NO: 1723279 - protein, 21 aa, Staphylococcus aureus
KNIPLIPKSKLPDIPHHKFLE

SEQ ID NO: 1723280 - protein, 27 aa, Staphylococcus aureus
KNNETQYYHFFSIKDPADVYYTKKKAE

SEQ ID NO: 1723281 - protein, 24 aa, Staphylococcus aureus
KNRPVTYAGFKWNGKAFACSMAGL

SEQ ID NO: 1723282 - protein, 20 aa, Staphylococcus aureus
KNRSQNYVLIRLLNWLRTTN

SEQ ID NO: 1723283 - protein, 25 aa, Staphylococcus aureus
KNTDGSISLIIFPSPYYSPTFSKGE

SEQ ID NO: 1723284 - protein, 23 aa, Staphylococcus aureus
KNTILFNDFFTGHQWYNDLLVDL

SEQ ID NO: 1723285 - protein, 25 aa, Staphylococcus aureus
KNTNHIKSMRWPFQYNIGLKTNDPN

SEQ ID NO: 1723286 - protein, 25 aa, Staphylococcus aureus
KNTNHIKSMRWPFQYNIGLKTNDSN

SEQ ID NO: 1723287 - protein, 21 aa, Staphylococcus aureus
KNTTITTLPNGWTSNLTKADK

SEQ ID NO: 1723288 - protein, 24 aa, Staphylococcus aureus
KNYSKPISIYSPSSYKILSSVGES

SEQ ID NO: 1723289 - protein, 23 aa, Staphylococcus aureus
KPASKQAGHPVFYVYAGNQGNAS

SEQ ID NO: 1723290 - protein, 21 aa, Staphylococcus aureus
KPFSKQAGHPVFYVYAGNQGN

SEQ ID NO: 1723291 - protein, 20 aa, Staphylococcus aureus
KPLVVIYGDYKCPFCKELDE

SEQ ID NO: 1723292 - protein, 23 aa, Staphylococcus aureus
KPNPRDYDYSQFYWGGKYNVSVS

SEQ ID NO: 1723293 - protein, 18 aa, Staphylococcus aureus
KQAFINANRDVITLAEGD

SEQ ID NO: 1723294 - protein, 25 aa, Staphylococcus aureus
KQAMNAIQPNIVKKPAVLAQINQHY

SEQ ID NO: 1723295 - protein, 17 aa, Staphylococcus aureus
KQDIIQTVTTRKQQIKK

SEQ ID NO: 1723296 - protein, 18 aa, Staphylococcus aureus
KQGIANKAQIKGSENYHD

SEQ ID NO: 1723297 - protein, 40 aa, Staphylococcus aureus
KQIADGYYWGIIENLENQFYNIFHLLDQHKYAEKEYKDAV

SEQ ID NO: 1723298 - protein, 24 aa, Staphylococcus aureus
KQKSFWVAILSTIFLFAQNIAKAI

SEQ ID NO: 1723299 - protein, 25 aa, Staphylococcus aureus
KQLDAGSWFNKKYPKYARASYKNAK

SEQ ID NO: 1723300 - protein, 20 aa, Staphylococcus aureus
KQLISYKYLNDKVKSVLKSE

SEQ ID NO: 1723301 - protein, 22 aa, Staphylococcus aureus
KQNLRTAAYHKELLSDKIKISD

SEQ ID NO: 1723302 - protein, 23 aa, Staphylococcus aureus
KQSIITAFMNKNQNIRGYLASTD

SEQ ID NO: 1723303 - protein, 43 aa, Staphylococcus aureus; identical to SEQ ID NO: 1598738

SEQ ID NO: 1723304 - protein, 17 aa, Staphylococcus aureus
KQVALNQLANNEKLALQ

SEQ ID NO: 1723305 - protein, 19 aa, Staphylococcus aureus
KQVALNQLANNKKLALQNI

SEQ ID NO: 1723306 - protein, 26 aa, Staphylococcus aureus
KQVPVTVNVYQFEFPQNSYTTTVGGT

SEQ ID NO: 1723307 - protein, 17 aa, Staphylococcus aureus
KRAIADKADTKASGNYV

SEQ ID NO: 1723308 - protein, 22 aa, Staphylococcus aureus
KRELGFVLMALNIRKIAAQRAV

SEQ ID NO: 1723309 - protein, 17 aa, Staphylococcus aureus
KRGLHPTLIHRSDKINK

SEQ ID NO: 1723310 - protein, 26 aa, Staphylococcus aureus
KRKYDDTLPPLFDELPKEEPKSKPVV

SEQ ID NO: 1723311 - protein, 19 aa, Staphylococcus aureus
KRSEQFFMDNFGLKVKATN

SEQ ID NO: 1723312 - protein, 18 aa, Staphylococcus aureus
KRVDFLSNKLNKYSIRKF

SEQ ID NO: 1723313 - protein, 29 aa, Staphylococcus aureus
KRVNKLVIGISLLFLVISITAGCGMGKEE

SEQ ID NO: 1723314 - protein, 30 aa, Staphylococcus aureus
KRVNKLVLGISFLLLIISIVAGCGTGKEAE

SEQ ID NO: 1723315 - protein, 25 aa, Staphylococcus aureus
KSDQSLILPLSPYAIDKYYGERTTL

SEQ ID NO: 1723316 - protein, 21 aa, Staphylococcus aureus
KSFRKYFAKGYSYNSTGLSFL

SEQ ID NO: 1723317 - protein, 21 aa, Staphylococcus aureus
KSFYSIRKSSLGVASVAISTL

SEQ ID NO: 1723318 - protein, 29 aa, Staphylococcus aureus
KSIIAIISLGILTYTTMIGSVLADEIKYP

SEQ ID NO: 1723319 - protein, 17 aa, Staphylococcus aureus
KSIYLYGSVNGKSGWVS

SEQ ID NO: 1723320 - protein, 26 aa, Staphylococcus aureus
KSKKVDVGFLPPTAYTLAHDQKAADL

SEQ ID NO: 1723321 - protein, 28 aa, Staphylococcus aureus
KTATYKVVRTVPKHVFETARGVLYPGVS

SEQ ID NO: 1723322 - protein, 25 aa, Staphylococcus aureus
KTATYKVVRTVPKQVFETARGVLYP

SEQ ID NO: 1723323 - protein, 28 aa, Staphylococcus aureus
KTATYKVVSTVPKHVFETNRGAVFPGVS

SEQ ID NO: 1723324 - protein, 38 aa, Staphylococcus aureus
KTGTAHLFKVPTDADRLDLQFIPDNTAVADASRITTNK

SEQ ID NO: 1723325 - protein, 29 aa, Staphylococcus aureus
KTIEDGPTLRLFKVPDNVNNLKIQFVPKN

SEQ ID NO: 1723326 - protein, 22 aa, Staphylococcus aureus
KTNSWNLGQYKDSLRTVMCTSE

SEQ ID NO: 1723327 - protein, 23 aa, Staphylococcus aureus
KTSKTPKLLFKGSGDIKGSSVGY

SEQ ID NO: 1723328 - protein, 26 aa, Staphylococcus aureus
KVDDKIKVIGYPLPAQNTFKQFESTG

SEQ ID NO: 1723329 - protein, 18 aa, Staphylococcus aureus
KVGVFSHAMVRTSMFDSA

SEQ ID NO: 1723330 - protein, 18 aa, Staphylococcus aureus
KVITLTYAPFKGSSELST

SEQ ID NO: 1723331 - protein, 23 aa, Staphylococcus aureus
KVKQAFINANRDIITLAEGDISV

SEQ ID NO: 1723332 - protein, 25 aa, Staphylococcus aureus
KVMAIGEVIAERKIRYTFTDYIDNK

SEQ ID NO: 1723333 - protein, 17 aa, Staphylococcus aureus
KVPMLKAERLAMINITT

SEQ ID NO: 1723334 - protein, 36 aa, Staphylococcus aureus
KVVNAKYDVIYNGHTFATSLPAKFVVKDVQPAKPTV

SEQ ID NO: 1723335 - protein, 19 aa, Staphylococcus aureus
KVVVVNPTALTGDEKQRII

SEQ ID NO: 1723336 - protein, 26 aa, Staphylococcus aureus
KYAKKAYYTVYFKNGGKRILQLNSKN

SEQ ID NO: 1723337 - protein, 19 aa, Staphylococcus aureus
KYDNLYKFFKDNEKKYQYT

SEQ ID NO: 1723338 - protein, 28 aa, Staphylococcus aureus
KYDTAKYYTDKYFKYKGTIDKTVLSVFG

SEQ ID NO: 1723339 - protein, 25 aa, Staphylococcus aureus
KYDTAKYYTDKYFKYKGTIDKTVQS

SEQ ID NO: 1723340 - protein, 27 aa, Staphylococcus aureus
KYELEIKLKRPIPYINELLALSNFYPQ

SEQ ID NO: 1723341 - protein, 18 aa, Staphylococcus aureus
KYNSHIKRFIFASSAAVY

SEQ ID NO: 1723342 - protein, 27 aa, Staphylococcus aureus
KYNSLKQAIAGLTPDLAPLQTAKTQLQ

SEQ ID NO: 1723343 - protein, 22 aa, Staphylococcus aureus
KYPEIKKSMKYDFIAYYDKDEN

SEQ ID NO: 1723344 - protein, 17 aa, Staphylococcus aureus
KYTVYFKNGTKKVIDLK

SEQ ID NO: 1723345 - protein, 18 aa, Staphylococcus aureus
LALLLLVAACGTGGKQSS

SEQ ID NO: 1723346 - protein, 18 aa, Staphylococcus aureus
LALSLFLAACGQDSDQQK

SEQ ID NO: 1723347 - protein, 21 aa, Staphylococcus aureus
LALSSFIILSACGQNTEDNHK

SEQ ID NO: 1723348 - protein, 22 aa, Staphylococcus aureus
LALSSFIILSACGQNTEDNHKK

SEQ ID NO: 1723349 - protein, 17 aa, Staphylococcus aureus
LASTLVLGACGSNDTDK

SEQ ID NO: 1723350 - protein, 17 aa, Staphylococcus aureus
LASTMILVACGNASNEN

SEQ ID NO: 1723351 - protein, 17 aa, Staphylococcus aureus
LASTMILVACGNVNNEN

SEQ ID NO: 1723352 - protein, 23 aa, Staphylococcus aureus
LCIILLILIIFVTSCDGDNKITG

SEQ ID NO: 1723353 - protein, 23 aa, Staphylococcus aureus
LCISLLILIIFVTSCDVDNKITG

SEQ ID NO: 1723354 - protein, 24 aa, Staphylococcus aureus
LCISLLILIIFVTSCDVDNKITGD

SEQ ID NO: 1723355 - protein, 20 aa, Staphylococcus aureus
LCISLLILSIFVTSCDSDNK

SEQ ID NO: 1723356 - protein, 18 aa, Staphylococcus aureus
LCTSLILGGCSLMHKDQT

SEQ ID NO: 1723357 - protein, 18 aa, Staphylococcus aureus
LDFKLRKHLIDKHDLYKT

SEQ ID NO: 1723358 - protein, 23 aa, Staphylococcus aureus
LDLKYKLRVNNVPTPRTVTFNDT

SEQ ID NO: 1723359 - protein, 19 aa, Staphylococcus aureus
LDPSALVYLVAPTNQTTNG

SEQ ID NO: 1723360 - protein, 19 aa, Staphylococcus aureus
LDPSALVYLVIPTSQTRDG

SEQ ID NO: 1723361 - protein, 24 aa, Staphylococcus aureus
LDTDEFVYKIQLPEGVEYVNNSLT

SEQ ID NO: 1723362 - protein, 23 aa, Staphylococcus aureus
LDTLDKSYVIHYSGEYLNGTNEV

SEQ ID NO: 1723363 - protein, 23 aa, Staphylococcus aureus
LDVQLRNYLNKKYKLYEQGGDIV

SEQ ID NO: 1723364 - protein, 25 aa, Staphylococcus aureus
LDYRLRERAIKQHGLYSNGLKQGRI

SEQ ID NO: 1723365 - protein, 27 aa, Staphylococcus aureus
LEAIREVVNKQIEIIKNADADASAKEI

SEQ ID NO: 1723366 - protein, 28 aa, Staphylococcus aureus
LEAIREVVNKQIEIIKNADADASAKEIA

SEQ ID NO: 1723367 - protein, 24 aa, Staphylococcus aureus
LEGISQMMPMIKESPFKHTQDKAT

SEQ ID NO: 1723368 - protein, 24 aa, Staphylococcus aureus
LEGISQMMPMIKETPFKETSQNDT

SEQ ID NO: 1723369 - protein, 19 aa, Staphylococcus aureus
LEHEFSYIDVLLDKNADQA

SEQ ID NO: 1723370 - protein, 17 aa, Staphylococcus aureus
LEKKVEEIPFKKERKFN

SEQ ID NO: 1723371 - protein, 20 aa, Staphylococcus aureus
LENKALMVGATYFNEHRDEV

SEQ ID NO: 1723372 - protein, 22 aa, Staphylococcus aureus
LFAASFVTHFSGQTPHIHFDIA

SEQ ID NO: 1723373 - protein, 21 aa, Staphylococcus aureus
LFISVIILSIFIIGCNSSSDT

SEQ ID NO: 1723374 - protein, 18 aa, Staphylococcus aureus
LFLLAMYELGKYVTEQIY

SEQ ID NO: 1723375 - protein, 19 aa, Staphylococcus aureus
LFLLAMYELGKYVTEQVFI

SEQ ID NO: 1723376 - protein, 20 aa, Staphylococcus aureus
LFLLGKDKEEYKEGIEGKDV

SEQ ID NO: 1723377 - protein, 38 aa, Staphylococcus aureus
LFTDQKLQEAARTRNPIRLMIGFDYPDAYGNSETLVPV

SEQ ID NO: 1723378 - protein, 23 aa, Staphylococcus aureus
LGISFLFLVISITAGCGIGKEAE

SEQ ID NO: 1723379 - protein, 18 aa, Staphylococcus aureus
LGLIVPIATPFQGSKATT

SEQ ID NO: 1723380 - protein, 24 aa, Staphylococcus aureus
LGTKAINAIQPNIVKKPAALAQIN

SEQ ID NO: 1723381 - protein, 17 aa, Staphylococcus aureus
LGTLLISGGVTPAANAA

SEQ ID NO: 1723382 - protein, 29 aa, Staphylococcus aureus
LGVASVAISTLLLLMSNGEAQAAAEETGG

SEQ ID NO: 1723383 - protein, 25 aa, Staphylococcus aureus
LGVASVIVSTLFLITSQHQAHAAEN

SEQ ID NO: 1723384 - protein, 29 aa, Staphylococcus aureus
LGVCNGFQILTEIGLLPGALLHNDSHLFI

SEQ ID NO: 1723385 - protein, 19 aa, Staphylococcus aureus
LHSLINKYPQIQKNMKSEF

SEQ ID NO: 1723386 - protein, 17 aa, Staphylococcus aureus
LIAMIILSGCSTTNNES

SEQ ID NO: 1723387 - protein, 17 aa, Staphylococcus aureus
LIIMMSIINYGCGNEQN

SEQ ID NO: 1723388 - protein, 19 aa, Staphylococcus aureus
LIKYYTQPHFSLSNKWLWQ

SEQ ID NO: 1723389 - protein, 18 aa, Staphylococcus aureus
LILKFAIGSNIIGLSAFV

SEQ ID NO: 1723390 - protein, 20 aa, Staphylococcus aureus
LILMTTLLLLGTTATQIPNS

SEQ ID NO: 1723391 - protein, 19 aa, Staphylococcus aureus
LINKYPQIQKNMESEFIAY

SEQ ID NO: 1723392 - protein, 17 aa, Staphylococcus aureus
LINQTSNPTLDKAQVEQ

SEQ ID NO: 1723393 - protein, 24 aa, Staphylococcus aureus
LIQPVKQEILYRIGEYYYGSDDTL

SEQ ID NO: 1723394 - protein, 19 aa, Staphylococcus aureus
LITLFSIMFMVPNDTFAEG

SEQ ID NO: 1723395 - protein, 20 aa, Staphylococcus aureus
LITLFSIMFMVPNDTFAEGK

SEQ ID NO: 1723396 - protein, 19 aa, Staphylococcus aureus
LIVCVLTIGAYFLGHQTTK

SEQ ID NO: 1723397 - protein, 17 aa, Staphylococcus aureus
LIVSLSVILVSCNNNDS

SEQ ID NO: 1723398 - protein, 21 aa, Staphylococcus aureus
LKDHKVDIFGISYSGLCNTKY

SEQ ID NO: 1723399 - protein, 25 aa, Staphylococcus aureus
LKELDFKLRKQLIEKIICTVTLVQV

SEQ ID NO: 1723400 - protein, 24 aa, Staphylococcus aureus
LKELIKLHRLLSETYKIMQNGNYL

SEQ ID NO: 1723401 - protein, 25 aa, Staphylococcus aureus
LKHDLLFHDMFLNDAWKKDLKVEFE

SEQ ID NO: 1723402 - protein, 28 aa, Staphylococcus aureus
LKIEKMNLPGISLLPETERFYPNGNFAS

SEQ ID NO: 1723403 - protein, 24 aa, Staphylococcus aureus
LKKIKFDDFDLYRLTKKEYNELHQ

SEQ ID NO: 1723404 - protein, 36 aa, Staphylococcus aureus
LKNKRTLIVVIAFVLFIIFLFLLLNSNSEDSGNITK

SEQ ID NO: 1723405 - protein, 29 aa, Staphylococcus aureus
LKNKYIYGGVTLAGDYLEKSRCIPINLWV

SEQ ID NO: 1723406 - protein, 24 aa, Staphylococcus aureus
LKNTILFNDFFTGHQWYNDLLVDL

SEQ ID NO: 1723407 - protein, 22 aa, Staphylococcus aureus
LKSTTITTLPSGWTSNLTKSDK

SEQ ID NO: 1723408 - protein, 20 aa, Staphylococcus aureus
LKVLSAPSIDYGLIGFVSHD

SEQ ID NO: 1723409 - protein, 28 aa, Staphylococcus aureus
LKYAKKAYYTVYFKNGGKRILQLNSKNY

SEQ ID NO: 1723410 - protein, 24 aa, Staphylococcus aureus
LLEKKKALYEKYKEWYKKHKEINP

SEQ ID NO: 1723411 - protein, 21 aa, Staphylococcus aureus
LLFLIFLSACANTRHSESNKN

SEQ ID NO: 1723412 - protein, 18 aa, Staphylococcus aureus
LLFLLAMYELGKYVTEQV

SEQ ID NO: 1723413 - protein, 20 aa, Staphylococcus aureus
LLFLLAMYELGKYVTEQVYI

SEQ ID NO: 1723414 - protein, 21 aa, Staphylococcus aureus
LLITMAVVTWKVWKIEKHTRK

SEQ ID NO: 1723415 - protein, 20 aa, Staphylococcus aureus
LLIVPDLIRLSKTFLIESRE

SEQ ID NO: 1723416 - protein, 24 aa, Staphylococcus aureus
LLLNFIFILILSGCSKEGIYSDKG

SEQ ID NO: 1723417 - protein, 25 aa, Staphylococcus aureus
LLPGDYFGTIRFGRKEQLFEIRVKP

SEQ ID NO: 1723418 - protein, 17 aa, Staphylococcus aureus
LLTLTSKGLSNLRVIDD

SEQ ID NO: 1723419 - protein, 19 aa, Staphylococcus aureus
LNDIAYLKATFKTNKKING

SEQ ID NO: 1723420 - protein, 18 aa, Staphylococcus aureus
LNEYQISQLFTDDKLQQA

SEQ ID NO: 1723421 - protein, 17 aa, Staphylococcus aureus
LNEYQLSQLFTDQKLQE

SEQ ID NO: 1723422 - protein, 28 aa, Staphylococcus aureus
LNIDDFVDDPLSYVKTPSNKVLGFYSNN

SEQ ID NO: 1723423 - protein, 21 aa, Staphylococcus aureus
LNISQILTFNFIKDKSYDKDT

SEQ ID NO: 1723424 - protein, 18 aa, Staphylococcus aureus
LNLFIDPTTVTKQGKQKV

SEQ ID NO: 1723425 - protein, 18 aa, Staphylococcus aureus
LNTAMTGLKRGVANHNQV

SEQ ID NO: 1723426 - protein, 18 aa, Staphylococcus aureus
LNTGKVLYAFYQNPKVVK

SEQ ID NO: 1723427 - protein, 18 aa, Staphylococcus aureus
LNVDVTYPGISAAKQVPV

SEQ ID NO: 1723428 - protein, 23 aa, Staphylococcus aureus
LPFFILVLTISVTTLPISQTRIA

SEQ ID NO: 1723429 - protein, 23 aa, Staphylococcus aureus
LPGDYFGTIRFGRKEQLFEIRVK

SEQ ID NO: 1723430 - protein, 17 aa, Staphylococcus aureus
LPNLTQLQKDNLKHQVE

SEQ ID NO: 1723431 - protein, 19 aa, Staphylococcus aureus
LPQSVYLDASDKNKYKDVT

SEQ ID NO: 1723432 - protein, 17 aa, Staphylococcus aureus
LPSMVALMLVGSAVTAH

SEQ ID NO: 1723433 - protein, 17 aa, Staphylococcus aureus
LPSMVALTLVGSAVTAH

SEQ ID NO: 1723434 - protein, 32 aa, Staphylococcus aureus
LQEAARTRNPIRLMIGFDYPDAYGNSETLVPV

SEQ ID NO: 1723435 - protein, 17 aa, Staphylococcus aureus
LQQMWEYGVNDPDRSHD

SEQ ID NO: 1723436 - protein, 17 aa, Staphylococcus aureus
LQQMWEYGVNDPHRSHD

SEQ ID NO: 1723437 - protein, 20 aa, Staphylococcus aureus
LRAKLDIILGDAKDPVRITN

SEQ ID NO: 1723438 - protein, 21 aa, Staphylococcus aureus
LRAKLDLIIGEEKNAFRITNE

SEQ ID NO: 1723439 - protein, 17 aa, Staphylococcus aureus
LRDGYLLSDKNYKDWTE

SEQ ID NO: 1723440 - protein, 21 aa, Staphylococcus aureus
LREFYIFRFIIGKQPYKLNIN

SEQ ID NO: 1723441 - protein, 42 aa, Staphylococcus aureus
LRGTALQKVPVTVTDIPLDPSALVYLVIPTSQTRDGGSEADQ

SEQ ID NO: 1723442 - protein, 20 aa, Staphylococcus aureus
LRLSKQAKYTVYFKNGAKRV

SEQ ID NO: 1723443 - protein, 20 aa, Staphylococcus aureus
LRQVVNRTYRIGTTKRVEVS

SEQ ID NO: 1723444 - protein, 21 aa, Staphylococcus aureus
LRRNSMDAFPVLAYSFSNKEN

SEQ ID NO: 1723445 - protein, 21 aa, Staphylococcus aureus
LSGFDPIRREIARTALVNLVS

SEQ ID NO: 1723446 - protein, 23 aa, Staphylococcus aureus
LSGFDPIRREIARTALVNLVSDG

SEQ ID NO: 1723447 - protein, 19 aa, Staphylococcus aureus
LSHAMVRTSMFEAGSNRTY

SEQ ID NO: 1723448 - protein, 17 aa, Staphylococcus aureus
LSIFPNMNLRMWENPVT

SEQ ID NO: 1723449 - protein, 17 aa, Staphylococcus aureus
LSQLFTDQKLQEAARTR

SEQ ID NO: 1723450 - protein, 30 aa, Staphylococcus aureus
LSWSDDHKSLIYRYDATLGTQITTNDILTM

SEQ ID NO: 1723451 - protein, 20 aa, Staphylococcus aureus
LTAELSLNLFIDPTTVTKQG

SEQ ID NO: 1723452 - protein, 19 aa, Staphylococcus aureus
LTEFEVAYAPPYSHPKDLI

SEQ ID NO: 1723453 - protein, 30 aa, Staphylococcus aureus; identical to SEQ ID NO: 1717767

SEQ ID NO: 1723454 - protein, 31 aa, Staphylococcus aureus
LTFLFVCSLIVCRFFAYKIYFPTDAENKSEI

SEQ ID NO: 1723455 - protein, 32 aa, Staphylococcus aureus
LTFLFVCSLIVCRFFAYKIYFPTDAENKSEIP

SEQ ID NO: 1723456 - protein, 22 aa, Staphylococcus aureus
LTGFILILLLEGIFTNSASAIE

SEQ ID NO: 1723457 - protein, 24 aa, Staphylococcus aureus
LTGFILILLLEGIFTNTASAIEYS

SEQ ID NO: 1723458 - protein, 19 aa, Staphylococcus aureus
LTIYGIFEDGSKELVFENG

SEQ ID NO: 1723459 - protein, 38 aa, Staphylococcus aureus
LTKSFTSNLNNMNFLRWVNFPQDYTVTWTNAKIANRPT

SEQ ID NO: 1723460 - protein, 24 aa, Staphylococcus aureus
LTQAINQLVPLADNSALKTAKTKL

SEQ ID NO: 1723461 - protein, 24 aa, Staphylococcus aureus
LTQQLKIYNAMDRVTYHNKDLDFA

SEQ ID NO: 1723462 - protein, 18 aa, Staphylococcus aureus
LTQSIDFKGLKQIDLTKE

SEQ ID NO: 1723463 - protein, 23 aa, Staphylococcus aureus
LTSIILIILINVAGIHFKMKYDE

SEQ ID NO: 1723464 - protein, 30 aa, Staphylococcus aureus
LTTEKFLDFDLLFKNFTWLDGKSVEFKDLK

SEQ ID NO: 1723465 - protein, 20 aa, Staphylococcus aureus
LTTLAFLIAVTESIGIAEVK

SEQ ID NO: 1723466 - protein, 27 aa, Staphylococcus aureus
LVGDNAPALYPNYWGGNKFKVIEELRK

SEQ ID NO: 1723467 - protein, 19 aa, Staphylococcus aureus
LVGNLLPGDYFGTIRFGRK

SEQ ID NO: 1723468 - protein, 21 aa, Staphylococcus aureus
LVLSILIILPVSKLDGHHIAN

SEQ ID NO: 1723469 - protein, 18 aa, Staphylococcus aureus
LVLTFAVVLAACGNGDKG

SEQ ID NO: 1723470 - protein, 18 aa, Staphylococcus aureus
LVNCKATKRRKLFNGYIE

SEQ ID NO: 1723471 - protein, 18 aa, Staphylococcus aureus
LVPVNLTVLPEIQHNIKF

SEQ ID NO: 1723472 - protein, 18 aa, Staphylococcus aureus
LVQSGFNPSFITTLSHER

SEQ ID NO: 1723473 - protein, 21 aa, Staphylococcus aureus
LVSTLALTACGEKEKPKKEEN

SEQ ID NO: 1723474 - protein, 17 aa, Staphylococcus aureus
LWKNVRDALKEASIIDK

SEQ ID NO: 1723475 - protein, 22 aa, Staphylococcus aureus
LYDIKDLYRYYSSESFEFSNIS

SEQ ID NO: 1723476 - protein, 21 aa, Staphylococcus aureus
LYISFLILIISIVAGCGTGKE

SEQ ID NO: 1723477 - protein, 19 aa, Staphylococcus aureus
LYISIMALSIFIIGCDKSS

SEQ ID NO: 1723478 - protein, 22 aa, Staphylococcus aureus
LYISVMILIFAIAGCGKSDETK

SEQ ID NO: 1723479 - protein, 18 aa, Staphylococcus aureus
LYNKLDMILGYKDEERKK

SEQ ID NO: 1723480 - protein, 17 aa, Staphylococcus aureus
LYYSVEYKNTATFNKLV

SEQ ID NO: 1723481 - protein, 22 aa, Staphylococcus aureus
MADDKFYTFELTKKLQPHRMGD

SEQ ID NO: 1723482 - protein, 24 aa, Staphylococcus aureus
MCISLLIVIIFVTSCGGGNKITED

SEQ ID NO: 1723483 - protein, 27 aa, Staphylococcus aureus
MDEFKIDWNRHGFWGYWSGENHVDEKE

SEQ ID NO: 1723484 - protein, 28 aa, Staphylococcus aureus
MDEIISFLETFFQLYPTATEKELTYYVS

SEQ ID NO: 1723485 - protein, 17 aa, Staphylococcus aureus
METRGMVLYINRNTRTT

SEQ ID NO: 1723486 - protein, 26 aa, Staphylococcus aureus
MEVISKLKPDLIIADVSRHKKIKSEL

SEQ ID NO: 1723487 - protein, 27 aa, Staphylococcus aureus
MFINNEDTFMGQFLIKMGIQPEVTKDK

SEQ ID NO: 1723488 - protein, 17 aa, Staphylococcus aureus
MFLGDAPVAPIYQKGVA

SEQ ID NO: 1723489 - protein, 20 aa, Staphylococcus aureus
MGIPTDIKPFVTTKLISPLG

SEQ ID NO: 1723490 - protein, 29 aa, Staphylococcus aureus
MGNIKSFALYISILLLIVVVAGCGKSDKT

SEQ ID NO: 1723491 - protein, 18 aa, Staphylococcus aureus
MGNLRQAVADKEQVKRTE

SEQ ID NO: 1723492 - protein, 22 aa, Staphylococcus aureus
MHVYFEQFDPKKDKYKVFVQFD

SEQ ID NO: 1723493 - protein, 20 aa, Staphylococcus aureus
MIEMMFGVHFIKGGMYGMAQ

SEQ ID NO: 1723494 - protein, 20 aa, Staphylococcus aureus
MITALFIAVISVLLAFHLKQ

SEQ ID NO: 1723495 - protein, 28 aa, Staphylococcus aureus
MKDGSFYNLNLRCKLAFKYMGEVIESKQ

SEQ ID NO: 1723496 - protein, 18 aa, Staphylococcus aureus
MKFQSLDQNWNNGGWRKA

SEQ ID NO: 1723497 - protein, 17 aa, Staphylococcus aureus
MKNGDFYTFELNKKLQT

SEQ ID NO: 1723498 - protein, 25 aa, Staphylococcus aureus
MLGICLVLLIILIVGYVIMTKINSR

SEQ ID NO: 1723499 - protein, 28 aa, Staphylococcus aureus
MNKNIIIKSIAALTILTSITGAGTTVVE

SEQ ID NO: 1723500 - protein, 26 aa, Staphylococcus aureus
MNKNIIIKSIAALTILTSITGVGTTV

SEQ ID NO: 1723501 - protein, 25 aa, Staphylococcus aureus
MPESGEKFYPTKYLLIYNDNKTVES

SEQ ID NO: 1723502 - protein, 20 aa, Staphylococcus aureus
MQPKGRKFKDFTSKFNIASE

SEQ ID NO: 1723503 - protein, 22 aa, Staphylococcus aureus
MQTYTVKPGTKLYSVPWGTYKQ

SEQ ID NO: 1723504 - protein, 34 aa, Staphylococcus aureus
MSLPKKLFLWVFGILVILAIIAVVYVAAKIFITG

SEQ ID NO: 1723505 - protein, 31 aa, Staphylococcus aureus
MSNAVTILPDDIPPTINNPVGINAKYYRGDE

SEQ ID NO: 1723506 - protein, 30 aa, Staphylococcus aureus
MTIAGVVLILVAAYLFAKPHIDNYLHDKDK

SEQ ID NO: 1723507 - protein, 29 aa, Staphylococcus aureus
MTIAGVVLILVVAYLFAKPHIDNYLHDKD

SEQ ID NO: 1723508 - protein, 28 aa, Staphylococcus aureus
MTLDSGFYKTPKYSLGDYVWYDSNKDGK

SEQ ID NO: 1723509 - protein, 17 aa, Staphylococcus aureus
MVLYINRNTRTTKGYYF

SEQ ID NO: 1723510 - protein, 28 aa, Staphylococcus aureus
NAADAVYKAQLYLSPYGPKQYVEHLNQN

SEQ ID NO: 1723511 - protein, 29 aa, Staphylococcus aureus
NAADAVYKAQLYLSPYGPKQYVEHLNQNT

SEQ ID NO: 1723512 - protein, 24 aa, Staphylococcus aureus
NAAKDLVLKAKEKAYQDILNAQTT

SEQ ID NO: 1723513 - protein, 21 aa, Staphylococcus aureus
NADVAYLLHDGKNEIREIEPV

SEQ ID NO: 1723514 - protein, 41 aa, Staphylococcus aureus; identical to SEQ ID NO: 1593381

SEQ ID NO: 1723515 - protein, 41 aa, Staphylococcus aureus
NAGTQLYHITATNAYHKDTEDFYITLKIIDVKQPEGDQRVY

SEQ ID NO: 1723516 - protein, 41 aa, Staphylococcus aureus
NAGTQLYHIVASNAYHKDTEDFYISLKIIDVKQPEGDQRVY

SEQ ID NO: 1723517 - protein, 20 aa, Staphylococcus aureus
NAIDYITFDPNTNTNGITAA

SEQ ID NO: 1723518 - protein, 17 aa, Staphylococcus aureus
NAIIQKPIRSVQEVQTA

SEQ ID NO: 1723519 - protein, 20 aa, Staphylococcus aureus
NAIIQKPIRSVQEVQTALTN

SEQ ID NO: 1723520 - protein, 20 aa, Staphylococcus aureus
NAINPIAPVTVVKQAAKDAV

SEQ ID NO: 1723521 - protein, 22 aa, Staphylococcus aureus
NAPAAAQPAAQPAAPVAANAQT

SEQ ID NO: 1723522 - protein, 23 aa, Staphylococcus aureus
NAPNEVLSFDDNGIRPSTNRSVP

SEQ ID NO: 1723523 - protein, 33 aa, Staphylococcus aureus
NASNKGAPYNLPTSPWNTLKASAAKEIVLMTAK

SEQ ID NO: 1723524 - protein, 34 aa, Staphylococcus aureus
NASNKGAPYNLPTTPWNTLKASAAKEIALITAKQ

SEQ ID NO: 1723525 - protein, 32 aa, Staphylococcus aureus
NASSKGAPYNLPTTPWNTLKASDAKEIALITA

SEQ ID NO: 1723526 - protein, 34 aa, Staphylococcus aureus; identical to SEQ ID NO: 1596975

SEQ ID NO: 1723527 - protein, 31 aa, Staphylococcus aureus
NASSKGAPYNLPTTPWNTLKASDSKEIALMT

SEQ ID NO: 1723528 - protein, 27 aa, Staphylococcus aureus
NATGLPTDGFTYKWNNAATGTNDANWA

SEQ ID NO: 1723529 - protein, 27 aa, Staphylococcus aureus
NAVNSEKTLFKYLNQNDATQQGVNEKS

SEQ ID NO: 1723530 - protein, 22 aa, Staphylococcus aureus
NAVTILPDDIPPTINNPVGINA

SEQ ID NO: 1723531 - protein, 20 aa, Staphylococcus aureus
NAVTILPDDIPPTINNPVGL

SEQ ID NO: 1723532 - protein, 38 aa, Staphylococcus aureus
NDAITDVRGIYQLRDGYKYYDFVDSIGLHSGSHLYVER

SEQ ID NO: 1723533 - protein, 21 aa, Staphylococcus aureus
NDDEVLYSIKLSITNKKEKNS

SEQ ID NO: 1723534 - protein, 25 aa, Staphylococcus aureus
NDGLNLFEFKYKLKPFFNPENVYSK

SEQ ID NO: 1723535 - protein, 17 aa, Staphylococcus aureus
NDIINGNAQHPVITASD

SEQ ID NO: 1723536 - protein, 31 aa, Staphylococcus aureus
NDIKQHTQFIIDEILAIKLPAEVIKASPKVG

SEQ ID NO: 1723537 - protein, 22 aa, Staphylococcus aureus
NDKQLVVSAPTKKPTLPTYTET

SEQ ID NO: 1723538 - protein, 17 aa, Staphylococcus aureus
NDKQLVVSAPTKKPTSP

SEQ ID NO: 1723539 - protein, 43 aa, Staphylococcus aureus
NDSRSWDFKIRNRSGQVIYDWPTVHINSLKDLARAGDYFSEAG

SEQ ID NO: 1723540 - protein, 18 aa, Staphylococcus aureus
NDVVLVYKKVRDGFDVQV

SEQ ID NO: 1723541 - protein, 17 aa, Staphylococcus aureus
NEDKRFEGAKYSIGGIT

SEQ ID NO: 1723542 - protein, 17 aa, Staphylococcus aureus
NERISIVGYPEPYINKF

SEQ ID NO: 1723543 - protein, 18 aa, Staphylococcus aureus
NESLFSRQWDMNKITNNG

SEQ ID NO: 1723544 - protein, 20 aa, Staphylococcus aureus
NEYQLSQLFTDDKLQQAART

SEQ ID NO: 1723545 - protein, 32 aa, Staphylococcus aureus
NFGASLKADQFKYEVTLPQAVTYGNDSLTTTF

SEQ ID NO: 1723546 - protein, 32 aa, Staphylococcus aureus
NFGASLKSDQFKYEVTLPQGVTYVNDSLTTTF

SEQ ID NO: 1723547 - protein, 26 aa, Staphylococcus aureus
NFTDKDWQITGIPRTLHIENSTNRPN

SEQ ID NO: 1723548 - protein, 32 aa, Staphylococcus aureus; identical to SEQ ID NO: 1594674

SEQ ID NO: 1723549 - protein, 33 aa, Staphylococcus aureus
NGETLVPVNLTVLPEIQHNIKFFKNDDGQNIAD

SEQ ID NO: 1723550 - protein, 23 aa, Staphylococcus aureus
NGGAPVAITAPYTPTTDPNANNA

SEQ ID NO: 1723551 - protein, 20 aa, Staphylococcus aureus
NGGYYTFELNKKLQPHRMGD

SEQ ID NO: 1723552 - protein, 26 aa, Staphylococcus aureus
NGKNVTLIYFEKDGKLGFYVQKTQKE

SEQ ID NO: 1723553 - protein, 24 aa, Staphylococcus aureus
NGLKQAIAGLTPDLAPLQAAKTQL

SEQ ID NO: 1723554 - protein, 18 aa, Staphylococcus aureus
NGLRQTVNRTYRLGTTKR

SEQ ID NO: 1723555 - protein, 25 aa, Staphylococcus aureus
NGLRQVVNRTYRIGTTKRVEVSQGN

SEQ ID NO: 1723556 - protein, 26 aa, Staphylococcus aureus
NGQKYVVMKTKDDSYWKDLIVEGKRV

SEQ ID NO: 1723557 - protein, 22 aa, Staphylococcus aureus
NGQVIQVLDIINPSNGYGGQPV

SEQ ID NO: 1723558 - protein, 18 aa, Staphylococcus aureus
NGSSAADYFKLSNGSAIP

SEQ ID NO: 1723559 - protein, 19 aa, Staphylococcus aureus
NGTTWSWSYEAANGQTTGF

SEQ ID NO: 1723560 - protein, 17 aa, Staphylococcus aureus
NGYKSYIQPLKVEDQKN

SEQ ID NO: 1723561 - protein, 18 aa, Staphylococcus aureus
NHIILLNIDGKSADSVEG

SEQ ID NO: 1723562 - protein, 20 aa, Staphylococcus aureus
NHLIPKFEAYYKSAKNLPDD

SEQ ID NO: 1723563 - protein, 17 aa, Staphylococcus aureus
NHQLFLLGKDKEEYKEG

SEQ ID NO: 1723564 - protein, 27 aa, Staphylococcus aureus
NIADKPISKQAGHPVFYVYAGNQGNAS

SEQ ID NO: 1723565 - protein, 27 aa, Staphylococcus aureus
NIADKYNVIITTNVGVFKPHAVRDMNG

SEQ ID NO: 1723566 - protein, 25 aa, Staphylococcus aureus
NIAEKPFSKQAGHPVFYVYAGNQGN

SEQ ID NO: 1723567 - protein, 38 aa, Staphylococcus aureus
NIDDFVDDPLSYVKTPSNKVLGFYPTNANTNAFRPGGV

SEQ ID NO: 1723568 - protein, 23 aa, Staphylococcus aureus
NIDQATKLQPIAELVDQATQLNQ

SEQ ID NO: 1723569 - protein, 28 aa, Staphylococcus aureus
NIDTPKNIDFNEKLTYRTASDVVINNAQ

SEQ ID NO: 1723570 - protein, 20 aa, Staphylococcus aureus
NIFPYTGVVAFNSATGFVVG

SEQ ID NO: 1723571 - protein, 18 aa, Staphylococcus aureus
NIGDIKQYFTLSNGQAIP

SEQ ID NO: 1723572 - protein, 20 aa, Staphylococcus aureus
NIMAVSWYQNSAEAKALYLQ

SEQ ID NO: 1723573 - protein, 30 aa, Staphylococcus aureus
NKGHAPHENMIFWFALPADQVPVGRTDFVT

SEQ ID NO: 1723574 - protein, 17 aa, Staphylococcus aureus
NKLKIKDAIKWLHHNVY

SEQ ID NO: 1723575 - protein, 28 aa, Staphylococcus aureus
NKMRRIYRRKLTYILKRLKPYKEQLDIQ

SEQ ID NO: 1723576 - protein, 22 aa, Staphylococcus aureus
NKNIIIKSIAALTILTSITGVG

SEQ ID NO: 1723577 - protein, 27 aa, Staphylococcus aureus
NKNTNMLTFHKYNLYNLTMNEYNDIFN

SEQ ID NO: 1723578 - protein, 30 aa, Staphylococcus aureus
NKTGQSYIFAKNKLYPIPGGSIMGIPTDIK

SEQ ID NO: 1723579 - protein, 20 aa, Staphylococcus aureus
NKVLGFYPTSANTNAFRPGG

SEQ ID NO: 1723580 - protein, 19 aa, Staphylococcus aureus
NLDMLISSLSFADYEKYEE

SEQ ID NO: 1723581 - protein, 22 aa, Staphylococcus aureus
NLKANYDNAIANAAHELDKVQG

SEQ ID NO: 1723582 - protein, 19 aa, Staphylococcus aureus
NLKKIKRIQLNSITIFLMG

SEQ ID NO: 1723583 - protein, 39 aa, Staphylococcus aureus
NLNIDDFIDDPLSYVRTPSNKVLGFYPTSANPNGRRPGG

SEQ ID NO: 1723584 - protein, 43 aa, Staphylococcus aureus
NLNIDDFMDDPLSYVKTPSNKVLGFYPTSANTNAFRPGGVNPL

SEQ ID NO: 1723585 - protein, 44 aa, Staphylococcus aureus
NLNIDDFVDDPLSYVKTPSNKVLGFYPTNATTNAFRPGGVQELN

SEQ ID NO: 1723586 - protein, 30 aa, Staphylococcus aureus
NLNIDDFVDDPLSYVKTPSNKVLGFYSNNA

SEQ ID NO: 1723587 - protein, 21 aa, Staphylococcus aureus
NLNWWDYEIGTPKSLTNTLIL

SEQ ID NO: 1723588 - protein, 23 aa, Staphylococcus aureus
NLNWWDYEIGTPRALTNTLILLK

SEQ ID NO: 1723589 - protein, 23 aa, Staphylococcus aureus
NLNWWDYEIGTPRALTNTLILLN

SEQ ID NO: 1723590 - protein, 27 aa, Staphylococcus aureus
NLRFKYRGMKIQVLLLGNDKNRFQQRS

SEQ ID NO: 1723591 - protein, 23 aa, Staphylococcus aureus
NLYTSGQCTYYVFDRVGGKIGST

SEQ ID NO: 1723592 - protein, 20 aa, Staphylococcus aureus
NMKVTDFHKTPMGGYFIVGY

SEQ ID NO: 1723593 - protein, 17 aa, Staphylococcus aureus
NMNMYTRLLLLDENDHL

SEQ ID NO: 1723594 - protein, 42 aa, Staphylococcus aureus
NMSNAVTILPDDIPPTINNPVGLNAKYYRGDEVSFTMGVSDR

SEQ ID NO: 1723595 - protein, 21 aa, Staphylococcus aureus
NNAVNLSQWEQNRANELKSNP

SEQ ID NO: 1723596 - protein, 23 aa, Staphylococcus aureus
NNEDTFMGQFLIKMGIQPEVTKD

SEQ ID NO: 1723597 - protein, 21 aa, Staphylococcus aureus
NNKIVPAQDYLALKSQIKVDD

SEQ ID NO: 1723598 - protein, 18 aa, Staphylococcus aureus
NNPVGINAKYYRGDEVNF

SEQ ID NO: 1723599 - protein, 25 aa, Staphylococcus aureus
NNVLSSSSIKLFKADNTPLTITNTT

SEQ ID NO: 1723600 - protein, 25 aa, Staphylococcus aureus
NPKNVIFLVGDGMGPSFNTAYRYYK

SEQ ID NO: 1723601 - protein, 26 aa, Staphylococcus aureus
NPNDYDFSKLYWGAKYNVSISSQSND

SEQ ID NO: 1723602 - protein, 19 aa, Staphylococcus aureus
NPSTLTAPATHTVNKTEIV

SEQ ID NO: 1723603 - protein, 27 aa, Staphylococcus aureus
NPTYPKMQTFHEFSVYNLTMEEYNEIS

SEQ ID NO: 1723604 - protein, 27 aa, Staphylococcus aureus
NQDNGYYSYYYYNGYNNYNYNYNNYNN

SEQ ID NO: 1723605 - protein, 21 aa, Staphylococcus aureus
NQIRALIFYNNVVASNMSNAV

SEQ ID NO: 1723606 - protein, 22 aa, Staphylococcus aureus
NQKIYVYNWGEYIDPELIKKFE

SEQ ID NO: 1723607 - protein, 18 aa, Staphylococcus aureus
NQLPPLIQSGFNPSFITT

SEQ ID NO: 1723608 - protein, 21 aa, Staphylococcus aureus
NQMLNKLYVIKQRNKEKLSIT

SEQ ID NO: 1723609 - protein, 19 aa, Staphylococcus aureus
NQTGSKKGWLYGYSEIDSS

SEQ ID NO: 1723610 - protein, 24 aa, Staphylococcus aureus
NQVPNVVLGLTHQRYLAIHEAIKE

SEQ ID NO: 1723611 - protein, 26 aa, Staphylococcus aureus
NRANKRMVWPFQYNIGLTSKDQNTSL

SEQ ID NO: 1723612 - protein, 19 aa, Staphylococcus aureus
NRKGMIPNRLNKFSIRKYS

SEQ ID NO: 1723613 - protein, 32 aa, Staphylococcus aureus; identical to SEQ ID NO: 1591891

SEQ ID NO: 1723614 - protein, 23 aa, Staphylococcus aureus
NRQTEDLTILSKVKPDPPRIDAN

SEQ ID NO: 1723615 - protein, 24 aa, Staphylococcus aureus
NRQTEDLTILSKVKPDPPRIDANS

SEQ ID NO: 1723616 - protein, 23 aa, Staphylococcus aureus
NRQTEELTILSKVKPDPPRIDGN

SEQ ID NO: 1723617 - protein, 31 aa, Staphylococcus aureus
NRVNDRLTLAINQLVPLADNSALRTAKTKLD

SEQ ID NO: 1723618 - protein, 26 aa, Staphylococcus aureus
NSDNKYGYVLYPGLSKDVFKSKASQV

SEQ ID NO: 1723619 - protein, 26 aa, Staphylococcus aureus
NSDNKYGYVLYPSLSKDVFKSKASQV

SEQ ID NO: 1723620 - protein, 24 aa, Staphylococcus aureus
NSELIFEFNTMTTKNYQGMTNLVI

SEQ ID NO: 1723621 - protein, 24 aa, Staphylococcus aureus
NSELIFEFNTMTTKNYQGVTNLII

SEQ ID NO: 1723622 - protein, 25 aa, Staphylococcus aureus
NSETLVPVNLTVLPEIQHNIKFFKN

SEQ ID NO: 1723623 - protein, 27 aa, Staphylococcus aureus
NSETLVPVNLTVLPEIQHNIKFFKNDD

SEQ ID NO: 1723624 - protein, 19 aa, Staphylococcus aureus
NSHVDIKSELGYEGGQNSG

SEQ ID NO: 1723625 - protein, 22 aa, Staphylococcus aureus
NSHYTIASIAEYNKLKQQADTI

SEQ ID NO: 1723626 - protein, 24 aa, Staphylococcus aureus
NSKISQLNLLFVKDIKKIDIDVKT

SEQ ID NO: 1723627 - protein, 25 aa, Staphylococcus aureus
NSLKQAIAGLNPDLAPLQTAKTQLQ

SEQ ID NO: 1723628 - protein, 24 aa, Staphylococcus aureus
NSLKQAIAGLTPDLAPLQTAKTQL

SEQ ID NO: 1723629 - protein, 25 aa, Staphylococcus aureus
NSLKQAIAGLTPDLAPLQTAKTQLQ

SEQ ID NO: 1723630 - protein, 34 aa, Staphylococcus aureus
NSLNWWDYEIGTPRALTNTLLLMDNMLTKDEMKN

SEQ ID NO: 1723631 - protein, 30 aa, Staphylococcus aureus
NSNILGMTQGRYELIYEGLKNQSTEFLKEI

SEQ ID NO: 1723632 - protein, 25 aa, Staphylococcus aureus
NSPARLMPDKILDLKYKLRVNNVPT

SEQ ID NO: 1723633 - protein, 23 aa, Staphylococcus aureus
NSVLAQLQNIYDAAIGQLDHDRS

SEQ ID NO: 1723634 - protein, 22 aa, Staphylococcus aureus
NTAMGQLQHAIADKTNTLASSK

SEQ ID NO: 1723635 - protein, 22 aa, Staphylococcus aureus
NTAMGQLQHAIADKTTTLASSK

SEQ ID NO: 1723636 - protein, 23 aa, Staphylococcus aureus
NTDDFVYKIQLPEGVEYVNNSLT

SEQ ID NO: 1723637 - protein, 30 aa, Staphylococcus aureus
NTITIRPQDYIVFIPPVGKQIRAVVYYNKV

SEQ ID NO: 1723638 - protein, 22 aa, Staphylococcus aureus
NTNVAPYSGVTWMGAGTGFVVG

SEQ ID NO: 1723639 - protein, 17 aa, Staphylococcus aureus
NTPLNVTNITYGSGYTS

SEQ ID NO: 1723640 - protein, 29 aa, Staphylococcus aureus
NTTGQSYIFAKNKLYPIPGGSIMGIPTDI

SEQ ID NO: 1723641 - protein, 31 aa, Staphylococcus aureus
NTTLTSWIDDGFMPLIYKGEMMDLSRGRAIS

SEQ ID NO: 1723642 - protein, 38 aa, Staphylococcus aureus
NTVTIRPQDYVVFIPPVGKQIRAVVYYNKVVASNMSNA

SEQ ID NO: 1723643 - protein, 17 aa, Staphylococcus aureus
NVAKTGTAHLFKVPTDA

SEQ ID NO: 1723644 - protein, 31 aa, Staphylococcus aureus
NVDMRGTFLMTKMMLPLMMTQGGSIVNTSSF

SEQ ID NO: 1723645 - protein, 18 aa, Staphylococcus aureus
NVSHLKIQFVPKNDAITD

SEQ ID NO: 1723646 - protein, 17 aa, Staphylococcus aureus
NVTLHYRDGSSTTLDAT

SEQ ID NO: 1723647 - protein, 19 aa, Staphylococcus aureus
NVYDLAAGSLNRYYKRTIM

SEQ ID NO: 1723648 - protein, 18 aa, Staphylococcus aureus
NYDTLLLGIEMSRKTLYS

SEQ ID NO: 1723649 - protein, 25 aa, Staphylococcus aureus
NYEDYIELRQLRYIYDVYFDRDDRI

SEQ ID NO: 1723650 - protein, 25 aa, Staphylococcus aureus
NYLTGFITGPLLSKKYLSDVPIKDL

SEQ ID NO: 1723651 - protein, 24 aa, Staphylococcus aureus
PAEQGRFLKFFVDAGLIKVKKGVK

SEQ ID NO: 1723652 - protein, 26 aa, Staphylococcus aureus
PAESPGVPKVYTFIGQGDASYTISFK

SEQ ID NO: 1723653 - protein, 18 aa, Staphylococcus aureus
PARPQFNKTPKYVKYRDA

SEQ ID NO: 1723654 - protein, 20 aa, Staphylococcus aureus
PASINAYNNSMHALQAELTS

SEQ ID NO: 1723655 - protein, 29 aa, Staphylococcus aureus
PASTKAFGRQIFEYINGERPTESPGVPRV

SEQ ID NO: 1723656 - protein, 18 aa, Staphylococcus aureus
PDATITWVSGQAPNKNNT

SEQ ID NO: 1723657 - protein, 18 aa, Staphylococcus aureus
PDLIIADVSRHKKIKSEL

SEQ ID NO: 1723658 - protein, 20 aa, Staphylococcus aureus
PEIELGLQSGQFWRKFEVYE

SEQ ID NO: 1723659 - protein, 32 aa, Staphylococcus aureus
PELSFASKYRYPALVRSGFNPEFLTYISNEKT

SEQ ID NO: 1723660 - protein, 24 aa, Staphylococcus aureus
PESGEKFYPTKYLLIYNDNKTVES

SEQ ID NO: 1723661 - protein, 22 aa, Staphylococcus aureus
PFNDKIPYIKEPKLTKQNIEQA

SEQ ID NO: 1723662 - protein, 24 aa, Staphylococcus aureus
PGDKPVATMWESKGKITYLKGEAM

SEQ ID NO: 1723663 - protein, 30 aa, Staphylococcus aureus
PHNAQRVTLKYKWKFGEGIKAGDYFDFTLS

SEQ ID NO: 1723664 - protein, 32 aa, Staphylococcus aureus
PIRAGYSLEIKVPLNAIKIPKSVLTKGNNVFI

SEQ ID NO: 1723665 - protein, 24 aa, Staphylococcus aureus
PKDYNYSQFYWSGKYNVSVSSESN

SEQ ID NO: 1723666 - protein, 32 aa, Staphylococcus aureus
PKRGPSLYSIIPMIEMMFGVHFIKGGMYGMVQ

SEQ ID NO: 1723667 - protein, 22 aa, Staphylococcus aureus
PKRVPSLYSIISMIEMMFGVHF

SEQ ID NO: 1723668 - protein, 29 aa, Staphylococcus aureus
PKRVVVLEYSFADYLAALDMKPVGIADDG

SEQ ID NO: 1723669 - protein, 25 aa, Staphylococcus aureus
PLDPSSLVYIVYPNEHTRDGGTEAD

SEQ ID NO: 1723670 - protein, 20 aa, Staphylococcus aureus
PLEKLLSKELGIPVKVSVST

SEQ ID NO: 1723671 - protein, 19 aa, Staphylococcus aureus
PLITSGFNPSFIATVSHEK

SEQ ID NO: 1723672 - protein, 24 aa, Staphylococcus aureus
PLNEYQLSQLFTDDKLQQAARTGS

SEQ ID NO: 1723673 - protein, 20 aa, Staphylococcus aureus
PLNVTNITYGSGYTSVVTVS

SEQ ID NO: 1723674 - protein, 19 aa, Staphylococcus aureus
PLVQSGFNPSFITTLSHEK

SEQ ID NO: 1723675 - protein, 38 aa, Staphylococcus aureus; identical to SEQ ID NO: 1597189

SEQ ID NO: 1723676 - protein, 39 aa, Staphylococcus aureus
PNVAKVVNAKYDIIYNGHTFATSLPAKFVVKDVQPAKPT

SEQ ID NO: 1723677 - protein, 20 aa, Staphylococcus aureus
PSGYTILATGTPDGVHNTIT

SEQ ID NO: 1723678 - protein, 24 aa, Staphylococcus aureus
PSNTEILYELGLGKYIVGVSTVDD

SEQ ID NO: 1723679 - protein, 31 aa, Staphylococcus aureus
PSVTVVDNLPGFTLINGGKVGVFSHAMVRTS

SEQ ID NO: 1723680 - protein, 17 aa, Staphylococcus aureus
PTALTGDEKQRIITAFM

SEQ ID NO: 1723681 - protein, 20 aa, Staphylococcus aureus
PTDGGLSWSDDHKSLIYRYD

SEQ ID NO: 1723682 - protein, 35 aa, Staphylococcus aureus
PTDGGLSWSDDHKSLIYRYDATLGTQITTNDILTL

SEQ ID NO: 1723683 - protein, 35 aa, Staphylococcus aureus
PTDGGLSWSDDHKSLIYRYDATLGTQITTNDILTM

SEQ ID NO: 1723684 - protein, 30 aa, Staphylococcus aureus
PTESPGVPKVYTFIGKGDASYTISFKTQGP

SEQ ID NO: 1723685 - protein, 29 aa, Staphylococcus aureus
PTESPGVPRVYTFIGKGDASYTISFKTQG

SEQ ID NO: 1723686 - protein, 21 aa, Staphylococcus aureus
PTNNALKLLLKGTGNLKGSSV

SEQ ID NO: 1723687 - protein, 26 aa, Staphylococcus aureus
PTVTVVDNLPGYTLINGGKVGVFSHA

SEQ ID NO: 1723688 - protein, 18 aa, Staphylococcus aureus
PVEKLGIKALSKYELEIK

SEQ ID NO: 1723689 - protein, 18 aa, Staphylococcus aureus
PVIAFLINPILPNNNWNI

SEQ ID NO: 1723690 - protein, 17 aa, Staphylococcus aureus
PVKHVIPDIVAHSHYTV

SEQ ID NO: 1723691 - protein, 18 aa, Staphylococcus aureus
PVKRVIPEIVAHSHYTVQ

SEQ ID NO: 1723692 - protein, 24 aa, Staphylococcus aureus
PVPEDHAYIRFPVSDGTQELKIVS

SEQ ID NO: 1723693 - protein, 25 aa, Staphylococcus aureus
PVTAYDFVYAWRKLVDPKTGSEYAY

SEQ ID NO: 1723694 - protein, 17 aa, Staphylococcus aureus
PYTIAVNGASNPTLSDL

SEQ ID NO: 1723695 - protein, 19 aa, Staphylococcus aureus
PYYKRMIMMNQYRAKAALK

SEQ ID NO: 1723696 - protein, 26 aa, Staphylococcus aureus
QADYTFASLDIFNDLKRRAQTILAEN

SEQ ID NO: 1723697 - protein, 25 aa, Staphylococcus aureus
QADYTFASLDIFNDLKRRAQTILDE

SEQ ID NO: 1723698 - protein, 22 aa, Staphylococcus aureus
QAINQLVPLADNSALRTAKTKL

SEQ ID NO: 1723699 - protein, 23 aa, Staphylococcus aureus
QAINQLVPLADNSALRTAKTKLD

SEQ ID NO: 1723700 - protein, 20 aa, Staphylococcus aureus
QAKYTVYFKNGAKRVIDLKA

SEQ ID NO: 1723701 - protein, 25 aa, Staphylococcus aureus
QAQKKINPKFKGLRSYYTKPSLEFK

SEQ ID NO: 1723702 - protein, 40 aa, Staphylococcus aureus
QDGEIPTLDPIRSIAPSVYLINMNMYTRLLLLDENDHLTT

SEQ ID NO: 1723703 - protein, 33 aa, Staphylococcus aureus
QDNATLSNWIYEGFMPLIYKGEMMDLSRGRAIS

SEQ ID NO: 1723704 - protein, 20 aa, Staphylococcus aureus
QEKFLQHDLLFKINGSKIDG

SEQ ID NO: 1723705 - protein, 28 aa, Staphylococcus aureus
QEKQNHQLFLLGKDKYKKGLEGQNVFVV

SEQ ID NO: 1723706 - protein, 18 aa, Staphylococcus aureus
QFFMDNFGLKVKATNVVG

SEQ ID NO: 1723707 - protein, 25 aa, Staphylococcus aureus
QGLNEYQISQLFSDEKLQQAARNRT

SEQ ID NO: 1723708 - protein, 20 aa, Staphylococcus aureus
QGNYHYTWTGNWNPSQLTQN

SEQ ID NO: 1723709 - protein, 26 aa, Staphylococcus aureus
QGTRNVEVPVKVYPVANAKAPSRDVK

SEQ ID NO: 1723710 - protein, 18 aa, Staphylococcus aureus
QHAIADKTTTLASSKFVN

SEQ ID NO: 1723711 - protein, 22 aa, Staphylococcus aureus
QHEARENLYNKLDLIVGRSDDE

SEQ ID NO: 1723712 - protein, 22 aa, Staphylococcus aureus
QHLNVDVTYPGISAAKRVPVTV

SEQ ID NO: 1723713 - protein, 27 aa, Staphylococcus aureus
QHTQFIVDEILAIKLPAEETKVSPKEI

SEQ ID NO: 1723714 - protein, 21 aa, Staphylococcus aureus
QILRLLFLLAMYELGKYVTEQ

SEQ ID NO: 1723715 - protein, 17 aa, Staphylococcus aureus
QINQVLAGSPTVDQINT

SEQ ID NO: 1723716 - protein, 17 aa, Staphylococcus aureus
QIPSGYTILATGTPDGV

SEQ ID NO: 1723717 - protein, 25 aa, Staphylococcus aureus
QITTNDILTMLKATTTVAGLRNNIA

SEQ ID NO: 1723718 - protein, 25 aa, Staphylococcus aureus
QITTNDILTMLKATTTVPGLRNNIT

SEQ ID NO: 1723719 - protein, 26 aa, Staphylococcus aureus
QITTNDILTMLKATTTVPGLRNNITG

SEQ ID NO: 1723720 - protein, 18 aa, Staphylococcus aureus
QKLDYKARHWLTKEKSYT

SEQ ID NO: 1723721 - protein, 23 aa, Staphylococcus aureus
QKLSTITLLMAGAITLNGGEFRS

SEQ ID NO: 1723722 - protein, 23 aa, Staphylococcus aureus
QKLSTITLLMAGGITFNDSEFRS

SEQ ID NO: 1723723 - protein, 32 aa, Staphylococcus aureus
QKLSTITLLMAGVIILNGGEFRSIDKHQIAVA

SEQ ID NO: 1723724 - protein, 33 aa, Staphylococcus aureus
QKLSTITLLMAGVIILNGGEFRSIDKHQIAVAN

SEQ ID NO: 1723725 - protein, 22 aa, Staphylococcus aureus
QKLSTITLLMAGVITLNGGEFR

SEQ ID NO: 1723726 - protein, 23 aa, Staphylococcus aureus
QKLSTITLLMAGVITLNNGEFRN

SEQ ID NO: 1723727 - protein, 23 aa, Staphylococcus aureus
QKLSTITLLMAGVITLSDGEFRS

SEQ ID NO: 1723728 - protein, 22 aa, Staphylococcus aureus
QKLSTITLLMVGVITLNNGEFR

SEQ ID NO: 1723729 - protein, 17 aa, Staphylococcus aureus
QLAYLTVSPQLYHDKEH

SEQ ID NO: 1723730 - protein, 17 aa, Staphylococcus aureus
QLPPLVQSGFNPSFITT

SEQ ID NO: 1723731 - protein, 21 aa, Staphylococcus aureus
QLRKRYNIPTKKAPKLLLKGS

SEQ ID NO: 1723732 - protein, 23 aa, Staphylococcus aureus
QNAPNEALSFDDNNIRPSTNRSV

SEQ ID NO: 1723733 - protein, 28 aa, Staphylococcus aureus
QNASGLPTDGFTYKWNNAATGTNDANWV

SEQ ID NO: 1723734 - protein, 19 aa, Staphylococcus aureus
QNHQLFLLGKDKEEYKEGI

SEQ ID NO: 1723735 - protein, 19 aa, Staphylococcus aureus
QNIVVIQPATQVKTDARNA

SEQ ID NO: 1723736 - protein, 18 aa, Staphylococcus aureus
QNNGSYSLNIENLDKTYV

SEQ ID NO: 1723737 - protein, 23 aa, Staphylococcus aureus
QNQKFKVFLLGKDENKYKEKTHG

SEQ ID NO: 1723738 - protein, 21 aa, Staphylococcus aureus
QNQYQYVPPQQQAPTKQRPAK

SEQ ID NO: 1723739 - protein, 23 aa, Staphylococcus aureus
QNTWVIDSFYFRYKQQNYIVLVK

SEQ ID NO: 1723740 - protein, 22 aa, Staphylococcus aureus
QQLNVDVTYPGISAAKRVPVTV

SEQ ID NO: 1723741 - protein, 17 aa, Staphylococcus aureus
QQNAFYEILHLPNLNEE

SEQ ID NO: 1723742 - protein, 22 aa, Staphylococcus aureus
QQNAFYQVLNMPNLNADQRNGF

SEQ ID NO: 1723743 - protein, 29 aa, Staphylococcus aureus
QRQFTLNGQVIQILDIINPSNGYGGQPVT

SEQ ID NO: 1723744 - protein, 20 aa, Staphylococcus aureus
QSIITAFMNKNQNIRGYLAS

SEQ ID NO: 1723745 - protein, 21 aa, Staphylococcus aureus
QSIITAFMNKNQNIRGYLAST

SEQ ID NO: 1723746 - protein, 17 aa, Staphylococcus aureus
QSLINKYPQIQKNMKSE

SEQ ID NO: 1723747 - protein, 18 aa, Staphylococcus aureus
QSWQAYDYVFLTCGTFAY

SEQ ID NO: 1723748 - protein, 28 aa, Staphylococcus aureus
QTAIINSLTFTETVPNRSYARASANEIT

SEQ ID NO: 1723749 - protein, 27 aa, Staphylococcus aureus
QTAIINSLTFTETVPNRSYARASTNEI

SEQ ID NO: 1723750 - protein, 23 aa, Staphylococcus aureus
QTIRLMEEFLRNGNKEEIAYHQA

SEQ ID NO: 1723751 - protein, 22 aa, Staphylococcus aureus
QTLDHAMELLRNSVADNQTTLA

SEQ ID NO: 1723752 - protein, 20 aa, Staphylococcus aureus
QTLYNCISMIVKIGIVCMHH

SEQ ID NO: 1723753 - protein, 24 aa, Staphylococcus aureus
QTTIINSLTFTSNAPNRNYATASA

SEQ ID NO: 1723754 - protein, 25 aa, Staphylococcus aureus
QTTNAEIATIKNSALEQLKAQRINP

SEQ ID NO: 1723755 - protein, 17 aa, Staphylococcus aureus
QTTNPMLNPDDITRALT

SEQ ID NO: 1723756 - protein, 27 aa, Staphylococcus aureus
QVFETTRGVLYPGVSDMYDAKQYVKPV

SEQ ID NO: 1723757 - protein, 21 aa, Staphylococcus aureus
QVIQVLDIINPTNGFGGQTIT

SEQ ID NO: 1723758 - protein, 25 aa, Staphylococcus aureus
QVIYDWPTVHINSLKDLARASDYFS

SEQ ID NO: 1723759 - protein, 17 aa, Staphylococcus aureus
QVQAAITPYYTYNGYIG

SEQ ID NO: 1723760 - protein, 17 aa, Staphylococcus aureus
QWTIANKPDYVTLDAHT

SEQ ID NO: 1723761 - protein, 17 aa, Staphylococcus aureus
QYFTLSNGQAIPNGTFT

SEQ ID NO: 1723762 - protein, 25 aa, Staphylococcus aureus
QYTGSWHNIWYLYNSDPVNAKKIKL

SEQ ID NO: 1723763 - protein, 25 aa, Staphylococcus aureus
RALEYNQLFMYSQLYVESTQDHQQR

SEQ ID NO: 1723764 - protein, 19 aa, Staphylococcus aureus
RAMVLYINRNTRTAKGYFL

SEQ ID NO: 1723765 - protein, 24 aa, Staphylococcus aureus
REELQDFWHHLADDLVKTEKVTDT

SEQ ID NO: 1723766 - protein, 19 aa, Staphylococcus aureus
RELGFVLMALNIRKIAAQR

SEQ ID NO: 1723767 - protein, 36 aa, Staphylococcus aureus
RERNIELVGNLLPGDYFGTIRFGRKEQLFEIGVKPH

SEQ ID NO: 1723768 - protein, 38 aa, Staphylococcus aureus
RERNIELVGNLLPGDYFGTIRFGRKEQLFEIRVKPHTP

SEQ ID NO: 1723769 - protein, 46 aa, Staphylococcus aureus
RERNIELVGNLLPGDYFGTIRFGRKEQLFEIRVKPHTPRITTTAEE

SEQ ID NO: 1723770 - protein, 23 aa, Staphylococcus aureus
REVKPYQLILKAGHWYCYVYCYL

SEQ ID NO: 1723771 - protein, 19 aa, Staphylococcus aureus
RGIIDVDLRLSKQAKYTVN

SEQ ID NO: 1723772 - protein, 19 aa, Staphylococcus aureus
RGISDLDLKFAKQAKYTVY

SEQ ID NO: 1723773 - protein, 22 aa, Staphylococcus aureus
RGQNNQWTIANKPDYVTLDAQT

SEQ ID NO: 1723774 - protein, 24 aa, Staphylococcus aureus
RGQVYHVFYHPLITDPKVAFTGDT

SEQ ID NO: 1723775 - protein, 18 aa, Staphylococcus aureus
RGTALQKVPVTVSGVPLD

SEQ ID NO: 1723776 - protein, 20 aa, Staphylococcus aureus
RGVLYPGVSDMYDAKQYVKP

SEQ ID NO: 1723777 - protein, 22 aa, Staphylococcus aureus
RGYRRVVPSPQPISIIELESIK

SEQ ID NO: 1723778 - protein, 25 aa, Staphylococcus aureus
RHGGTAISWIIKPLSRKHAVLVKKY

SEQ ID NO: 1723779 - protein, 18 aa, Staphylococcus aureus
RHNGKIINIFDDMSEKDK

SEQ ID NO: 1723780 - protein, 19 aa, Staphylococcus aureus
RIQLNSITIFLMGINITLY

SEQ ID NO: 1723781 - protein, 29 aa, Staphylococcus aureus
RIQQADYTFASLDIFNDLKKRAQTILAEN

SEQ ID NO: 1723782 - protein, 23 aa, Staphylococcus aureus
RIWLYLVLLAVFIGACGMKKEES

SEQ ID NO: 1723783 - protein, 22 aa, Staphylococcus aureus
RIWLYLVLLAVFISACNVKEDK

SEQ ID NO: 1723784 - protein, 17 aa, Staphylococcus aureus
RLHNIIFSDDFRGNIEE

SEQ ID NO: 1723785 - protein, 19 aa, Staphylococcus aureus
RLKSRGMVLKLDRNKRTAK

SEQ ID NO: 1723786 - protein, 23 aa, Staphylococcus aureus
RLNKFSIRKYTVGTASILVGTTL

SEQ ID NO: 1723787 - protein, 19 aa, Staphylococcus aureus
RLQKWYDKGYLPKVATHDV

SEQ ID NO: 1723788 - protein, 22 aa, Staphylococcus aureus
RLWLYLVLLAVFIGACGMKKEE

SEQ ID NO: 1723789 - protein, 24 aa, Staphylococcus aureus
RLWLYLVLLAVFISACGMKEDKQI

SEQ ID NO: 1723790 - protein, 26 aa, Staphylococcus aureus
RLYNGETLNFVIVDPITGVQLSQGFV

SEQ ID NO: 1723791 - protein, 19 aa, Staphylococcus aureus
RMENTPAYYKLYGDKIVGF

SEQ ID NO: 1723792 - protein, 17 aa, Staphylococcus aureus
RMIMMNQYRAKAALKSN

SEQ ID NO: 1723793 - protein, 23 aa, Staphylococcus aureus
RNDLKGIKNVYVTEIPKGSKVNP

SEQ ID NO: 1723794 - protein, 17 aa, Staphylococcus aureus
RNKNFKVFLIGDDRNKY

SEQ ID NO: 1723795 - protein, 22 aa, Staphylococcus aureus
RNKYVDIFALKDYETWHTYMLA

SEQ ID NO: 1723796 - protein, 18 aa, Staphylococcus aureus
RNLKIQFVSKNDAITDAR

SEQ ID NO: 1723797 - protein, 30 aa, Staphylococcus aureus
RNRSGQVIYDWPTVHIYSLEDLSRASDYFS

SEQ ID NO: 1723798 - protein, 22 aa, Staphylococcus aureus
RNSILAQLQNIYDTAIGQIDQD

SEQ ID NO: 1723799 - protein, 28 aa, Staphylococcus aureus
RQFTLNGQVIQILDIINPSNGYGGQPVT

SEQ ID NO: 1723800 - protein, 20 aa, Staphylococcus aureus
RQFYHYASTVEPATVIFTKT

SEQ ID NO: 1723801 - protein, 21 aa, Staphylococcus aureus
RQGQLFLLDVFEGNIFKINPE

SEQ ID NO: 1723802 - protein, 26 aa, Staphylococcus aureus
RQRGLRAIEYYLKTKKLLSNRKKVQQ

SEQ ID NO: 1723803 - protein, 21 aa, Staphylococcus aureus
RQTEDLTILSKVKPDPPRIDA

SEQ ID NO: 1723804 - protein, 20 aa, Staphylococcus aureus
RQTQQQIIYNTPKQLAGLNG

SEQ ID NO: 1723805 - protein, 17 aa, Staphylococcus aureus
RQVVNRTYRIGTTKRVE

SEQ ID NO: 1723806 - protein, 30 aa, Staphylococcus aureus
RQYTLNGQVIQVLDIINPTNGFGGQTITNS

SEQ ID NO: 1723807 - protein, 17 aa, Staphylococcus aureus
RSCLFVAVRNRIMKMMP

SEQ ID NO: 1723808 - protein, 21 aa, Staphylococcus aureus
RSFYSIRKSTLGVASVIVSTL

SEQ ID NO: 1723809 - protein, 32 aa, Staphylococcus aureus
RSGQVIYEWPTVHINSLRDLARAGDYFSEANA

SEQ ID NO: 1723810 - protein, 33 aa, Staphylococcus aureus
RTAKGYYFVRTFYRKYKLPYRKNYKVKMKNNKI

SEQ ID NO: 1723811 - protein, 17 aa, Staphylococcus aureus
RTDLKMANFHKYNLEEL

SEQ ID NO: 1723812 - protein, 26 aa, Staphylococcus aureus
RTIAKTSLALGLLTTGAITVTTQSVK

SEQ ID NO: 1723813 - protein, 25 aa, Staphylococcus aureus
RVETNGIATLKGVQPHIVIKPEAQQ

SEQ ID NO: 1723814 - protein, 18 aa, Staphylococcus aureus
RVGWGEIPMSLGFTYSSN

SEQ ID NO: 1723815 - protein, 23 aa, Staphylococcus aureus
RVNTLKNRALNDIGVTSTAMVNS

SEQ ID NO: 1723816 - protein, 25 aa, Staphylococcus aureus
RVPVTVNVYQFEFPQTSYTTTVGGT

SEQ ID NO: 1723817 - protein, 18 aa, Staphylococcus aureus
RVYRMSTYDITTDEISKV

SEQ ID NO: 1723818 - protein, 17 aa, Staphylococcus aureus
RYGTMYIPMDETLARVV

SEQ ID NO: 1723819 - protein, 18 aa, Staphylococcus aureus
RYGTMYIPMDETLARVVV

SEQ ID NO: 1723820 - protein, 17 aa, Staphylococcus aureus
RYKQQNYIVLVKLFEKE

SEQ ID NO: 1723821 - protein, 20 aa, Staphylococcus aureus
RYSIGMFLALGMSNKAYADE

SEQ ID NO: 1723822 - protein, 26 aa, Staphylococcus aureus
RYYVVDFPFIDNSYYFGLILSFGDKC

SEQ ID NO: 1723823 - protein, 19 aa, Staphylococcus aureus
SAADYFKLSNGSAIPDATI

SEQ ID NO: 1723824 - protein, 25 aa, Staphylococcus aureus
SAEPLSHLRVIVRSLLGIAVPTQIA

SEQ ID NO: 1723825 - protein, 24 aa, Staphylococcus aureus
SAIVNANLWLRTADRIKIVVGRFN

SEQ ID NO: 1723826 - protein, 24 aa, Staphylococcus aureus
SALVLTTLGTGLHSSYLGLDTNKV

SEQ ID NO: 1723827 - protein, 25 aa, Staphylococcus aureus
SALVLTTLGTGLHSSYLGLDTNKVV

SEQ ID NO: 1723828 - protein, 35 aa, Staphylococcus aureus
SDEKLQQAARNRTPIQLMIGFDYPDSHGNAETLVP

SEQ ID NO: 1723829 - protein, 27 aa, Staphylococcus aureus
SDGKFHGQRLNDVILTYVASTGKMRAE

SEQ ID NO: 1723830 - protein, 25 aa, Staphylococcus aureus
SDKDYAYIRFPVSNGTRDVKIVSSI

SEQ ID NO: 1723831 - protein, 31 aa, Staphylococcus aureus
SDLKKYLYIKRMIWPFQYNISLKTKDSNVDL

SEQ ID NO: 1723832 - protein, 25 aa, Staphylococcus aureus
SDSSINSQFYWGAKYNVFVSSESKD

SEQ ID NO: 1723833 - protein, 25 aa, Staphylococcus aureus
SDVKKLMIIMQLQMIKLLLQLIHSN

SEQ ID NO: 1723834 - protein, 24 aa, Staphylococcus aureus
SELPPLVQSGFNPSFIATVSHEKG

SEQ ID NO: 1723835 - protein, 30 aa, Staphylococcus aureus; identical to SEQ ID NO: 1699767

SEQ ID NO: 1723836 - protein, 27 aa, Staphylococcus aureus
SESVMDGFVEHPFYTATLNGQKYVVMK

SEQ ID NO: 1723837 - protein, 36 aa, Staphylococcus aureus
SETGILLHNIYDLKPLKSFVYGRTILLGDAAHVTTP

SEQ ID NO: 1723838 - protein, 34 aa, Staphylococcus aureus
SETGILLHNIYDLKPLKSFVYGRTILLGDVAHAT

SEQ ID NO: 1723839 - protein, 24 aa, Staphylococcus aureus
SETLVPVNLTVLPEIQHNIKFFKN

SEQ ID NO: 1723840 - protein, 23 aa, Staphylococcus aureus
SETNWKYKFKDLPKYDEGKKIEY

SEQ ID NO: 1723841 - protein, 26 aa, Staphylococcus aureus
SFSIGDIKQYFTLSNGQAIPSGTFTN

SEQ ID NO: 1723842 - protein, 34 aa, Staphylococcus aureus
SFTSNLNNMNFLRWVNFPQDYTVTWTNAKIANRP

SEQ ID NO: 1723843 - protein, 23 aa, Staphylococcus aureus
SGLPTDGFTYKWNNAATGTNDAN

SEQ ID NO: 1723844 - protein, 19 aa, Staphylococcus aureus
SGYTILATGTPDGVHNTIT

SEQ ID NO: 1723845 - protein, 19 aa, Staphylococcus aureus
SHKFFVSKSWINNAPTKED

SEQ ID NO: 1723846 - protein, 33 aa, Staphylococcus aureus
SHNDDLPYAELALGAGMAFLIRRFTKKDHQTEE

SEQ ID NO: 1723847 - protein, 17 aa, Staphylococcus aureus
SHVDIKSELGYEGGQNS

SEQ ID NO: 1723848 - protein, 18 aa, Staphylococcus aureus
SIAALTILTSITGVGTTM

SEQ ID NO: 1723849 - protein, 18 aa, Staphylococcus aureus
SIAALTILTSITGVGTTV

SEQ ID NO: 1723850 - protein, 20 aa, Staphylococcus aureus
SIAVLTILTSITGVGTTVVE

SEQ ID NO: 1723851 - protein, 17 aa, Staphylococcus aureus
SIDKINQFLKGKGVLEN

SEQ ID NO: 1723852 - protein, 24 aa, Staphylococcus aureus
SIGDIKQYFTLSNGQPIPSGTFTN

SEQ ID NO: 1723853 - protein, 22 aa, Staphylococcus aureus
SIIDDFFMETGQNRPVKITKYN

SEQ ID NO: 1723854 - protein, 18 aa, Staphylococcus aureus
SIKDVLTKYKNPMYSYNE

SEQ ID NO: 1723855 - protein, 26 aa, Staphylococcus aureus
SIKNTLSNLLSFWKSSIKNTLSNLLS

SEQ ID NO: 1723856 - protein, 20 aa, Staphylococcus aureus
SILGIAAISLTVSTFAGESH

SEQ ID NO: 1723857 - protein, 35 aa, Staphylococcus aureus; identical to SEQ ID NO: 1691589

SEQ ID NO: 1723858 - protein, 33 aa, Staphylococcus aureus
SIRKFSVGASSILIATLLFLSGGQAQATEKQVN

SEQ ID NO: 1723859 - protein, 20 aa, Staphylococcus aureus
SITLLIVPDLIRLNKTFLIE

SEQ ID NO: 1723860 - protein, 23 aa, Staphylococcus aureus
SITLLIVPDLIRLNKTFLIESRE

SEQ ID NO: 1723861 - protein, 20 aa, Staphylococcus aureus
SITLLIVPDLIRLSKTFLIE

SEQ ID NO: 1723862 - protein, 32 aa, Staphylococcus aureus
SIYLYGTVNGKSGWISKAYLAVPAAPKKAVAQ

SEQ ID NO: 1723863 - protein, 18 aa, Staphylococcus aureus
SKDPRDYFVPDSELPPLV

SEQ ID NO: 1723864 - protein, 24 aa, Staphylococcus aureus
SKGKITYLKGEAMQYDLSTTGGNS

SEQ ID NO: 1723865 - protein, 23 aa, Staphylococcus aureus
SKISQLNLLFVKDIKKIDIDVKT

SEQ ID NO: 1723866 - protein, 24 aa, Staphylococcus aureus
SKVKQAFINANRDAITFAEGDISV

SEQ ID NO: 1723867 - protein, 30 aa, Staphylococcus aureus
SKVNKTYNYKYFYTYKVVKGVKKHFSFSKS

SEQ ID NO: 1723868 - protein, 21 aa, Staphylococcus aureus
SLALGILTTGMITTTAQPVKA

SEQ ID NO: 1723869 - protein, 20 aa, Staphylococcus aureus
SLATLTILTSVAGIGTTLVE

SEQ ID NO: 1723870 - protein, 27 aa, Staphylococcus aureus
SLDTDEFVYKIQLPEGVEYVNNSLTKD

SEQ ID NO: 1723871 - protein, 19 aa, Staphylococcus aureus
SLFILFLSIKRIKYLLDKE

SEQ ID NO: 1723872 - protein, 17 aa, Staphylococcus aureus
SLFVAILSVLIFTDNAN

SEQ ID NO: 1723873 - protein, 29 aa, Staphylococcus aureus
SLGNKFAIFLMVVLVVLGGVYASAKLKLE

SEQ ID NO: 1723874 - protein, 17 aa, Staphylococcus aureus
SLHNISISNLRILEVRE

SEQ ID NO: 1723875 - protein, 21 aa, Staphylococcus aureus
SLIVTSTLVFSSMPFQNAHAD

SEQ ID NO: 1723876 - protein, 24 aa, Staphylococcus aureus
SLKKVATLALANLLLVGALTDNSA

SEQ ID NO: 1723877 - protein, 22 aa, Staphylococcus aureus
SLKQAIAGLTPDLAPLQTAKTQ

SEQ ID NO: 1723878 - protein, 19 aa, Staphylococcus aureus
SLLLAAGVLFVSPISLSYN

SEQ ID NO: 1723879 - protein, 32 aa, Staphylococcus aureus
SLNWWDYEIGTPRALTNTLLLMDDMLTKDEMK

SEQ ID NO: 1723880 - protein, 24 aa, Staphylococcus aureus
SNAKLPVIFWMHGGGYIAGDKQYK

SEQ ID NO: 1723881 - protein, 23 aa, Staphylococcus aureus
SNAVTILPDDIPPTINNPVGINA

SEQ ID NO: 1723882 - protein, 33 aa, Staphylococcus aureus
SNAVTILPDDIPPTINNPVGLNAKYYRGDEVSF

SEQ ID NO: 1723883 - protein, 24 aa, Staphylococcus aureus
SNDKYVTSFLLMPTVIVVNSDLQG

SEQ ID NO: 1723884 - protein, 18 aa, Staphylococcus aureus
SNEKSWIAGWHTNLDIVA

SEQ ID NO: 1723885 - protein, 29 aa, Staphylococcus aureus
SNENFTDKDWQITGIPRTLHIENSTNRPN

SEQ ID NO: 1723886 - protein, 28 aa, Staphylococcus aureus
SNENFTDRDWQITGIPRTLHIENSTNRP

SEQ ID NO: 1723887 - protein, 28 aa, Staphylococcus aureus
SNKNTNMLTFHKYNLYNLTMNEYNDIFN

SEQ ID NO: 1723888 - protein, 29 aa, Staphylococcus aureus
SNLANMNFLRWVNFPQDYTVTWTNAKIAN

SEQ ID NO: 1723889 - protein, 44 aa, Staphylococcus aureus
SNLNIDDFIDDPLSYVKTPSNKVLGFYPTNANPNVRRPGGVQEL

SEQ ID NO: 1723890 - protein, 43 aa, Staphylococcus aureus
SNMSNAVTILPDDIPPTINNPVGLNAKYYRGDEVSFTMGVSDR

SEQ ID NO: 1723891 - protein, 26 aa, Staphylococcus aureus
SNNTKIKLMNVTSTYYDKVAKALKSY

SEQ ID NO: 1723892 - protein, 23 aa, Staphylococcus aureus
SREKELLKYFPSDYKKPEEKTSD

SEQ ID NO: 1723893 - protein, 17 aa, Staphylococcus aureus
SSKRKYDDTLPPLFDEL

SEQ ID NO: 1723894 - protein, 22 aa, Staphylococcus aureus
SSLFVATLTTATLVSSTAANAL

SEQ ID NO: 1723895 - protein, 17 aa, Staphylococcus aureus
SSNPSTLTAPATHTVNK

SEQ ID NO: 1723896 - protein, 18 aa, Staphylococcus aureus
SSVASSIALLLLSNTVDA

SEQ ID NO: 1723897 - protein, 19 aa, Staphylococcus aureus
SSVATSMALLLLSSTANAE

SEQ ID NO: 1723898 - protein, 23 aa, Staphylococcus aureus
STAGYTFPLAMLKNEAGINATKD

SEQ ID NO: 1723899 - protein, 31 aa, Staphylococcus aureus
STIVFVLAIGLILSLVFSLFFNNVNAEEASQ

SEQ ID NO: 1723900 - protein, 25 aa, Staphylococcus aureus
STNAQNMNFQFVGTYGPNKDVVGIS

SEQ ID NO: 1723901 - protein, 43 aa, Staphylococcus aureus
STNLNIDDFIDDPLSYVRTPSNKVLGFYPTSANPNGRRPGGVQ

SEQ ID NO: 1723902 - protein, 29 aa, Staphylococcus aureus
STTEKFLDFDLLFKSIDWLDGISAEFKDL

SEQ ID NO: 1723903 - protein, 29 aa, Staphylococcus aureus
STTEKFLDFDLLFKSINWLDGISAEFKDL

SEQ ID NO: 1723904 - protein, 32 aa, Staphylococcus aureus
STTEKFLDFDLLFKSINWLDGISAKFKDLKVE

SEQ ID NO: 1723905 - protein, 19 aa, Staphylococcus aureus
STTVLAPLGIYSDKIKDVK

SEQ ID NO: 1723906 - protein, 17 aa, Staphylococcus aureus
STVSHFMAFNPDKDVLK

SEQ ID NO: 1723907 - protein, 28 aa, Staphylococcus aureus
SVAPKRVNAKIRFAVAQPAAVASNNVND

SEQ ID NO: 1723908 - protein, 17 aa, Staphylococcus aureus
SVFLGTMIVVGMGQEKE

SEQ ID NO: 1723909 - protein, 18 aa, Staphylococcus aureus
SVTTSMALLLLSGTANAE

SEQ ID NO: 1723910 - protein, 29 aa, Staphylococcus aureus
SVTVVDNLPGFTFINGGKVGVFSHAMVRT

SEQ ID NO: 1723911 - protein, 26 aa, Staphylococcus aureus
SVTVVDNLPGFTLINGGKVGVLSHAM

SEQ ID NO: 1723912 - protein, 29 aa, Staphylococcus aureus
SWSDDHKSLIYRYDATLGTQITTNDILTL

SEQ ID NO: 1723913 - protein, 20 aa, Staphylococcus aureus
SYNKLVAKKLQLFLIKGIQV

SEQ ID NO: 1723914 - protein, 27 aa, Staphylococcus aureus
SYSIKPGTKLYTVPWGTSKQVAGSVSG

SEQ ID NO: 1723915 - protein, 35 aa, Staphylococcus aureus
SYTISFKTQGPTTNKLYYAAGGRALEYNQLFMYSQ

SEQ ID NO: 1723916 - protein, 48 aa, Staphylococcus aureus
SYTISFKTQGPTVNKLYYAAGGRALEYNQLFMYSQLYVESTQDHQQRL

SEQ ID NO: 1723917 - protein, 22 aa, Staphylococcus aureus
SYVAPYYGQNAAPVVRQIYPFN

SEQ ID NO: 1723918 - protein, 25 aa, Staphylococcus aureus
TAEQLRGTALQKVPVNISGIPLDPS

SEQ ID NO: 1723919 - protein, 34 aa, Staphylococcus aureus
TAHLFKVPTDADRLDLQFIPDNTAVADASRITTN

SEQ ID NO: 1723920 - protein, 27 aa, Staphylococcus aureus
TAITTNDILTMLKATTTVPGLRNNIVG

SEQ ID NO: 1723921 - protein, 24 aa, Staphylococcus aureus
TAKGYYFVRTFYRKDKLPDRKNYK

SEQ ID NO: 1723922 - protein, 21 aa, Staphylococcus aureus
TAMGNLKHALAEKDTTKRSVN

SEQ ID NO: 1723923 - protein, 23 aa, Staphylococcus aureus
TAQAMFIYELRGDGNINLNVHKY

SEQ ID NO: 1723924 - protein, 38 aa, Staphylococcus aureus
TAQVINAKYDVIYNGHTFATSLPAKFVVKDVQPAKPTV

SEQ ID NO: 1723925 - protein, 17 aa, Staphylococcus aureus
TARNEITTALNNKLQEI

SEQ ID NO: 1723926 - protein, 18 aa, Staphylococcus aureus
TASTWKKFEVYEGDKKLP

SEQ ID NO: 1723927 - protein, 18 aa, Staphylococcus aureus
TDKDWQITGIPRTLHIEN

SEQ ID NO: 1723928 - protein, 20 aa, Staphylococcus aureus
TDKGVYVWKDRKDYFVGLLG

SEQ ID NO: 1723929 - protein, 29 aa, Staphylococcus aureus
TDNTNEAINIYFVPSDLVNPTISVGNYTN

SEQ ID NO: 1723930 - protein, 31 aa, Staphylococcus aureus
TDNTNEAINIYFVPSDLVNPTISVGNYTNHQ

SEQ ID NO: 1723931 - protein, 28 aa, Staphylococcus aureus
TDPIYKREYKHFYTPEEAQRAQENSDQI

SEQ ID NO: 1723932 - protein, 19 aa, Staphylococcus aureus
TDQQKAFYQVLHLKGITEE

SEQ ID NO: 1723933 - protein, 17 aa, Staphylococcus aureus
TDYVDKYEDIKARLTLY

SEQ ID NO: 1723934 - protein, 22 aa, Staphylococcus aureus
TEEVQESIFTKADKRELITAKN

SEQ ID NO: 1723935 - protein, 25 aa, Staphylococcus aureus
TEINTAMTALKRAIADKADTKTSGN

SEQ ID NO: 1723936 - protein, 18 aa, Staphylococcus aureus
TEKAPKLLLKGSGDLKGA

SEQ ID NO: 1723937 - protein, 22 aa, Staphylococcus aureus
TEKAPKLLLKGSGDLKGSSVGY

SEQ ID NO: 1723938 - protein, 28 aa, Staphylococcus aureus
TELNTAMGQLKHAIADKTTTLASSKYVN

SEQ ID NO: 1723939 - protein, 24 aa, Staphylococcus aureus
TELNTAMGTLKHAIADKTNTLASS

SEQ ID NO: 1723940 - protein, 25 aa, Staphylococcus aureus
TESPGVPKVYTFIGKSDASYTISFK

SEQ ID NO: 1723941 - protein, 18 aa, Staphylococcus aureus
TFDITRPLEEHRKNIKVV

SEQ ID NO: 1723942 - protein, 22 aa, Staphylococcus aureus
TFEEIFRESYFNNPQYQNLFYT

SEQ ID NO: 1723943 - protein, 19 aa, Staphylococcus aureus
TFILILSVALIACGKKYDK

SEQ ID NO: 1723944 - protein, 24 aa, Staphylococcus aureus
TFNSFDAGYRLYNGEKLNFTVVDP

SEQ ID NO: 1723945 - protein, 24 aa, Staphylococcus aureus
TFSEYKKDALAKIADAYNAKVNEE

SEQ ID NO: 1723946 - protein, 23 aa, Staphylococcus aureus
TFTRRNNTSPWVKEASAATVAGI

SEQ ID NO: 1723947 - protein, 19 aa, Staphylococcus aureus
TGDGYQWVIKFNKGHAPHE

SEQ ID NO: 1723948 - protein, 22 aa, Staphylococcus aureus
TGKIYLQVKLKGQIDKEQLVFQ

SEQ ID NO: 1723949 - protein, 24 aa, Staphylococcus aureus
TGKKPASIAAYNNSIHALQSDLTS

SEQ ID NO: 1723950 - protein, 30 aa, Staphylococcus aureus
TGNTNEAINIYFVPSDLVNPTISVGNYANH

SEQ ID NO: 1723951 - protein, 29 aa, Staphylococcus aureus
TGNTTDAINIYFVPSDLVNPTISVGNYTN

SEQ ID NO: 1723952 - protein, 31 aa, Staphylococcus aureus
TGNTTDAINIYFVPSDLVNPTISVGNYTNHQ

SEQ ID NO: 1723953 - protein, 32 aa, Staphylococcus aureus
TGSEEMDLPLKELALITGAALLARRRTKNEKE

SEQ ID NO: 1723954 - protein, 23 aa, Staphylococcus aureus
TGTKLVMFHYQSINKFCDILTGF

SEQ ID NO: 1723955 - protein, 19 aa, Staphylococcus aureus
THGTNAIDYITFDPNTNTN

SEQ ID NO: 1723956 - protein, 33 aa, Staphylococcus aureus; identical to SEQ ID NO: 1597686

SEQ ID NO: 1723957 - protein, 33 aa, Staphylococcus aureus
THNAADAVYKAQLYLSPYGPKQYVEHLNQNTGN

SEQ ID NO: 1723958 - protein, 25 aa, Staphylococcus aureus
TIDAQGNFHYTWTGNWNPSQLTQNN

SEQ ID NO: 1723959 - protein, 20 aa, Staphylococcus aureus
TIGAVVPQVTHKKAARDAIN

SEQ ID NO: 1723960 - protein, 25 aa, Staphylococcus aureus
TIHATLQTWVWYTHIQVFGPESWGN

SEQ ID NO: 1723961 - protein, 24 aa, Staphylococcus aureus
TIHATSLQFSWYSHIQVYGPESWG

SEQ ID NO: 1723962 - protein, 26 aa, Staphylococcus aureus
TIINSLTFTETVPNRSYARASANEIT

SEQ ID NO: 1723963 - protein, 21 aa, Staphylococcus aureus
TIKPRTLNRLAVNTVAAPQQG

SEQ ID NO: 1723964 - protein, 19 aa, Staphylococcus aureus
TIKPRTLNRMAVNTVAAPQ

SEQ ID NO: 1723965 - protein, 21 aa, Staphylococcus aureus
TIKQRALNRMAVNTVAAPQQG

SEQ ID NO: 1723966 - protein, 22 aa, Staphylococcus aureus
TINGLPHLTQLQKDNLKHQVEQ

SEQ ID NO: 1723967 - protein, 29 aa, Staphylococcus aureus
TISFKTQGPTIDKLYYAAGGRALEYNQLF

SEQ ID NO: 1723968 - protein, 18 aa, Staphylococcus aureus
TISFKTQGPTVNKLYYAA

SEQ ID NO: 1723969 - protein, 21 aa, Staphylococcus aureus
TKDGIKPLLAKKWEVSEDGKT

SEQ ID NO: 1723970 - protein, 18 aa, Staphylococcus aureus
TKGMFILKKKDDKTYECS

SEQ ID NO: 1723971 - protein, 24 aa, Staphylococcus aureus
TKHEVEQTIYVNPLKLNAKNTNVT

SEQ ID NO: 1723972 - protein, 30 aa, Staphylococcus aureus
TKKNIGYHFLDKPKITVKKKVILVSGVKLI

SEQ ID NO: 1723973 - protein, 28 aa, Staphylococcus aureus
TKNKEGIGYFGYNFYIQNKDKLKEVKIK

SEQ ID NO: 1723974 - protein, 19 aa, Staphylococcus aureus
TKRRKLFNGYIECTYYQYW

SEQ ID NO: 1723975 - protein, 38 aa, Staphylococcus aureus
TKSFTSNLANMNFLRWVNFPQDYTVSWTNAKIASRPTD

SEQ ID NO: 1723976 - protein, 37 aa, Staphylococcus aureus
TKSFTSNLTNMNFLRWISFPQDYTVTWTNAKIANRPT

SEQ ID NO: 1723977 - protein, 30 aa, Staphylococcus aureus
TKSIIAIISLGILTYTTMIGSVLADEIKYP

SEQ ID NO: 1723978 - protein, 29 aa, Staphylococcus aureus
TKTATYKVVRTVPKHVFETARGVLYPGVS

SEQ ID NO: 1723979 - protein, 28 aa, Staphylococcus aureus
TKTATYKVVRTVPKQVFETARGVLYPGV

SEQ ID NO: 1723980 - protein, 28 aa, Staphylococcus aureus
TKTATYKVVRTVPKQVFETTRGVLYPGV

SEQ ID NO: 1723981 - protein, 25 aa, Staphylococcus aureus
TKTGPIIELGLKTASTWKKFEVYEG

SEQ ID NO: 1723982 - protein, 17 aa, Staphylococcus aureus
TKVKLLESIIEEDKDMM

SEQ ID NO: 1723983 - protein, 29 aa, Staphylococcus aureus
TLDSNNIIDFIYKNLPQTNINQLLTKNKY

SEQ ID NO: 1723984 - protein, 26 aa, Staphylococcus aureus
TLGICLVLLIILIGGYFIMTKTNGRN

SEQ ID NO: 1723985 - protein, 26 aa, Staphylococcus aureus
TLGICLVLLIILIGGYVIMTKENGRN

SEQ ID NO: 1723986 - protein, 27 aa, Staphylococcus aureus
TLGICLVLLIILIVGYVIMTKINSRSA

SEQ ID NO: 1723987 - protein, 25 aa, Staphylococcus aureus
TLIASALVLTTVGSGFHSSSNYNGI

SEQ ID NO: 1723988 - protein, 19 aa, Staphylococcus aureus
TLILVISIALIACGKKYDK

SEQ ID NO: 1723989 - protein, 17 aa, Staphylococcus aureus
TLLFGYSSYSLLEARAE

SEQ ID NO: 1723990 - protein, 26 aa, Staphylococcus aureus
TLNGQVIQVLDIINPSNGYGGQPVTN

SEQ ID NO: 1723991 - protein, 26 aa, Staphylococcus aureus
TLNTGKVLYAFYQNPKLVNAAITTAE

SEQ ID NO: 1723992 - protein, 23 aa, Staphylococcus aureus
TLTAGIGTALVGQAHHADAAENY

SEQ ID NO: 1723993 - protein, 21 aa, Staphylococcus aureus
TLTAGIGTALVGQAYHADAAE

SEQ ID NO: 1723994 - protein, 31 aa, Staphylococcus aureus
TLTAKKSYFILNDKIVFIGTGIKSTDSSKNP

SEQ ID NO: 1723995 - protein, 29 aa, Staphylococcus aureus
TLTAKKSYFILNDKIVFLGTGIKNTDSSM

SEQ ID NO: 1723996 - protein, 30 aa, Staphylococcus aureus
TLTAKKSYFILNDKIVFLGTGIKSTDSSKN

SEQ ID NO: 1723997 - protein, 33 aa, Staphylococcus aureus
TLTAKKSYFILNDKIVFLGTGIKTTDSSKNPVT

SEQ ID NO: 1723998 - protein, 20 aa, Staphylococcus aureus
TLVPVNLTVLPEIQHNIKFF

SEQ ID NO: 1723999 - protein, 21 aa, Staphylococcus aureus
TMGVICATQLWHSNHANALVT

SEQ ID NO: 1724000 - protein, 18 aa, Staphylococcus aureus
TMQNGDFYTFELNKKLQT

SEQ ID NO: 1724001 - protein, 17 aa, Staphylococcus aureus
TNAFRPGGVNPLNEYQL

SEQ ID NO: 1724002 - protein, 18 aa, Staphylococcus aureus
TNAFRPGGVNPLNEYQLS

SEQ ID NO: 1724003 - protein, 22 aa, Staphylococcus aureus
TNDANWVAMNKPNAAKVVNAKY

SEQ ID NO: 1724004 - protein, 17 aa, Staphylococcus aureus
TNDILTMLKATTTVPGL

SEQ ID NO: 1724005 - protein, 23 aa, Staphylococcus aureus
TNDMKAPLATVSKGSNSANQDML

SEQ ID NO: 1724006 - protein, 45 aa, Staphylococcus aureus; identical to SEQ ID NO: 1594953

SEQ ID NO: 1724007 - protein, 25 aa, Staphylococcus aureus
TNGTDAINYITFDPNTNTNGITAVW

SEQ ID NO: 1724008 - protein, 19 aa, Staphylococcus aureus
TNKAPKLLLKGTGNLKGSS

SEQ ID NO: 1724009 - protein, 17 aa, Staphylococcus aureus
TNKSPKLLLKGSGDLKG

SEQ ID NO: 1724010 - protein, 45 aa, Staphylococcus aureus
TNLNIDDFMDDPLSYVKTPSNKVLGFYPTSANTNAFRPGGVNPLN

SEQ ID NO: 1724011 - protein, 37 aa, Staphylococcus aureus
TNSPARLMPDKILDLKFKLRVNNVPTPRTVTFNDTLT

SEQ ID NO: 1724012 - protein, 23 aa, Staphylococcus aureus
TNTNVAPYSGVTWMGAGTGFVVG

SEQ ID NO: 1724013 - protein, 21 aa, Staphylococcus aureus
TNVAPYSGVTWMGAGTGFVVG

SEQ ID NO: 1724014 - protein, 18 aa, Staphylococcus aureus
TPAYYQLHGDKIIGFDTE

SEQ ID NO: 1724015 - protein, 26 aa, Staphylococcus aureus
TPGICLVLLIILIGGYVIMTKTNGRN

SEQ ID NO: 1724016 - protein, 23 aa, Staphylococcus aureus
TPKAGAIMQTTQGYYGHVAYVES

SEQ ID NO: 1724017 - protein, 17 aa, Staphylococcus aureus
TQALQQLPNFQTALNSA

SEQ ID NO: 1724018 - protein, 26 aa, Staphylococcus aureus
TQITTNDILTLLKATTTVPGLRNNIA

SEQ ID NO: 1724019 - protein, 19 aa, Staphylococcus aureus
TQKAPKLLLKGSGNLKGSS

SEQ ID NO: 1724020 - protein, 24 aa, Staphylococcus aureus
TQLYHITATNAYHKDSEDFYISLK

SEQ ID NO: 1724021 - protein, 40 aa, Staphylococcus aureus; identical to SEQ ID NO: 1597783

SEQ ID NO: 1724022 - protein, 34 aa, Staphylococcus aureus
TQNDTTLKSWIDDGFMPLIYKGEMMDLSRGRAIS

SEQ ID NO: 1724023 - protein, 24 aa, Staphylococcus aureus
TQPHLSLSNKWLWQKPNGSIHATL

SEQ ID NO: 1724024 - protein, 19 aa, Staphylococcus aureus
TRHNNTSPWVKEASAANVA

SEQ ID NO: 1724025 - protein, 25 aa, Staphylococcus aureus
TSAIVKANLWLRTADRIKIVVGRFN

SEQ ID NO: 1724026 - protein, 35 aa, Staphylococcus aureus
TSDGQRQFTLNGQVIQIMDIINPSNGFGGQPVTNS

SEQ ID NO: 1724027 - protein, 25 aa, Staphylococcus aureus
TSISPYKGILRVGAATGFVVGKNTI

SEQ ID NO: 1724028 - protein, 17 aa, Staphylococcus aureus
TSLALGLLTTGVITTTT

SEQ ID NO: 1724029 - protein, 31 aa, Staphylococcus aureus
TSNENFTDRDWQITGIPRTLHIENSTNRPNN

SEQ ID NO: 1724030 - protein, 31 aa, Staphylococcus aureus
TSNLANMNFLRWVNFPQDYTVSWTNAKIASR

SEQ ID NO: 1724031 - protein, 20 aa, Staphylococcus aureus
TSNLIFPNQVLKVSGSSNST

SEQ ID NO: 1724032 - protein, 35 aa, Staphylococcus aureus
TSQNDTILKSWIDDGFMPLIYKGEMMDLSRGRAIS

SEQ ID NO: 1724033 - protein, 35 aa, Staphylococcus aureus; identical to SEQ ID NO: 1597806

SEQ ID NO: 1724034 - protein, 24 aa, Staphylococcus aureus
TTDAINIYFVPSDLVNPTISVGNY

SEQ ID NO: 1724035 - protein, 34 aa, Staphylococcus aureus
TTDGQRQFTLNGQVIQILDIINPSNGYGGQPVTN

SEQ ID NO: 1724036 - protein, 35 aa, Staphylococcus aureus
TTDGQRQFTLNGQVIQVLDIINPSNGFGGQPVTNS

SEQ ID NO: 1724037 - protein, 25 aa, Staphylococcus aureus
TTEEAPLPIAQPLVKIPQGTIQGEI

SEQ ID NO: 1724038 - protein, 19 aa, Staphylococcus aureus
TTFTRRNNTSPWVKEASAA

SEQ ID NO: 1724039 - protein, 25 aa, Staphylococcus aureus
TTFTRRNNTSPWVKEASAATVAGIA

SEQ ID NO: 1724040 - protein, 19 aa, Staphylococcus aureus
TTGADGWGFLFSKGNAEEY

SEQ ID NO: 1724041 - protein, 22 aa, Staphylococcus aureus
TTIAKTSLALGLLTTGVITTTT

SEQ ID NO: 1724042 - protein, 28 aa, Staphylococcus aureus
TTKHEVEQTIYVNPLKLNAKNTNVTIKS

SEQ ID NO: 1724043 - protein, 18 aa, Staphylococcus aureus
TTLSLGLIVPIATPFQGS

SEQ ID NO: 1724044 - protein, 21 aa, Staphylococcus aureus
TTLSVSLLAPLANPLLEKAKA

SEQ ID NO: 1724045 - protein, 24 aa, Staphylococcus aureus
TTNEATIAAITPDANVKPTAKQAI

SEQ ID NO: 1724046 - protein, 38 aa, Staphylococcus aureus
TTNSPARLMPDKILDLKYKLRVNNVPTPRTVTFNDTLT

SEQ ID NO: 1724047 - protein, 18 aa, Staphylococcus aureus
TTSFNVTIKPLRDKYRVG

SEQ ID NO: 1724048 - protein, 17 aa, Staphylococcus aureus
TTTLLLGSVLLNPIANA

SEQ ID NO: 1724049 - protein, 20 aa, Staphylococcus aureus
TVEPATVIFTKTGPIIELGL

SEQ ID NO: 1724050 - protein, 30 aa, Staphylococcus aureus
TVGTFSTVIATLVFLGLNTSQAQAAETNQP

SEQ ID NO: 1724051 - protein, 22 aa, Staphylococcus aureus
TVNDLYLIVKKLSQGDVKKAVV

SEQ ID NO: 1724052 - protein, 17 aa, Staphylococcus aureus
TVQMKYYGKYTIELDKK

SEQ ID NO: 1724053 - protein, 27 aa, Staphylococcus aureus
TVTDHVNGYSLINNGKIGFVNSELRRS

SEQ ID NO: 1724054 - protein, 17 aa, Staphylococcus aureus
TVTWTNAKIANRPTDGG

SEQ ID NO: 1724055 - protein, 18 aa, Staphylococcus aureus
TYHNKGLDFAFGLSMTSK

SEQ ID NO: 1724056 - protein, 35 aa, Staphylococcus aureus
TYQREMDLYQICWNGFYWAGANYKNFKTRTFKSTY

SEQ ID NO: 1724057 - protein, 33 aa, Staphylococcus aureus; identical to SEQ ID NO: 1592878

SEQ ID NO: 1724058 - protein, 17 aa, Staphylococcus aureus
VALNQLANNEKLALQNI

SEQ ID NO: 1724059 - protein, 27 aa, Staphylococcus aureus
VAPKRVNAKIRFAVAQPAAVASNNVND

SEQ ID NO: 1724060 - protein, 34 aa, Staphylococcus aureus
VATAPTSVAPKRLNAKMRFAVAQPAAVASNNVND

SEQ ID NO: 1724061 - protein, 25 aa, Staphylococcus aureus
VDAGTYWYNDPYTLDFMRKNLKEKL

SEQ ID NO: 1724062 - protein, 21 aa, Staphylococcus aureus
VDAVLKRFNVALSDIEAVITE

SEQ ID NO: 1724063 - protein, 24 aa, Staphylococcus aureus
VDDKIKVIGYPLPAHNSFKQFEST

SEQ ID NO: 1724064 - protein, 27 aa, Staphylococcus aureus
VDNALNAVTRAKAALNGAENLRNAKTS

SEQ ID NO: 1724065 - protein, 27 aa, Staphylococcus aureus
VDVTAELEINLFIDPKTVQTNGNQTIT

SEQ ID NO: 1724066 - protein, 27 aa, Staphylococcus aureus
VEGAQKIYDLFKPILEKKDKKLSDDIQ

SEQ ID NO: 1724067 - protein, 17 aa, Staphylococcus aureus
VESLKHAGYSFAKDIDI

SEQ ID NO: 1724068 - protein, 20 aa, Staphylococcus aureus
VETNGIATLKGVQPHIVIKP

SEQ ID NO: 1724069 - protein, 27 aa, Staphylococcus aureus
VEVTANLEINLFIDPKTFQSNGEEKVT

SEQ ID NO: 1724070 - protein, 26 aa, Staphylococcus aureus
VFETARGVLYPGVSDMYDAKQYVKPV

SEQ ID NO: 1724071 - protein, 23 aa, Staphylococcus aureus
VFETNRGAVFPGVSDVYDAKQYV

SEQ ID NO: 1724072 - protein, 26 aa, Staphylococcus aureus
VFIAFQAFIIKFLNPSFLFHNKTNIA

SEQ ID NO: 1724073 - protein, 20 aa, Staphylococcus aureus
VFRENQKWMTPLGRLGKPEE

SEQ ID NO: 1724074 - protein, 18 aa, Staphylococcus aureus
VGAIFQTAAGPYGHVGVV

SEQ ID NO: 1724075 - protein, 22 aa, Staphylococcus aureus
VGEQFFKDNFGLKVKATNVVGK

SEQ ID NO: 1724076 - protein, 31 aa, Staphylococcus aureus
VGIDSGTTVYPHQAGYVKLNYGFSVPNSAVK

SEQ ID NO: 1724077 - protein, 17 aa, Staphylococcus aureus
VGKTDMFVFPHGAQDRH

SEQ ID NO: 1724078 - protein, 26 aa, Staphylococcus aureus
VGLLIFTTLFWKTSLGEFNMLKNKTF

SEQ ID NO: 1724079 - protein, 26 aa, Staphylococcus aureus
VGTASILVGTTLIFGLSGHEAKAAEH

SEQ ID NO: 1724080 - protein, 29 aa, Staphylococcus aureus
VGTVNYDVPFQFRLIFVESGNGVAITTFT

SEQ ID NO: 1724081 - protein, 27 aa, Staphylococcus aureus
VGTVNYDVPFQLQLLFVESGNGIIIST

SEQ ID NO: 1724082 - protein, 17 aa, Staphylococcus aureus
VGVLSHAMVRTSMFEAG

SEQ ID NO: 1724083 - protein, 23 aa, Staphylococcus aureus
VGVLSHAMVRTSMFEAGSNRTYQ

SEQ ID NO: 1724084 - protein, 20 aa, Staphylococcus aureus
VGWGVLPRYTAGSVSAILVN

SEQ ID NO: 1724085 - protein, 41 aa, Staphylococcus aureus
VHNTVTIRPQDYVVFIPPVGKQIRAVVYYNKVVGSNMSNAV

SEQ ID NO: 1724086 - protein, 17 aa, Staphylococcus aureus
VIELGLKTASTWKKFEV

SEQ ID NO: 1724087 - protein, 29 aa, Staphylococcus aureus
VIILLIGALGFAIYAAINHSTSSIHNNEQ

SEQ ID NO: 1724088 - protein, 27 aa, Staphylococcus aureus
VIIVLIGTLGFAIYAAINHSTSSSNNQ

SEQ ID NO: 1724089 - protein, 23 aa, Staphylococcus aureus
VILIIIVLAIYLKIGHDEKEQYY

SEQ ID NO: 1724090 - protein, 25 aa, Staphylococcus aureus
VIMPKSTAPKRLNTRMRIAAVQPSS

SEQ ID NO: 1724091 - protein, 34 aa, Staphylococcus aureus
VINGQTWYYGKLSNGKLAWIKSTDLAKELIKYNQ

SEQ ID NO: 1724092 - protein, 18 aa, Staphylococcus aureus
VIQPAPKVCTPIKKEETH

SEQ ID NO: 1724093 - protein, 19 aa, Staphylococcus aureus
VISKLKPDLIIADVSRHKK

SEQ ID NO: 1724094 - protein, 20 aa, Staphylococcus aureus
VIVTILTVSAYFIGTQTTKQ

SEQ ID NO: 1724095 - protein, 24 aa, Staphylococcus aureus
VKANERIAIVGYPAPYKNKHHMYQ

SEQ ID NO: 1724096 - protein, 24 aa, Staphylococcus aureus
VKDALEWLHKNAYGKEPDKKVADL

SEQ ID NO: 1724097 - protein, 25 aa, Staphylococcus aureus
VKDALEWLHKNAYGKEPDKKVADLT

SEQ ID NO: 1724098 - protein, 23 aa, Staphylococcus aureus
VKFKEMIQMLLYNNAAFLTTDND

SEQ ID NO: 1724099 - protein, 24 aa, Staphylococcus aureus
VKFKEMIQMLLYNNAAFLTTDNDL

SEQ ID NO: 1724100 - protein, 25 aa, Staphylococcus aureus
VKMNKKQYPDFKNKNLRLAIAQAID

SEQ ID NO: 1724101 - protein, 19 aa, Staphylococcus aureus
VKNYGLYKGTTKYGKITFN

SEQ ID NO: 1724102 - protein, 21 aa, Staphylococcus aureus
VKQAFINANRDVITLAEGDIS

SEQ ID NO: 1724103 - protein, 21 aa, Staphylococcus aureus
VKQAFINANRDVITLAEGNIS

SEQ ID NO: 1724104 - protein, 17 aa, Staphylococcus aureus
VKVVVANIGYEGQYHVR

SEQ ID NO: 1724105 - protein, 24 aa, Staphylococcus aureus
VLGISLLFLIISINAGCGMGKEAE

SEQ ID NO: 1724106 - protein, 18 aa, Staphylococcus aureus
VLLFCYSQNRIATADVGV

SEQ ID NO: 1724107 - protein, 19 aa, Staphylococcus aureus
VLMLAVIVFAAACGNSSSL

SEQ ID NO: 1724108 - protein, 20 aa, Staphylococcus aureus
VLSHAMVRTSMFEAGSNRTY

SEQ ID NO: 1724109 - protein, 21 aa, Staphylococcus aureus
VLSHAMVRTSMFEAGSNRTYQ

SEQ ID NO: 1724110 - protein, 25 aa, Staphylococcus aureus
VLSISFLYLIISFTAGCGMGKEAEI

SEQ ID NO: 1724111 - protein, 19 aa, Staphylococcus aureus
VLSNSTVKLFKADNTPLNV

SEQ ID NO: 1724112 - protein, 25 aa, Staphylococcus aureus
VLTSGTFFVKMNEKQYPDFKNKNLR

SEQ ID NO: 1724113 - protein, 17 aa, Staphylococcus aureus
VLVHGFNGFTDDINSSV

SEQ ID NO: 1724114 - protein, 17 aa, Staphylococcus aureus
VLVLSFLTAGISTHHHS

SEQ ID NO: 1724115 - protein, 23 aa, Staphylococcus aureus
VLYISFLILIISIVAGCGTGKEA

SEQ ID NO: 1724116 - protein, 29 aa, Staphylococcus aureus
VNAKYDVIYNGHTFATSLPAKFVVKDVQP

SEQ ID NO: 1724117 - protein, 22 aa, Staphylococcus aureus
VNKLRDGYLLSDKKYKDWTEHN

SEQ ID NO: 1724118 - protein, 17 aa, Staphylococcus aureus
VNNLKIQFVPKNDAITD

SEQ ID NO: 1724119 - protein, 21 aa, Staphylococcus aureus
VNQLVDLLYTSTFIIEKPSYP

SEQ ID NO: 1724120 - protein, 22 aa, Staphylococcus aureus
VPEDHAYIRFPVSDGTQELKIV

SEQ ID NO: 1724121 - protein, 18 aa, Staphylococcus aureus
VPKVYTFIGQGDASYTIS

SEQ ID NO: 1724122 - protein, 19 aa, Staphylococcus aureus
VPKVYTFIGQGDASYTISF

SEQ ID NO: 1724123 - protein, 18 aa, Staphylococcus aureus
VPVNISGIPLDPSALVYL

SEQ ID NO: 1724124 - protein, 34 aa, Staphylococcus aureus
VPVTVSGVPLDPSALVYLVIPTSQTRDGGSEADQ

SEQ ID NO: 1724125 - protein, 34 aa, Staphylococcus aureus
VPVTVTDIPLDPSALVYLVIPTSQTRDGGSEADQ

SEQ ID NO: 1724126 - protein, 19 aa, Staphylococcus aureus
VRTNPYTIDIIMNKDALQA

SEQ ID NO: 1724127 - protein, 22 aa, Staphylococcus aureus
VSESLKLIDYKNNKQYTAEAYK

SEQ ID NO: 1724128 - protein, 25 aa, Staphylococcus aureus
VSKVKAERYVPYTIAVNGASNPTLS

SEQ ID NO: 1724129 - protein, 24 aa, Staphylococcus aureus
VSVNEPFEVTIYLKGFEANQTLEN

SEQ ID NO: 1724130 - protein, 18 aa, Staphylococcus aureus
VTIPAIEAIVPQKDPNAN

SEQ ID NO: 1724131 - protein, 25 aa, Staphylococcus aureus
VTIQPFGATIPYYFTGHEGPDSCCI

SEQ ID NO: 1724132 - protein, 18 aa, Staphylococcus aureus
VTTFTRRNNTSPWVKEAS

SEQ ID NO: 1724133 - protein, 25 aa, Staphylococcus aureus
VTTFTRRNNTSPWVKEASAANVTGI

SEQ ID NO: 1724134 - protein, 21 aa, Staphylococcus aureus
VTVNVYQFEFPQTTYTTTVGG

SEQ ID NO: 1724135 - protein, 23 aa, Staphylococcus aureus
VTVVDNLPGYTLINGGKVGVFSH

SEQ ID NO: 1724136 - protein, 36 aa, Staphylococcus aureus
VTYQREMDLYQIRWNGFYWAGANYKNYKTRTFKSTY

SEQ ID NO: 1724137 - protein, 21 aa, Staphylococcus aureus
VVALICIIALSACGKEQTKTY

SEQ ID NO: 1724138 - protein, 18 aa, Staphylococcus aureus
VVFMLILVVAVAGCGQKD

SEQ ID NO: 1724139 - protein, 26 aa, Staphylococcus aureus
VVGTVNYDVPFQLQLLFVESGNGITI

SEQ ID NO: 1724140 - protein, 18 aa, Staphylococcus aureus
VVMVNTKFQYTTSESPTL

SEQ ID NO: 1724141 - protein, 17 aa, Staphylococcus aureus
VVVAILIGLIVIAYAHN

SEQ ID NO: 1724142 - protein, 27 aa, Staphylococcus aureus
VYASAKLKLELLPNVQNPVISVTTTMP

SEQ ID NO: 1724143 - protein, 17 aa, Staphylococcus aureus
VYEDGKFITISFVYDKD

SEQ ID NO: 1724144 - protein, 22 aa, Staphylococcus aureus
VYSINMNMYTRLLLDENDHLTT

SEQ ID NO: 1724145 - protein, 17 aa, Staphylococcus aureus
WAAMNKPNTAQVINAKY

SEQ ID NO: 1724146 - protein, 17 aa, Staphylococcus aureus
WAAMNKPNVAKVVNAKY

SEQ ID NO: 1724147 - protein, 17 aa, Staphylococcus aureus
WILYSSIVSEFKGESLK

SEQ ID NO: 1724148 - protein, 18 aa, Staphylococcus aureus
WKHTVGNTHKTVVVTLPN

SEQ ID NO: 1724149 - protein, 17 aa, Staphylococcus aureus
WNYAAKVAGFKVDKTPE

SEQ ID NO: 1724150 - protein, 19 aa, Staphylococcus aureus
WQSVYPYLKDGTLDEVMEH

SEQ ID NO: 1724151 - protein, 27 aa, Staphylococcus aureus
WSDDHKSLIYRYDATLGTQITTNDILT

SEQ ID NO: 1724152 - protein, 17 aa, Staphylococcus aureus
WSNGAGAGANKPLPQMW

SEQ ID NO: 1724153 - protein, 20 aa, Staphylococcus aureus
WVVAAFPSKAWAKRVYPELS

SEQ ID NO: 1724154 - protein, 21 aa, Staphylococcus aureus
YAATQLQYYGLKPDSAEYDGK

SEQ ID NO: 1724155 - protein, 17 aa, Staphylococcus aureus
YCFSVRRNPLKGNGELG

SEQ ID NO: 1724156 - protein, 19 aa, Staphylococcus aureus
YDLNSIIDDFFMETNQNRP

SEQ ID NO: 1724157 - protein, 28 aa, Staphylococcus aureus
YDNHQTQIIKILAKVKPDPPRIDGNSVT

SEQ ID NO: 1724158 - protein, 23 aa, Staphylococcus aureus
YDNIDVFIVLEDNKYQLKKYSVG

SEQ ID NO: 1724159 - protein, 17 aa, Staphylococcus aureus
YDVIYNGHTFATSLPAK

SEQ ID NO: 1724160 - protein, 24 aa, Staphylococcus aureus
YDYTKLVFAKPIYNDPSLVKSDTN

SEQ ID NO: 1724161 - protein, 17 aa, Staphylococcus aureus
YEAYKKWFEKHKSENPH

SEQ ID NO: 1724162 - protein, 30 aa, Staphylococcus aureus
YEGFTYHFESDGTYFAWNYHATGANGADMS

SEQ ID NO: 1724163 - protein, 25 aa, Staphylococcus aureus
YENEYFYISTIPYNLTEYRNYFEPL

SEQ ID NO: 1724164 - protein, 24 aa, Staphylococcus aureus
YENEYFYITTIPYNLTEYRDYFEP

SEQ ID NO: 1724165 - protein, 17 aa, Staphylococcus aureus
YEPLIRKNDKEFKEGME

SEQ ID NO: 1724166 - protein, 22 aa, Staphylococcus aureus
YETINVTYLLSNGYSSSVSAPG

SEQ ID NO: 1724167 - protein, 18 aa, Staphylococcus aureus
YFNNPQYQNLFYTGSNAN

SEQ ID NO: 1724168 - protein, 23 aa, Staphylococcus aureus
YGEAEHVFVPHFTIAQGLSSQEF

SEQ ID NO: 1724169 - protein, 26 aa, Staphylococcus aureus
YGPNKDVVGISTRLIRITYDNRQTEE

SEQ ID NO: 1724170 - protein, 19 aa, Staphylococcus aureus
YGYVLYPGLSKDDFKTKKD

SEQ ID NO: 1724171 - protein, 31 aa, Staphylococcus aureus; identical to SEQ ID NO: 1680090

SEQ ID NO: 1724172 - protein, 28 aa, Staphylococcus aureus
YKDKKLDIFGVPYFYTCIIPKSEPDINQ

SEQ ID NO: 1724173 - protein, 34 aa, Staphylococcus aureus
YKDNKGLNFLLTTGTFFVKMNEKQYPDFKNKNLR

SEQ ID NO: 1724174 - protein, 27 aa, Staphylococcus aureus
YKEAMDTYRKKLFAELDALNKFLDEER

SEQ ID NO: 1724175 - protein, 28 aa, Staphylococcus aureus
YKELEQAVALIRTMPQRQQTSRRSNRIQ

SEQ ID NO: 1724176 - protein, 26 aa, Staphylococcus aureus
YKELEQAVALIRTMPQRQQTSRRSSR

SEQ ID NO: 1724177 - protein, 27 aa, Staphylococcus aureus
YKELEQAVALIRTMPQRQQTSRRSSRI

SEQ ID NO: 1724178 - protein, 28 aa, Staphylococcus aureus
YKELEQAVALIRTMPQRQQTSRRSSRIQ

SEQ ID NO: 1724179 - protein, 29 aa, Staphylococcus aureus
YKGKKVDIFGVPYFYTCIIPKSEPDINQN

SEQ ID NO: 1724180 - protein, 22 aa, Staphylococcus aureus
YKGKKWIYMVFIMVINVLGVHH

SEQ ID NO: 1724181 - protein, 26 aa, Staphylococcus aureus
YKKPVELMMNYFKALNSTIVNVDEDI

SEQ ID NO: 1724182 - protein, 20 aa, Staphylococcus aureus
YKNEYFYITYSSRSLKEYRK

SEQ ID NO: 1724183 - protein, 23 aa, Staphylococcus aureus
YKYNYVIPKEGSNLWFDNMVIPK

SEQ ID NO: 1724184 - protein, 18 aa, Staphylococcus aureus
YLNNFNSKEIEYARVWYQ

SEQ ID NO: 1724185 - protein, 18 aa, Staphylococcus aureus
YMVFIMVINVLGVHHSKQ

SEQ ID NO: 1724186 - protein, 21 aa, Staphylococcus aureus
YNFPKKPFKYGIHYSEIEDFD

SEQ ID NO: 1724187 - protein, 18 aa, Staphylococcus aureus
YNGPKGPTGFMIPTIVQW

SEQ ID NO: 1724188 - protein, 23 aa, Staphylococcus aureus
YPARPQFNKTPKYVKYRDAGTGI

SEQ ID NO: 1724189 - protein, 24 aa, Staphylococcus aureus
YPARPQFNKTPKYVKYRDAGTGIR

SEQ ID NO: 1724190 - protein, 17 aa, Staphylococcus aureus
YPIKNLEDLYDKKGYRD

SEQ ID NO: 1724191 - protein, 19 aa, Staphylococcus aureus
YQDKLKIEKMNLPGISLLP

SEQ ID NO: 1724192 - protein, 42 aa, Staphylococcus aureus
YQISQLFTDDKLQQAARNRTPIQLMIGFDYPDGHGNAETLVP

SEQ ID NO: 1724193 - protein, 27 aa, Staphylococcus aureus
YQLRDGYKYYDFVDSIGLHSGSHVYVE

SEQ ID NO: 1724194 - protein, 43 aa, Staphylococcus aureus
YQLSQLFTDQKLQEAARTRNPIRLMIGFDYPDAYGNSETLVPV

SEQ ID NO: 1724195 - protein, 19 aa, Staphylococcus aureus
YRDNFWATADMKRLADTTT

SEQ ID NO: 1724196 - protein, 17 aa, Staphylococcus aureus
YRVPEGYTLNKGYDVNT

SEQ ID NO: 1724197 - protein, 18 aa, Staphylococcus aureus
YRVPEGYTLNKGYDVNTN

SEQ ID NO: 1724198 - protein, 32 aa, Staphylococcus aureus
YSIRKYKVGIFSTLIGTVLLLSNPNGAQALTT

SEQ ID NO: 1724199 - protein, 27 aa, Staphylococcus aureus
YSLEIKVPLNVIKIPKSVLTKGNNVFI

SEQ ID NO: 1724200 - protein, 18 aa, Staphylococcus aureus
YSQFYWGGKYNVSVSSES

SEQ ID NO: 1724201 - protein, 21 aa, Staphylococcus aureus
YSTHYLLLEELRKQLKIKPGH

SEQ ID NO: 1724202 - protein, 26 aa, Staphylococcus aureus
YTIDAQGNFHYTWTGNWNPSQLTQNN

SEQ ID NO: 1724203 - protein, 25 aa, Staphylococcus aureus
YTQPHFSLSNKWLWQKPNGSIHATL

SEQ ID NO: 1724204 - protein, 26 aa, Staphylococcus aureus
YTQRHLTFSNKWLWQKENGTIHATLL

SEQ ID NO: 1724205 - protein, 18 aa, Staphylococcus aureus
YVAPYYGQNAAPVARQIY

SEQ ID NO: 1724206 - protein, 24 aa, Staphylococcus aureus
YVKPVNDSWTQNAQRMNFQFTNSY

SEQ ID NO: 1724207 - protein, 17 aa, Staphylococcus aureus
YVLYPGITKDNFKSKAS

SEQ ID NO: 1724208 - protein, 18 aa, Staphylococcus aureus
YVNDLAAGSLNPYYKRMI

SEQ ID NO: 1724209 - protein, 19 aa, Staphylococcus aureus
YVNDLAAGSLNPYYKRMIM

SEQ ID NO: 1724210 - protein, 17 aa, Staphylococcus aureus
YVNPLKLNAKNTNVTIK

SEQ ID NO: 1724211 - protein, 19 aa, Staphylococcus aureus
YVVARNLLLQKQSQARQTA

SEQ ID NO: 1724212 - protein, 19 aa, Staphylococcus aureus
YVWKDRKDYFVGLLGKDIE

SEQ ID NO: 1724213 - protein, 18 aa, Staphylococcus aureus
YYDYIHTPILEIKKGKEE

SEQ ID NO: 1724214 - protein, 21 aa, Staphylococcus aureus
YYTFDITRPLEEHRKNIPVVK

SEQ ID NO: 1724215 - protein, 25 aa, Staphylococcus aureus
LTAKKSYFILNDKIVFLGTGIKSTD

SEQ ID NO: 1724216 - protein, 25 aa, Staphylococcus aureus
NKDNKAFYFLLRDDDYFAKVVNGQA

SEQ ID NO: 1724217 - protein, 18 aa, Staphylococcus aureus
GNNIVKFFDYTFASVGVK

SEQ ID NO: 1724218 - protein, 25 aa, Staphylococcus aureus
MPYPHGQCTWYVYNRMKQFGTSISG

SEQ ID NO: 1724219 - protein, 18 aa, Staphylococcus aureus
YLLSTTLVLPTLVSPTAY

SEQ ID NO: 1724220 - protein, 18 aa, Staphylococcus aureus
YYQFHIYPVFPIPERRRF

SEQ ID NO: 1724221 - protein, 18 aa, Staphylococcus aureus
ALSRPLFIYVNEKALKDN

SEQ ID NO: 1724222 - protein, 23 aa, Staphylococcus aureus
IDQDQFIKFYRGDKFKIASPITP

SEQ ID NO: 1724223 - protein, 17 aa, Staphylococcus aureus
NLPLIKYSFDQVIMTKE

SEQ ID NO: 1724224 - protein, 28 aa, Staphylococcus aureus
NQAVFFTRQLWNMLVLARVITIGAYNRN

SEQ ID NO: 1724225 - protein, 18 aa, Staphylococcus aureus
HRIPVIFIRLVLDKHFND

SEQ ID NO: 1724226 - protein, 25 aa, Staphylococcus aureus
KKYPYIKRMIWPFQYNISLKTKDSN

SEQ ID NO: 1724227 - protein, 17 aa, Staphylococcus aureus
EVYLISHALLETGNGTS

SEQ ID NO: 1724228 - protein, 24 aa, Staphylococcus aureus
GASSILIATLLFLSGGQAQAAEKQ

SEQ ID NO: 1724229 - protein, 21 aa, Staphylococcus aureus
LAELAMPRPYVFVSPKDFKNG

SEQ ID NO: 1724230 - protein, 26 aa, Staphylococcus aureus
MDLYQIRWNGFYWAGANYKNFKTRTF

SEQ ID NO: 1724231 - protein, 19 aa, Staphylococcus aureus
YGINEVYLISHALLETGNG

SEQ ID NO: 1724232 - protein, 17 aa, Staphylococcus aureus
SVLAHYWGGNKMNIRQD

SEQ ID NO: 1724233 - protein, 26 aa, Staphylococcus aureus
RFIAFLLALFFFLSVNNVFGNIFNTG

SEQ ID NO: 1724234 - protein, 19 aa, Staphylococcus aureus
FFLLLSVALLYSCSKQNEK

SEQ ID NO: 1724235 - protein, 17 aa, Staphylococcus aureus
LKDSFNYGYKYLTDTYK

SEQ ID NO: 1724236 - protein, 17 aa, Staphylococcus aureus
LTVLLLLFSFSSITNEV

SEQ ID NO: 1724237 - protein, 17 aa, Staphylococcus aureus
ILIFMLVLSGCGMKDND

SEQ ID NO: 1724238 - protein, 33 aa, Staphylococcus aureus
KNKRTLIVVIAFVLFIIFLFLLLNSNSEDSGNI

SEQ ID NO: 1724239 - protein, 21 aa, Staphylococcus aureus
SSLFVATLTTATLVSSPAANA

SEQ ID NO: 1724240 - protein, 25 aa, Staphylococcus aureus
TLGICLVLLIILIVGYVIMTKTNGR

SEQ ID NO: 1724241 - protein, 20 aa, Staphylococcus aureus
VQILLVVIIIIFGYKIVQTY

SEQ ID NO: 1724242 - protein, 26 aa, Staphylococcus aureus
DEYVVLRFGWLYGPGTWYGKDGMIYN

SEQ ID NO: 1724243 - protein, 17 aa, Staphylococcus aureus
ILLGIILGVVGGYVVAR

SEQ ID NO: 1724244 - protein, 28 aa, Staphylococcus aureus
YSIRKYKVGIFSTLIGTVLLLSNPNGAQ

SEQ ID NO: 1724245 - protein, 19 aa, Staphylococcus aureus
AGVVLILVAAYLFAKPHID

SEQ ID NO: 1724246 - protein, 24 aa, Staphylococcus aureus
QKADLNMFFPFVITGNLIGKATEK

SEQ ID NO: 1724247 - protein, 20 aa, Staphylococcus aureus
GKKYIIFPNPMYGSWEATIY

SEQ ID NO: 1724248 - protein, 21 aa, Staphylococcus aureus
GYWNSTLRWPGSYSVSIQNVD

SEQ ID NO: 1724249 - protein, 27 aa, Staphylococcus aureus
KLIVVLCAIIVFIALIGLSIRSQSQSP

SEQ ID NO: 1724250 - protein, 20 aa, Staphylococcus aureus
FDLVNVYWNHLYGHGLKGYG

SEQ ID NO: 1724251 - protein, 21 aa, Staphylococcus aureus
VLGIIFLFLVISITAGCGIGK

SEQ ID NO: 1724252 - protein, 19 aa, Staphylococcus aureus
HTHYFYNCYPKNANANGSG

SEQ ID NO: 1724253 - protein, 23 aa, Staphylococcus aureus
VYNLDPKLWYFAAGSTTTTIKQI

SEQ ID NO: 1724254 - protein, 22 aa, Staphylococcus aureus
LILLALVLIVVPIVFATLLFKT

SEQ ID NO: 1724255 - protein, 19 aa, Staphylococcus aureus
MAVMLFLTGCGKSQEKATL

SEQ ID NO: 1724256 - protein, 21 aa, Staphylococcus aureus
RKAMLYAIDREKWIKAFFNGY

SEQ ID NO: 1724257 - protein, 18 aa, Staphylococcus aureus
ILGLIVALLLVAACGNTD

SEQ ID NO: 1724258 - protein, 22 aa, Staphylococcus aureus
IQCDQLIILTAIDYVYINFNTE

SEQ ID NO: 1724259 - protein, 19 aa, Staphylococcus aureus
KSVFLMLNIKKGIFKTHPN

SEQ ID NO: 1724260 - protein, 24 aa, Staphylococcus aureus
LRDGYKYYDFVDSIGLHSGSHVYV

SEQ ID NO: 1724261 - protein, 18 aa, Staphylococcus aureus
SILLIVVLVLSACGKSSN

SEQ ID NO: 1724262 - protein, 26 aa, Staphylococcus aureus
VIHACVLLFIIISIALIFHRLQTKTH

SEQ ID NO: 1724263 - protein, 17 aa, Staphylococcus aureus
LVLTFAVVLAACGNGNK

SEQ ID NO: 1724264 - protein, 18 aa, Staphylococcus aureus
VVFVLSLTVLSGCSLPGL

SEQ ID NO: 1724265 - protein, 24 aa, Staphylococcus aureus
VIIVLIGALGFAIYAAINHSTSSS

SEQ ID NO: 1724266 - protein, 17 aa, Staphylococcus aureus
LPWFKTSKPIPLKDLML

SEQ ID NO: 1724267 - protein, 23 aa, Staphylococcus aureus
TALHRTYFVFPENKKVLYQEIDS

SEQ ID NO: 1724268 - protein, 17 aa, Staphylococcus aureus
TFLASTLILTGCASDQS

SEQ ID NO: 1724269 - protein, 17 aa, Staphylococcus aureus
IIDFIYKNLPQTNINQL

SEQ ID NO: 1724270 - protein, 17 aa, Staphylococcus aureus
KLRQYLIQNFDLYKKFP

SEQ ID NO: 1724271 - protein, 18 aa, Staphylococcus aureus
CLMLYLLIFLSSCGTNNK

SEQ ID NO: 1724272 - protein, 17 aa, Staphylococcus aureus
DLYVYLTKNGDIKNGKE

SEQ ID NO: 1724273 - protein, 17 aa, Staphylococcus aureus
GPDLYVYLTKNGDIKNG

SEQ ID NO: 1724274 - protein, 27 aa, Staphylococcus aureus
GTHTKEVLFPDKSLKLSYKVNVANIDT

SEQ ID NO: 1724275 - protein, 20 aa, Staphylococcus aureus
KFRARFAVLAHLLTQREGLP

SEQ ID NO: 1724276 - protein, 23 aa, Staphylococcus aureus
KLAKEWMEFLKSDKAKEILKEYH

SEQ ID NO: 1724277 - protein, 18 aa, Staphylococcus aureus
LGYYQSLKDSFNYGYKYL

SEQ ID NO: 1724278 - protein, 18 aa, Staphylococcus aureus
DNAKLCYIYKFRARFAVL

SEQ ID NO: 1724279 - protein, 30 aa, Staphylococcus aureus; identical to SEQ ID NO: 1701886

SEQ ID NO: 1724280 - protein, 31 aa, Staphylococcus aureus
FSIRKFNVGIFSALIATVTFISTNPTTASAA

SEQ ID NO: 1724281 - protein, 18 aa, Staphylococcus aureus
KNRSQNYALIRLLNWLRT

SEQ ID NO: 1724282 - protein, 25 aa, Staphylococcus aureus
TDADRLDLQFIPDNTAVADASRITT

SEQ ID NO: 1724283 - protein, 18 aa, Staphylococcus aureus
TKRMIWPFQYNIGLTTKD

SEQ ID NO: 1724284 - protein, 25 aa, Staphylococcus aureus
GLFSGSHLYVKNRDLAPKATNNKEY

SEQ ID NO: 1724285 - protein, 18 aa, Staphylococcus aureus
SGYKWYDPTTFKAGSYGS

SEQ ID NO: 1724286 - protein, 17 aa, Staphylococcus aureus
IDWNRHGFWGYWSGENH

SEQ ID NO: 1724287 - protein, 17 aa, Staphylococcus aureus
IYYRALTEYLTSNSNFK

SEQ ID NO: 1724288 - protein, 20 aa, Staphylococcus aureus
KNFYFNYPFLFGNDDYIFKK

SEQ ID NO: 1724289 - protein, 18 aa, Staphylococcus aureus
SKSEQIYYRALTEYLTSN

SEQ ID NO: 1724290 - protein, 24 aa, Staphylococcus aureus
KYDTAKYYYNTYYKYKGAIDQTVL

SEQ ID NO: 1724291 - protein, 23 aa, Staphylococcus aureus
RGTFLMTKMMLPLMMTKGGSIVN

SEQ ID NO: 1724292 - protein, 19 aa, Staphylococcus aureus
PSGYKWYDPTTFKAGSYGS

SEQ ID NO: 1724293 - protein, 17 aa, Staphylococcus aureus
TFLASALILTGCASDQS

SEQ ID NO: 1724294 - protein, 22 aa, Staphylococcus aureus
LAKEWMEFLKSDKAKEILKEYH

SEQ ID NO: 1724295 - protein, 17 aa, Staphylococcus aureus
LVLTFAVVLAACGNGSK

SEQ ID NO: 1724296 - protein, 18 aa, Staphylococcus aureus
FNRGISDIDLRLSKQAKY

SEQ ID NO: 1724297 - protein, 17 aa, Staphylococcus aureus
IKVILPKVQVKPAARQS

SEQ ID NO: 1724298 - protein, 18 aa, Staphylococcus aureus
ILGLIVALFLVAACGNTD

SEQ ID NO: 1724299 - protein, 24 aa, Staphylococcus aureus
KADQFKYEVTLPQGVTYVNDSLTT

SEQ ID NO: 1724300 - protein, 19 aa, Staphylococcus aureus
LLGYYQSLKDSFNYGYKYL

SEQ ID NO: 1724301 - protein, 24 aa, Staphylococcus aureus
VIILLIGALGFAIYAAINHSTSSN

SEQ ID NO: 1724302 - protein, 18 aa, Staphylococcus aureus
VVLVLSLTVLSGCSLPGL

SEQ ID NO: 1724303 - protein, 22 aa, Staphylococcus aureus
DYTFASLDIFNDLKRRAQTILD

SEQ ID NO: 1724304 - protein, 19 aa, Staphylococcus aureus
ILVFILLFNIKDLTYAQGD

SEQ ID NO: 1724305 - protein, 19 aa, Staphylococcus aureus
NFYFNYPFLFGNDDYIFKK

SEQ ID NO: 1724306 - protein, 23 aa, Staphylococcus aureus
NNTSFWFDLFPKKELVPFVPYKF

SEQ ID NO: 1724307 - protein, 23 aa, Staphylococcus aureus
TARNEITAILNNKLQEIQATPDA

SEQ ID NO: 1724308 - protein, 29 aa, Staphylococcus aureus
AEKSVAYGPIWRLFKVPENVSHLKIQFVP

SEQ ID NO: 1724309 - protein, 17 aa, Staphylococcus aureus
FMPLIYKGEMMDLSRGR

SEQ ID NO: 1724310 - protein, 25 aa, Staphylococcus aureus
GMDLPLKEFALITGAALLARRRTKN

SEQ ID NO: 1724311 - protein, 19 aa, Staphylococcus aureus
HKHYFYNCYPKNANANGSG

SEQ ID NO: 1724312 - protein, 17 aa, Staphylococcus aureus
ICVKSCSLLFMLNGNPK

SEQ ID NO: 1724313 - protein, 21 aa, Staphylococcus aureus
ILVFILFFNIKDLSYAQGDIG

SEQ ID NO: 1724314 - protein, 19 aa, Staphylococcus aureus
IVICVLLVLITISQILKHF

SEQ ID NO: 1724315 - protein, 19 aa, Staphylococcus aureus
LFISVIILGIFIIGCDSSS

SEQ ID NO: 1724316 - protein, 25 aa, Staphylococcus aureus
RFMNIVPDYFIYKIALVGKDDKKYG

SEQ ID NO: 1724317 - protein, 18 aa, Staphylococcus aureus
SVFLMLNIKKGIFKTHPN

SEQ ID NO: 1724318 - protein, 19 aa, Staphylococcus aureus
TAKYYYNKYYQYKGLIDKT

SEQ ID NO: 1724319 - protein, 17 aa, Staphylococcus aureus
TVRFMNVIPNRFIYKIA

SEQ ID NO: 1724320 - protein, 18 aa, Staphylococcus aureus
VVALVCVIALSACGKEQT

SEQ ID NO: 1724321 - protein, 19 aa, Staphylococcus aureus
ALYISVMILIFAIAGCGKS

SEQ ID NO: 1724322 - protein, 24 aa, Staphylococcus aureus
DESIYDVVFLFPKSMQLKEVMEAM

SEQ ID NO: 1724323 - protein, 17 aa, Staphylococcus aureus
FWVAILSAIFLFAQNIA

SEQ ID NO: 1724324 - protein, 19 aa, Staphylococcus aureus
KNRSQNYVLIRLLNWLRTT

SEQ ID NO: 1724325 - protein, 24 aa, Staphylococcus aureus
KVYNLDPKLWYFAAGSTTTTIKQI

SEQ ID NO: 1724326 - protein, 17 aa, Staphylococcus aureus
LLIVILIGLLVIAYTHN

SEQ ID NO: 1724327 - protein, 20 aa, Staphylococcus aureus
MAIMLFLTGCGKSQEKATLE

SEQ ID NO: 1724328 - protein, 21 aa, Staphylococcus aureus
NAPALYPNYWGGNKFKVIEEL

SEQ ID NO: 1724329 - protein, 24 aa, Staphylococcus aureus
NNTSFWFDLFPKKELVPFVPYKFL

SEQ ID NO: 1724330 - protein, 24 aa, Staphylococcus aureus
RKKEDLEFIIDKFFKKIQQERPES

SEQ ID NO: 1724331 - protein, 17 aa, Staphylococcus aureus
SFIYYPQNDLKGLGGEH

SEQ ID NO: 1724332 - protein, 26 aa, Staphylococcus aureus
TTEKFLDFDLLFKSINWLDGISAEFK

SEQ ID NO: 1724333 - protein, 17 aa, Staphylococcus aureus
VLMLAVIVFAAACGNSS

SEQ ID NO: 1724334 - protein, 18 aa, Staphylococcus aureus
VVALICIIALSACGKEQT

SEQ ID NO: 1724335 - protein, 18 aa, Staphylococcus aureus
YYSYYYYNGYNNYNNYNN

SEQ ID NO: 1724336 - protein, 24 aa, Staphylococcus aureus
DTNDFPITWFYPLGEKKVERTTPK

SEQ ID NO: 1724337 - protein, 25 aa, Staphylococcus aureus
EMDLPLKELALITGAALLARRRSKK

SEQ ID NO: 1724338 - protein, 17 aa, Staphylococcus aureus
FLAIIITFTYGNFAEAS

SEQ ID NO: 1724339 - protein, 19 aa, Staphylococcus aureus
FRARFAVLAHLLTQREGLP

SEQ ID NO: 1724340 - protein, 17 aa, Staphylococcus aureus
ILIFVATIALSGCANDD

SEQ ID NO: 1724341 - protein, 18 aa, Staphylococcus aureus
ILILIATIALSGCANDDG

SEQ ID NO: 1724342 - protein, 24 aa, Staphylococcus aureus
IQFADIYLMALPTKAMREVATQIN

SEQ ID NO: 1724343 - protein, 26 aa, Staphylococcus aureus
RDESIYDVVFLFPKSMQLKEVMEDMK

SEQ ID NO: 1724344 - protein, 18 aa, Staphylococcus aureus
RNEYYYLTAIPYTLDEYK

SEQ ID NO: 1724345 - protein, 25 aa, Staphylococcus aureus
SKYDTPIPDWYLGSILNRLGDQIYY

SEQ ID NO: 1724346 - protein, 24 aa, Staphylococcus aureus
SWIDDGFLPLIYKGEMMDLSRGRA

SEQ ID NO: 1724347 - protein, 24 aa, Staphylococcus aureus
TEKFLDIDLLFKNFTWLDGKSAEF

SEQ ID NO: 1724348 - protein, 20 aa, Staphylococcus aureus
TLGICLVLLIILIGGCIIMT

SEQ ID NO: 1724349 - protein, 28 aa, Staphylococcus aureus
TMRYLKRLSWYISILILIVVIAGCGKGN

SEQ ID NO: 1724350 - protein, 17 aa, Staphylococcus aureus
VLAVMFLLAACGNNSDK

SEQ ID NO: 1724351 - protein, 18 aa, Staphylococcus aureus
YNYKYFYTYKVVKGVKKH

SEQ ID NO: 1724352 - protein, 18 aa, Staphylococcus aureus
DSGFYKTPKYSLGDYVWY

SEQ ID NO: 1724353 - protein, 23 aa, Staphylococcus aureus
FMNIVPDYFIYKIALVGKDDKKY

SEQ ID NO: 1724354 - protein, 17 aa, Staphylococcus aureus
ILILIATIALSGCANDD

SEQ ID NO: 1724355 - protein, 20 aa, Staphylococcus aureus
LGICLVLLIILIVGYVIMTK

SEQ ID NO: 1724356 - protein, 18 aa, Staphylococcus aureus
LGISFLFLVISITAGCGM

SEQ ID NO: 1724357 - protein, 19 aa, Staphylococcus aureus
LYISFLILIISIVAGCGTG

SEQ ID NO: 1724358 - protein, 21 aa, Staphylococcus aureus
LYISFLILVISFTAGCGMGKE

SEQ ID NO: 1724359 - protein, 21 aa, Staphylococcus aureus
RLWLYLVLLAVFIGACGMKKE

SEQ ID NO: 1724360 - protein, 17 aa, Staphylococcus aureus
TLIASALVLTTVGSGFH

SEQ ID NO: 1724361 - protein, 18 aa, Staphylococcus aureus
VVALVCIIALSACGKEQT

SEQ ID NO: 1724362 - protein, 22 aa, Staphylococcus aureus
ALYMSVLLLIIFIGGCGNMKEE

SEQ ID NO: 1724363 - protein, 22 aa, Staphylococcus aureus
DNAPALYPNYWGGNKFKVIEEL

SEQ ID NO: 1724364 - protein, 26 aa, Staphylococcus aureus
EKVVAYGPIWRLLKVPENVSHLKIQF

SEQ ID NO: 1724365 - protein, 18 aa, Staphylococcus aureus
KKYIIFPNPMYGSWEATI

SEQ ID NO: 1724366 - protein, 17 aa, Staphylococcus aureus
LSIILVVMGGWYHSAHA

SEQ ID NO: 1724367 - protein, 23 aa, Staphylococcus aureus
QYADIYLMALPTKAMREVATQIN

SEQ ID NO: 1724368 - protein, 21 aa, Staphylococcus aureus
TDLGRYFDRFADKLDKTQTNT

SEQ ID NO: 1724369 - protein, 20 aa, Staphylococcus aureus
TFASLDIFNDLKRRAQTILD

SEQ ID NO: 1724370 - protein, 17 aa, Staphylococcus aureus
NAKLCYIYKFRARFAVL

SEQ ID NO: 1724371 - protein, 20 aa, Staphylococcus aureus
VLGINLLFLVISITAGCGMG

SEQ ID NO: 1724372 - protein, 20 aa, Staphylococcus aureus
YWNSTLRWPGSYSVSIQNVD

SEQ ID NO: 1724373 - protein, 26 aa, Staphylococcus aureus
GLVLIMFVLCGFIFPLTVTALGQVLF

SEQ ID NO: 1724374 - protein, 24 aa, Staphylococcus aureus
IQFADIYLMALPTKAMREVASQIN

SEQ ID NO: 1724375 - protein, 26 aa, Staphylococcus aureus
KLIVVLCAIIVFIALIGLSIRSQSQS

SEQ ID NO: 1724376 - protein, 24 aa, Staphylococcus aureus
MLGICLVLLIILIVGYVIMTKINS

SEQ ID NO: 1724377 - protein, 21 aa, Staphylococcus aureus
QCDQLIILTAIDYVYINFNTE

SEQ ID NO: 1724378 - protein, 18 aa, Staphylococcus aureus
TLLQFSWYSHIQVYGPES

SEQ ID NO: 1724379 - protein, 21 aa, Staphylococcus aureus
TNMLTFHKYNLYNLTMNEYND

SEQ ID NO: 1724380 - protein, 18 aa, Staphylococcus aureus
EYLKENLNWIWNSLSIED

SEQ ID NO: 1724381 - protein, 18 aa, Staphylococcus aureus
GIFYYQHSKKSLGIWFVV

SEQ ID NO: 1724382 - protein, 17 aa, Staphylococcus aureus
LTFLFVCSLIVCGFFAY

SEQ ID NO: 1724383 - protein, 17 aa, Staphylococcus aureus
LTGFILILLLEGIFTNS

SEQ ID NO: 1724384 - protein, 25 aa, Staphylococcus aureus
QKADLNMFFPFVITGNLIGKATEKE

SEQ ID NO: 1724385 - protein, 24 aa, Staphylococcus aureus
TVSDYYYWKIIDSLEAQFTGAIDL

SEQ ID NO: 1724386 - protein, 19 aa, Staphylococcus aureus
CLMLYLLIFLSSCGTNNKI

SEQ ID NO: 1724387 - protein, 18 aa, Staphylococcus aureus
FLGFVAVILTVCLIGLLI

SEQ ID NO: 1724388 - protein, 17 aa, Staphylococcus aureus
LLFLIFLSACTNTRHSE

SEQ ID NO: 1724389 - protein, 22 aa, Staphylococcus aureus
TALHRTYFVFPENKKVLYQEID

SEQ ID NO: 1724390 - protein, 24 aa, Staphylococcus aureus
VEGGPTLRLFKVPDNVRNLKIQFV

SEQ ID NO: 1724391 - protein, 26 aa, Staphylococcus aureus
VIHACVLLFIIISIGLVFHRLQTKTN

SEQ ID NO: 1724392 - protein, 18 aa, Staphylococcus aureus
ISLIILSLLISITMSNAS

SEQ ID NO: 1724393 - protein, 19 aa, Staphylococcus aureus
NIKVILPKVQVKPAARQSV

SEQ ID NO: 1724394 - protein, 27 aa, Staphylococcus aureus
TVRFMNVIPDWFIYKIALVGKDDKKYK

SEQ ID NO: 1724395 - protein, 18 aa, Staphylococcus aureus
DGNNNIKVILPKVQVKPA

SEQ ID NO: 1724396 - protein, 20 aa, Staphylococcus aureus
DHKSLIYRYDATLGTQITTN

SEQ ID NO: 1724397 - protein, 25 aa, Staphylococcus aureus
DTNGFPITWFYPLGEKKVERKAPKL

SEQ ID NO: 1724398 - protein, 19 aa, Staphylococcus aureus
IFILILIVLMAGCESNKIT

SEQ ID NO: 1724399 - protein, 19 aa, Staphylococcus aureus
LLFIALTLTTSPLVNGSEK

SEQ ID NO: 1724400 - protein, 19 aa, Staphylococcus aureus
LLFLIFLSSCANTRHSESD

SEQ ID NO: 1724401 - protein, 22 aa, Staphylococcus aureus
LTGFILILLLEGIFTNSASAIE

SEQ ID NO: 1724402 - protein, 21 aa, Staphylococcus aureus
LVLGISFLFLIISIFAGCGTG

SEQ ID NO: 1724403 - protein, 22 aa, Staphylococcus aureus
MVFIMLLNIITPLFNKNEAFAA

SEQ ID NO: 1724404 - protein, 18 aa, Staphylococcus aureus
NFYFNYPFLFGNDDYIFK

SEQ ID NO: 1724405 - protein, 17 aa, Staphylococcus aureus
SKSEQIYYRALTEYLTS

SEQ ID NO: 1724406 - protein, 19 aa, Staphylococcus aureus
SKVNESFIYYPQNDLKGLG

SEQ ID NO: 1724407 - protein, 18 aa, Staphylococcus aureus
TILMTKMMLPLMMNQGGS

SEQ ID NO: 1724408 - protein, 19 aa, Staphylococcus aureus
TQFIIDEILAIKLPAEVIK

SEQ ID NO: 1724409 - protein, 23 aa, Staphylococcus aureus
ALYMSVLLLIIFIGGCGNMKDEQ

SEQ ID NO: 1724410 - protein, 23 aa, Staphylococcus aureus
EKPTLIYFMATWCPSCIYNEEIF

SEQ ID NO: 1724411 - protein, 18 aa, Staphylococcus aureus
FWVAILSAIFLFAQNIAK

SEQ ID NO: 1724412 - protein, 18 aa, Staphylococcus aureus
GFMPLIYKGEMMDLSRGR

SEQ ID NO: 1724413 - protein, 27 aa, Staphylococcus aureus
GHAPHENMIYWFALPAGQTPVGRTEFV

SEQ ID NO: 1724414 - protein, 17 aa, Staphylococcus aureus
HWISILPVIIFNKGPRL

SEQ ID NO: 1724415 - protein, 30 aa, Staphylococcus aureus
LIDSRYLNSALYYLEDYIIYAIGLTNKYEY

SEQ ID NO: 1724416 - protein, 24 aa, Staphylococcus aureus
LTAKKSYFILNDKIVFLGTGIKST

SEQ ID NO: 1724417 - protein, 27 aa, Staphylococcus aureus
NLNNMNFLRWVNFPQDYTVTWTNAKIA

SEQ ID NO: 1724418 - protein, 25 aa, Staphylococcus aureus
QLKDGYKYYSFVDSIGLHSGSHVFV

SEQ ID NO: 1724419 - protein, 20 aa, Staphylococcus aureus
SGIFYYQHSKKALGIWFVVD

SEQ ID NO: 1724420 - protein, 18 aa, Staphylococcus aureus
APYNLPTTPWNTLKASDA

SEQ ID NO: 1724421 - protein, 27 aa, Staphylococcus aureus
DEYVVLRFGWLYGPGTWYGKDGMIYNQ

SEQ ID NO: 1724422 - protein, 23 aa, Staphylococcus aureus
DGNNNIKVILPKVQVKPAARQSV

SEQ ID NO: 1724423 - protein, 18 aa, Staphylococcus aureus
DTEDFYITLKIIDVKQPE

SEQ ID NO: 1724424 - protein, 17 aa, Staphylococcus aureus
FGYYSFREAPKTQIYTV

SEQ ID NO: 1724425 - protein, 19 aa, Staphylococcus aureus
GYYSYYYYNGYNNYNNYNN

SEQ ID NO: 1724426 - protein, 19 aa, Staphylococcus aureus
KIDWNRHGFWGYWSGENHV

SEQ ID NO: 1724427 - protein, 21 aa, Staphylococcus aureus
LYISFLILVISFTAGCGIGKE

SEQ ID NO: 1724428 - protein, 22 aa, Staphylococcus aureus
NVVPDYFIYKIALVGKDDKKYG

SEQ ID NO: 1724429 - protein, 22 aa, Staphylococcus aureus
RTGSPIRLMIGFDYPDAFGNGE

SEQ ID NO: 1724430 - protein, 18 aa, Staphylococcus aureus
SFALYISILLLIVVVAGC

SEQ ID NO: 1724431 - protein, 18 aa, Staphylococcus aureus
SKVNESFIYYPQNDLKGL

SEQ ID NO: 1724432 - protein, 21 aa, Staphylococcus aureus
STVIATLVFLGLNTSQAQAAE

SEQ ID NO: 1724433 - protein, 18 aa, Staphylococcus aureus
TIDKLYYAAGGRALEYNQ

SEQ ID NO: 1724434 - protein, 24 aa, Staphylococcus aureus
TVSLFFFTFLIKNNLAYADVGVIN

SEQ ID NO: 1724435 - protein, 17 aa, Staphylococcus aureus
YDWPTVHINSLKDLARA

SEQ ID NO: 1724436 - protein, 20 aa, Staphylococcus aureus
AGVVLILVAAYLFAKPHIDN

SEQ ID NO: 1724437 - protein, 19 aa, Staphylococcus aureus
GTILMTKMMLPLMMNQGGS

SEQ ID NO: 1724438 - protein, 17 aa, Staphylococcus aureus
LYISVMILMFAIAGCGK

SEQ ID NO: 1724439 - protein, 21 aa, Staphylococcus aureus
TDLGRYFDRFADKLDKTQTNA

SEQ ID NO: 1724440 - protein, 28 aa, Staphylococcus aureus
TTVRFMNVIPDWFIYKIALVGKDDKKYK

SEQ ID NO: 1724441 - protein, 20 aa, Staphylococcus aureus
VLGISFLFLIISIFAGCGTG

SEQ ID NO: 1724442 - protein, 17 aa, Staphylococcus aureus
VVIAMLLVLAGCSNSND

SEQ ID NO: 1724443 - protein, 25 aa, Staphylococcus aureus
ADAVYKAQLYLSPYGPKQYVEHLNQ

SEQ ID NO: 1724444 - protein, 20 aa, Staphylococcus aureus
ALHRTYFIFPENKNVLYQEI

SEQ ID NO: 1724445 - protein, 24 aa, Staphylococcus aureus
DAVYKAQLYLTPYGPKQYVEHLNQ

SEQ ID NO: 1724446 - protein, 25 aa, Staphylococcus aureus
DESIYDVVFLFPKSMQLKEVMEDMK

SEQ ID NO: 1724447 - protein, 20 aa, Staphylococcus aureus
FLSIILVVMSGLYHSAHASD

SEQ ID NO: 1724448 - protein, 19 aa, Staphylococcus aureus
FSFLALLLSFTSYAKAEDL

SEQ ID NO: 1724449 - protein, 17 aa, Staphylococcus aureus
IGTVLLLSNPNGAQALT

SEQ ID NO: 1724450 - protein, 24 aa, Staphylococcus aureus
KADQFKYEVTLPQGVTYVNNSLTT

SEQ ID NO: 1724451 - protein, 21 aa, Staphylococcus aureus
KFSIRKYTVGTFSTVIATLVF

SEQ ID NO: 1724452 - protein, 28 aa, Staphylococcus aureus
KGHAPHQNMIFWFALPADQVPVGRTDFV

SEQ ID NO: 1724453 - protein, 18 aa, Staphylococcus aureus
LITLFSIMFMVPNDTFAE

SEQ ID NO: 1724454 - protein, 25 aa, Staphylococcus aureus
LLPGDYFGTIRFGRKEQLFEIRVKP

SEQ ID NO: 1724455 - protein, 18 aa, Staphylococcus aureus
NIKVILPKVQVKPAARQS

SEQ ID NO: 1724456 - protein, 19 aa, Staphylococcus aureus
PVTYAGFKWNGKAFACSMA

SEQ ID NO: 1724457 - protein, 18 aa, Staphylococcus aureus
RARFAVLAHLLTQREGLP

SEQ ID NO: 1724458 - protein, 22 aa, Staphylococcus aureus
TLGICLVLLIILIGGCVIMTKT

SEQ ID NO: 1724459 - protein, 29 aa, Staphylococcus aureus
YSIRKYKVGIFSTLIGTVLLLSNPNGAQA

SEQ ID NO: 1724460 - protein, 18 aa, Staphylococcus aureus
AMTALKRAIADKADTKAS

SEQ ID NO: 1724461 - protein, 17 aa, Staphylococcus aureus
EYLKENLNWIWNSLSIE

SEQ ID NO: 1724462 - protein, 21 aa, Staphylococcus aureus
GLPTDGFTYKWNNAATGTNDA

SEQ ID NO: 1724463 - protein, 26 aa, Staphylococcus aureus
GMDLPLKEFALITGAALLARRRTKNE

SEQ ID NO: 1724464 - protein, 25 aa, Staphylococcus aureus
HKDTEDFYITLKIIDVKQPEGDQRV

SEQ ID NO: 1724465 - protein, 17 aa, Staphylococcus aureus
KNRSQNYALIRLLNWLR

SEQ ID NO: 1724466 - protein, 19 aa, Staphylococcus aureus
LTKRMIWPFQYNIGLTTKD

SEQ ID NO: 1724467 - protein, 23 aa, Staphylococcus aureus
PARLMPDKILDLRYKLRVNNVPT

SEQ ID NO: 1724468 - protein, 18 aa, Staphylococcus aureus
QNEYFYITYLSRNLKEYR

SEQ ID NO: 1724469 - protein, 20 aa, Staphylococcus aureus
QPMTFRLLLVDTPETKHPKK

SEQ ID NO: 1724470 - protein, 20 aa, Staphylococcus aureus
RNEYYYLTAIPYTLDEYKKY

SEQ ID NO: 1724471 - protein, 18 aa, Staphylococcus aureus
RSFYSIRKSTLGVASVIV

SEQ ID NO: 1724472 - protein, 19 aa, Staphylococcus aureus
WFISVIILGIFIIGCDSSS

SEQ ID NO: 1724473 - protein, 22 aa, Staphylococcus aureus
ADSSLLHLSFNRDYNWYGSMIG

SEQ ID NO: 1724474 - protein, 21 aa, Staphylococcus aureus
CFDLVNVYWNHLYGHGLKGYG

SEQ ID NO: 1724475 - protein, 17 aa, Staphylococcus aureus
DYTFASLDIFNDLKRRA

SEQ ID NO: 1724476 - protein, 18 aa, Staphylococcus aureus
FVATLTTATLVSSPAANA

SEQ ID NO: 1724477 - protein, 24 aa, Staphylococcus aureus
GANKPLPEMWPYGVNDSRSWDYKI

SEQ ID NO: 1724478 - protein, 22 aa, Staphylococcus aureus
GDTFTFKYGQYFRPGSVRLPSQ

SEQ ID NO: 1724479 - protein, 27 aa, Staphylococcus aureus
GTHKKLTFVLWVLLIGSVGFGIYKNFT

SEQ ID NO: 1724480 - protein, 18 aa, Staphylococcus aureus
HWISILPVIIFNKGPRLV

SEQ ID NO: 1724481 - protein, 18 aa, Staphylococcus aureus
IFLFLLLNSNSEDSGNIT

SEQ ID NO: 1724482 - protein, 24 aa, Staphylococcus aureus
IQYADIYLMALPTKAMREVATQIN

SEQ ID NO: 1724483 - protein, 20 aa, Staphylococcus aureus
KFSIRKYTVGTFSTVIATLV

SEQ ID NO: 1724484 - protein, 28 aa, Staphylococcus aureus
KGHAPHENMIYWFALPAGQTPVGRTEFV

SEQ ID NO: 1724485 - protein, 24 aa, Staphylococcus aureus
KPKPWDVYAFPYYYVYNDFSDHYP

SEQ ID NO: 1724486 - protein, 25 aa, Staphylococcus aureus
KYDTAKYYYNTYYKYKGAIDKAVLT

SEQ ID NO: 1724487 - protein, 21 aa, Staphylococcus aureus
LAKEWMEFLKSDKAKEILKEY

SEQ ID NO: 1724488 - protein, 19 aa, Staphylococcus aureus
LLFLIFLSACANTRHSESD

SEQ ID NO: 1724489 - protein, 18 aa, Staphylococcus aureus
LLFLIFLSACTNTRHSES

SEQ ID NO: 1724490 - protein, 18 aa, Staphylococcus aureus
LLISVIILTIFIMGCDSQ

SEQ ID NO: 1724491 - protein, 19 aa, Staphylococcus aureus
LLISVIILTIFIMGCDSQS

SEQ ID NO: 1724492 - protein, 23 aa, Staphylococcus aureus
LPGDYFGTIRFGRKEQLFEIRVK

SEQ ID NO: 1724493 - protein, 21 aa, Staphylococcus aureus
NGKYRFDNLDSGKYKVIFEKP

SEQ ID NO: 1724494 - protein, 26 aa, Staphylococcus aureus
PDESIYDVVFLFPKSMQLKEVMEDMK

SEQ ID NO: 1724495 - protein, 19 aa, Staphylococcus aureus
QILLVVIIIIFGYKIVQTY

SEQ ID NO: 1724496 - protein, 17 aa, Staphylococcus aureus
QSTWDSVAPAKYKGVSP

SEQ ID NO: 1724497 - protein, 19 aa, Staphylococcus aureus
RSFYSIRKSTLGVASVIVS

SEQ ID NO: 1724498 - protein, 29 aa, Staphylococcus aureus
SNLANMNFLRWVNFPQDYTVTWTNAKIAN

SEQ ID NO: 1724499 - protein, 18 aa, Staphylococcus aureus
SSLFVATLTTATLVSSPA

SEQ ID NO: 1724500 - protein, 23 aa, Staphylococcus aureus
TDKYGYYNYAGYSNFIVTSNDTG

SEQ ID NO: 1724501 - protein, 29 aa, Staphylococcus aureus
TNKDGYKYYSFIDNVGLFSGSHLYVKNRD

SEQ ID NO: 1724502 - protein, 22 aa, Staphylococcus aureus
YQNEYFYITYLSRNLKEYRKYY

SEQ ID NO: 1724503 - protein, 19 aa, Staphylococcus aureus
ALHRTYFIFPENKNVLYQE

SEQ ID NO: 1724504 - protein, 22 aa, Staphylococcus aureus
ALYMSVFLLIIFIVGCRNMKDE

SEQ ID NO: 1724505 - protein, 18 aa, Staphylococcus aureus
APYNLPTTPWNTLKASDS

SEQ ID NO: 1724506 - protein, 18 aa, Staphylococcus aureus
ASITAYNNSIRALQSDLT

SEQ ID NO: 1724507 - protein, 24 aa, Staphylococcus aureus
ATARNEITAILNNKLQEIQATPDA

SEQ ID NO: 1724508 - protein, 23 aa, Staphylococcus aureus
DADRLDLQFIPDNTAVADASRIT

SEQ ID NO: 1724509 - protein, 24 aa, Staphylococcus aureus
DESIYDVVFLFPKSMQLKEVMEDM

SEQ ID NO: 1724510 - protein, 17 aa, Staphylococcus aureus
DKILDLRYKLRVNNVPT

SEQ ID NO: 1724511 - protein, 18 aa, Staphylococcus aureus
DSGFYKTPKYNLGNYVWE

SEQ ID NO: 1724512 - protein, 29 aa, Staphylococcus aureus
EAARTRNPIRLMIGFDYPDGYGNSETLVP

SEQ ID NO: 1724513 - protein, 21 aa, Staphylococcus aureus
EKLIYWNPWDTELSIQDADSS

SEQ ID NO: 1724514 - protein, 25 aa, Staphylococcus aureus
GDTFTFKYGQYFRPGSVRLPSQTQN

SEQ ID NO: 1724515 - protein, 17 aa, Staphylococcus aureus
GIKGVYVILKDSNGKEL

SEQ ID NO: 1724516 - protein, 17 aa, Staphylococcus aureus
GTFSTVIATLVFLGLNT

SEQ ID NO: 1724517 - protein, 18 aa, Staphylococcus aureus
IPINIWINGNHKTISTNK

SEQ ID NO: 1724518 - protein, 18 aa, Staphylococcus aureus
IVICVLLVLITISQILKH

SEQ ID NO: 1724519 - protein, 17 aa, Staphylococcus aureus
KGAPYNLPTTPWNTLKA

SEQ ID NO: 1724520 - protein, 20 aa, Staphylococcus aureus
KSIDQFLYFDLIYSIKDTKL

SEQ ID NO: 1724521 - protein, 17 aa, Staphylococcus aureus
KSRNIPINIWINGNHKT

SEQ ID NO: 1724522 - protein, 26 aa, Staphylococcus aureus
LANMNFLRWVNFPQDYTVTWTNAKIA

SEQ ID NO: 1724523 - protein, 17 aa, Staphylococcus aureus
LGFVAVILTVCLIGLLI

SEQ ID NO: 1724524 - protein, 19 aa, Staphylococcus aureus
LVGNLLPGDYFGTIRFGRK

SEQ ID NO: 1724525 - protein, 17 aa, Staphylococcus aureus
MIGFDYPDGYGNSETLV

SEQ ID NO: 1724526 - protein, 18 aa, Staphylococcus aureus
NGKYRFDNLDSGKYKVIF

SEQ ID NO: 1724527 - protein, 22 aa, Staphylococcus aureus
NGKYRFDNLDSGKYKVIFEKPA

SEQ ID NO: 1724528 - protein, 20 aa, Staphylococcus aureus
NKVLGFYPTSANTNAFRPGG

SEQ ID NO: 1724529 - protein, 21 aa, Staphylococcus aureus
PARLMPDKILDLRYKLRVNNV

SEQ ID NO: 1724530 - protein, 26 aa, Staphylococcus aureus
PDESIYDVVFLFPKSMQLKEVMEAMK

SEQ ID NO: 1724531 - protein, 20 aa, Staphylococcus aureus
PPSGYKWYDPTTFKAGSYGS

SEQ ID NO: 1724532 - protein, 20 aa, Staphylococcus aureus
QNEYFYITYLSRNLKEYRKY

SEQ ID NO: 1724533 - protein, 23 aa, Staphylococcus aureus
RTRNPIRLMIGFDYPDGYGNSET

SEQ ID NO: 1724534 - protein, 26 aa, Staphylococcus aureus
SDAVYKAQLYLTPYGPKQYVEHLNQN

SEQ ID NO: 1724535 - protein, 30 aa, Staphylococcus aureus; identical to SEQ ID NO: 1715591

SEQ ID NO: 1724536 - protein, 29 aa, Staphylococcus aureus
SNLNNMNFLRWVNFPQDYTVTWTNAKIAN

SEQ ID NO: 1724537 - protein, 22 aa, Staphylococcus aureus
TARNEITAILNNKLQEIQATPD

SEQ ID NO: 1724538 - protein, 26 aa, Staphylococcus aureus
TLGICLVLLIILIVGYVIMTKANGQN

SEQ ID NO: 1724539 - protein, 17 aa, Staphylococcus aureus
VDNLPGFTLINGGKVGV

SEQ ID NO: 1724540 - protein, 17 aa, Staphylococcus aureus
VLAILFVVISACGNKEK

SEQ ID NO: 1724541 - protein, 26 aa, Staphylococcus aureus
VVFSLFFFLLLFLVIFFADDTDSGEN

SEQ ID NO: 1724542 - protein, 17 aa, Staphylococcus aureus
YGQYFRPGSVRLPSQTQ

SEQ ID NO: 1724543 - protein, 18 aa, Staphylococcus aureus
YNGHTFATSLPAKFVVKD

SEQ ID NO: 1724544 - protein, 18 aa, Staphylococcus aureus
AMGQLQHAIADKTTTLAS

SEQ ID NO: 1724545 - protein, 25 aa, Staphylococcus aureus
ASSKGAPYNLPTTPWNTLKASDSKE

SEQ ID NO: 1724546 - protein, 20 aa, Staphylococcus aureus
DAINIYFVPSDLVNPTISVG

SEQ ID NO: 1724547 - protein, 19 aa, Staphylococcus aureus
DKPRNIPINIWINGNHKTI

SEQ ID NO: 1724548 - protein, 19 aa, Staphylococcus aureus
DLGRYFDRFADKLDKTQTN

SEQ ID NO: 1724549 - protein, 20 aa, Staphylococcus aureus
DNIKVILPKVQVKPAARQSV

SEQ ID NO: 1724550 - protein, 17 aa, Staphylococcus aureus
DTGFYKEPKYNLGDYVW

SEQ ID NO: 1724551 - protein, 28 aa, Staphylococcus aureus
EKVVAYGPIWRLFKVPENVSHLKIQFSP

SEQ ID NO: 1724552 - protein, 25 aa, Staphylococcus aureus
EMDLPLKEFALITGAALLARRRTKN

SEQ ID NO: 1724553 - protein, 17 aa, Staphylococcus aureus
FKFRGIKIQVLLPGNDK

SEQ ID NO: 1724554 - protein, 31 aa, Staphylococcus aureus; identical to SEQ ID NO: 1599598

SEQ ID NO: 1724555 - protein, 31 aa, Staphylococcus aureus
FSIRKFNVGIFSALIATVTFISINPTTASAA

SEQ ID NO: 1724556 - protein, 32 aa, Staphylococcus aureus
FSIRKFNVGIFSALIATVTFISINPTTASAAE

SEQ ID NO: 1724557 - protein, 29 aa, Staphylococcus aureus
FSIRKFNVGIFSALIATVTFISTNPTTAS

SEQ ID NO: 1724558 - protein, 26 aa, Staphylococcus aureus
GLFSGSHLYVKNRDLAPKATNNKEFT

SEQ ID NO: 1724559 - protein, 17 aa, Staphylococcus aureus
GNDNIKVILPKVQVKPA

SEQ ID NO: 1724560 - protein, 24 aa, Staphylococcus aureus
HTKEVLFPDKSLKLSYKVNVANID

SEQ ID NO: 1724561 - protein, 19 aa, Staphylococcus aureus
IILLFLSIISMSTLSKVQA

SEQ ID NO: 1724562 - protein, 20 aa, Staphylococcus aureus
LFISVIILTIFIMGCDSQSD

SEQ ID NO: 1724563 - protein, 24 aa, Staphylococcus aureus
LFSGSHLYVKNRDLAPKATNNKEF

SEQ ID NO: 1724564 - protein, 20 aa, Staphylococcus aureus
LLFIALTWTTSPLVNGSEKS

SEQ ID NO: 1724565 - protein, 18 aa, Staphylococcus aureus
LLFLIFLSACANTRHSES

SEQ ID NO: 1724566 - protein, 24 aa, Staphylococcus aureus
LRDGYKYYDFVDSIGLHSGSHLYV

SEQ ID NO: 1724567 - protein, 19 aa, Staphylococcus aureus
MLGISFLFLVISITAGCGM

SEQ ID NO: 1724568 - protein, 23 aa, Staphylococcus aureus
MNVVPDYFIYKIALVGKDDKKYG

SEQ ID NO: 1724569 - protein, 23 aa, Staphylococcus aureus
NHQTQIIKILSKVKPDPPRIDGN

SEQ ID NO: 1724570 - protein, 19 aa, Staphylococcus aureus
NIPINIWINGNHKTISTNK

SEQ ID NO: 1724571 - protein, 27 aa, Staphylococcus aureus
NKDGYKYYSFIDNVGLFSGSHLYVKNR

SEQ ID NO: 1724572 - protein, 27 aa, Staphylococcus aureus
NLANMNFLRWVNFPQDYTVTWTNAKIA

SEQ ID NO: 1724573 - protein, 25 aa, Staphylococcus aureus
NLENQFYNIFHLLDQHKYAEKEYKD

SEQ ID NO: 1724574 - protein, 17 aa, Staphylococcus aureus
NVYQFEFPQTSYTTTVG

SEQ ID NO: 1724575 - protein, 17 aa, Staphylococcus aureus
PARLMPDKILDLKYKLR

SEQ ID NO: 1724576 - protein, 17 aa, Staphylococcus aureus
PVNISGIPLDPSALVYL

SEQ ID NO: 1724577 - protein, 29 aa, Staphylococcus aureus
QAARTGSPIRLMIGFDYPDAFGNGETLVP

SEQ ID NO: 1724578 - protein, 20 aa, Staphylococcus aureus
QAYNFLITSSQRWGLNQGIN

SEQ ID NO: 1724579 - protein, 22 aa, Staphylococcus aureus
QEKLIYWNPWDTELSIQDADSS

SEQ ID NO: 1724580 - protein, 26 aa, Staphylococcus aureus
QLRDGYKYYDFVDSIGLHSGSHVYVE

SEQ ID NO: 1724581 - protein, 19 aa, Staphylococcus aureus
QVIYSWPTVHVYSLEDLSR

SEQ ID NO: 1724582 - protein, 18 aa, Staphylococcus aureus
RKEQLFEIRVKPHTPRIT

SEQ ID NO: 1724583 - protein, 20 aa, Staphylococcus aureus
RLDLQFIPDNTAVADASRIT

SEQ ID NO: 1724584 - protein, 19 aa, Staphylococcus aureus
RVILIFALILVISTPNVLA

SEQ ID NO: 1724585 - protein, 18 aa, Staphylococcus aureus
SVLAHYWGGNKMNIRQDL

SEQ ID NO: 1724586 - protein, 21 aa, Staphylococcus aureus
TDAINIYFVPSDLVNPTISVG

SEQ ID NO: 1724587 - protein, 20 aa, Staphylococcus aureus
TDKDWQITGIPRTLHIENST

SEQ ID NO: 1724588 - protein, 21 aa, Staphylococcus aureus
TDKDWQITGIPRTLHIENSTN

SEQ ID NO: 1724589 - protein, 29 aa, Staphylococcus aureus
TISFKTQGPTIDKLYYAAGGRALEYNQLF

SEQ ID NO: 1724590 - protein, 25 aa, Staphylococcus aureus
TKKDYDLIFYRTYSDALMPYNFISS

SEQ ID NO: 1724591 - protein, 17 aa, Staphylococcus aureus
TNDILTMLKATTTVPGL

SEQ ID NO: 1724592 - protein, 22 aa, Staphylococcus aureus
TNEAINIYFVPSDLVNPTISVG

SEQ ID NO: 1724593 - protein, 22 aa, Staphylococcus aureus
TTNDILTLLKATTTVPGLRNNI

SEQ ID NO: 1724594 - protein, 18 aa, Staphylococcus aureus
TVIATLVFLGFNTSQAHA

SEQ ID NO: 1724595 - protein, 20 aa, Staphylococcus aureus
VYKAQLYLSPYGPKQYVEHL

SEQ ID NO: 1724596 - protein, 19 aa, Staphylococcus aureus
YNGHTFATSLPAKFVVKDV

SEQ ID NO: 1724597 - protein, 31 aa, Staphylococcus aureus; identical to SEQ ID NO: 1599492

SEQ ID NO: 1724598 - protein, 28 aa, Staphylococcus aureus
AARTGSPIRLMIGFDYPDAFGNGETLVP

SEQ ID NO: 1724599 - protein, 19 aa, Staphylococcus aureus
ADQFKYEVTLPQGVTYVNN

SEQ ID NO: 1724600 - protein, 19 aa, Staphylococcus aureus
ALEYNQLFMYSQLYVESTQ

SEQ ID NO: 1724601 - protein, 22 aa, Staphylococcus aureus
ALEYNQLFMYSQLYVESTQDHQ

SEQ ID NO: 1724602 - protein, 17 aa, Staphylococcus aureus
ALLFFTSLVISPLNVKA

SEQ ID NO: 1724603 - protein, 18 aa, Staphylococcus aureus
ALLFFTSLVISPLNVKAN

SEQ ID NO: 1724604 - protein, 18 aa, Staphylococcus aureus
AMGQLQHAIADKTNTLAS

SEQ ID NO: 1724605 - protein, 17 aa, Staphylococcus aureus
ASITAYNNSIRALQSDL

SEQ ID NO: 1724606 - protein, 25 aa, Staphylococcus aureus
ASSKGAPYNLPTTPWNTLKASDAKE

SEQ ID NO: 1724607 - protein, 28 aa, Staphylococcus aureus
ASSKGAPYNLPTTPWNTLKASDAKEIAL

SEQ ID NO: 1724608 - protein, 26 aa, Staphylococcus aureus
ASSKGAPYNLPTTPWNTLKASDSKEI

SEQ ID NO: 1724609 - protein, 22 aa, Staphylococcus aureus
CVILIFALILVLFTPNVLAESQ

SEQ ID NO: 1724610 - protein, 23 aa, Staphylococcus aureus
CVILIFALILVLFTPNVLAESQP

SEQ ID NO: 1724611 - protein, 19 aa, Staphylococcus aureus
DGFMPLIYKGEMMDLSRGR

SEQ ID NO: 1724612 - protein, 20 aa, Staphylococcus aureus
DGFMPLIYKGEMMDLSRGRA

SEQ ID NO: 1724613 - protein, 23 aa, Staphylococcus aureus
DGNDNIKVILPKVQVKPAARQSV

SEQ ID NO: 1724614 - protein, 20 aa, Staphylococcus aureus
DKPRNIPINIWINGNHKTIS

SEQ ID NO: 1724615 - protein, 18 aa, Staphylococcus aureus
DLGIYKPKYNLGDYVWED

SEQ ID NO: 1724616 - protein, 20 aa, Staphylococcus aureus
DLGRYFDRFADKLDKTQTNA

SEQ ID NO: 1724617 - protein, 17 aa, Staphylococcus aureus
DSGFYKTPKYNLGNYVW

SEQ ID NO: 1724618 - protein, 17 aa, Staphylococcus aureus
DSGFYKTPKYSLGDYVW

SEQ ID NO: 1724619 - protein, 17 aa, Staphylococcus aureus
ETQYYHFFSIKDPADVY

SEQ ID NO: 1724620 - protein, 18 aa, Staphylococcus aureus
FILLSFIALTLITSPFVN

SEQ ID NO: 1724621 - protein, 29 aa, Staphylococcus aureus
FKTQGPTVNKLYYAAGGRALEYNQLFMYS

SEQ ID NO: 1724622 - protein, 39 aa, Staphylococcus aureus; identical to SEQ ID NO: 1598888

SEQ ID NO: 1724623 - protein, 25 aa, Staphylococcus aureus
FSTVIATLVFLGFNTSQAHAAETNQ

SEQ ID NO: 1724624 - protein, 23 aa, Staphylococcus aureus
FTDKDWQITGIPRTLHIENSTNR

SEQ ID NO: 1724625 - protein, 19 aa, Staphylococcus aureus
FVCSLIVCRFFAYKIYFPT

SEQ ID NO: 1724626 - protein, 24 aa, Staphylococcus aureus
GASSILIATLLFLSDGQAQAAEKQ

SEQ ID NO: 1724627 - protein, 27 aa, Staphylococcus aureus
GEKVVAYGPIWRLLKVPENVSHLKIQF

SEQ ID NO: 1724628 - protein, 17 aa, Staphylococcus aureus
GNNNIKVILPKVQVKPA

SEQ ID NO: 1724629 - protein, 22 aa, Staphylococcus aureus
GPTVNKLYYAAGGRALEYNQLF

SEQ ID NO: 1724630 - protein, 26 aa, Staphylococcus aureus
GQVIYDWPTVHINSLKDLARASDYFS

SEQ ID NO: 1724631 - protein, 27 aa, Staphylococcus aureus
GQVIYDWPTVHINSLKDLARASDYFSE

SEQ ID NO: 1724632 - protein, 18 aa, Staphylococcus aureus
GVVLILVAAYLFAKPHID

SEQ ID NO: 1724633 - protein, 25 aa, Staphylococcus aureus
HAPHENMIYWFALPAGQTPVGRTEF

SEQ ID NO: 1724634 - protein, 18 aa, Staphylococcus aureus
HLYVKNRDLAPKATNNKE

SEQ ID NO: 1724635 - protein, 17 aa, Staphylococcus aureus
ILILVATIALSGCANDD

SEQ ID NO: 1724636 - protein, 17 aa, Staphylococcus aureus
ILTLLKATTTVPGLRNN

SEQ ID NO: 1724637 - protein, 26 aa, Staphylococcus aureus
ITIRPQDYVVFIPPVGKQIRAVVYYN

SEQ ID NO: 1724638 - protein, 21 aa, Staphylococcus aureus
IVQILLVVIIIIFGCKIVQTY

SEQ ID NO: 1724639 - protein, 24 aa, Staphylococcus aureus
KADQFKYEVTLPQGVTYINDSLTT

SEQ ID NO: 1724640 - protein, 20 aa, Staphylococcus aureus
KGAPYNLPTTPWNTLKASDS

SEQ ID NO: 1724641 - protein, 17 aa, Staphylococcus aureus
KLRQYLIQDFDLYKKFP

SEQ ID NO: 1724642 - protein, 43 aa, Staphylococcus aureus; identical to SEQ ID NO: 1598738

SEQ ID NO: 1724643 - protein, 25 aa, Staphylococcus aureus
KSWIDDGFLPLIYKGEMMDLSRGRA

SEQ ID NO: 1724644 - protein, 18 aa, Staphylococcus aureus
KTQGPTVNKLYYAAGGRA

SEQ ID NO: 1724645 - protein, 17 aa, Staphylococcus aureus
KVQTLKKLLMKVMALNF

SEQ ID NO: 1724646 - protein, 19 aa, Staphylococcus aureus
LDPSALVYLVAPTNQTTNG

SEQ ID NO: 1724647 - protein, 17 aa, Staphylococcus aureus
LEYNQLFMYSQLYVEST

SEQ ID NO: 1724648 - protein, 19 aa, Staphylococcus aureus
LEYNQLFMYSQLYVESTQD

SEQ ID NO: 1724649 - protein, 19 aa, Staphylococcus aureus
LGISFLFLVISITAGCGMG

SEQ ID NO: 1724650 - protein, 17 aa, Staphylococcus aureus
LIKYISILLIVVLVLSA

SEQ ID NO: 1724651 - protein, 25 aa, Staphylococcus aureus
LNNMNFLRWVNFPQDYTVTWTNAKI

SEQ ID NO: 1724652 - protein, 20 aa, Staphylococcus aureus
LWLYLVLLAVFIGACGMKKE

SEQ ID NO: 1724653 - protein, 18 aa, Staphylococcus aureus
LYISIMALSIFIIGCDKS

SEQ ID NO: 1724654 - protein, 18 aa, Staphylococcus aureus
MSVMILLAGCGKSEEKAT

SEQ ID NO: 1724655 - protein, 21 aa, Staphylococcus aureus
MVFIMLLNIITPLFNKNEAFA

SEQ ID NO: 1724656 - protein, 21 aa, Staphylococcus aureus
NEAINIYFVPSDLVNPTISVG

SEQ ID NO: 1724657 - protein, 17 aa, Staphylococcus aureus
NGKYRFDNLDSGKYKVI

SEQ ID NO: 1724658 - protein, 18 aa, Staphylococcus aureus
NHQTQIIKILSKVKPDPP

SEQ ID NO: 1724659 - protein, 19 aa, Staphylococcus aureus
NMLTFHKYNLYNLTMNEYN

SEQ ID NO: 1724660 - protein, 17 aa, Staphylococcus aureus
NNTSFWFDLFPKKELVP

SEQ ID NO: 1724661 - protein, 27 aa, Staphylococcus aureus
NRSGQVIYSWPTVHVYSLEDLSRASDY

SEQ ID NO: 1724662 - protein, 19 aa, Staphylococcus aureus
PDHPFVFWATLKNAASLLD

SEQ ID NO: 1724663 - protein, 17 aa, Staphylococcus aureus
PINIWINGNHKTISTNK

SEQ ID NO: 1724664 - protein, 20 aa, Staphylococcus aureus
PLDPSALVYLVIPTSQTRDG

SEQ ID NO: 1724665 - protein, 21 aa, Staphylococcus aureus
PLDPSALVYLVIPTSQTRDGG

SEQ ID NO: 1724666 - protein, 25 aa, Staphylococcus aureus
QLKDGYKYYSFVDSIGLHSGSHVYV

SEQ ID NO: 1724667 - protein, 26 aa, Staphylococcus aureus
QLKDGYKYYSFVDSIGLHSGSHVYVE

SEQ ID NO: 1724668 - protein, 20 aa, Staphylococcus aureus
QTGDGYQWVIKFNKGHAPHE

SEQ ID NO: 1724669 - protein, 23 aa, Staphylococcus aureus
QTGDGYQWVIKFNKGHAPHENMI

SEQ ID NO: 1724670 - protein, 26 aa, Staphylococcus aureus
QTGDGYQWVIKFNKGHAPHQNMIFWF

SEQ ID NO: 1724671 - protein, 17 aa, Staphylococcus aureus
RFDNLDSGKYKVIFEKP

SEQ ID NO: 1724672 - protein, 22 aa, Staphylococcus aureus
RLWLYLVLLAVFIGACGMKKEE

SEQ ID NO: 1724673 - protein, 28 aa, Staphylococcus aureus
RNRSGQVIYSWPTVHVYSLEDLSRASDY

SEQ ID NO: 1724674 - protein, 26 aa, Staphylococcus aureus
RQKADLNMFFLFVITGNLIGKATEKE

SEQ ID NO: 1724675 - protein, 18 aa, Staphylococcus aureus
SFIYYPKNDLKGLGGEHN

SEQ ID NO: 1724676 - protein, 20 aa, Staphylococcus aureus
SKVNESFIYYPKNDLKGLGG

SEQ ID NO: 1724677 - protein, 18 aa, Staphylococcus aureus
SLKDSFNYGYKYLTDTYK

SEQ ID NO: 1724678 - protein, 17 aa, Staphylococcus aureus
SSKGAPYNLPTTPWNTL

SEQ ID NO: 1724679 - protein, 23 aa, Staphylococcus aureus
SVWLVLLFSVMGLWQVSNAAEQH

SEQ ID NO: 1724680 - protein, 17 aa, Staphylococcus aureus
TANNLITYTFTDYVDRF

SEQ ID NO: 1724681 - protein, 23 aa, Staphylococcus aureus
TARNEITTILNNKLQEIQATPDA

SEQ ID NO: 1724682 - protein, 24 aa, Staphylococcus aureus
TDADRLDLQFIPDNTAVADASRIT

SEQ ID NO: 1724683 - protein, 19 aa, Staphylococcus aureus
TDKDWQITGIPRTLHIENS

SEQ ID NO: 1724684 - protein, 19 aa, Staphylococcus aureus
TGSPIRLMIGFDYPDAFGN

SEQ ID NO: 1724685 - protein, 17 aa, Staphylococcus aureus
TILTSALILTGCASDQS

SEQ ID NO: 1724686 - protein, 26 aa, Staphylococcus aureus
TIRPEDYVVFIPPVGNQIRALIFYNN

SEQ ID NO: 1724687 - protein, 27 aa, Staphylococcus aureus
TIRPEDYVVFIPPVGNQIRALIFYNNV

SEQ ID NO: 1724688 - protein, 21 aa, Staphylococcus aureus
TPISDTYYWGVIKNLESQFAE

SEQ ID NO: 1724689 - protein, 20 aa, Staphylococcus aureus
TQIIKILSKVKPDPPRIDGN

SEQ ID NO: 1724690 - protein, 21 aa, Staphylococcus aureus
TSFWFDLFPKKELVPFVPYKF

SEQ ID NO: 1724691 - protein, 25 aa, Staphylococcus aureus
TTEKFLDFDLLFKNFTWLDGKSAEF

SEQ ID NO: 1724692 - protein, 30 aa, Staphylococcus aureus
TVGTFSTVIATLVFLGFNTSQAHAAETNQP

SEQ ID NO: 1724693 - protein, 30 aa, Staphylococcus aureus; identical to SEQ ID NO: 1724050

SEQ ID NO: 1724694 - protein, 19 aa, Staphylococcus aureus
TVIATLVFLGFNTSQAHAA

SEQ ID NO: 1724695 - protein, 19 aa, Staphylococcus aureus
TVIATLVFLGLNTSQAQAA

SEQ ID NO: 1724696 - protein, 17 aa, Staphylococcus aureus
VAAYLFAKPHIDNYLHD

SEQ ID NO: 1724697 - protein, 18 aa, Staphylococcus aureus
VCRFFAYKIYFPTDAENK

SEQ ID NO: 1724698 - protein, 18 aa, Staphylococcus aureus
VDNLPGFTLINGGKVGVL

SEQ ID NO: 1724699 - protein, 17 aa, Staphylococcus aureus
VDNLPGYTLINGGKVGV

SEQ ID NO: 1724700 - protein, 23 aa, Staphylococcus aureus
VDQDQFIKFYRGDKFKIASPITP

SEQ ID NO: 1724701 - protein, 17 aa, Staphylococcus aureus
VFLMLNIKKGIFKTHPN

SEQ ID NO: 1724702 - protein, 17 aa, Staphylococcus aureus
VIATLVFLGFNTSQAHA

SEQ ID NO: 1724703 - protein, 18 aa, Staphylococcus aureus
VIQIMDIINPSNGFGGQP

SEQ ID NO: 1724704 - protein, 27 aa, Staphylococcus aureus
VTIRPQDYVVFIPPVGKQIRAVVYYNK

SEQ ID NO: 1724705 - protein, 17 aa, Staphylococcus aureus
YFYITYLSRNLKEYRKY

SEQ ID NO: 1724706 - protein, 21 aa, Staphylococcus aureus
YGINEVYLISHALLETGNGTS

SEQ ID NO: 1724707 - protein, 18 aa, Staphylococcus aureus
YGQYFRPGSVRLPSQTQN

SEQ ID NO: 1724708 - protein, 17 aa, Staphylococcus aureus
YIHLQYLRTDAGRINFM

SEQ ID NO: 1724709 - protein, 17 aa, Staphylococcus aureus
YSYFYWGAKYNVSVSSE

SEQ ID NO: 1724710 - protein, 30 aa, Staphylococcus aureus; identical to SEQ ID NO: 1599491

SEQ ID NO: 1724711 - protein, 19 aa, Staphylococcus aureus
AAKDLVLKVKEKAYQDILN

SEQ ID NO: 1724712 - protein, 20 aa, Staphylococcus aureus
ADQFKYEVTLPQGVTYVNNS

SEQ ID NO: 1724713 - protein, 18 aa, Staphylococcus aureus
AINIYFVPSDLVNPTISV

SEQ ID NO: 1724714 - protein, 18 aa, Staphylococcus aureus
AIQSINQALANKLKEIEA

SEQ ID NO: 1724715 - protein, 24 aa, Staphylococcus aureus
AKYDIIYNGHTFATSLPAKFVVKD

SEQ ID NO: 1724716 - protein, 22 aa, Staphylococcus aureus
ALAELAMPRPYVFVSPKDFKNG

SEQ ID NO: 1724717 - protein, 20 aa, Staphylococcus aureus
ALEYNQLFMYSQLYVESTQD

SEQ ID NO: 1724718 - protein, 21 aa, Staphylococcus aureus
ALEYNQLFMYSQLYVESTQDH

SEQ ID NO: 1724719 - protein, 21 aa, Staphylococcus aureus
ALHRTYFVFPENKKVLYQEID

SEQ ID NO: 1724720 - protein, 22 aa, Staphylococcus aureus
ALYMSVLLLIIFIGGCGNMKDE

SEQ ID NO: 1724721 - protein, 18 aa, Staphylococcus aureus
AMGQLKHAIADKTTTLAS

SEQ ID NO: 1724722 - protein, 17 aa, Staphylococcus aureus
AMGTLKHAIADKTNTLA

SEQ ID NO: 1724723 - protein, 22 aa, Staphylococcus aureus
AMYMSVLLLIIFIGGCGNMKDE

SEQ ID NO: 1724724 - protein, 24 aa, Staphylococcus aureus
ANMNFLRWVNFPQDYTVTWTNAKI

SEQ ID NO: 1724725 - protein, 23 aa, Staphylococcus aureus
APHENMIYWFALPAGQTPVGRTE

SEQ ID NO: 1724726 - protein, 26 aa, Staphylococcus aureus
ARTGSPIRLMIGFDYPDAFGNGETLV

SEQ ID NO: 1724727 - protein, 27 aa, Staphylococcus aureus
ARTRNPIRLMIGFDYPDAYGNSETLVP

SEQ ID NO: 1724728 - protein, 26 aa, Staphylococcus aureus
ARTRNPIRLMIGFDYPDGYGNSETLV

SEQ ID NO: 1724729 - protein, 27 aa, Staphylococcus aureus
ASDAVYKAQLYLTPYGPKQYVEHLNQN

SEQ ID NO: 1724730 - protein, 25 aa, Staphylococcus aureus
ASNKGAPYNLPTSPWNTLKASAAKE

SEQ ID NO: 1724731 - protein, 25 aa, Staphylococcus aureus
ASNKGAPYNLPTTPWNTLKASAAKE

SEQ ID NO: 1724732 - protein, 26 aa, Staphylococcus aureus
ASSKGAPYNLPTTPWNTLKASDAKEI

SEQ ID NO: 1724733 - protein, 19 aa, Staphylococcus aureus
ATLLQFSWYSHIQVYGPES

SEQ ID NO: 1724734 - protein, 25 aa, Staphylococcus aureus
ATLSNWIYEGFMPLIYKGEMMDLSR

SEQ ID NO: 1724735 - protein, 22 aa, Staphylococcus aureus
AVYKAQLYLSPYGPKQYVEHLN

SEQ ID NO: 1724736 - protein, 18 aa, Staphylococcus aureus
AYNYKYFYSYSVVNGVKK

SEQ ID NO: 1724737 - protein, 18 aa, Staphylococcus aureus
CLCLIILSVFIGACGMKK

SEQ ID NO: 1724738 - protein, 23 aa, Staphylococcus aureus
DAVYKAQLYLSPYGPKQYVEHLN

SEQ ID NO: 1724739 - protein, 25 aa, Staphylococcus aureus
DDHKSLIYRYDATLGTAITTNDILT

SEQ ID NO: 1724740 - protein, 17 aa, Staphylococcus aureus
DFIDDPLSYVKTPSNKV

SEQ ID NO: 1724741 - protein, 21 aa, Staphylococcus aureus
DHVNGYSLINNGKIGFVNSEL

SEQ ID NO: 1724742 - protein, 17 aa, Staphylococcus aureus
DKDWQITGIPRTLHIEN

SEQ ID NO: 1724743 - protein, 23 aa, Staphylococcus aureus
DKPRNIPINIWINGNHKTISTNK

SEQ ID NO: 1724744 - protein, 20 aa, Staphylococcus aureus
DLALRSTLYGYNSNIIWRSM

SEQ ID NO: 1724745 - protein, 17 aa, Staphylococcus aureus
DLGIYKPKYNLGDYVWE

SEQ ID NO: 1724746 - protein, 17 aa, Staphylococcus aureus
DLVNVYWNHIYGHGLKG

SEQ ID NO: 1724747 - protein, 19 aa, Staphylococcus aureus
DSGFYKTPKYSLGDYVWYD

SEQ ID NO: 1724748 - protein, 24 aa, Staphylococcus aureus
DTNDFPITWFYPLGEKKVERKAPK

SEQ ID NO: 1724749 - protein, 23 aa, Staphylococcus aureus
DYTFASLDIFNDLKRRAQTILDE

SEQ ID NO: 1724750 - protein, 29 aa, Staphylococcus aureus
EAARTRNPIRLMIGFDYPDAYGNSETLVP

SEQ ID NO: 1724751 - protein, 20 aa, Staphylococcus aureus
EEAPLPIAQPLVKLPQIGTQ

SEQ ID NO: 1724752 - protein, 26 aa, Staphylococcus aureus
EGDTFTFKYGQYFRPGSVRLPSQTQN

SEQ ID NO: 1724753 - protein, 17 aa, Staphylococcus aureus
EGIYKDWKPGQKIHLVG

SEQ ID NO: 1724754 - protein, 25 aa, Staphylococcus aureus
EMDLPLKELALITGAALLARRRTKN

SEQ ID NO: 1724755 - protein, 25 aa, Staphylococcus aureus
ENFTDRDWQITGIPRTLHIENSTNR

SEQ ID NO: 1724756 - protein, 23 aa, Staphylococcus aureus
ENGKYRFDNLDSGKYKVIFEKPA

SEQ ID NO: 1724757 - protein, 29 aa, Staphylococcus aureus
ETMRYLKRLSWYISILILIVVIAGCGKGN

SEQ ID NO: 1724758 - protein, 17 aa, Staphylococcus aureus
EVAKLVVFLASDDSSFI

SEQ ID NO: 1724759 - protein, 19 aa, Staphylococcus aureus
EWPTVHINSLRDLARAGDY

SEQ ID NO: 1724760 - protein, 19 aa, Staphylococcus aureus
FASLDIFNDLKRRAQTILD

SEQ ID NO: 1724761 - protein, 19 aa, Staphylococcus aureus
FFLLLSVALLYSCSKHNEK

SEQ ID NO: 1724762 - protein, 17 aa, Staphylococcus aureus
FGRQIFEYINGERPTES

SEQ ID NO: 1724763 - protein, 17 aa, Staphylococcus aureus
FGTIRFGRKEQLFEIRV

SEQ ID NO: 1724764 - protein, 20 aa, Staphylococcus aureus
FILLLFIALTWTTSPLVNGS

SEQ ID NO: 1724765 - protein, 19 aa, Staphylococcus aureus
FIRILVLVLTITSVTGVIE

SEQ ID NO: 1724766 - protein, 20 aa, Staphylococcus aureus
FLSIILVVMSGLYHSAHASN

SEQ ID NO: 1724767 - protein, 24 aa, Staphylococcus aureus
FMNIVPDYFIYKIALVGKDDKKYG

SEQ ID NO: 1724768 - protein, 26 aa, Staphylococcus aureus
FSTVIATLVFLGFNTSQAHAAETNQP

SEQ ID NO: 1724769 - protein, 24 aa, Staphylococcus aureus
FTDKGWQITGIPRTLHIENSTNRT

SEQ ID NO: 1724770 - protein, 17 aa, Staphylococcus aureus
FVATLTTATLVSSTAAN

SEQ ID NO: 1724771 - protein, 24 aa, Staphylococcus aureus
GASSILIATLLFLSGGQAQATEKQ

SEQ ID NO: 1724772 - protein, 21 aa, Staphylococcus aureus
GDTFTFKYGQYFRPGSVRLPS

SEQ ID NO: 1724773 - protein, 20 aa, Staphylococcus aureus
GDYFGTIRFGRKEQLFEIRV

SEQ ID NO: 1724774 - protein, 27 aa, Staphylococcus aureus
GHAPHENMIFWFALPADQVPVGRTDFV

SEQ ID NO: 1724775 - protein, 26 aa, Staphylococcus aureus
GHAPHQNMIFWFALPADQVPVGRTDF

SEQ ID NO: 1724776 - protein, 21 aa, Staphylococcus aureus
GHTHYFYNCYPKNANANGSGQ

SEQ ID NO: 1724777 - protein, 17 aa, Staphylococcus aureus
GICLVLLIILIGGYVIM

SEQ ID NO: 1724778 - protein, 19 aa, Staphylococcus aureus
GPDLYVYLTKNGDIKNGKE

SEQ ID NO: 1724779 - protein, 26 aa, Staphylococcus aureus
GQVIYDWPTVHINSLKDLARAGDYFS

SEQ ID NO: 1724780 - protein, 21 aa, Staphylococcus aureus
GQVIYSWPTVHVYSLEDLSRA

SEQ ID NO: 1724781 - protein, 19 aa, Staphylococcus aureus
GRKEQLFEIRVKPHTPRIT

SEQ ID NO: 1724782 - protein, 17 aa, Staphylococcus aureus
GSTVAWHDSPDTWKHTV

SEQ ID NO: 1724783 - protein, 21 aa, Staphylococcus aureus
GTFLMTKMMLPLMMTQGGSIV

SEQ ID NO: 1724784 - protein, 28 aa, Staphylococcus aureus
GTHTKEVLFPDKSLKLSYKVNVANIDTP

SEQ ID NO: 1724785 - protein, 20 aa, Staphylococcus aureus
GTILMTKMMLPLMMNQGGSI

SEQ ID NO: 1724786 - protein, 41 aa, Staphylococcus aureus
GVHNTITIPPEDFTVFIPPVGKQIRALIYYNKVVASNMSNA

SEQ ID NO: 1724787 - protein, 21 aa, Staphylococcus aureus
HKDSEDFYISLKIIDVKQPEG

SEQ ID NO: 1724788 - protein, 23 aa, Staphylococcus aureus
HKDTEDFYISLKIIDVKQPEGDQ

SEQ ID NO: 1724789 - protein, 18 aa, Staphylococcus aureus
HKSLIYRYDATLGTAITT

SEQ ID NO: 1724790 - protein, 18 aa, Staphylococcus aureus
HRIPVIFIRLVLDKHFDD

SEQ ID NO: 1724791 - protein, 17 aa, Staphylococcus aureus
HRIPVIFIRLVLDKHFN

SEQ ID NO: 1724792 - protein, 21 aa, Staphylococcus aureus
HVILIFVLILVISTPNVLAES

SEQ ID NO: 1724793 - protein, 19 aa, Staphylococcus aureus
IAVMLFLTGCGKSQEKATL

SEQ ID NO: 1724794 - protein, 17 aa, Staphylococcus aureus
ICVKSCSLLFMLNGNPR

SEQ ID NO: 1724795 - protein, 17 aa, Staphylococcus aureus
ICVKSCSLLFMLNGSPR

SEQ ID NO: 1724796 - protein, 33 aa, Staphylococcus aureus; identical to SEQ ID NO: 1598474

SEQ ID NO: 1724797 - protein, 18 aa, Staphylococcus aureus
IILLFLSIISMSTLSKVQ

SEQ ID NO: 1724798 - protein, 18 aa, Staphylococcus aureus
ILIFMLVLSGCGMKDNDK

SEQ ID NO: 1724799 - protein, 20 aa, Staphylococcus aureus
ILVFILFFNIKDLSYAQGDI

SEQ ID NO: 1724800 - protein, 17 aa, Staphylococcus aureus
IMFMLILVVAVAGCGQK

SEQ ID NO: 1724801 - protein, 19 aa, Staphylococcus aureus
IQLMIGFDYPDGHGNAETL

SEQ ID NO: 1724802 - protein, 18 aa, Staphylococcus aureus
IRALIFYNNVVASNMSNA

SEQ ID NO: 1724803 - protein, 19 aa, Staphylococcus aureus
IRILPYYIITLNNSIFEKV

SEQ ID NO: 1724804 - protein, 18 aa, Staphylococcus aureus
IRPQDYVVFIPPVGKQIR

SEQ ID NO: 1724805 - protein, 17 aa, Staphylococcus aureus
ISLIILSLLISITMSNA

SEQ ID NO: 1724806 - protein, 26 aa, Staphylococcus aureus
ITIRPEDYVVFIPPVGHQIRALIYYN

SEQ ID NO: 1724807 - protein, 28 aa, Staphylococcus aureus
ITIRPEDYVVFIPPVGNQIRALIFYNNV

SEQ ID NO: 1724808 - protein, 19 aa, Staphylococcus aureus
IVCGFFAYKIYFPADAKNK

SEQ ID NO: 1724809 - protein, 21 aa, Staphylococcus aureus
IVQILLVVIIIIFGYKIVQTY

SEQ ID NO: 1724810 - protein, 18 aa, Staphylococcus aureus
IVVFILFFNVYDLSYAQG

SEQ ID NO: 1724811 - protein, 24 aa, Staphylococcus aureus
KADQFKYEVTLPQAVTYGNDSLTT

SEQ ID NO: 1724812 - protein, 25 aa, Staphylococcus aureus
KADQFKYEVTLPQGVTYINDSLTTT

SEQ ID NO: 1724813 - protein, 23 aa, Staphylococcus aureus
KADQFKYEVTLPQGVTYVNNSLT

SEQ ID NO: 1724814 - protein, 23 aa, Staphylococcus aureus
KDTEDFYITLKIIDVKQPEGDQR

SEQ ID NO: 1724815 - protein, 25 aa, Staphylococcus aureus
KEKNKFTHVAYVKPLNQFKLGTVTV

SEQ ID NO: 1724816 - protein, 21 aa, Staphylococcus aureus
KFAIFLMVVLVVLGGVYASAK

SEQ ID NO: 1724817 - protein, 21 aa, Staphylococcus aureus
KGAPYNLPTTPWNTLKASDAK

SEQ ID NO: 1724818 - protein, 29 aa, Staphylococcus aureus
KGHAPHENMIFWFALPADQVPVGRTDFVT

SEQ ID NO: 1724819 - protein, 29 aa, Staphylococcus aureus
KGHAPHENMIYWFALPADQVPVGRTDFVT

SEQ ID NO: 1724820 - protein, 20 aa, Staphylococcus aureus
KGPDLYVYLTKNGDIKNGKE

SEQ ID NO: 1724821 - protein, 17 aa, Staphylococcus aureus
KGVYVILKDSNGKELDR

SEQ ID NO: 1724822 - protein, 21 aa, Staphylococcus aureus
KGYYFVRTFYRKYKLPYRKNY

SEQ ID NO: 1724823 - protein, 20 aa, Staphylococcus aureus
KKVDVGFLPPTAYTLAHDQK

SEQ ID NO: 1724824 - protein, 19 aa, Staphylococcus aureus
KKYIIFPNPMYGSWEATIY

SEQ ID NO: 1724825 - protein, 20 aa, Staphylococcus aureus
KLCLCLIILSVFIGACGMKK

SEQ ID NO: 1724826 - protein, 24 aa, Staphylococcus aureus
KLVLGISFLFLIISIFAGCGTGKE

SEQ ID NO: 1724827 - protein, 33 aa, Staphylococcus aureus
KMNKIFRILTVSLFFFTFLIKNNLAYADVGVIN

SEQ ID NO: 1724828 - protein, 18 aa, Staphylococcus aureus
KNLPLIKYSFDQVIMTKE

SEQ ID NO: 1724829 - protein, 24 aa, Staphylococcus aureus
KQTGDGYQWVIKFNKGHAPHENMI

SEQ ID NO: 1724830 - protein, 25 aa, Staphylococcus aureus
KQTGDGYQWVIKFNKGHAPHENMIF

SEQ ID NO: 1724831 - protein, 27 aa, Staphylococcus aureus
KQTGDGYQWVIKFNKGHAPHQNMIFWF

SEQ ID NO: 1724832 - protein, 22 aa, Staphylococcus aureus
KRMDYWPTYYPSKLNKDPIKEE

SEQ ID NO: 1724833 - protein, 18 aa, Staphylococcus aureus
KRMVWPFQYNIGLTSKDQ

SEQ ID NO: 1724834 - protein, 20 aa, Staphylococcus aureus
KRVNAKMRFAVAQPAAVASN

SEQ ID NO: 1724835 - protein, 21 aa, Staphylococcus aureus
KRVNAKMRFAVAQPAAVASNN

SEQ ID NO: 1724836 - protein, 19 aa, Staphylococcus aureus
KSIDQFLYFDLIYSIKDTK

SEQ ID NO: 1724837 - protein, 18 aa, Staphylococcus aureus
KTPSNKVLGFYPTSANTN

SEQ ID NO: 1724838 - protein, 17 aa, Staphylococcus aureus
KTQGPTIDKLYYAAGGR

SEQ ID NO: 1724839 - protein, 17 aa, Staphylococcus aureus
KTQGPTTNKLYYAAGGR

SEQ ID NO: 1724840 - protein, 27 aa, Staphylococcus aureus
KTQGPTVNKLYYAAGGRALEYNQLFMY

SEQ ID NO: 1724841 - protein, 18 aa, Staphylococcus aureus
KVLGFYPTNANTNAFRPG

SEQ ID NO: 1724842 - protein, 19 aa, Staphylococcus aureus
KVLGFYPTNATTNAFRPGG

SEQ ID NO: 1724843 - protein, 19 aa, Staphylococcus aureus
KVLGFYPTSANTNAFRPGG

SEQ ID NO: 1724844 - protein, 24 aa, Staphylococcus aureus
KVVAYGPIWRLLKVPENVSHLKIQ

SEQ ID NO: 1724845 - protein, 26 aa, Staphylococcus aureus
KYDSPMSNWYYWGKVKSLESQFADAI

SEQ ID NO: 1724846 - protein, 24 aa, Staphylococcus aureus
KYDTPIPDWYLGSILNRLGDQIYY

SEQ ID NO: 1724847 - protein, 17 aa, Staphylococcus aureus
KYKVIFEKPAGLIQTGT

SEQ ID NO: 1724848 - protein, 19 aa, Staphylococcus aureus
LAKEWMEFLKSDKAKEILK

SEQ ID NO: 1724849 - protein, 25 aa, Staphylococcus aureus
LANMNFLRWVNFPQDYTVSWTNAKI

SEQ ID NO: 1724850 - protein, 20 aa, Staphylococcus aureus
LCIILLILIIFVTSCDGDNK

SEQ ID NO: 1724851 - protein, 22 aa, Staphylococcus aureus
LCISLLILIIFVTSCGGNKITG

SEQ ID NO: 1724852 - protein, 17 aa, Staphylococcus aureus
LDPSALVYLVAPTNQTT

SEQ ID NO: 1724853 - protein, 19 aa, Staphylococcus aureus
LDPSALVYLVIPTSQTRDG

SEQ ID NO: 1724854 - protein, 23 aa, Staphylococcus aureus
LDPSSLVYIVYPNEHTRDGGTEA

SEQ ID NO: 1724855 - protein, 20 aa, Staphylococcus aureus
LDSGFYKTPKYSLGDYVWYD

SEQ ID NO: 1724856 - protein, 17 aa, Staphylococcus aureus
LEIKVPLNAIKIPKSVL

SEQ ID NO: 1724857 - protein, 18 aa, Staphylococcus aureus
LEYNQLFMYSQLYVESTQ

SEQ ID NO: 1724858 - protein, 18 aa, Staphylococcus aureus
LFISVIILSIFIIGCNSS

SEQ ID NO: 1724859 - protein, 24 aa, Staphylococcus aureus
LFSGSHLYVKNRDLAPKATNNKEY

SEQ ID NO: 1724860 - protein, 19 aa, Staphylococcus aureus
LGICLVLLIILIGGYFIMT

SEQ ID NO: 1724861 - protein, 18 aa, Staphylococcus aureus
LGISFLFLVISITAGCGI

SEQ ID NO: 1724862 - protein, 20 aa, Staphylococcus aureus
LIFTTLFWKTSLGEFNMLKN

SEQ ID NO: 1724863 - protein, 17 aa, Staphylococcus aureus
LINIIILGVSNNASAQG

SEQ ID NO: 1724864 - protein, 17 aa, Staphylococcus aureus
LITLFSIMFMVPNDTFA

SEQ ID NO: 1724865 - protein, 24 aa, Staphylococcus aureus
LKDGYKYYDFVDSIGLHSGSHVYV

SEQ ID NO: 1724866 - protein, 26 aa, Staphylococcus aureus
LKKYLYIKRMIWPFQYNISLKTKDSN

SEQ ID NO: 1724867 - protein, 25 aa, Staphylococcus aureus
LKSDQFKYEVTLPQGVTYVNDSLTT

SEQ ID NO: 1724868 - protein, 17 aa, Staphylococcus aureus
LKYKLRVNNVPTPRTVT

SEQ ID NO: 1724869 - protein, 21 aa, Staphylococcus aureus
LLGYYQSLKDSFNYGYKYLTD

SEQ ID NO: 1724870 - protein, 18 aa, Staphylococcus aureus
LLLNFIFILILSGCSKEG

SEQ ID NO: 1724871 - protein, 17 aa, Staphylococcus aureus
LMLYLLIFLSSCGTNNK

SEQ ID NO: 1724872 - protein, 19 aa, Staphylococcus aureus
LPFFILVLTISVTTLPISQ

SEQ ID NO: 1724873 - protein, 35 aa, Staphylococcus aureus
LSGYHKNYPYYPYYSYYPVQLTWNNGVAFYSNNAQ

SEQ ID NO: 1724874 - protein, 23 aa, Staphylococcus aureus
LSPVKFYDYNLYDFTMKEYNDIH

SEQ ID NO: 1724875 - protein, 24 aa, Staphylococcus aureus
LTAKKSYFILNDKIVFIGTGIKST

SEQ ID NO: 1724876 - protein, 24 aa, Staphylococcus aureus
LTAKKSYFILNDKIVFLGTGIKNT

SEQ ID NO: 1724877 - protein, 24 aa, Staphylococcus aureus
LTAKKSYFILNDKIVFLGTGIKTT

SEQ ID NO: 1724878 - protein, 21 aa, Staphylococcus aureus
LTGFILILLLEGIFTNSASAI

SEQ ID NO: 1724879 - protein, 22 aa, Staphylococcus aureus
LTGFILILLLEGIFTNTASAIE

SEQ ID NO: 1724880 - protein, 20 aa, Staphylococcus aureus
LTKRMIWPFQYNIGLTTKDP

SEQ ID NO: 1724881 - protein, 21 aa, Staphylococcus aureus
LTSIILIILINVAGIHFKMKY

SEQ ID NO: 1724882 - protein, 17 aa, Staphylococcus aureus
LTTLAFLIAVTESIGIA

SEQ ID NO: 1724883 - protein, 17 aa, Staphylococcus aureus
LVLTFAVVLAACGNGDK

SEQ ID NO: 1724884 - protein, 18 aa, Staphylococcus aureus
LVVAYLFAKPHIDNYLHD

SEQ ID NO: 1724885 - protein, 22 aa, Staphylococcus aureus
MDLYQICWNGFYWAGANYKNFK

SEQ ID NO: 1724886 - protein, 26 aa, Staphylococcus aureus
MDLYQIRWNGFYWAGANYKNYKTRTF

SEQ ID NO: 1724887 - protein, 17 aa, Staphylococcus aureus
MHKKYFIALLMIKITIK

SEQ ID NO: 1724888 - protein, 25 aa, Staphylococcus aureus
MLGICLVLLIILIVGYVIMTKINSR

SEQ ID NO: 1724889 - protein, 22 aa, Staphylococcus aureus
MNIVPDYFIYKIALVGKDDKKY

SEQ ID NO: 1724890 - protein, 19 aa, Staphylococcus aureus
MNVIPNRFIYKIALVGKDE

SEQ ID NO: 1724891 - protein, 29 aa, Staphylococcus aureus
MSLPKKLFLWVFGILVILAIIAVVYVAAK

SEQ ID NO: 1724892 - protein, 18 aa, Staphylococcus aureus
MTIAGVVLILVVAYLFAK

SEQ ID NO: 1724893 - protein, 17 aa, Staphylococcus aureus
NAKIRFAVAQPAAVASN

SEQ ID NO: 1724894 - protein, 24 aa, Staphylococcus aureus
NEKPTLIYFMATWCPSCIYNEEIF

SEQ ID NO: 1724895 - protein, 23 aa, Staphylococcus aureus
NHQTQIIKILAKVKPDPPRIDGN

SEQ ID NO: 1724896 - protein, 21 aa, Staphylococcus aureus
NIDDFIDDPLSYVRTPSNKVL

SEQ ID NO: 1724897 - protein, 18 aa, Staphylococcus aureus
NIIIKSIAALTILTSITG

SEQ ID NO: 1724898 - protein, 25 aa, Staphylococcus aureus
NKDNKAFYFLLRDDDYFAKVVNGQV

SEQ ID NO: 1724899 - protein, 24 aa, Staphylococcus aureus
NLENQFYNIFHLLDQHKYAEKEYK

SEQ ID NO: 1724900 - protein, 20 aa, Staphylococcus aureus
NNIKVILPKVQVKPAARQSV

SEQ ID NO: 1724901 - protein, 23 aa, Staphylococcus aureus
NNSRTLIFPYVPDKAVYNAIVKV

SEQ ID NO: 1724902 - protein, 17 aa, Staphylococcus aureus
NRGISDIDLRLSKQAEY

SEQ ID NO: 1724903 - protein, 28 aa, Staphylococcus aureus
NRSGQVIYDWPTVHIYSLEDLSRASDYF

SEQ ID NO: 1724904 - protein, 19 aa, Staphylococcus aureus
PARLMPDKILDLKYKLRVN

SEQ ID NO: 1724905 - protein, 29 aa, Staphylococcus aureus
PEQRYGYYYNSYQLTWDNGLVLYSNKADG

SEQ ID NO: 1724906 - protein, 21 aa, Staphylococcus aureus
PGDYFGTIRFGRKEQLFEIGV

SEQ ID NO: 1724907 - protein, 21 aa, Staphylococcus aureus
PGDYFGTIRFGRKEQLFEIRV

SEQ ID NO: 1724908 - protein, 21 aa, Staphylococcus aureus
PKRLNAKMRFAVAQPAAVASN

SEQ ID NO: 1724909 - protein, 22 aa, Staphylococcus aureus
PKRLNAKMRFAVAQPAAVASNN

SEQ ID NO: 1724910 - protein, 23 aa, Staphylococcus aureus
PKRLNAKMRFAVAQPAAVASNNV

SEQ ID NO: 1724911 - protein, 25 aa, Staphylococcus aureus
PLDPSALVYLVIPTSQTRDGGSEAD

SEQ ID NO: 1724912 - protein, 17 aa, Staphylococcus aureus
PMTFRLLLVDTPETKHP

SEQ ID NO: 1724913 - protein, 19 aa, Staphylococcus aureus
PMTFRLLLVDTPETKHPKK

SEQ ID NO: 1724914 - protein, 18 aa, Staphylococcus aureus
PRMRAFSLAAVAADAPAA

SEQ ID NO: 1724915 - protein, 20 aa, Staphylococcus aureus
PTIDKLYYAAGGRALEYNQL

SEQ ID NO: 1724916 - protein, 21 aa, Staphylococcus aureus
PTTNKLYYAAGGRALEYNQLF

SEQ ID NO: 1724917 - protein, 18 aa, Staphylococcus aureus
PVGHQIRALIYYNNVVAS

SEQ ID NO: 1724918 - protein, 21 aa, Staphylococcus aureus
QAYNFLITSSQRWGLNQGINA

SEQ ID NO: 1724919 - protein, 17 aa, Staphylococcus aureus
QFIIDEILAIKLPAEVI

SEQ ID NO: 1724920 - protein, 21 aa, Staphylococcus aureus
QKEINPKFKGLRSYYTKPSLE

SEQ ID NO: 1724921 - protein, 19 aa, Staphylococcus aureus
QKIYDLFKPILEKKDKKLS

SEQ ID NO: 1724922 - protein, 21 aa, Staphylococcus aureus
QNEYFYITYLSRNLKEYRKYY

SEQ ID NO: 1724923 - protein, 20 aa, Staphylococcus aureus
QRAILKYKLKFENGLHQGDF

SEQ ID NO: 1724924 - protein, 19 aa, Staphylococcus aureus
QVIQIMDIINPSNGFGGQP

SEQ ID NO: 1724925 - protein, 17 aa, Staphylococcus aureus
QYYHFFSIKDPADVYYT

SEQ ID NO: 1724926 - protein, 26 aa, Staphylococcus aureus
RALEYNQLFMYSQLYLESTQDYQLRL

SEQ ID NO: 1724927 - protein, 18 aa, Staphylococcus aureus
RAVLKYKLKFENGLHQGD

SEQ ID NO: 1724928 - protein, 25 aa, Staphylococcus aureus
RDESIYDVVFLFPKSMQLKEVMEDM

SEQ ID NO: 1724929 - protein, 23 aa, Staphylococcus aureus
RDGYKYYDFVDSIGLHSGSHVYV

SEQ ID NO: 1724930 - protein, 29 aa, Staphylococcus aureus
RGTHTKEVLFPDKSLKLSYKVNVANIDTP

SEQ ID NO: 1724931 - protein, 28 aa, Staphylococcus aureus
RGTHTKEVLFPDKSLKLSYKVNVTNIDT

SEQ ID NO: 1724932 - protein, 21 aa, Staphylococcus aureus
RIWLYLVLLAVFIGACGMKKE

SEQ ID NO: 1724933 - protein, 21 aa, Staphylococcus aureus
RIWLYLVLLAVFISACNVKED

SEQ ID NO: 1724934 - protein, 17 aa, Staphylococcus aureus
RKEQLFEIRVKPHTPRI

SEQ ID NO: 1724935 - protein, 22 aa, Staphylococcus aureus
RLWLYLVLLAVFISACGMKEDK

SEQ ID NO: 1724936 - protein, 20 aa, Staphylococcus aureus
RNRTPIQLMIGFDYPDGHGN

SEQ ID NO: 1724937 - protein, 24 aa, Staphylococcus aureus
RNRTPIQLMIGFDYPDSHGNAETL

SEQ ID NO: 1724938 - protein, 18 aa, Staphylococcus aureus
RPEDYVVFIPPVGNQIRA

SEQ ID NO: 1724939 - protein, 17 aa, Staphylococcus aureus
RPQDYVVFIPPVGKQIR

SEQ ID NO: 1724940 - protein, 26 aa, Staphylococcus aureus
RSGQVIYDWPTVHIYSLEDLSRASDY

SEQ ID NO: 1724941 - protein, 17 aa, Staphylococcus aureus
RTHLSGYHKNYPYYPYY

SEQ ID NO: 1724942 - protein, 25 aa, Staphylococcus aureus
RTRNPIRLMIGFDYPDAYGNSETLV

SEQ ID NO: 1724943 - protein, 19 aa, Staphylococcus aureus
RVNAKMRFAVAQPAAVASN

SEQ ID NO: 1724944 - protein, 19 aa, Staphylococcus aureus
SDYYYWKIIDSLEAQFTGA

SEQ ID NO: 1724945 - protein, 20 aa, Staphylococcus aureus
SDYYYWKIIDSLEAQFTGAI

SEQ ID NO: 1724946 - protein, 17 aa, Staphylococcus aureus
SFALYISILLLIVVVAG

SEQ ID NO: 1724947 - protein, 17 aa, Staphylococcus aureus
SGKYKVIFEKPAGLIQT

SEQ ID NO: 1724948 - protein, 28 aa, Staphylococcus aureus
SGQVIYDWPTVHINSLKDLARASDYFSE

SEQ ID NO: 1724949 - protein, 24 aa, Staphylococcus aureus
SGQVIYDWPTVHIYSLEDLSRASD

SEQ ID NO: 1724950 - protein, 30 aa, Staphylococcus aureus
SGQVIYEWPTVHINSLRDLARAGDYFSEAN

SEQ ID NO: 1724951 - protein, 23 aa, Staphylococcus aureus
SGQVIYSWPTVHVYSLEDLSRAS

SEQ ID NO: 1724952 - protein, 31 aa, Staphylococcus aureus
SGYHKNYPYYPYYSYYPVQLTWNNGVAFYSN

SEQ ID NO: 1724953 - protein, 19 aa, Staphylococcus aureus
SHLYVKNRDLAPKATNNKE

SEQ ID NO: 1724954 - protein, 26 aa, Staphylococcus aureus
SIRKYKVGIFSTLIGTVLLLSNPNGA

SEQ ID NO: 1724955 - protein, 29 aa, Staphylococcus aureus
SNLANMNFLRWVNFPQDYTVSWTNAKIAS

SEQ ID NO: 1724956 - protein, 30 aa, Staphylococcus aureus
SNLNNMNFLRWVNFPQDYTVTWTNAKIANR

SEQ ID NO: 1724957 - protein, 23 aa, Staphylococcus aureus
SSKGAPYNLPTTPWNTLKASDSK

SEQ ID NO: 1724958 - protein, 18 aa, Staphylococcus aureus
SSLFVATLTTATLVSSTA

SEQ ID NO: 1724959 - protein, 30 aa, Staphylococcus aureus
STDKKKQWIKRYKLHKALQILIMVQMQIKM

SEQ ID NO: 1724960 - protein, 24 aa, Staphylococcus aureus
STVIATLVFLGFNTSQAHAAETNQ

SEQ ID NO: 1724961 - protein, 27 aa, Staphylococcus aureus
SVVFSLFFFLLLFLVIFFADDTDSGEN

SEQ ID NO: 1724962 - protein, 18 aa, Staphylococcus aureus
TAKYYYNKYYQYKGLIDQ

SEQ ID NO: 1724963 - protein, 20 aa, Staphylococcus aureus
TAMIALKRAIADKADTKASG

SEQ ID NO: 1724964 - protein, 23 aa, Staphylococcus aureus
TARNEITTILNNKLQEIQATPDV

SEQ ID NO: 1724965 - protein, 18 aa, Staphylococcus aureus
TASILIGSLMYLGTQQEA

SEQ ID NO: 1724966 - protein, 17 aa, Staphylococcus aureus
TDIPLDPSALVYLVIPT

SEQ ID NO: 1724967 - protein, 24 aa, Staphylococcus aureus
TEKFLDFDLLFKSIDWLDGISAEF

SEQ ID NO: 1724968 - protein, 17 aa, Staphylococcus aureus
TFILILSVALIACGKKY

SEQ ID NO: 1724969 - protein, 17 aa, Staphylococcus aureus
TFRLLLVDTPETKHPKK

SEQ ID NO: 1724970 - protein, 19 aa, Staphylococcus aureus
TGDGYQWVIKFNKGHAPHE

SEQ ID NO: 1724971 - protein, 22 aa, Staphylococcus aureus
TGLPTDGFTYKWNNAATGTNDA

SEQ ID NO: 1724972 - protein, 17 aa, Staphylococcus aureus
TIHATLLQFSWYSHIQV

SEQ ID NO: 1724973 - protein, 19 aa, Staphylococcus aureus
TILKSWIDDGFMPLIYKGE

SEQ ID NO: 1724974 - protein, 20 aa, Staphylococcus aureus
TIRPQDYVVFIPPVGKQIRA

SEQ ID NO: 1724975 - protein, 25 aa, Staphylococcus aureus
TIRPQDYVVFIPPVGKQIRAVVYYN

SEQ ID NO: 1724976 - protein, 25 aa, Staphylococcus aureus
TKKDYDLIFYRTYSDALMPYNFMSS

SEQ ID NO: 1724977 - protein, 19 aa, Staphylococcus aureus
TLGICLVLLIILIGGCIIM

SEQ ID NO: 1724978 - protein, 25 aa, Staphylococcus aureus
TLGICLVLLIILIVGYVIMTKINSR

SEQ ID NO: 1724979 - protein, 32 aa, Staphylococcus aureus
TLIDSRYLNSALYYLEDYIIYAIGLTNKYEYG

SEQ ID NO: 1724980 - protein, 17 aa, Staphylococcus aureus
TLILVISIALIACGKKY

SEQ ID NO: 1724981 - protein, 17 aa, Staphylococcus aureus
TNDILTLLKATTTVPGL

SEQ ID NO: 1724982 - protein, 23 aa, Staphylococcus aureus
TNEAINIYFVPSDLVNPTISVGN

SEQ ID NO: 1724983 - protein, 24 aa, Staphylococcus aureus
TPGICLVLLIILIGGYVIMTKTNG

SEQ ID NO: 1724984 - protein, 18 aa, Staphylococcus aureus
TQFIIDEILAIKLPAEVI

SEQ ID NO: 1724985 - protein, 19 aa, Staphylococcus aureus
TRNPIRLMIGFDYPDAYGN

SEQ ID NO: 1724986 - protein, 30 aa, Staphylococcus aureus
TSNLTNMNFLRWISFPQDYTVTWTNAKIAN

SEQ ID NO: 1724987 - protein, 25 aa, Staphylococcus aureus
TTEKFLDFDLLFKNFTWLDGKSVEF

SEQ ID NO: 1724988 - protein, 26 aa, Staphylococcus aureus
TTEKFLDFDLLFKSINWLDGISAKFK

SEQ ID NO: 1724989 - protein, 26 aa, Staphylococcus aureus
TTEKFLDIDLLFKNFTWLDGKSAEFK

SEQ ID NO: 1724990 - protein, 17 aa, Staphylococcus aureus
TTPWNTLKASDAKEIAL

SEQ ID NO: 1724991 - protein, 20 aa, Staphylococcus aureus
TTVRFMNVIPNRFIYKIALV

SEQ ID NO: 1724992 - protein, 19 aa, Staphylococcus aureus
TTVYPHQAGYVKLNYGFSV

SEQ ID NO: 1724993 - protein, 26 aa, Staphylococcus aureus
TVEGGPTLRLFKVPDNVRNLKIQFVS

SEQ ID NO: 1724994 - protein, 26 aa, Staphylococcus aureus
TVGTFSTVIATLVFLGLNTSHAQAAE

SEQ ID NO: 1724995 - protein, 19 aa, Staphylococcus aureus
TVIATLVFLGLNTSQAQAT

SEQ ID NO: 1724996 - protein, 18 aa, Staphylococcus aureus
TVNKLYYAAGGRALEYNQ

SEQ ID NO: 1724997 - protein, 19 aa, Staphylococcus aureus
TVNKLYYAAGGRALEYNQL

SEQ ID NO: 1724998 - protein, 27 aa, Staphylococcus aureus
TVRFMNVIPDWFIYKIALVGKDDMKYK

SEQ ID NO: 1724999 - protein, 18 aa, Staphylococcus aureus
VDNLPGFTLINGGKVGVF

SEQ ID NO: 1725000 - protein, 17 aa, Staphylococcus aureus
VFLGFNTSQAHAAETNQ

SEQ ID NO: 1725001 - protein, 17 aa, Staphylococcus aureus
VFLGLNTSQAQAAETNQ

SEQ ID NO: 1725002 - protein, 30 aa, Staphylococcus aureus; identical to SEQ ID NO: 1598944

SEQ ID NO: 1725003 - protein, 17 aa, Staphylococcus aureus
VGLVSVAITMLYIMTNG

SEQ ID NO: 1725004 - protein, 18 aa, Staphylococcus aureus
VGTFSTVIATLVFLGFNT

SEQ ID NO: 1725005 - protein, 26 aa, Staphylococcus aureus
VGTFSTVIATLVFLGLNTSQAQAAET

SEQ ID NO: 1725006 - protein, 24 aa, Staphylococcus aureus
VIILLIGALGFAIYAAINHSTSSI

SEQ ID NO: 1725007 - protein, 17 aa, Staphylococcus aureus
VIITTNVGVFKPHAVRD

SEQ ID NO: 1725008 - protein, 23 aa, Staphylococcus aureus
VIIVLIGTLGFAIYAAINHSTSS

SEQ ID NO: 1725009 - protein, 22 aa, Staphylococcus aureus
VIYDWPTVHINSLKDLARASDY

SEQ ID NO: 1725010 - protein, 17 aa, Staphylococcus aureus
VLGFYPTNANTNAFRPG

SEQ ID NO: 1725011 - protein, 18 aa, Staphylococcus aureus
VLGISLLFLIISINAGCG

SEQ ID NO: 1725012 - protein, 21 aa, Staphylococcus aureus
VLSISFLYLIISFTAGCGMGK

SEQ ID NO: 1725013 - protein, 20 aa, Staphylococcus aureus
VLYISFLILIISIVAGCGTG

SEQ ID NO: 1725014 - protein, 20 aa, Staphylococcus aureus
VRTPSNKVLGFYPTSANPNG

SEQ ID NO: 1725015 - protein, 23 aa, Staphylococcus aureus
VSDYYYWKIIDSLEAQFTGAIDL

SEQ ID NO: 1725016 - protein, 18 aa, Staphylococcus aureus
VTANLEINLFIDPKTFQS

SEQ ID NO: 1725017 - protein, 18 aa, Staphylococcus aureus
VTPLVFQAISRNAVYTDT

SEQ ID NO: 1725018 - protein, 17 aa, Staphylococcus aureus
VVALVCIIALSACGKEQ

SEQ ID NO: 1725019 - protein, 19 aa, Staphylococcus aureus
VVDNLPGFTLINGGKVGVF

SEQ ID NO: 1725020 - protein, 19 aa, Staphylococcus aureus
VVLILVVAYLFAKPHIDNY

SEQ ID NO: 1725021 - protein, 17 aa, Staphylococcus aureus
VVLVLSLTVLSGCSLPG

SEQ ID NO: 1725022 - protein, 20 aa, Staphylococcus aureus
VYKAQLYLTPYGPKQYVEHL

SEQ ID NO: 1725023 - protein, 17 aa, Staphylococcus aureus
VYVILKDSNGKELDRTT

SEQ ID NO: 1725024 - protein, 17 aa, Staphylococcus aureus
WKIIDSLEAQFTGAIDL

SEQ ID NO: 1725025 - protein, 17 aa, Staphylococcus aureus
WMEFLKSDKAKEILKEY

SEQ ID NO: 1725026 - protein, 19 aa, Staphylococcus aureus
WNGFYWAGANYKNFKTRTF

SEQ ID NO: 1725027 - protein, 29 aa, Staphylococcus aureus
WTTVRFMNVIPDWFIYKIALVGKDDKKYK

SEQ ID NO: 1725028 - protein, 18 aa, Staphylococcus aureus
WVVAAFPSKAWAKRVYPE

SEQ ID NO: 1725029 - protein, 19 aa, Staphylococcus aureus
YALSRPLFIYVNEKALKDN

SEQ ID NO: 1725030 - protein, 23 aa, Staphylococcus aureus
YDTAKYYYNTYYKYKGAIDQTVL

SEQ ID NO: 1725031 - protein, 26 aa, Staphylococcus aureus
YDTNGFPIAWFYPLGEKKVERKAPKL

SEQ ID NO: 1725032 - protein, 17 aa, Staphylococcus aureus
YDVIYNGHTFATSLPAK

SEQ ID NO: 1725033 - protein, 20 aa, Staphylococcus aureus
YDVPFQFRLIFVESGNGVAI

SEQ ID NO: 1725034 - protein, 22 aa, Staphylococcus aureus
YGINEVYLISHALLETGNGTSQ

SEQ ID NO: 1725035 - protein, 17 aa, Staphylococcus aureus
YHFFSIKDPADVYYTKK

SEQ ID NO: 1725036 - protein, 17 aa, Staphylococcus aureus
YNLNLRCKLAFKYMGEV

SEQ ID NO: 1725037 - protein, 17 aa, Staphylococcus aureus
YNYKYFYTYKVVKGVKK

SEQ ID NO: 1725038 - protein, 27 aa, Staphylococcus aureus
YSIRKYKVGIFSTLIGTVLLLSNPNGA

SEQ ID NO: 1725039 - protein, 33 aa, Staphylococcus aureus
YTISFKTQGPTIDKLYYAAGGRALEYNQLFMYS

SEQ ID NO: 1725040 - protein, 18 aa, Staphylococcus aureus
YTLTWDNGLVLYSNKANG

SEQ ID NO: 1725041 - protein, 30 aa, Staphylococcus aureus
YTVGTFSTVIATLVFLGLNTSQAQATETNQ

SEQ ID NO: 1725042 - protein, 19 aa, Staphylococcus aureus
YVVVEYPYFTPIPDSQLNK

SEQ ID NO: 1725043 - protein, 17 aa, Staphylococcus aureus
YYAAGGRALEYNQLFMY

SEQ ID NO: 1725044 - protein, 17 aa, Staphylococcus epidermidis
DEATNTISGTPSEVGSY

SEQ ID NO: 1725045 - protein, 19 aa, Staphylococcus epidermidis
TKYGPVDGDPITSTEEIPF

SEQ ID NO: 1725046 - protein, 4 aa, Staphylococcus epidermidis
GNKD

SEQ ID NO: 1725047 - protein, 14 aa, Staphylococcus epidermidis
REFDPNLAPGTEKV

SEQ ID NO: 1725048 - protein, 4 aa, Staphylococcus epidermidis
ISES

SEQ ID NO: 1725049 - protein, 4 aa, Staphylococcus epidermidis
LTGF

SEQ ID NO: 1725050 - protein, 5 aa, Staphylococcus epidermidis
AKNRD

SEQ ID NO: 1725051 - protein, 4 aa, Staphylococcus epidermidis
PFGT

SEQ ID NO: 1725052 - protein, 4 aa, Staphylococcus epidermidis
TDYN

SEQ ID NO: 1725053 - protein, 14 aa, Staphylococcus epidermidis
VTTTDESGNATETT

SEQ ID NO: 1725054 - protein, 9 aa, Staphylococcus epidermidis
ASSGPDEDW

SEQ ID NO: 1725055 - protein, 6 aa, Staphylococcus epidermidis
FNGKKS

SEQ ID NO: 1725056 - protein, 4 aa, Staphylococcus epidermidis
GGIG

SEQ ID NO: 1725057 - protein, 10 aa, Staphylococcus epidermidis
IGPSGSGKST

SEQ ID NO: 1725058 - protein, 5 aa, Staphylococcus epidermidis
KVPEG

SEQ ID NO: 1725059 - protein, 8 aa, Staphylococcus epidermidis
NAAGTTFT

SEQ ID NO: 1725060 - protein, 4 aa, Staphylococcus epidermidis
NEVE

SEQ ID NO: 1725061 - protein, 11 aa, Staphylococcus epidermidis
SDLGPKITPIG

SEQ ID NO: 1725062 - protein, 5 aa, Staphylococcus epidermidis
SGLTS

SEQ ID NO: 1725063 - protein, 4 aa, Staphylococcus epidermidis
SSSG

SEQ ID NO: 1725064 - protein, 4 aa, Staphylococcus epidermidis
TQSH

SEQ ID NO: 1725065 - protein, 9 aa, Staphylococcus epidermidis
TRDESKDQM

SEQ ID NO: 1725066 - protein, 10 aa, Staphylococcus epidermidis
VGPSGSGKST

SEQ ID NO: 1725067 - protein, 4 aa, Staphylococcus epidermidis
VKGS

SEQ ID NO: 1725068 - protein, 4 aa, Staphylococcus epidermidis
VKTP

SEQ ID NO: 1725069 - protein, 6 aa, Staphylococcus epidermidis
YGQDTK

SEQ ID NO: 1725070 - protein, 4 aa, Staphylococcus epidermidis
AAAQ

SEQ ID NO: 1725071 - protein, 5 aa, Staphylococcus epidermidis
AAGNA

SEQ ID NO: 1725072 - protein, 11 aa, Staphylococcus epidermidis
AAINPGNSGGA

SEQ ID NO: 1725073 - protein, 8 aa, Staphylococcus epidermidis
AALNGQKR

SEQ ID NO: 1725074 - protein, 16 aa, Staphylococcus epidermidis
AANSAEAINPQKTMPR

SEQ ID NO: 1725075 - protein, 7 aa, Staphylococcus epidermidis
AAPTPVS

SEQ ID NO: 1725076 - protein, 5 aa, Staphylococcus epidermidis
AAQRA

SEQ ID NO: 1725077 - protein, 11 aa, Staphylococcus epidermidis
AASATNSGIYS

SEQ ID NO: 1725078 - protein, 6 aa, Staphylococcus epidermidis
AASGAF

SEQ ID NO: 1725079 - protein, 14 aa, Staphylococcus epidermidis
AATPKLASKSSIRE

SEQ ID NO: 1725080 - protein, 4 aa, Staphylococcus epidermidis
AATS

SEQ ID NO: 1725081 - protein, 6 aa, Staphylococcus epidermidis
AATSGV

SEQ ID NO: 1725082 - protein, 9 aa, Staphylococcus epidermidis
ADISTANNT

SEQ ID NO: 1725083 - protein, 10 aa, Staphylococcus epidermidis
AELRTGPNAA

SEQ ID NO: 1725084 - protein, 5 aa, Staphylococcus epidermidis
AESNA

SEQ ID NO: 1725085 - protein, 9 aa, Staphylococcus epidermidis
AGADEEKQE

SEQ ID NO: 1725086 - protein, 6 aa, Staphylococcus epidermidis
AGAGET

SEQ ID NO: 1725087 - protein, 6 aa, Staphylococcus epidermidis
AGASIP

SEQ ID NO: 1725088 - protein, 6 aa, Staphylococcus epidermidis
AGEAGA

SEQ ID NO: 1725089 - protein, 13 aa, Staphylococcus epidermidis
AGESENPERAVPK

SEQ ID NO: 1725090 - protein, 6 aa, Staphylococcus epidermidis
AGGCSI

SEQ ID NO: 1725091 - protein, 4 aa, Staphylococcus epidermidis
AGGL

SEQ ID NO: 1725092 - protein, 8 aa, Staphylococcus epidermidis
AGNSGMYA

SEQ ID NO: 1725093 - protein, 6 aa, Staphylococcus epidermidis
AGQLGK

SEQ ID NO: 1725094 - protein, 5 aa, Staphylococcus epidermidis
AGSLS

SEQ ID NO: 1725095 - protein, 11 aa, Staphylococcus epidermidis
AGSRVGTGNIA

SEQ ID NO: 1725096 - protein, 12 aa, Staphylococcus epidermidis
AGSSGPLADKLG

SEQ ID NO: 1725097 - protein, 11 aa, Staphylococcus epidermidis
AGSSPTSSLSL

SEQ ID NO: 1725098 - protein, 7 aa, Staphylococcus epidermidis
AHGGPVS

SEQ ID NO: 1725099 - protein, 6 aa, Staphylococcus epidermidis
AIGSGQ

SEQ ID NO: 1725100 - protein, 6 aa, Staphylococcus epidermidis
AISNSI

SEQ ID NO: 1725101 - protein, 4 aa, Staphylococcus epidermidis
AKDT

SEQ ID NO: 1725102 - protein, 7 aa, Staphylococcus epidermidis
AKEHAKD

SEQ ID NO: 1725103 - protein, 5 aa, Staphylococcus epidermidis
AKESI

SEQ ID NO: 1725104 - protein, 6 aa, Staphylococcus epidermidis
AKKEVQ

SEQ ID NO: 1725105 - protein, 6 aa, Staphylococcus epidermidis
AKQAFG

SEQ ID NO: 1725106 - protein, 6 aa, Staphylococcus epidermidis
AKSPFE

SEQ ID NO: 1725107 - protein, 8 aa, Staphylococcus epidermidis
ALGSTEFT

SEQ ID NO: 1725108 - protein, 5 aa, Staphylococcus epidermidis
AMSTV

SEQ ID NO: 1725109 - protein, 10 aa, Staphylococcus epidermidis
ANGGTYNNAH

SEQ ID NO: 1725110 - protein, 7 aa, Staphylococcus epidermidis
ANIKETN

SEQ ID NO: 1725111 - protein, 6 aa, Staphylococcus epidermidis
ANRQEI

SEQ ID NO: 1725112 - protein, 7 aa, Staphylococcus epidermidis
ANSGIYT

SEQ ID NO: 1725113 - protein, 8 aa, Staphylococcus epidermidis
APIPGRSA

SEQ ID NO: 1725114 - protein, 6 aa, Staphylococcus epidermidis
APMYPS

SEQ ID NO: 1725115 - protein, 8 aa, Staphylococcus epidermidis
APQATDIG

SEQ ID NO: 1725116 - protein, 13 aa, Staphylococcus epidermidis
APREATGDNWDGL

SEQ ID NO: 1725117 - protein, 11 aa, Staphylococcus epidermidis
APTEYRGSLGS

SEQ ID NO: 1725118 - protein, 9 aa, Staphylococcus epidermidis
AQGGGGGGR

SEQ ID NO: 1725119 - protein, 11 aa, Staphylococcus epidermidis
ARAKSQTTNAL

SEQ ID NO: 1725120 - protein, 9 aa, Staphylococcus epidermidis
AREGKNKID

SEQ ID NO: 1725121 - protein, 7 aa, Staphylococcus epidermidis
ASEQEMK

SEQ ID NO: 1725122 - protein, 6 aa, Staphylococcus epidermidis
ASGKPI

SEQ ID NO: 1725123 - protein, 6 aa, Staphylococcus epidermidis
ASIYGA

SEQ ID NO: 1725124 - protein, 8 aa, Staphylococcus epidermidis
ASSCNSGI

SEQ ID NO: 1725125 - protein, 7 aa, Staphylococcus epidermidis
ASSRAMK

SEQ ID NO: 1725126 - protein, 11 aa, Staphylococcus epidermidis
ASVGTANMDNR

SEQ ID NO: 1725127 - protein, 6 aa, Staphylococcus epidermidis
ASVSGS

SEQ ID NO: 1725128 - protein, 7 aa, Staphylococcus epidermidis
ATARAGA

SEQ ID NO: 1725129 - protein, 8 aa, Staphylococcus epidermidis
ATDRRGRV

SEQ ID NO: 1725130 - protein, 6 aa, Staphylococcus epidermidis
ATDSQV

SEQ ID NO: 1725131 - protein, 5 aa, Staphylococcus epidermidis
ATDVP

SEQ ID NO: 1725132 - protein, 4 aa, Staphylococcus epidermidis
ATPI

SEQ ID NO: 1725133 - protein, 6 aa, Staphylococcus epidermidis
ATQDPV

SEQ ID NO: 1725134 - protein, 5 aa, Staphylococcus epidermidis
ATTTS

SEQ ID NO: 1725135 - protein, 5 aa, Staphylococcus epidermidis
AVSTT

SEQ ID NO: 1725136 - protein, 5 aa, Staphylococcus epidermidis
AYDAT

SEQ ID NO: 1725137 - protein, 38 aa, Staphylococcus epidermidis
AYDTRGKIADLDQKIEKQSSENSALKSEIKKNSSYERI

SEQ ID NO: 1725138 - protein, 16 aa, Staphylococcus epidermidis
CEGEKRAKKELNEKGL

SEQ ID NO: 1725139 - protein, 8 aa, Staphylococcus epidermidis
DDGSSEFT

SEQ ID NO: 1725140 - protein, 8 aa, Staphylococcus epidermidis
DEFDDDEV

SEQ ID NO: 1725141 - protein, 8 aa, Staphylococcus epidermidis
DETEDELE

SEQ ID NO: 1725142 - protein, 9 aa, Staphylococcus epidermidis
DETGRTRPT

SEQ ID NO: 1725143 - protein, 5 aa, Staphylococcus epidermidis
DGASE

SEQ ID NO: 1725144 - protein, 11 aa, Staphylococcus epidermidis
DGGEGGTGATF

SEQ ID NO: 1725145 - protein, 11 aa, Staphylococcus epidermidis
DGLEEPPVQPG

SEQ ID NO: 1725146 - protein, 15 aa, Staphylococcus epidermidis
DGVEGQVQGITRETT

SEQ ID NO: 1725147 - protein, 12 aa, Staphylococcus epidermidis
DKAQGGKSRTDS

SEQ ID NO: 1725148 - protein, 6 aa, Staphylococcus epidermidis
DKDDAV

SEQ ID NO: 1725149 - protein, 11 aa, Staphylococcus epidermidis
DKEGGFRGGPA

SEQ ID NO: 1725150 - protein, 7 aa, Staphylococcus epidermidis
DKKPELK

SEQ ID NO: 1725151 - protein, 7 aa, Staphylococcus epidermidis
DKKTSDF

SEQ ID NO: 1725152 - protein, 5 aa, Staphylococcus epidermidis
DKNEN

SEQ ID NO: 1725153 - protein, 6 aa, Staphylococcus epidermidis
DKPGLV

SEQ ID NO: 1725154 - protein, 5 aa, Staphylococcus epidermidis
DKQTI

SEQ ID NO: 1725155 - protein, 5 aa, Staphylococcus epidermidis
DKRLP

SEQ ID NO: 1725156 - protein, 8 aa, Staphylococcus epidermidis
DKSLGEGI

SEQ ID NO: 1725157 - protein, 5 aa, Staphylococcus epidermidis
DKTGV

SEQ ID NO: 1725158 - protein, 6 aa, Staphylococcus epidermidis
DKTKLP

SEQ ID NO: 1725159 - protein, 8 aa, Staphylococcus epidermidis
DNGKGFNV

SEQ ID NO: 1725160 - protein, 16 aa, Staphylococcus epidermidis
DNGTDMDKAEEQLKKE

SEQ ID NO: 1725161 - protein, 7 aa, Staphylococcus epidermidis
DNTDSPQ

SEQ ID NO: 1725162 - protein, 5 aa, Staphylococcus epidermidis
DPVGP

SEQ ID NO: 1725163 - protein, 12 aa, Staphylococcus epidermidis
DRDVQGGSTITQ

SEQ ID NO: 1725164 - protein, 6 aa, Staphylococcus epidermidis
DRTSTR

SEQ ID NO: 1725165 - protein, 14 aa, Staphylococcus epidermidis
DRTTNGSGKVSEHT

SEQ ID NO: 1725166 - protein, 7 aa, Staphylococcus epidermidis
DSEDIDT

SEQ ID NO: 1725167 - protein, 6 aa, Staphylococcus epidermidis
DSGISK

SEQ ID NO: 1725168 - protein, 7 aa, Staphylococcus epidermidis
DSNEAME

SEQ ID NO: 1725169 - protein, 8 aa, Staphylococcus epidermidis
DSNKDNDF

SEQ ID NO: 1725170 - protein, 5 aa, Staphylococcus epidermidis
DSNTG

SEQ ID NO: 1725171 - protein, 4 aa, Staphylococcus epidermidis
DTYT

SEQ ID NO: 1725172 - protein, 4 aa, Staphylococcus epidermidis
DYSP

SEQ ID NO: 1725173 - protein, 8 aa, Staphylococcus epidermidis
EAATQAGG

SEQ ID NO: 1725174 - protein, 8 aa, Staphylococcus epidermidis
EADTGMRN

SEQ ID NO: 1725175 - protein, 6 aa, Staphylococcus epidermidis
EAESEV

SEQ ID NO: 1725176 - protein, 10 aa, Staphylococcus epidermidis
EAGNKGWGST

SEQ ID NO: 1725177 - protein, 7 aa, Staphylococcus epidermidis
EAPTPVS

SEQ ID NO: 1725178 - protein, 9 aa, Staphylococcus epidermidis
EDEAEAEDN

SEQ ID NO: 1725179 - protein, 5 aa, Staphylococcus epidermidis
EDEAN

SEQ ID NO: 1725180 - protein, 17 aa, Staphylococcus epidermidis
EDIERKTKEIVSDIENN

SEQ ID NO: 1725181 - protein, 5 aa, Staphylococcus epidermidis
EDSND

SEQ ID NO: 1725182 - protein, 7 aa, Staphylococcus epidermidis
EDTAGGI

SEQ ID NO: 1725183 - protein, 9 aa, Staphylococcus epidermidis
EEASEDYSR

SEQ ID NO: 1725184 - protein, 5 aa, Staphylococcus epidermidis
EEATD

SEQ ID NO: 1725185 - protein, 6 aa, Staphylococcus epidermidis
EGDTSQ

SEQ ID NO: 1725186 - protein, 18 aa, Staphylococcus epidermidis
EGKSNGLSGAISGGAEQL

SEQ ID NO: 1725187 - protein, 10 aa, Staphylococcus epidermidis
EGSASASEVF

SEQ ID NO: 1725188 - protein, 10 aa, Staphylococcus epidermidis
EGTKSISQKF

SEQ ID NO: 1725189 - protein, 6 aa, Staphylococcus epidermidis
EHLGSA

SEQ ID NO: 1725190 - protein, 5 aa, Staphylococcus epidermidis
EHNLD

SEQ ID NO: 1725191 - protein, 10 aa, Staphylococcus epidermidis
EIKNPEKNIA

SEQ ID NO: 1725192 - protein, 5 aa, Staphylococcus epidermidis
EIQPE

SEQ ID NO: 1725193 - protein, 7 aa, Staphylococcus epidermidis
EKADHEI

SEQ ID NO: 1725194 - protein, 11 aa, Staphylococcus epidermidis
EKEDENSKELE

SEQ ID NO: 1725195 - protein, 4 aa, Staphylococcus epidermidis
EKER

SEQ ID NO: 1725196 - protein, 5 aa, Staphylococcus epidermidis
EKNFD

SEQ ID NO: 1725197 - protein, 7 aa, Staphylococcus epidermidis
EKSEHVD

SEQ ID NO: 1725198 - protein, 10 aa, Staphylococcus epidermidis
ENIRSGVEKS

SEQ ID NO: 1725199 - protein, 9 aa, Staphylococcus epidermidis
ENPDNISKT

SEQ ID NO: 1725200 - protein, 9 aa, Staphylococcus epidermidis
EPPFNGETA

SEQ ID NO: 1725201 - protein, 7 aa, Staphylococcus epidermidis
EQAPDAE

SEQ ID NO: 1725202 - protein, 8 aa, Staphylococcus epidermidis
EQDNTPMY

SEQ ID NO: 1725203 - protein, 7 aa, Staphylococcus epidermidis
EQRTQLK

SEQ ID NO: 1725204 - protein, 5 aa, Staphylococcus epidermidis
ERTEE

SEQ ID NO: 1725205 - protein, 11 aa, Staphylococcus epidermidis
ERTGGSGNASS

SEQ ID NO: 1725206 - protein, 6 aa, Staphylococcus epidermidis
ERTSKE

SEQ ID NO: 1725207 - protein, 7 aa, Staphylococcus epidermidis
ESNVKET

SEQ ID NO: 1725208 - protein, 17 aa, Staphylococcus epidermidis
ESVEPGITKHIEEQVIK

SEQ ID NO: 1725209 - protein, 6 aa, Staphylococcus epidermidis
ETDRPE

SEQ ID NO: 1725210 - protein, 4 aa, Staphylococcus epidermidis
ETPV

SEQ ID NO: 1725211 - protein, 8 aa, Staphylococcus epidermidis
ETRGRSLE

SEQ ID NO: 1725212 - protein, 5 aa, Staphylococcus epidermidis
EVENA

SEQ ID NO: 1725213 - protein, 15 aa, Staphylococcus epidermidis
EVSTGASNDFERATQ

SEQ ID NO: 1725214 - protein, 7 aa, Staphylococcus epidermidis
FASTHND

SEQ ID NO: 1725215 - protein, 4 aa, Staphylococcus epidermidis
FATG

SEQ ID NO: 1725216 - protein, 6 aa, Staphylococcus epidermidis
FEEDEE

SEQ ID NO: 1725217 - protein, 5 aa, Staphylococcus epidermidis
FEQSY

SEQ ID NO: 1725218 - protein, 6 aa, Staphylococcus epidermidis
FGRDGS

SEQ ID NO: 1725219 - protein, 9 aa, Staphylococcus epidermidis
FNNGGTLES

SEQ ID NO: 1725220 - protein, 4 aa, Staphylococcus epidermidis
FNQQ

SEQ ID NO: 1725221 - protein, 5 aa, Staphylococcus epidermidis
FSTGQ

SEQ ID NO: 1725222 - protein, 12 aa, Staphylococcus epidermidis
FTTSGKKRRGFR

SEQ ID NO: 1725223 - protein, 10 aa, Staphylococcus epidermidis
GAANKTDPTR

SEQ ID NO: 1725224 - protein, 5 aa, Staphylococcus epidermidis
GAGIG

SEQ ID NO: 1725225 - protein, 5 aa, Staphylococcus epidermidis
GAHLT

SEQ ID NO: 1725226 - protein, 6 aa, Staphylococcus epidermidis
GAKGRD

SEQ ID NO: 1725227 - protein, 9 aa, Staphylococcus epidermidis
GAKNDEQSL

SEQ ID NO: 1725228 - protein, 6 aa, Staphylococcus epidermidis
GASSSS

SEQ ID NO: 1725229 - protein, 6 aa, Staphylococcus epidermidis
GASTYR

SEQ ID NO: 1725230 - protein, 8 aa, Staphylococcus epidermidis
GATPGLGG

SEQ ID NO: 1725231 - protein, 7 aa, Staphylococcus epidermidis
GATPNAM

SEQ ID NO: 1725232 - protein, 4 aa, Staphylococcus epidermidis
GCNS

SEQ ID NO: 1725233 - protein, 5 aa, Staphylococcus epidermidis
GDLGR

SEQ ID NO: 1725234 - protein, 9 aa, Staphylococcus epidermidis
GEFSPGPGV

SEQ ID NO: 1725235 - protein, 5 aa, Staphylococcus epidermidis
GEHAD

SEQ ID NO: 1725236 - protein, 8 aa, Staphylococcus epidermidis
GEKAEPVK

SEQ ID NO: 1725237 - protein, 4 aa, Staphylococcus epidermidis
GFST

SEQ ID NO: 1725238 - protein, 7 aa, Staphylococcus epidermidis
GGAGEET

SEQ ID NO: 1725239 - protein, 8 aa, Staphylococcus epidermidis
GGASTINE

SEQ ID NO: 1725240 - protein, 13 aa, Staphylococcus epidermidis
GGDASKRRVSGAG

SEQ ID NO: 1725241 - protein, 6 aa, Staphylococcus epidermidis
GGGGLI

SEQ ID NO: 1725242 - protein, 8 aa, Staphylococcus epidermidis
GGGGWGPV

SEQ ID NO: 1725243 - protein, 5 aa, Staphylococcus epidermidis
GGGTG

SEQ ID NO: 1725244 - protein, 7 aa, Staphylococcus epidermidis
GGGTSGL

SEQ ID NO: 1725245 - protein, 9 aa, Staphylococcus epidermidis
GGKAVATSA

SEQ ID NO: 1725246 - protein, 12 aa, Staphylococcus epidermidis
GGKENIKDVTNC

SEQ ID NO: 1725247 - protein, 6 aa, Staphylococcus epidermidis
GGNGIK

SEQ ID NO: 1725248 - protein, 10 aa, Staphylococcus epidermidis
GGPPSTTYGE

SEQ ID NO: 1725249 - protein, 11 aa, Staphylococcus epidermidis
GGPYNQIRGTT

SEQ ID NO: 1725250 - protein, 5 aa, Staphylococcus epidermidis
GGSGF

SEQ ID NO: 1725251 - protein, 9 aa, Staphylococcus epidermidis
GGTLQATGG

SEQ ID NO: 1725252 - protein, 7 aa, Staphylococcus epidermidis
GGTTAGT

SEQ ID NO: 1725253 - protein, 11 aa, Staphylococcus epidermidis
GHISASSNKAI

SEQ ID NO: 1725254 - protein, 7 aa, Staphylococcus epidermidis
GIKRPEE

SEQ ID NO: 1725255 - protein, 9 aa, Staphylococcus epidermidis
GKEPGQGVG

SEQ ID NO: 1725256 - protein, 4 aa, Staphylococcus epidermidis
GLAR

SEQ ID NO: 1725257 - protein, 5 aa, Staphylococcus epidermidis
GLGNS

SEQ ID NO: 1725258 - protein, 8 aa, Staphylococcus epidermidis
GLGSGAAN

SEQ ID NO: 1725259 - protein, 18 aa, Staphylococcus epidermidis
GLPQGSAYSLKGDNTYQS

SEQ ID NO: 1725260 - protein, 5 aa, Staphylococcus epidermidis
GMTTT

SEQ ID NO: 1725261 - protein, 5 aa, Staphylococcus epidermidis
GNDEI

SEQ ID NO: 1725262 - protein, 4 aa, Staphylococcus epidermidis
GNDT

SEQ ID NO: 1725263 - protein, 8 aa, Staphylococcus epidermidis
GNGNMPKQ

SEQ ID NO: 1725264 - protein, 5 aa, Staphylococcus epidermidis
GNTFP

SEQ ID NO: 1725265 - protein, 4 aa, Staphylococcus epidermidis
GPFN

SEQ ID NO: 1725266 - protein, 6 aa, Staphylococcus epidermidis
GPGSFS

SEQ ID NO: 1725267 - protein, 8 aa, Staphylococcus epidermidis
GPPGTGKT

SEQ ID NO: 1725268 - protein, 4 aa, Staphylococcus epidermidis
GPTT

SEQ ID NO: 1725269 - protein, 7 aa, Staphylococcus epidermidis
GPTTADR

SEQ ID NO: 1725270 - protein, 4 aa, Staphylococcus epidermidis
GQHD

SEQ ID NO: 1725271 - protein, 7 aa, Staphylococcus epidermidis
GQRTTST

SEQ ID NO: 1725272 - protein, 8 aa, Staphylococcus epidermidis
GQSQTTSI

SEQ ID NO: 1725273 - protein, 6 aa, Staphylococcus epidermidis
GRGEKR

SEQ ID NO: 1725274 - protein, 7 aa, Staphylococcus epidermidis
GRGGDQV

SEQ ID NO: 1725275 - protein, 6 aa, Staphylococcus epidermidis
GRTYTT

SEQ ID NO: 1725276 - protein, 5 aa, Staphylococcus epidermidis
GSAIG

SEQ ID NO: 1725277 - protein, 4 aa, Staphylococcus epidermidis
GSIS

SEQ ID NO: 1725278 - protein, 7 aa, Staphylococcus epidermidis
GSLNPSS

SEQ ID NO: 1725279 - protein, 4 aa, Staphylococcus epidermidis
GSMS

SEQ ID NO: 1725280 - protein, 10 aa, Staphylococcus epidermidis
GSNASGKSTF

SEQ ID NO: 1725281 - protein, 8 aa, Staphylococcus epidermidis
GSPAAGWT

SEQ ID NO: 1725282 - protein, 8 aa, Staphylococcus epidermidis
GSTGSGKS

SEQ ID NO: 1725283 - protein, 10 aa, Staphylococcus epidermidis
GSTVENEEKI

SEQ ID NO: 1725284 - protein, 6 aa, Staphylococcus epidermidis
GTAGGT

SEQ ID NO: 1725285 - protein, 4 aa, Staphylococcus epidermidis
GTIT

SEQ ID NO: 1725286 - protein, 9 aa, Staphylococcus epidermidis
GTNSTDGTT

SEQ ID NO: 1725287 - protein, 9 aa, Staphylococcus epidermidis
GTPGGNKIP

SEQ ID NO: 1725288 - protein, 7 aa, Staphylococcus epidermidis
GTSGHTL

SEQ ID NO: 1725289 - protein, 5 aa, Staphylococcus epidermidis
GTTQI

SEQ ID NO: 1725290 - protein, 10 aa, Staphylococcus epidermidis
GVARQPEARG

SEQ ID NO: 1725291 - protein, 8 aa, Staphylococcus epidermidis
GVDQGKRG

SEQ ID NO: 1725292 - protein, 5 aa, Staphylococcus epidermidis
GVGDT

SEQ ID NO: 1725293 - protein, 7 aa, Staphylococcus epidermidis
GVGGGAT

SEQ ID NO: 1725294 - protein, 9 aa, Staphylococcus epidermidis
GYQPQEGPG

SEQ ID NO: 1725295 - protein, 9 aa, Staphylococcus epidermidis
HASTKSSTL

SEQ ID NO: 1725296 - protein, 8 aa, Staphylococcus epidermidis
HNNPGGGF

SEQ ID NO: 1725297 - protein, 13 aa, Staphylococcus epidermidis
HNRESQSTTGIGE

SEQ ID NO: 1725298 - protein, 5 aa, Staphylococcus epidermidis
HQQGY

SEQ ID NO: 1725299 - protein, 11 aa, Staphylococcus epidermidis
IADTANPSSNI

SEQ ID NO: 1725300 - protein, 16 aa, Staphylococcus epidermidis
IAGPAKKSRVISEKER

SEQ ID NO: 1725301 - protein, 7 aa, Staphylococcus epidermidis
IAQTRTQ

SEQ ID NO: 1725302 - protein, 5 aa, Staphylococcus epidermidis
IDPGE

SEQ ID NO: 1725303 - protein, 13 aa, Staphylococcus epidermidis
IEQDADDKKTFKF

SEQ ID NO: 1725304 - protein, 5 aa, Staphylococcus epidermidis
IEVPN

SEQ ID NO: 1725305 - protein, 11 aa, Staphylococcus epidermidis
IGEGGEMLSGG

SEQ ID NO: 1725306 - protein, 10 aa, Staphylococcus epidermidis
IGEPGSSKTL

SEQ ID NO: 1725307 - protein, 10 aa, Staphylococcus epidermidis
IGNAASHGAA

SEQ ID NO: 1725308 - protein, 4 aa, Staphylococcus epidermidis
IGPT

SEQ ID NO: 1725309 - protein, 5 aa, Staphylococcus epidermidis
IGPTL

SEQ ID NO: 1725310 - protein, 5 aa, Staphylococcus epidermidis
IKPTF

SEQ ID NO: 1725311 - protein, 6 aa, Staphylococcus epidermidis
INSSKM

SEQ ID NO: 1725312 - protein, 4 aa, Staphylococcus epidermidis
INTI

SEQ ID NO: 1725313 - protein, 4 aa, Staphylococcus epidermidis
IPKD

SEQ ID NO: 1725314 - protein, 6 aa, Staphylococcus epidermidis
IPQTAE

SEQ ID NO: 1725315 - protein, 4 aa, Staphylococcus epidermidis
IQKL

SEQ ID NO: 1725316 - protein, 7 aa, Staphylococcus epidermidis
IQPAQGV

SEQ ID NO: 1725317 - protein, 8 aa, Staphylococcus epidermidis
ISENHNNA

SEQ ID NO: 1725318 - protein, 8 aa, Staphylococcus epidermidis
ISGPTGAL

SEQ ID NO: 1725319 - protein, 4 aa, Staphylococcus epidermidis
ISKH

SEQ ID NO: 1725320 - protein, 10 aa, Staphylococcus epidermidis
ISKSLGTRHR

SEQ ID NO: 1725321 - protein, 11 aa, Staphylococcus epidermidis
ISPGADKAKNF

SEQ ID NO: 1725322 - protein, 11 aa, Staphylococcus epidermidis
ISPVSGGDVNE

SEQ ID NO: 1725323 - protein, 9 aa, Staphylococcus epidermidis
ISQAGPGGA

SEQ ID NO: 1725324 - protein, 11 aa, Staphylococcus epidermidis
ISQRTPGFSGA

SEQ ID NO: 1725325 - protein, 5 aa, Staphylococcus epidermidis
ISRAS

SEQ ID NO: 1725326 - protein, 6 aa, Staphylococcus epidermidis
ISSGAD

SEQ ID NO: 1725327 - protein, 10 aa, Staphylococcus epidermidis
ISTGEINEQS

SEQ ID NO: 1725328 - protein, 4 aa, Staphylococcus epidermidis
ISTS

SEQ ID NO: 1725329 - protein, 10 aa, Staphylococcus epidermidis
ITEDGDKDHV

SEQ ID NO: 1725330 - protein, 13 aa, Staphylococcus epidermidis
ITQNMNDTQRSEI

SEQ ID NO: 1725331 - protein, 8 aa, Staphylococcus epidermidis
ITSISQDQ

SEQ ID NO: 1725332 - protein, 6 aa, Staphylococcus epidermidis
ITTPSA

SEQ ID NO: 1725333 - protein, 6 aa, Staphylococcus epidermidis
ITVPTD

SEQ ID NO: 1725334 - protein, 4 aa, Staphylococcus epidermidis
KAAS

SEQ ID NO: 1725335 - protein, 9 aa, Staphylococcus epidermidis
KANDQPAYD

SEQ ID NO: 1725336 - protein, 6 aa, Staphylococcus epidermidis
KAPTAE

SEQ ID NO: 1725337 - protein, 13 aa, Staphylococcus epidermidis
KARSRDSGGTGLG

SEQ ID NO: 1725338 - protein, 11 aa, Staphylococcus epidermidis
KARTRKMGGTG

SEQ ID NO: 1725339 - protein, 7 aa, Staphylococcus epidermidis
KDPYSEY

SEQ ID NO: 1725340 - protein, 8 aa, Staphylococcus epidermidis
KDQAQARK

SEQ ID NO: 1725341 - protein, 4 aa, Staphylococcus epidermidis
KDRT

SEQ ID NO: 1725342 - protein, 14 aa, Staphylococcus epidermidis
KEAKGKKTLSQDTF

SEQ ID NO: 1725343 - protein, 6 aa, Staphylococcus epidermidis
KERKEL

SEQ ID NO: 1725344 - protein, 8 aa, Staphylococcus epidermidis
KEVGKESE

SEQ ID NO: 1725345 - protein, 7 aa, Staphylococcus epidermidis
KEVPPNI

SEQ ID NO: 1725346 - protein, 10 aa, Staphylococcus epidermidis
KEVTDTERSR

SEQ ID NO: 1725347 - protein, 6 aa, Staphylococcus epidermidis
KEYKHA

SEQ ID NO: 1725348 - protein, 7 aa, Staphylococcus epidermidis
KFGGRPV

SEQ ID NO: 1725349 - protein, 6 aa, Staphylococcus epidermidis
KGAGHS

SEQ ID NO: 1725350 - protein, 4 aa, Staphylococcus epidermidis
KGAS

SEQ ID NO: 1725351 - protein, 20 aa, Staphylococcus epidermidis
KGIGDSVQNLNGSVDRVTNS

SEQ ID NO: 1725352 - protein, 8 aa, Staphylococcus epidermidis
KGLDSGTA

SEQ ID NO: 1725353 - protein, 6 aa, Staphylococcus epidermidis
KGLEKA

SEQ ID NO: 1725354 - protein, 5 aa, Staphylococcus epidermidis
KGRTL

SEQ ID NO: 1725355 - protein, 5 aa, Staphylococcus epidermidis
KGTTR

SEQ ID NO: 1725356 - protein, 11 aa, Staphylococcus epidermidis
KGYSRNDRVGK

SEQ ID NO: 1725357 - protein, 7 aa, Staphylococcus epidermidis
KGYTGAT

SEQ ID NO: 1725358 - protein, 7 aa, Staphylococcus epidermidis
KHPPRWQ

SEQ ID NO: 1725359 - protein, 6 aa, Staphylococcus epidermidis
KIERPS

SEQ ID NO: 1725360 - protein, 8 aa, Staphylococcus epidermidis
KIQARKQH

SEQ ID NO: 1725361 - protein, 6 aa, Staphylococcus epidermidis
KIQPRY

SEQ ID NO: 1725362 - protein, 8 aa, Staphylococcus epidermidis
KIRNGGTH

SEQ ID NO: 1725363 - protein, 7 aa, Staphylococcus epidermidis
KITPAKF

SEQ ID NO: 1725364 - protein, 17 aa, Staphylococcus epidermidis
KKDPKSSYSYEDKAAFE

SEQ ID NO: 1725365 - protein, 6 aa, Staphylococcus epidermidis
KKDRRQ

SEQ ID NO: 1725366 - protein, 8 aa, Staphylococcus epidermidis
KKEDPYKV

SEQ ID NO: 1725367 - protein, 11 aa, Staphylococcus epidermidis
KKFKQMGSRIP

SEQ ID NO: 1725368 - protein, 6 aa, Staphylococcus epidermidis
KKGLYD

SEQ ID NO: 1725369 - protein, 13 aa, Staphylococcus epidermidis
KKQSAQRLGSQAT

SEQ ID NO: 1725370 - protein, 4 aa, Staphylococcus epidermidis
KLPT

SEQ ID NO: 1725371 - protein, 9 aa, Staphylococcus epidermidis
KLSGGQRQR

SEQ ID NO: 1725372 - protein, 8 aa, Staphylococcus epidermidis
KLTDTGSS

SEQ ID NO: 1725373 - protein, 7 aa, Staphylococcus epidermidis
KNESGQL

SEQ ID NO: 1725374 - protein, 28 aa, Staphylococcus epidermidis
KNIGADLQTEQALADKNIAQAKAEERRA

SEQ ID NO: 1725375 - protein, 6 aa, Staphylococcus epidermidis
KNNITN

SEQ ID NO: 1725376 - protein, 7 aa, Staphylococcus epidermidis
KNPLASP

SEQ ID NO: 1725377 - protein, 10 aa, Staphylococcus epidermidis
KPGKANTRNA

SEQ ID NO: 1725378 - protein, 6 aa, Staphylococcus epidermidis
KPITDM

SEQ ID NO: 1725379 - protein, 9 aa, Staphylococcus epidermidis
KQDFSKGNH

SEQ ID NO: 1725380 - protein, 8 aa, Staphylococcus epidermidis
KQGEMGRR

SEQ ID NO: 1725381 - protein, 6 aa, Staphylococcus epidermidis
KQKQRG

SEQ ID NO: 1725382 - protein, 10 aa, Staphylococcus epidermidis
KRGSQEKDIK

SEQ ID NO: 1725383 - protein, 8 aa, Staphylococcus epidermidis
KRQSMTPD

SEQ ID NO: 1725384 - protein, 17 aa, Staphylococcus epidermidis
KRVQEAQANTESEKRRL

SEQ ID NO: 1725385 - protein, 13 aa, Staphylococcus epidermidis
KSRARSQGGNGLG

SEQ ID NO: 1725386 - protein, 8 aa, Staphylococcus epidermidis
KSTFETSY

SEQ ID NO: 1725387 - protein, 6 aa, Staphylococcus epidermidis
KTHEVS

SEQ ID NO: 1725388 - protein, 7 aa, Staphylococcus epidermidis
KTLADNR

SEQ ID NO: 1725389 - protein, 6 aa, Staphylococcus epidermidis
KTPITS

SEQ ID NO: 1725390 - protein, 4 aa, Staphylococcus epidermidis
KVGV

SEQ ID NO: 1725391 - protein, 7 aa, Staphylococcus epidermidis
KVNEEDD

SEQ ID NO: 1725392 - protein, 7 aa, Staphylococcus epidermidis
KYPYGDT

SEQ ID NO: 1725393 - protein, 5 aa, Staphylococcus epidermidis
LADKL

SEQ ID NO: 1725394 - protein, 8 aa, Staphylococcus epidermidis
LDNGQRHE

SEQ ID NO: 1725395 - protein, 4 aa, Staphylococcus epidermidis
LENI

SEQ ID NO: 1725396 - protein, 7 aa, Staphylococcus epidermidis
LESDSGV

SEQ ID NO: 1725397 - protein, 5 aa, Staphylococcus epidermidis
LKGSD

SEQ ID NO: 1725398 - protein, 8 aa, Staphylococcus epidermidis
LKKQAEKM

SEQ ID NO: 1725399 - protein, 7 aa, Staphylococcus epidermidis
LNEEDYE

SEQ ID NO: 1725400 - protein, 9 aa, Staphylococcus epidermidis
LNEFPKNEL

SEQ ID NO: 1725401 - protein, 8 aa, Staphylococcus epidermidis
LNNLNDKD

SEQ ID NO: 1725402 - protein, 9 aa, Staphylococcus epidermidis
LSETSLTQT

SEQ ID NO: 1725403 - protein, 4 aa, Staphylococcus epidermidis
LSPL

SEQ ID NO: 1725404 - protein, 10 aa, Staphylococcus epidermidis
LTEGNAAPIT

SEQ ID NO: 1725405 - protein, 5 aa, Staphylococcus epidermidis
LTESA

SEQ ID NO: 1725406 - protein, 4 aa, Staphylococcus epidermidis
LTSV

SEQ ID NO: 1725407 - protein, 4 aa, Staphylococcus epidermidis
LYGD

SEQ ID NO: 1725408 - protein, 9 aa, Staphylococcus epidermidis
MDNESDQIT

SEQ ID NO: 1725409 - protein, 4 aa, Staphylococcus epidermidis
MKPT

SEQ ID NO: 1725410 - protein, 6 aa, Staphylococcus epidermidis
MKTEGK

SEQ ID NO: 1725411 - protein, 4 aa, Staphylococcus epidermidis
MPIS

SEQ ID NO: 1725412 - protein, 10 aa, Staphylococcus epidermidis
MQGEPNYSGQ

SEQ ID NO: 1725413 - protein, 10 aa, Staphylococcus epidermidis
MSGNSGTQSL

SEQ ID NO: 1725414 - protein, 4 aa, Staphylococcus epidermidis
MSGT

SEQ ID NO: 1725415 - protein, 9 aa, Staphylococcus epidermidis
MSPLSDTTN

SEQ ID NO: 1725416 - protein, 7 aa, Staphylococcus epidermidis
MTGNEKK

SEQ ID NO: 1725417 - protein, 4 aa, Staphylococcus epidermidis
NAPI

SEQ ID NO: 1725418 - protein, 5 aa, Staphylococcus epidermidis
NDANY

SEQ ID NO: 1725419 - protein, 14 aa, Staphylococcus epidermidis
NDENITVNESVPRG

SEQ ID NO: 1725420 - protein, 5 aa, Staphylococcus epidermidis
NDLST

SEQ ID NO: 1725421 - protein, 5 aa, Staphylococcus epidermidis
NEENV

SEQ ID NO: 1725422 - protein, 10 aa, Staphylococcus epidermidis
NEKGRASSAL

SEQ ID NO: 1725423 - protein, 5 aa, Staphylococcus epidermidis
NENTS

SEQ ID NO: 1725424 - protein, 7 aa, Staphylococcus epidermidis
NETDNTV

SEQ ID NO: 1725425 - protein, 5 aa, Staphylococcus epidermidis
NFGDA

SEQ ID NO: 1725426 - protein, 5 aa, Staphylococcus epidermidis
NGGEE

SEQ ID NO: 1725427 - protein, 6 aa, Staphylococcus epidermidis
NGMGST

SEQ ID NO: 1725428 - protein, 6 aa, Staphylococcus epidermidis
NGSMGE

SEQ ID NO: 1725429 - protein, 7 aa, Staphylococcus epidermidis
NINGSKS

SEQ ID NO: 1725430 - protein, 5 aa, Staphylococcus epidermidis
NIPGV

SEQ ID NO: 1725431 - protein, 4 aa, Staphylococcus epidermidis
NIPS

SEQ ID NO: 1725432 - protein, 10 aa, Staphylococcus epidermidis
NISQNEDKIS

SEQ ID NO: 1725433 - protein, 5 aa, Staphylococcus epidermidis
NITQY

SEQ ID NO: 1725434 - protein, 4 aa, Staphylococcus epidermidis
NKAN

SEQ ID NO: 1725435 - protein, 12 aa, Staphylococcus epidermidis
NKEDSKETEIKQ

SEQ ID NO: 1725436 - protein, 7 aa, Staphylococcus epidermidis
NKKNKSF

SEQ ID NO: 1725437 - protein, 8 aa, Staphylococcus epidermidis
NKLPRAGR

SEQ ID NO: 1725438 - protein, 7 aa, Staphylococcus epidermidis
NKPLDET

SEQ ID NO: 1725439 - protein, 4 aa, Staphylococcus epidermidis
NKTR

SEQ ID NO: 1725440 - protein, 8 aa, Staphylococcus epidermidis
NLGSSVGS

SEQ ID NO: 1725441 - protein, 8 aa, Staphylococcus epidermidis
NLRNGSAN

SEQ ID NO: 1725442 - protein, 4 aa, Staphylococcus epidermidis
NMPN

SEQ ID NO: 1725443 - protein, 6 aa, Staphylococcus epidermidis
NNPGGL

SEQ ID NO: 1725444 - protein, 9 aa, Staphylococcus epidermidis
NNQGLTSKQ

SEQ ID NO: 1725445 - protein, 5 aa, Staphylococcus epidermidis
NPDLK

SEQ ID NO: 1725446 - protein, 9 aa, Staphylococcus epidermidis
NPHKASQAL

SEQ ID NO: 1725447 - protein, 5 aa, Staphylococcus epidermidis
NPKKA

SEQ ID NO: 1725448 - protein, 6 aa, Staphylococcus epidermidis
NPPYGD

SEQ ID NO: 1725449 - protein, 11 aa, Staphylococcus epidermidis
NPQNPGQHQYA

SEQ ID NO: 1725450 - protein, 13 aa, Staphylococcus epidermidis
NQAGNVESMGGAV

SEQ ID NO: 1725451 - protein, 4 aa, Staphylococcus epidermidis
NRNH

SEQ ID NO: 1725452 - protein, 5 aa, Staphylococcus epidermidis
NRPDI

SEQ ID NO: 1725453 - protein, 9 aa, Staphylococcus epidermidis
NSANGELFS

SEQ ID NO: 1725454 - protein, 5 aa, Staphylococcus epidermidis
NSTFT

SEQ ID NO: 1725455 - protein, 5 aa, Staphylococcus epidermidis
NSTNR

SEQ ID NO: 1725456 - protein, 4 aa, Staphylococcus epidermidis
NTIT

SEQ ID NO: 1725457 - protein, 8 aa, Staphylococcus epidermidis
NTKKQIGG

SEQ ID NO: 1725458 - protein, 10 aa, Staphylococcus epidermidis
NTSEKAHEAG

SEQ ID NO: 1725459 - protein, 5 aa, Staphylococcus epidermidis
NVGKT

SEQ ID NO: 1725460 - protein, 5 aa, Staphylococcus epidermidis
NVPTI

SEQ ID NO: 1725461 - protein, 9 aa, Staphylococcus epidermidis
NYTKGQAPF

SEQ ID NO: 1725462 - protein, 6 aa, Staphylococcus epidermidis
PAADPE

SEQ ID NO: 1725463 - protein, 11 aa, Staphylococcus epidermidis
PATPSNTARAG

SEQ ID NO: 1725464 - protein, 11 aa, Staphylococcus epidermidis
PDAQTDAMSEE

SEQ ID NO: 1725465 - protein, 4 aa, Staphylococcus epidermidis
PDKM

SEQ ID NO: 1725466 - protein, 7 aa, Staphylococcus epidermidis
PDSGTRI

SEQ ID NO: 1725467 - protein, 8 aa, Staphylococcus epidermidis
PEGGAQTH

SEQ ID NO: 1725468 - protein, 4 aa, Staphylococcus epidermidis
PEPH

SEQ ID NO: 1725469 - protein, 8 aa, Staphylococcus epidermidis
PISKDETV

SEQ ID NO: 1725470 - protein, 7 aa, Staphylococcus epidermidis
PKGGGAY

SEQ ID NO: 1725471 - protein, 9 aa, Staphylococcus epidermidis
PKGQTEAAY

SEQ ID NO: 1725472 - protein, 9 aa, Staphylococcus epidermidis
PKIQIEDPN

SEQ ID NO: 1725473 - protein, 5 aa, Staphylococcus epidermidis
PLASP

SEQ ID NO: 1725474 - protein, 17 aa, Staphylococcus epidermidis
PLDSEESARIEYDEDTG

SEQ ID NO: 1725475 - protein, 8 aa, Staphylococcus epidermidis
PLNSTTEG

SEQ ID NO: 1725476 - protein, 5 aa, Staphylococcus epidermidis
PNKHR

SEQ ID NO: 1725477 - protein, 5 aa, Staphylococcus epidermidis
PNVKT

SEQ ID NO: 1725478 - protein, 6 aa, Staphylococcus epidermidis
PPFSGF

SEQ ID NO: 1725479 - protein, 7 aa, Staphylococcus epidermidis
PPGSAPV

SEQ ID NO: 1725480 - protein, 6 aa, Staphylococcus epidermidis
PPHPGP

SEQ ID NO: 1725481 - protein, 10 aa, Staphylococcus epidermidis
PQSGGMSNYA

SEQ ID NO: 1725482 - protein, 7 aa, Staphylococcus epidermidis
PRGQAGG

SEQ ID NO: 1725483 - protein, 4 aa, Staphylococcus epidermidis
PSGL

SEQ ID NO: 1725484 - protein, 5 aa, Staphylococcus epidermidis
PSNGR

SEQ ID NO: 1725485 - protein, 11 aa, Staphylococcus epidermidis
PSSNSDGNYTK

SEQ ID NO: 1725486 - protein, 7 aa, Staphylococcus epidermidis
PSSSSHA

SEQ ID NO: 1725487 - protein, 4 aa, Staphylococcus epidermidis
PSVA

SEQ ID NO: 1725488 - protein, 7 aa, Staphylococcus epidermidis
PTADATV

SEQ ID NO: 1725489 - protein, 4 aa, Staphylococcus epidermidis
PTPV

SEQ ID NO: 1725490 - protein, 4 aa, Staphylococcus epidermidis
PVSG

SEQ ID NO: 1725491 - protein, 5 aa, Staphylococcus epidermidis
PVSST

SEQ ID NO: 1725492 - protein, 12 aa, Staphylococcus epidermidis
PYGKQGLQALSG

SEQ ID NO: 1725493 - protein, 6 aa, Staphylococcus epidermidis
QAGQSM

SEQ ID NO: 1725494 - protein, 6 aa, Staphylococcus epidermidis
QAIETT

SEQ ID NO: 1725495 - protein, 10 aa, Staphylococcus epidermidis
QAYSKANKSS

SEQ ID NO: 1725496 - protein, 6 aa, Staphylococcus epidermidis
QEYSKD

SEQ ID NO: 1725497 - protein, 19 aa, Staphylococcus epidermidis
QGAKTRGGHMEGNKVTEEI

SEQ ID NO: 1725498 - protein, 6 aa, Staphylococcus epidermidis
QGGAQY

SEQ ID NO: 1725499 - protein, 6 aa, Staphylococcus epidermidis
QGKENE

SEQ ID NO: 1725500 - protein, 5 aa, Staphylococcus epidermidis
QGNQL

SEQ ID NO: 1725501 - protein, 7 aa, Staphylococcus epidermidis
QHPAGLD

SEQ ID NO: 1725502 - protein, 5 aa, Staphylococcus epidermidis
QHPPE

SEQ ID NO: 1725503 - protein, 9 aa, Staphylococcus epidermidis
QIRKEGSLN

SEQ ID NO: 1725504 - protein, 7 aa, Staphylococcus epidermidis
QKASTSL

SEQ ID NO: 1725505 - protein, 8 aa, Staphylococcus epidermidis
QKPSQKKI

SEQ ID NO: 1725506 - protein, 8 aa, Staphylococcus epidermidis
QKQGYTSN

SEQ ID NO: 1725507 - protein, 4 aa, Staphylococcus epidermidis
QNGC

SEQ ID NO: 1725508 - protein, 5 aa, Staphylococcus epidermidis
QPDKL

SEQ ID NO: 1725509 - protein, 6 aa, Staphylococcus epidermidis
QPNMNG

SEQ ID NO: 1725510 - protein, 7 aa, Staphylococcus epidermidis
QPTEQRL

SEQ ID NO: 1725511 - protein, 7 aa, Staphylococcus epidermidis
QPVPPPW

SEQ ID NO: 1725512 - protein, 7 aa, Staphylococcus epidermidis
QQIGTSG

SEQ ID NO: 1725513 - protein, 13 aa, Staphylococcus epidermidis
QQKSIGRKAQEAY

SEQ ID NO: 1725514 - protein, 5 aa, Staphylococcus epidermidis
QRPSV

SEQ ID NO: 1725515 - protein, 7 aa, Staphylococcus epidermidis
QSGPIAS

SEQ ID NO: 1725516 - protein, 9 aa, Staphylococcus epidermidis
QSNTSGELK

SEQ ID NO: 1725517 - protein, 9 aa, Staphylococcus epidermidis
QSVTPTHGT

SEQ ID NO: 1725518 - protein, 5 aa, Staphylococcus epidermidis
QTETT

SEQ ID NO: 1725519 - protein, 7 aa, Staphylococcus epidermidis
QTISLTG

SEQ ID NO: 1725520 - protein, 12 aa, Staphylococcus epidermidis
QTVEMSKGNYTQ

SEQ ID NO: 1725521 - protein, 11 aa, Staphylococcus epidermidis
RAHAAGKAATL

SEQ ID NO: 1725522 - protein, 4 aa, Staphylococcus epidermidis
RAMP

SEQ ID NO: 1725523 - protein, 5 aa, Staphylococcus epidermidis
RANQP

SEQ ID NO: 1725524 - protein, 9 aa, Staphylococcus epidermidis
RDLGANESQ

SEQ ID NO: 1725525 - protein, 7 aa, Staphylococcus epidermidis
RDSSLPF

SEQ ID NO: 1725526 - protein, 9 aa, Staphylococcus epidermidis
REAESTTAI

SEQ ID NO: 1725527 - protein, 7 aa, Staphylococcus epidermidis
RGAATGI

SEQ ID NO: 1725528 - protein, 4 aa, Staphylococcus epidermidis
RGES

SEQ ID NO: 1725529 - protein, 8 aa, Staphylococcus epidermidis
RKHPQKAD

SEQ ID NO: 1725530 - protein, 5 aa, Staphylococcus epidermidis
RPDLD

SEQ ID NO: 1725531 - protein, 10 aa, Staphylococcus epidermidis
RPKPSWDGSA

SEQ ID NO: 1725532 - protein, 13 aa, Staphylococcus epidermidis
RQYGSGNTGATNS

SEQ ID NO: 1725533 - protein, 4 aa, Staphylococcus epidermidis
RSIG

SEQ ID NO: 1725534 - protein, 5 aa, Staphylococcus epidermidis
RSSKN

SEQ ID NO: 1725535 - protein, 5 aa, Staphylococcus epidermidis
RSTLT

SEQ ID NO: 1725536 - protein, 5 aa, Staphylococcus epidermidis
RTTDL

SEQ ID NO: 1725537 - protein, 8 aa, Staphylococcus epidermidis
RVGKTESI

SEQ ID NO: 1725538 - protein, 7 aa, Staphylococcus epidermidis
SASTVGK

SEQ ID NO: 1725539 - protein, 5 aa, Staphylococcus epidermidis
SDDRK

SEQ ID NO: 1725540 - protein, 6 aa, Staphylococcus epidermidis
SDIDPT

SEQ ID NO: 1725541 - protein, 21 aa, Staphylococcus epidermidis
SDIKQGSAKQEFKQETNQPTV

SEQ ID NO: 1725542 - protein, 12 aa, Staphylococcus epidermidis
SDTPNFDEEPDK

SEQ ID NO: 1725543 - protein, 4 aa, Staphylococcus epidermidis
SELE

SEQ ID NO: 1725544 - protein, 6 aa, Staphylococcus epidermidis
SENGGI

SEQ ID NO: 1725545 - protein, 9 aa, Staphylococcus epidermidis
SEQSDDNLK

SEQ ID NO: 1725546 - protein, 7 aa, Staphylococcus epidermidis
SFKDPGQ

SEQ ID NO: 1725547 - protein, 4 aa, Staphylococcus epidermidis
SGAF

SEQ ID NO: 1725548 - protein, 4 aa, Staphylococcus epidermidis
SGDD

SEQ ID NO: 1725549 - protein, 7 aa, Staphylococcus epidermidis
SGEINGD

SEQ ID NO: 1725550 - protein, 7 aa, Staphylococcus epidermidis
SGGGKST

SEQ ID NO: 1725551 - protein, 7 aa, Staphylococcus epidermidis
SGGRNYK

SEQ ID NO: 1725552 - protein, 10 aa, Staphylococcus epidermidis
SGQNSTITGT

SEQ ID NO: 1725553 - protein, 6 aa, Staphylococcus epidermidis
SHAFGT

SEQ ID NO: 1725554 - protein, 8 aa, Staphylococcus epidermidis
SHRNNGAA

SEQ ID NO: 1725555 - protein, 6 aa, Staphylococcus epidermidis
SHVNPE

SEQ ID NO: 1725556 - protein, 7 aa, Staphylococcus epidermidis
SIEDTNN

SEQ ID NO: 1725557 - protein, 7 aa, Staphylococcus epidermidis
SIENEKE

SEQ ID NO: 1725558 - protein, 5 aa, Staphylococcus epidermidis
SIIDE

SEQ ID NO: 1725559 - protein, 20 aa, Staphylococcus epidermidis
SIREEGPQSHMKKTGTPTMG

SEQ ID NO: 1725560 - protein, 11 aa, Staphylococcus epidermidis
SIVPHGDTQLR

SEQ ID NO: 1725561 - protein, 13 aa, Staphylococcus epidermidis
SKAKMYDSNKRRV

SEQ ID NO: 1725562 - protein, 7 aa, Staphylococcus epidermidis
SKAVHTK

SEQ ID NO: 1725563 - protein, 17 aa, Staphylococcus epidermidis
SKDKFKKVTEKISKKRD

SEQ ID NO: 1725564 - protein, 5 aa, Staphylococcus epidermidis
SKDKY

SEQ ID NO: 1725565 - protein, 8 aa, Staphylococcus epidermidis
SKDLKRAN

SEQ ID NO: 1725566 - protein, 5 aa, Staphylococcus epidermidis
SKGNG

SEQ ID NO: 1725567 - protein, 6 aa, Staphylococcus epidermidis
SKGRSI

SEQ ID NO: 1725568 - protein, 6 aa, Staphylococcus epidermidis
SKKSQR

SEQ ID NO: 1725569 - protein, 5 aa, Staphylococcus epidermidis
SKNAL

SEQ ID NO: 1725570 - protein, 10 aa, Staphylococcus epidermidis
SKRNKAIGRA

SEQ ID NO: 1725571 - protein, 6 aa, Staphylococcus epidermidis
SKSEQL

SEQ ID NO: 1725572 - protein, 9 aa, Staphylococcus epidermidis
SKTMPQEQR

SEQ ID NO: 1725573 - protein, 4 aa, Staphylococcus epidermidis
SLGS

SEQ ID NO: 1725574 - protein, 4 aa, Staphylococcus epidermidis
SLNP

SEQ ID NO: 1725575 - protein, 12 aa, Staphylococcus epidermidis
SMGPTAVSEVTE

SEQ ID NO: 1725576 - protein, 4 aa, Staphylococcus epidermidis
SNGM

SEQ ID NO: 1725577 - protein, 6 aa, Staphylococcus epidermidis
SNGSPL

SEQ ID NO: 1725578 - protein, 6 aa, Staphylococcus epidermidis
SNTERL

SEQ ID NO: 1725579 - protein, 9 aa, Staphylococcus epidermidis
SNVNSNDYT

SEQ ID NO: 1725580 - protein, 6 aa, Staphylococcus epidermidis
SNYKGI

SEQ ID NO: 1725581 - protein, 4 aa, Staphylococcus epidermidis
SPEF

SEQ ID NO: 1725582 - protein, 6 aa, Staphylococcus epidermidis
SPGNPV

SEQ ID NO: 1725583 - protein, 5 aa, Staphylococcus epidermidis
SPQQG

SEQ ID NO: 1725584 - protein, 10 aa, Staphylococcus epidermidis
SQKKVIGEPL

SEQ ID NO: 1725585 - protein, 9 aa, Staphylococcus epidermidis
SQSTRDNLT

SEQ ID NO: 1725586 - protein, 5 aa, Staphylococcus epidermidis
SRSAA

SEQ ID NO: 1725587 - protein, 9 aa, Staphylococcus epidermidis
SRSGSTIST

SEQ ID NO: 1725588 - protein, 8 aa, Staphylococcus epidermidis
SRSSAGAL

SEQ ID NO: 1725589 - protein, 10 aa, Staphylococcus epidermidis
SSGASSLTGV

SEQ ID NO: 1725590 - protein, 7 aa, Staphylococcus epidermidis
SSGPIDR

SEQ ID NO: 1725591 - protein, 4 aa, Staphylococcus epidermidis
SSLG

SEQ ID NO: 1725592 - protein, 5 aa, Staphylococcus epidermidis
SSLTE

SEQ ID NO: 1725593 - protein, 12 aa, Staphylococcus epidermidis
SSPSSVGGGIRT

SEQ ID NO: 1725594 - protein, 8 aa, Staphylococcus epidermidis
SSTRNIEG

SEQ ID NO: 1725595 - protein, 8 aa, Staphylococcus epidermidis
SSYNSDIG

SEQ ID NO: 1725596 - protein, 8 aa, Staphylococcus epidermidis
STRALTPR

SEQ ID NO: 1725597 - protein, 6 aa, Staphylococcus epidermidis
STREKP

SEQ ID NO: 1725598 - protein, 5 aa, Staphylococcus epidermidis
SVEGV

SEQ ID NO: 1725599 - protein, 5 aa, Staphylococcus epidermidis
SWGGS

SEQ ID NO: 1725600 - protein, 10 aa, Staphylococcus epidermidis
SYNGGEINQT

SEQ ID NO: 1725601 - protein, 6 aa, Staphylococcus epidermidis
TASSML

SEQ ID NO: 1725602 - protein, 4 aa, Staphylococcus epidermidis
TATA

SEQ ID NO: 1725603 - protein, 7 aa, Staphylococcus epidermidis
TATRETP

SEQ ID NO: 1725604 - protein, 7 aa, Staphylococcus epidermidis
TAVGPSG

SEQ ID NO: 1725605 - protein, 5 aa, Staphylococcus epidermidis
TDDTK

SEQ ID NO: 1725606 - protein, 7 aa, Staphylococcus epidermidis
TEKYDSL

SEQ ID NO: 1725607 - protein, 7 aa, Staphylococcus epidermidis
TEPDEIR

SEQ ID NO: 1725608 - protein, 11 aa, Staphylococcus epidermidis
TEQQQVERERR

SEQ ID NO: 1725609 - protein, 7 aa, Staphylococcus epidermidis
TGAITPG

SEQ ID NO: 1725610 - protein, 4 aa, Staphylococcus epidermidis
TGSL

SEQ ID NO: 1725611 - protein, 16 aa, Staphylococcus epidermidis
TIENNQQKALASEDDL

SEQ ID NO: 1725612 - protein, 9 aa, Staphylococcus epidermidis
TIGSSEHHT

SEQ ID NO: 1725613 - protein, 11 aa, Staphylococcus epidermidis
TKGDGPILGGN

SEQ ID NO: 1725614 - protein, 12 aa, Staphylococcus epidermidis
TKTGSEDGCGSS

SEQ ID NO: 1725615 - protein, 4 aa, Staphylococcus epidermidis
TNGT

SEQ ID NO: 1725616 - protein, 5 aa, Staphylococcus epidermidis
TNLGE

SEQ ID NO: 1725617 - protein, 6 aa, Staphylococcus epidermidis
TNPAIQ

SEQ ID NO: 1725618 - protein, 4 aa, Staphylococcus epidermidis
TNQN

SEQ ID NO: 1725619 - protein, 10 aa, Staphylococcus epidermidis
TNTYSRDEEK

SEQ ID NO: 1725620 - protein, 4 aa, Staphylococcus epidermidis
TPGP

SEQ ID NO: 1725621 - protein, 5 aa, Staphylococcus epidermidis
TPITA

SEQ ID NO: 1725622 - protein, 7 aa, Staphylococcus epidermidis
TQKTKGH

SEQ ID NO: 1725623 - protein, 4 aa, Staphylococcus epidermidis
TQRL

SEQ ID NO: 1725624 - protein, 4 aa, Staphylococcus epidermidis
TRNQ

SEQ ID NO: 1725625 - protein, 5 aa, Staphylococcus epidermidis
TRQPK

SEQ ID NO: 1725626 - protein, 4 aa, Staphylococcus epidermidis
TSAN

SEQ ID NO: 1725627 - protein, 4 aa, Staphylococcus epidermidis
TSEI

SEQ ID NO: 1725628 - protein, 9 aa, Staphylococcus epidermidis
TSGLTGPES

SEQ ID NO: 1725629 - protein, 6 aa, Staphylococcus epidermidis
TSIGTT

SEQ ID NO: 1725630 - protein, 6 aa, Staphylococcus epidermidis
TSPIDL

SEQ ID NO: 1725631 - protein, 5 aa, Staphylococcus epidermidis
TSSEY

SEQ ID NO: 1725632 - protein, 6 aa, Staphylococcus epidermidis
TSSSEA

SEQ ID NO: 1725633 - protein, 4 aa, Staphylococcus epidermidis
TSSY

SEQ ID NO: 1725634 - protein, 4 aa, Staphylococcus epidermidis
TSVG

SEQ ID NO: 1725635 - protein, 9 aa, Staphylococcus epidermidis
TTAASGTSH

SEQ ID NO: 1725636 - protein, 11 aa, Staphylococcus epidermidis
TTHYSSGPAPI

SEQ ID NO: 1725637 - protein, 4 aa, Staphylococcus epidermidis
TTRI

SEQ ID NO: 1725638 - protein, 6 aa, Staphylococcus epidermidis
TTYGGL

SEQ ID NO: 1725639 - protein, 4 aa, Staphylococcus epidermidis
TVES

SEQ ID NO: 1725640 - protein, 6 aa, Staphylococcus epidermidis
TVSEQA

SEQ ID NO: 1725641 - protein, 5 aa, Staphylococcus epidermidis
VAKTP

SEQ ID NO: 1725642 - protein, 4 aa, Staphylococcus epidermidis
VDIK

SEQ ID NO: 1725643 - protein, 4 aa, Staphylococcus epidermidis
VDIT

SEQ ID NO: 1725644 - protein, 11 aa, Staphylococcus epidermidis
VDKGQTEAARS

SEQ ID NO: 1725645 - protein, 8 aa, Staphylococcus epidermidis
VEDKLKPG

SEQ ID NO: 1725646 - protein, 4 aa, Staphylococcus epidermidis
VEEH

SEQ ID NO: 1725647 - protein, 4 aa, Staphylococcus epidermidis
VEQT

SEQ ID NO: 1725648 - protein, 7 aa, Staphylococcus epidermidis
VGEGTEN

SEQ ID NO: 1725649 - protein, 4 aa, Staphylococcus epidermidis
VGGT

SEQ ID NO: 1725650 - protein, 11 aa, Staphylococcus epidermidis
VGPSGAGKSTL

SEQ ID NO: 1725651 - protein, 9 aa, Staphylococcus epidermidis
VGRPDVKGR

SEQ ID NO: 1725652 - protein, 20 aa, Staphylococcus epidermidis
VGRQRGAGVGGGHDEREQTL

SEQ ID NO: 1725653 - protein, 8 aa, Staphylococcus epidermidis
VKEEEKQS

SEQ ID NO: 1725654 - protein, 14 aa, Staphylococcus epidermidis
VKRARTQEEKMAAN

SEQ ID NO: 1725655 - protein, 9 aa, Staphylococcus epidermidis
VKSKRGAEL

SEQ ID NO: 1725656 - protein, 7 aa, Staphylococcus epidermidis
VNGKEVT

SEQ ID NO: 1725657 - protein, 6 aa, Staphylococcus epidermidis
VNKGEK

SEQ ID NO: 1725658 - protein, 8 aa, Staphylococcus epidermidis
VPGVSGGT

SEQ ID NO: 1725659 - protein, 39 aa, Staphylococcus epidermidis
VQKGEPGTKTITTPTTKNPLTGEKVGEGEPTEKITKQPV

SEQ ID NO: 1725660 - protein, 4 aa, Staphylococcus epidermidis
VSED

SEQ ID NO: 1725661 - protein, 4 aa, Staphylococcus epidermidis
VSEL

SEQ ID NO: 1725662 - protein, 9 aa, Staphylococcus epidermidis
VSPTTAGTM

SEQ ID NO: 1725663 - protein, 6 aa, Staphylococcus epidermidis
VSRTGS

SEQ ID NO: 1725664 - protein, 7 aa, Staphylococcus epidermidis
VTGKPYV

SEQ ID NO: 1725665 - protein, 5 aa, Staphylococcus epidermidis
VTSGI

SEQ ID NO: 1725666 - protein, 8 aa, Staphylococcus epidermidis
VVDNGGKI

SEQ ID NO: 1725667 - protein, 8 aa, Staphylococcus epidermidis
WPNGGRQT

SEQ ID NO: 1725668 - protein, 7 aa, Staphylococcus epidermidis
YASSTAE

SEQ ID NO: 1725669 - protein, 9 aa, Staphylococcus epidermidis
YEASTNIKN

SEQ ID NO: 1725670 - protein, 8 aa, Staphylococcus epidermidis
YENEDKYD

SEQ ID NO: 1725671 - protein, 5 aa, Staphylococcus epidermidis
YGGTA

SEQ ID NO: 1725672 - protein, 6 aa, Staphylococcus epidermidis
YGSGKE

SEQ ID NO: 1725673 - protein, 6 aa, Staphylococcus epidermidis
YGSGMT

SEQ ID NO: 1725674 - protein, 5 aa, Staphylococcus epidermidis
YHDKR

SEQ ID NO: 1725675 - protein, 6 aa, Staphylococcus epidermidis
YPGLEG

SEQ ID NO: 1725676 - protein, 5 aa, Staphylococcus epidermidis
YQGHK

SEQ ID NO: 1725677 - protein, 8 aa, Staphylococcus epidermidis
YRGKSPAQ

SEQ ID NO: 1725678 - protein, 23 aa, Staphylococcus epidermidis
YSGKIGPSEVLGGSSSEFSPTQL

SEQ ID NO: 1725679 - protein, 7 aa, Staphylococcus epidermidis
YSLGGPE

SEQ ID NO: 1725680 - protein, 11 aa, Staphylococcus epidermidis
YSYSSGDGYHL

SEQ ID NO: 1725681 - protein, 6 aa, Staphylococcus epidermidis
YTPGGG

SEQ ID NO: 1725682 - protein, 14 aa, Staphylococcus epidermidis
YTSQENKKKQRQKM

SEQ ID NO: 1725683 - protein, 6 aa, Staphylococcus epidermidis
YYTREE

SEQ ID NO: 1725684 - protein, 7 aa, Staphylococcus epidermidis
AAAGGYG

SEQ ID NO: 1725685 - protein, 11 aa, Staphylococcus epidermidis
AAEDMQDDGNF

SEQ ID NO: 1725686 - protein, 6 aa, Staphylococcus epidermidis
AAGQGG

SEQ ID NO: 1725687 - protein, 8 aa, Staphylococcus epidermidis
AAIASQGS

SEQ ID NO: 1725688 - protein, 7 aa, Staphylococcus epidermidis
AAKGSKE

SEQ ID NO: 1725689 - protein, 4 aa, Staphylococcus epidermidis
AAPF

SEQ ID NO: 1725690 - protein, 6 aa, Staphylococcus epidermidis
AAPTPV

SEQ ID NO: 1725691 - protein, 11 aa, Staphylococcus epidermidis
AARKRGKQGTG

SEQ ID NO: 1725692 - protein, 7 aa, Staphylococcus epidermidis
AATKQNT

SEQ ID NO: 1725693 - protein, 10 aa, Staphylococcus epidermidis
ADDLNPVGLS

SEQ ID NO: 1725694 - protein, 6 aa, Staphylococcus epidermidis
ADGEQV

SEQ ID NO: 1725695 - protein, 10 aa, Staphylococcus epidermidis
ADGGGATRIA

SEQ ID NO: 1725696 - protein, 6 aa, Staphylococcus epidermidis
ADGMPS

SEQ ID NO: 1725697 - protein, 7 aa, Staphylococcus epidermidis
ADKNGKM

SEQ ID NO: 1725698 - protein, 7 aa, Staphylococcus epidermidis
ADKPGFA

SEQ ID NO: 1725699 - protein, 8 aa, Staphylococcus epidermidis
ADKQAPKF

SEQ ID NO: 1725700 - protein, 4 aa, Staphylococcus epidermidis
ADSA

SEQ ID NO: 1725701 - protein, 6 aa, Staphylococcus epidermidis
ADSTTH

SEQ ID NO: 1725702 - protein, 7 aa, Staphylococcus epidermidis
ADYQSKM

SEQ ID NO: 1725703 - protein, 5 aa, Staphylococcus epidermidis
AEMKG

SEQ ID NO: 1725704 - protein, 26 aa, Staphylococcus epidermidis
AESKKSDIRANQDATTEEKNTAIQSI

SEQ ID NO: 1725705 - protein, 10 aa, Staphylococcus epidermidis
AESNKPLKEQ

SEQ ID NO: 1725706 - protein, 6 aa, Staphylococcus epidermidis
AESPEE

SEQ ID NO: 1725707 - protein, 6 aa, Staphylococcus epidermidis
AETFVD

SEQ ID NO: 1725708 - protein, 6 aa, Staphylococcus epidermidis
AETYRI

SEQ ID NO: 1725709 - protein, 7 aa, Staphylococcus epidermidis
AFGGPSS

SEQ ID NO: 1725710 - protein, 6 aa, Staphylococcus epidermidis
AGASDM

SEQ ID NO: 1725711 - protein, 5 aa, Staphylococcus epidermidis
AGATR

SEQ ID NO: 1725712 - protein, 10 aa, Staphylococcus epidermidis
AGDPYTSGMS

SEQ ID NO: 1725713 - protein, 8 aa, Staphylococcus epidermidis
AGESIPTD

SEQ ID NO: 1725714 - protein, 14 aa, Staphylococcus epidermidis
AGETKDPEKTIPKA

SEQ ID NO: 1725715 - protein, 6 aa, Staphylococcus epidermidis
AGGDGV

SEQ ID NO: 1725716 - protein, 13 aa, Staphylococcus epidermidis
AGGEGAKNYGDTK

SEQ ID NO: 1725717 - protein, 6 aa, Staphylococcus epidermidis
AGGTRI

SEQ ID NO: 1725718 - protein, 7 aa, Staphylococcus epidermidis
AGLGEAA

SEQ ID NO: 1725719 - protein, 9 aa, Staphylococcus epidermidis
AGLNLTTNQ

SEQ ID NO: 1725720 - protein, 6 aa, Staphylococcus epidermidis
AGNLGF

SEQ ID NO: 1725721 - protein, 10 aa, Staphylococcus epidermidis
AGQKTSDTAV

SEQ ID NO: 1725722 - protein, 10 aa, Staphylococcus epidermidis
AGSTLSREAD

SEQ ID NO: 1725723 - protein, 7 aa, Staphylococcus epidermidis
AHGSDDK

SEQ ID NO: 1725724 - protein, 5 aa, Staphylococcus epidermidis
AIESN

SEQ ID NO: 1725725 - protein, 10 aa, Staphylococcus epidermidis
AIESSENSAM

SEQ ID NO: 1725726 - protein, 9 aa, Staphylococcus epidermidis
AINPNNKKY

SEQ ID NO: 1725727 - protein, 7 aa, Staphylococcus epidermidis
AINSSVA

SEQ ID NO: 1725728 - protein, 7 aa, Staphylococcus epidermidis
AISPETS

SEQ ID NO: 1725729 - protein, 27 aa, Staphylococcus epidermidis
AKDAGYNKVDQAQTNQQVSDAKTEAID

SEQ ID NO: 1725730 - protein, 10 aa, Staphylococcus epidermidis
AKEATTDNKL

SEQ ID NO: 1725731 - protein, 15 aa, Staphylococcus epidermidis
AKGSNSTKKQVITPR

SEQ ID NO: 1725732 - protein, 10 aa, Staphylococcus epidermidis
AKNEVEETKD

SEQ ID NO: 1725733 - protein, 7 aa, Staphylococcus epidermidis
AKNHEST

SEQ ID NO: 1725734 - protein, 8 aa, Staphylococcus epidermidis
AKTNQKKQ

SEQ ID NO: 1725735 - protein, 6 aa, Staphylococcus epidermidis
AKYNAS

SEQ ID NO: 1725736 - protein, 9 aa, Staphylococcus epidermidis
ALDSSNANG

SEQ ID NO: 1725737 - protein, 8 aa, Staphylococcus epidermidis
ALGGSQNI

SEQ ID NO: 1725738 - protein, 6 aa, Staphylococcus epidermidis
AMGASP

SEQ ID NO: 1725739 - protein, 6 aa, Staphylococcus epidermidis
ANDGYR

SEQ ID NO: 1725740 - protein, 25 aa, Staphylococcus epidermidis
ANEGLDNYEQHELNNGEQQYLSKGA

SEQ ID NO: 1725741 - protein, 22 aa, Staphylococcus epidermidis
ANGKEIGDGFSSETYGPYDPDE

SEQ ID NO: 1725742 - protein, 5 aa, Staphylococcus epidermidis
ANHPD

SEQ ID NO: 1725743 - protein, 18 aa, Staphylococcus epidermidis
ANNNATTEEKADAERKVN

SEQ ID NO: 1725744 - protein, 7 aa, Staphylococcus epidermidis
ANQQGTP

SEQ ID NO: 1725745 - protein, 17 aa, Staphylococcus epidermidis
ANTRTKVQEELNKATEL

SEQ ID NO: 1725746 - protein, 6 aa, Staphylococcus epidermidis
ANVDDL

SEQ ID NO: 1725747 - protein, 12 aa, Staphylococcus epidermidis
ANYDRPSVAGTA

SEQ ID NO: 1725748 - protein, 7 aa, Staphylococcus epidermidis
APAIGPT

SEQ ID NO: 1725749 - protein, 6 aa, Staphylococcus epidermidis
APGGMS

SEQ ID NO: 1725750 - protein, 4 aa, Staphylococcus epidermidis
APGH

SEQ ID NO: 1725751 - protein, 6 aa, Staphylococcus epidermidis
APKGKL

SEQ ID NO: 1725752 - protein, 5 aa, Staphylococcus epidermidis
APLSS

SEQ ID NO: 1725753 - protein, 17 aa, Staphylococcus epidermidis
APPTADPETTKAYTESL

SEQ ID NO: 1725754 - protein, 15 aa, Staphylococcus epidermidis
APQPEQVATHTYDNG

SEQ ID NO: 1725755 - protein, 6 aa, Staphylococcus epidermidis
APTTEH

SEQ ID NO: 1725756 - protein, 11 aa, Staphylococcus epidermidis
APVGKQGQYQG

SEQ ID NO: 1725757 - protein, 9 aa, Staphylococcus epidermidis
APVSADYSN

SEQ ID NO: 1725758 - protein, 11 aa, Staphylococcus epidermidis
AQGQDGQSKDM

SEQ ID NO: 1725759 - protein, 7 aa, Staphylococcus epidermidis
AQITGNS

SEQ ID NO: 1725760 - protein, 10 aa, Staphylococcus epidermidis
AQQNKIDEIE

SEQ ID NO: 1725761 - protein, 16 aa, Staphylococcus epidermidis
AQSEINSQKERAISDI

SEQ ID NO: 1725762 - protein, 9 aa, Staphylococcus epidermidis
AQSNPEMSR

SEQ ID NO: 1725763 - protein, 5 aa, Staphylococcus epidermidis
AQSPG

SEQ ID NO: 1725764 - protein, 7 aa, Staphylococcus epidermidis
AQTKQQV

SEQ ID NO: 1725765 - protein, 13 aa, Staphylococcus epidermidis
AQVTQKEYKGFGG

SEQ ID NO: 1725766 - protein, 8 aa, Staphylococcus epidermidis
ARAAQKQG

SEQ ID NO: 1725767 - protein, 16 aa, Staphylococcus epidermidis
ARESINASSSRDRAKF

SEQ ID NO: 1725768 - protein, 15 aa, Staphylococcus epidermidis
AREYERTQKPKPLDT

SEQ ID NO: 1725769 - protein, 6 aa, Staphylococcus epidermidis
ARGIDD

SEQ ID NO: 1725770 - protein, 7 aa, Staphylococcus epidermidis
ARGLGQR

SEQ ID NO: 1725771 - protein, 4 aa, Staphylococcus epidermidis
ARPR

SEQ ID NO: 1725772 - protein, 5 aa, Staphylococcus epidermidis
ARQTR

SEQ ID NO: 1725773 - protein, 13 aa, Staphylococcus epidermidis
ARSASKKELIDII

SEQ ID NO: 1725774 - protein, 5 aa, Staphylococcus epidermidis
ARYPN

SEQ ID NO: 1725775 - protein, 4 aa, Staphylococcus epidermidis
ASAG

SEQ ID NO: 1725776 - protein, 7 aa, Staphylococcus epidermidis
ASAIPPK

SEQ ID NO: 1725777 - protein, 7 aa, Staphylococcus epidermidis
ASDIQNS

SEQ ID NO: 1725778 - protein, 7 aa, Staphylococcus epidermidis
ASDRSRR

SEQ ID NO: 1725779 - protein, 5 aa, Staphylococcus epidermidis
ASEDT

SEQ ID NO: 1725780 - protein, 6 aa, Staphylococcus epidermidis
ASNDAK

SEQ ID NO: 1725781 - protein, 10 aa, Staphylococcus epidermidis
ASNDLGASTF

SEQ ID NO: 1725782 - protein, 8 aa, Staphylococcus epidermidis
ASNGEGGN

SEQ ID NO: 1725783 - protein, 7 aa, Staphylococcus epidermidis
ASSCNSG

SEQ ID NO: 1725784 - protein, 5 aa, Staphylococcus epidermidis
ASSMG

SEQ ID NO: 1725785 - protein, 7 aa, Staphylococcus epidermidis
ASTEPPG

SEQ ID NO: 1725786 - protein, 13 aa, Staphylococcus epidermidis
ATDNSGNTTNPAK

SEQ ID NO: 1725787 - protein, 8 aa, Staphylococcus epidermidis
ATEKDKYH

SEQ ID NO: 1725788 - protein, 9 aa, Staphylococcus epidermidis
ATETTERDI

SEQ ID NO: 1725789 - protein, 6 aa, Staphylococcus epidermidis
ATGDID

SEQ ID NO: 1725790 - protein, 8 aa, Staphylococcus epidermidis
ATGKGVKV

SEQ ID NO: 1725791 - protein, 7 aa, Staphylococcus epidermidis
ATGKTNT

SEQ ID NO: 1725792 - protein, 13 aa, Staphylococcus epidermidis
ATGTAWGSASTAG

SEQ ID NO: 1725793 - protein, 13 aa, Staphylococcus epidermidis
ATKSSQAEAVSEW

SEQ ID NO: 1725794 - protein, 6 aa, Staphylococcus epidermidis
ATPNVE

SEQ ID NO: 1725795 - protein, 10 aa, Staphylococcus epidermidis
ATRYTQAGDS

SEQ ID NO: 1725796 - protein, 5 aa, Staphylococcus epidermidis
ATSLA

SEQ ID NO: 1725797 - protein, 11 aa, Staphylococcus epidermidis
ATTDPKKEKGL

SEQ ID NO: 1725798 - protein, 10 aa, Staphylococcus epidermidis
ATTQEEDKTG

SEQ ID NO: 1725799 - protein, 7 aa, Staphylococcus epidermidis
AVGEDGY

SEQ ID NO: 1725800 - protein, 12 aa, Staphylococcus epidermidis
AVGRTNNATEKN

SEQ ID NO: 1725801 - protein, 7 aa, Staphylococcus epidermidis
AVGTAGS

SEQ ID NO: 1725802 - protein, 27 aa, Staphylococcus epidermidis
AVTQAKSNLHGDTKLQHDKDSAKQTIA

SEQ ID NO: 1725803 - protein, 18 aa, Staphylococcus epidermidis
AVYDKDKNTVDVGHDVGN

SEQ ID NO: 1725804 - protein, 4 aa, Staphylococcus epidermidis
AYRN

SEQ ID NO: 1725805 - protein, 11 aa, Staphylococcus epidermidis
AYTEDSSRKVM

SEQ ID NO: 1725806 - protein, 5 aa, Staphylococcus epidermidis
CATGT

SEQ ID NO: 1725807 - protein, 9 aa, Staphylococcus epidermidis
DAEGKTYRY

SEQ ID NO: 1725808 - protein, 4 aa, Staphylococcus epidermidis
DAGI

SEQ ID NO: 1725809 - protein, 9 aa, Staphylococcus epidermidis
DAKDKRQAI

SEQ ID NO: 1725810 - protein, 7 aa, Staphylococcus epidermidis
DANKERK

SEQ ID NO: 1725811 - protein, 7 aa, Staphylococcus epidermidis
DAPKMEQ

SEQ ID NO: 1725812 - protein, 10 aa, Staphylococcus epidermidis
DAQSSKAPIQ

SEQ ID NO: 1725813 - protein, 9 aa, Staphylococcus epidermidis
DASDKSGVI

SEQ ID NO: 1725814 - protein, 6 aa, Staphylococcus epidermidis
DASMAN

SEQ ID NO: 1725815 - protein, 8 aa, Staphylococcus epidermidis
DATKTGGS

SEQ ID NO: 1725816 - protein, 5 aa, Staphylococcus epidermidis
DCDRG

SEQ ID NO: 1725817 - protein, 6 aa, Staphylococcus epidermidis
DDDDYE

SEQ ID NO: 1725818 - protein, 7 aa, Staphylococcus epidermidis
DDGEITE

SEQ ID NO: 1725819 - protein, 12 aa, Staphylococcus epidermidis
DDGNISLPATGE

SEQ ID NO: 1725820 - protein, 4 aa, Staphylococcus epidermidis
DDIP

SEQ ID NO: 1725821 - protein, 4 aa, Staphylococcus epidermidis
DDIQ

SEQ ID NO: 1725822 - protein, 10 aa, Staphylococcus epidermidis
DDKANNEDIE

SEQ ID NO: 1725823 - protein, 15 aa, Staphylococcus epidermidis
DDKKSSQSKTSNEKG

SEQ ID NO: 1725824 - protein, 14 aa, Staphylococcus epidermidis
DDLTSQQSSSISNQ

SEQ ID NO: 1725825 - protein, 5 aa, Staphylococcus epidermidis
DDQNT

SEQ ID NO: 1725826 - protein, 9 aa, Staphylococcus epidermidis
DDSEIDKEL

SEQ ID NO: 1725827 - protein, 6 aa, Staphylococcus epidermidis
DDVLSG

SEQ ID NO: 1725828 - protein, 11 aa, Staphylococcus epidermidis
DEANNKLENIN

SEQ ID NO: 1725829 - protein, 7 aa, Staphylococcus epidermidis
DEDLKTQ

SEQ ID NO: 1725830 - protein, 9 aa, Staphylococcus epidermidis
DEDTGQITI

SEQ ID NO: 1725831 - protein, 9 aa, Staphylococcus epidermidis
DEGNKSAKI

SEQ ID NO: 1725832 - protein, 8 aa, Staphylococcus epidermidis
DEITEGTA

SEQ ID NO: 1725833 - protein, 38 aa, Staphylococcus epidermidis
DEKDISDVEKGNDVDVDIDGQKASIKGKVEEVGQATAA

SEQ ID NO: 1725834 - protein, 10 aa, Staphylococcus epidermidis
DEKENVDNMD

SEQ ID NO: 1725835 - protein, 9 aa, Staphylococcus epidermidis
DENETKKQS

SEQ ID NO: 1725836 - protein, 17 aa, Staphylococcus epidermidis
DENKIKQDVKKAKQQSD

SEQ ID NO: 1725837 - protein, 5 aa, Staphylococcus epidermidis
DEPGG

SEQ ID NO: 1725838 - protein, 4 aa, Staphylococcus epidermidis
DEPN

SEQ ID NO: 1725839 - protein, 11 aa, Staphylococcus epidermidis
DEQARNNLNGP

SEQ ID NO: 1725840 - protein, 10 aa, Staphylococcus epidermidis
DEQNQNDLNK

SEQ ID NO: 1725841 - protein, 8 aa, Staphylococcus epidermidis
DERNRGKQ

SEQ ID NO: 1725842 - protein, 13 aa, Staphylococcus epidermidis
DESKGAKGSSSSL

SEQ ID NO: 1725843 - protein, 11 aa, Staphylococcus epidermidis
DESKVDEDTLS

SEQ ID NO: 1725844 - protein, 7 aa, Staphylococcus epidermidis
DETEDEL

SEQ ID NO: 1725845 - protein, 8 aa, Staphylococcus epidermidis
DGDLAGSY

SEQ ID NO: 1725846 - protein, 13 aa, Staphylococcus epidermidis
DGEHKLQQAKENA

SEQ ID NO: 1725847 - protein, 5 aa, Staphylococcus epidermidis
DGGNQ

SEQ ID NO: 1725848 - protein, 19 aa, Staphylococcus epidermidis
DGKGTDGKNAYKEAGAKEN

SEQ ID NO: 1725849 - protein, 8 aa, Staphylococcus epidermidis
DGLGGKEN

SEQ ID NO: 1725850 - protein, 13 aa, Staphylococcus epidermidis
DGNSIQQEARQRR

SEQ ID NO: 1725851 - protein, 8 aa, Staphylococcus epidermidis
DGREGNRT

SEQ ID NO: 1725852 - protein, 6 aa, Staphylococcus epidermidis
DGSIST

SEQ ID NO: 1725853 - protein, 20 aa, Staphylococcus epidermidis
DGSSEEATETVRTKVNKTEL

SEQ ID NO: 1725854 - protein, 15 aa, Staphylococcus epidermidis
DGTTTSIQDYKLKLI

SEQ ID NO: 1725855 - protein, 12 aa, Staphylococcus epidermidis
DGVGEPELTRNS

SEQ ID NO: 1725856 - protein, 7 aa, Staphylococcus epidermidis
DHQTERQ

SEQ ID NO: 1725857 - protein, 17 aa, Staphylococcus epidermidis
DHSAPENGLSLDNKGGL

SEQ ID NO: 1725858 - protein, 10 aa, Staphylococcus epidermidis
DHSTGTRDVK

SEQ ID NO: 1725859 - protein, 10 aa, Staphylococcus epidermidis
DHYSHQSGDA

SEQ ID NO: 1725860 - protein, 4 aa, Staphylococcus epidermidis
DIES

SEQ ID NO: 1725861 - protein, 6 aa, Staphylococcus epidermidis
DIKYGN

SEQ ID NO: 1725862 - protein, 13 aa, Staphylococcus epidermidis
DILNSGKKRIDTI

SEQ ID NO: 1725863 - protein, 9 aa, Staphylococcus epidermidis
DIRQEVPTG

SEQ ID NO: 1725864 - protein, 6 aa, Staphylococcus epidermidis
DISPGQ

SEQ ID NO: 1725865 - protein, 11 aa, Staphylococcus epidermidis
DKAGKLSDPVS

SEQ ID NO: 1725866 - protein, 10 aa, Staphylococcus epidermidis
DKDKSSRRLE

SEQ ID NO: 1725867 - protein, 9 aa, Staphylococcus epidermidis
DKEDNSELV

SEQ ID NO: 1725868 - protein, 7 aa, Staphylococcus epidermidis
DKELSKL

SEQ ID NO: 1725869 - protein, 7 aa, Staphylococcus epidermidis
DKFPSKY

SEQ ID NO: 1725870 - protein, 6 aa, Staphylococcus epidermidis
DKGKQV

SEQ ID NO: 1725871 - protein, 5 aa, Staphylococcus epidermidis
DKHDY

SEQ ID NO: 1725872 - protein, 14 aa, Staphylococcus epidermidis
DKIGKKQLKQLTKK

SEQ ID NO: 1725873 - protein, 7 aa, Staphylococcus epidermidis
DKIPQSL

SEQ ID NO: 1725874 - protein, 7 aa, Staphylococcus epidermidis
DKLANTL

SEQ ID NO: 1725875 - protein, 7 aa, Staphylococcus epidermidis
DKLGGGG

SEQ ID NO: 1725876 - protein, 10 aa, Staphylococcus epidermidis
DKLSDPTNGY

SEQ ID NO: 1725877 - protein, 6 aa, Staphylococcus epidermidis
DKNGEL

SEQ ID NO: 1725878 - protein, 4 aa, Staphylococcus epidermidis
DKNL

SEQ ID NO: 1725879 - protein, 8 aa, Staphylococcus epidermidis
DKNNSNMS

SEQ ID NO: 1725880 - protein, 7 aa, Staphylococcus epidermidis
DKNSRMS

SEQ ID NO: 1725881 - protein, 7 aa, Staphylococcus epidermidis
DKNSTYR

SEQ ID NO: 1725882 - protein, 39 aa, Staphylococcus epidermidis
DKRERDINKDIDDAEQAKINAQKLEEENRKTLKETQDEV

SEQ ID NO: 1725883 - protein, 8 aa, Staphylococcus epidermidis
DKSSTQSV

SEQ ID NO: 1725884 - protein, 16 aa, Staphylococcus epidermidis
DKVKKDKTSYSTKKGL

SEQ ID NO: 1725885 - protein, 10 aa, Staphylococcus epidermidis
DKVKSGDTMT

SEQ ID NO: 1725886 - protein, 8 aa, Staphylococcus epidermidis
DKVNPSIT

SEQ ID NO: 1725887 - protein, 7 aa, Staphylococcus epidermidis
DLEKPSH

SEQ ID NO: 1725888 - protein, 20 aa, Staphylococcus epidermidis
DLPNETPGQIEPLTNNPGNY

SEQ ID NO: 1725889 - protein, 9 aa, Staphylococcus epidermidis
DLPREEKDS

SEQ ID NO: 1725890 - protein, 11 aa, Staphylococcus epidermidis
DLSDSRKLSDD

SEQ ID NO: 1725891 - protein, 5 aa, Staphylococcus epidermidis
DLSKN

SEQ ID NO: 1725892 - protein, 26 aa, Staphylococcus epidermidis
DLSREEDNKLSAKVKSEFGDNPQINT

SEQ ID NO: 1725893 - protein, 6 aa, Staphylococcus epidermidis
DMYSGN

SEQ ID NO: 1725894 - protein, 12 aa, Staphylococcus epidermidis
DNEGKPFSRSDY

SEQ ID NO: 1725895 - protein, 10 aa, Staphylococcus epidermidis
DNESTRTQVQ

SEQ ID NO: 1725896 - protein, 5 aa, Staphylococcus epidermidis
DNEVR

SEQ ID NO: 1725897 - protein, 8 aa, Staphylococcus epidermidis
DNGQREEV

SEQ ID NO: 1725898 - protein, 6 aa, Staphylococcus epidermidis
DNNSKG

SEQ ID NO: 1725899 - protein, 11 aa, Staphylococcus epidermidis
DNRQNSIDSRM

SEQ ID NO: 1725900 - protein, 4 aa, Staphylococcus epidermidis
DNYG

SEQ ID NO: 1725901 - protein, 8 aa, Staphylococcus epidermidis
DPAVASGP

SEQ ID NO: 1725902 - protein, 6 aa, Staphylococcus epidermidis
DPDSSP

SEQ ID NO: 1725903 - protein, 4 aa, Staphylococcus epidermidis
DPYH

SEQ ID NO: 1725904 - protein, 4 aa, Staphylococcus epidermidis
DQEV

SEQ ID NO: 1725905 - protein, 4 aa, Staphylococcus epidermidis
DQGY

SEQ ID NO: 1725906 - protein, 12 aa, Staphylococcus epidermidis
DQNKAADNGISA

SEQ ID NO: 1725907 - protein, 5 aa, Staphylococcus epidermidis
DQQVG

SEQ ID NO: 1725908 - protein, 18 aa, Staphylococcus epidermidis
DQRKYKKALRKYKRQKRK

SEQ ID NO: 1725909 - protein, 9 aa, Staphylococcus epidermidis
DQSKDKESL

SEQ ID NO: 1725910 - protein, 6 aa, Staphylococcus epidermidis
DQTQEW

SEQ ID NO: 1725911 - protein, 6 aa, Staphylococcus epidermidis
DRGRPT

SEQ ID NO: 1725912 - protein, 4 aa, Staphylococcus epidermidis
DRHE

SEQ ID NO: 1725913 - protein, 6 aa, Staphylococcus epidermidis
DRNIKG

SEQ ID NO: 1725914 - protein, 9 aa, Staphylococcus epidermidis
DRPDGYKAV

SEQ ID NO: 1725915 - protein, 10 aa, Staphylococcus epidermidis
DSDGSGSIDS

SEQ ID NO: 1725916 - protein, 5 aa, Staphylococcus epidermidis
DSEKA

SEQ ID NO: 1725917 - protein, 23 aa, Staphylococcus epidermidis
DSETKKSIKKAKHSDFDQKYKPS

SEQ ID NO: 1725918 - protein, 8 aa, Staphylococcus epidermidis
DSHHNPET

SEQ ID NO: 1725919 - protein, 7 aa, Staphylococcus epidermidis
DSKTGGL

SEQ ID NO: 1725920 - protein, 5 aa, Staphylococcus epidermidis
DSPTA

SEQ ID NO: 1725921 - protein, 7 aa, Staphylococcus epidermidis
DSSQPQT

SEQ ID NO: 1725922 - protein, 5 aa, Staphylococcus epidermidis
DSTNG

SEQ ID NO: 1725923 - protein, 5 aa, Staphylococcus epidermidis
DSTTI

SEQ ID NO: 1725924 - protein, 16 aa, Staphylococcus epidermidis
DSVENSDNYRQADDDK

SEQ ID NO: 1725925 - protein, 6 aa, Staphylococcus epidermidis
DSVTNT

SEQ ID NO: 1725926 - protein, 4 aa, Staphylococcus epidermidis
DTDF

SEQ ID NO: 1725927 - protein, 11 aa, Staphylococcus epidermidis
DTGGKRNENVS

SEQ ID NO: 1725928 - protein, 7 aa, Staphylococcus epidermidis
DTGNYGH

SEQ ID NO: 1725929 - protein, 9 aa, Staphylococcus epidermidis
DTGTGIAPE

SEQ ID NO: 1725930 - protein, 20 aa, Staphylococcus epidermidis
DTKNALNGEQRLATEKSKDL

SEQ ID NO: 1725931 - protein, 13 aa, Staphylococcus epidermidis
DTPQSQGLPPIEQ

SEQ ID NO: 1725932 - protein, 9 aa, Staphylococcus epidermidis
DTQDNGELT

SEQ ID NO: 1725933 - protein, 13 aa, Staphylococcus epidermidis
DVKPEAPKKLKGK

SEQ ID NO: 1725934 - protein, 6 aa, Staphylococcus epidermidis
DVPGGI

SEQ ID NO: 1725935 - protein, 7 aa, Staphylococcus epidermidis
DVPKDMK

SEQ ID NO: 1725936 - protein, 25 aa, Staphylococcus epidermidis
DVQQTLQDRINNGSFYKNEDQQVGA

SEQ ID NO: 1725937 - protein, 5 aa, Staphylococcus epidermidis
DVTKE

SEQ ID NO: 1725938 - protein, 16 aa, Staphylococcus epidermidis
DYYKKQSSDKLTQSAI

SEQ ID NO: 1725939 - protein, 6 aa, Staphylococcus epidermidis
EAGSGL

SEQ ID NO: 1725940 - protein, 16 aa, Staphylococcus epidermidis
EAKTQSIESHPSYLKR

SEQ ID NO: 1725941 - protein, 7 aa, Staphylococcus epidermidis
EAQTSTS

SEQ ID NO: 1725942 - protein, 13 aa, Staphylococcus epidermidis
EARIKEREAVSHE

SEQ ID NO: 1725943 - protein, 16 aa, Staphylococcus epidermidis
EATNTISGTPSEVGSY

SEQ ID NO: 1725944 - protein, 4 aa, Staphylococcus epidermidis
EDAI

SEQ ID NO: 1725945 - protein, 14 aa, Staphylococcus epidermidis
EDAMSSVPDKIREG

SEQ ID NO: 1725946 - protein, 7 aa, Staphylococcus epidermidis
EDATNLN

SEQ ID NO: 1725947 - protein, 15 aa, Staphylococcus epidermidis
EDDLKNNKNALQDKK

SEQ ID NO: 1725948 - protein, 6 aa, Staphylococcus epidermidis
EDKKMY

SEQ ID NO: 1725949 - protein, 4 aa, Staphylococcus epidermidis
EDKV

SEQ ID NO: 1725950 - protein, 12 aa, Staphylococcus epidermidis
EDNEAKNFDNHN

SEQ ID NO: 1725951 - protein, 15 aa, Staphylococcus epidermidis
EDTDDTVEVKDGMGK

SEQ ID NO: 1725952 - protein, 5 aa, Staphylococcus epidermidis
EDYQK

SEQ ID NO: 1725953 - protein, 19 aa, Staphylococcus epidermidis
EEDASIDKPNTGDSTVDGY

SEQ ID NO: 1725954 - protein, 4 aa, Staphylococcus epidermidis
EEKA

SEQ ID NO: 1725955 - protein, 9 aa, Staphylococcus epidermidis
EELDKTNPV

SEQ ID NO: 1725956 - protein, 28 aa, Staphylococcus epidermidis
EELGNKEANNELKEKVSANFDTKKADAI

SEQ ID NO: 1725957 - protein, 17 aa, Staphylococcus epidermidis
EEMPDLKGKTEKQAEKV

SEQ ID NO: 1725958 - protein, 5 aa, Staphylococcus epidermidis
EESDM

SEQ ID NO: 1725959 - protein, 16 aa, Staphylococcus epidermidis
EESVSRYQSTNARQNI

SEQ ID NO: 1725960 - protein, 6 aa, Staphylococcus epidermidis
EETGDI

SEQ ID NO: 1725961 - protein, 7 aa, Staphylococcus epidermidis
EFDQNQM

SEQ ID NO: 1725962 - protein, 10 aa, Staphylococcus epidermidis
EFKGQTTTIP

SEQ ID NO: 1725963 - protein, 10 aa, Staphylococcus epidermidis
EGAWQDKELA

SEQ ID NO: 1725964 - protein, 8 aa, Staphylococcus epidermidis
EGEYETQN

SEQ ID NO: 1725965 - protein, 5 aa, Staphylococcus epidermidis
EGIHR

SEQ ID NO: 1725966 - protein, 8 aa, Staphylococcus epidermidis
EGKDGRLQ

SEQ ID NO: 1725967 - protein, 4 aa, Staphylococcus epidermidis
EINT

SEQ ID NO: 1725968 - protein, 9 aa, Staphylococcus epidermidis
EISEQDQKE

SEQ ID NO: 1725969 - protein, 16 aa, Staphylococcus epidermidis
EITDQLNKGQNTLSTI

SEQ ID NO: 1725970 - protein, 17 aa, Staphylococcus epidermidis
EKANKKDTVLNDLLNKL

SEQ ID NO: 1725971 - protein, 17 aa, Staphylococcus epidermidis
EKDLQKITDTAKKQDNL

SEQ ID NO: 1725972 - protein, 14 aa, Staphylococcus epidermidis
EKESRKRYSPDSTY

SEQ ID NO: 1725973 - protein, 5 aa, Staphylococcus epidermidis
EKETG

SEQ ID NO: 1725974 - protein, 26 aa, Staphylococcus epidermidis
EKGIDRYETAKSHKQSLERDKSLREE

SEQ ID NO: 1725975 - protein, 6 aa, Staphylococcus epidermidis
EKGYKA

SEQ ID NO: 1725976 - protein, 7 aa, Staphylococcus epidermidis
EKIQNAE

SEQ ID NO: 1725977 - protein, 13 aa, Staphylococcus epidermidis
EKKVDKDKLYENK

SEQ ID NO: 1725978 - protein, 6 aa, Staphylococcus epidermidis
EKNALN

SEQ ID NO: 1725979 - protein, 15 aa, Staphylococcus epidermidis
EKPETLSSGEKGISP

SEQ ID NO: 1725980 - protein, 9 aa, Staphylococcus epidermidis
EKQGTGYAS

SEQ ID NO: 1725981 - protein, 10 aa, Staphylococcus epidermidis
EKQPQAKEAL

SEQ ID NO: 1725982 - protein, 7 aa, Staphylococcus epidermidis
EKQYSKN

SEQ ID NO: 1725983 - protein, 13 aa, Staphylococcus epidermidis
EKRAIRRKKQKRI

SEQ ID NO: 1725984 - protein, 9 aa, Staphylococcus epidermidis
EKSHNKTLA

SEQ ID NO: 1725985 - protein, 7 aa, Staphylococcus epidermidis
EKSVGYR

SEQ ID NO: 1725986 - protein, 8 aa, Staphylococcus epidermidis
EKTGKITK

SEQ ID NO: 1725987 - protein, 19 aa, Staphylococcus epidermidis
EKYELYGKTGTGIVNGKYN

SEQ ID NO: 1725988 - protein, 5 aa, Staphylococcus epidermidis
EKYGR

SEQ ID NO: 1725989 - protein, 8 aa, Staphylococcus epidermidis
EKYPNETF

SEQ ID NO: 1725990 - protein, 18 aa, Staphylococcus epidermidis
EKYRQDIKKSEEKDQDYI

SEQ ID NO: 1725991 - protein, 17 aa, Staphylococcus epidermidis
ELASDVNKKEFSHTRTT

SEQ ID NO: 1725992 - protein, 6 aa, Staphylococcus epidermidis
ELGTDN

SEQ ID NO: 1725993 - protein, 11 aa, Staphylococcus epidermidis
ELPKAKLDANQ

SEQ ID NO: 1725994 - protein, 8 aa, Staphylococcus epidermidis
ELTDSNEN

SEQ ID NO: 1725995 - protein, 5 aa, Staphylococcus epidermidis
EMSPK

SEQ ID NO: 1725996 - protein, 9 aa, Staphylococcus epidermidis
ENEAGKSTI

SEQ ID NO: 1725997 - protein, 4 aa, Staphylococcus epidermidis
ENGH

SEQ ID NO: 1725998 - protein, 7 aa, Staphylococcus epidermidis
ENIDQVE

SEQ ID NO: 1725999 - protein, 13 aa, Staphylococcus epidermidis
ENIKDAGKGMGMT

SEQ ID NO: 1726000 - protein, 5 aa, Staphylococcus epidermidis
ENKKA

SEQ ID NO: 1726001 - protein, 10 aa, Staphylococcus epidermidis
ENLEDGKQKL

SEQ ID NO: 1726002 - protein, 12 aa, Staphylococcus epidermidis
ENLQNAARSGRP

SEQ ID NO: 1726003 - protein, 5 aa, Staphylococcus epidermidis
ENNIN

SEQ ID NO: 1726004 - protein, 5 aa, Staphylococcus epidermidis
ENQLT

SEQ ID NO: 1726005 - protein, 6 aa, Staphylococcus epidermidis
ENSRLS

SEQ ID NO: 1726006 - protein, 9 aa, Staphylococcus epidermidis
ENTNPTVNA

SEQ ID NO: 1726007 - protein, 5 aa, Staphylococcus epidermidis
EPEDF

SEQ ID NO: 1726008 - protein, 12 aa, Staphylococcus epidermidis
EPSIAKAQTKLK

SEQ ID NO: 1726009 - protein, 5 aa, Staphylococcus epidermidis
EPSTF

SEQ ID NO: 1726010 - protein, 16 aa, Staphylococcus epidermidis
EPTAKASLKKGYKRLP

SEQ ID NO: 1726011 - protein, 5 aa, Staphylococcus epidermidis
EQGSN

SEQ ID NO: 1726012 - protein, 7 aa, Staphylococcus epidermidis
EQHPTLD

SEQ ID NO: 1726013 - protein, 20 aa, Staphylococcus epidermidis
EQIRKNSNYTNEDLAQQNAY

SEQ ID NO: 1726014 - protein, 6 aa, Staphylococcus epidermidis
EQLQQA

SEQ ID NO: 1726015 - protein, 4 aa, Staphylococcus epidermidis
EQVL

SEQ ID NO: 1726016 - protein, 8 aa, Staphylococcus epidermidis
ERDGYSQE

SEQ ID NO: 1726017 - protein, 15 aa, Staphylococcus epidermidis
ERNQATDPHPTGSSL

SEQ ID NO: 1726018 - protein, 6 aa, Staphylococcus epidermidis
ERPQNL

SEQ ID NO: 1726019 - protein, 12 aa, Staphylococcus epidermidis
ERRADKHKEIER

SEQ ID NO: 1726020 - protein, 4 aa, Staphylococcus epidermidis
ESAV

SEQ ID NO: 1726021 - protein, 8 aa, Staphylococcus epidermidis
ESELGKGT

SEQ ID NO: 1726022 - protein, 8 aa, Staphylococcus epidermidis
ESEQAHRQ

SEQ ID NO: 1726023 - protein, 5 aa, Staphylococcus epidermidis
ESGMT

SEQ ID NO: 1726024 - protein, 22 aa, Staphylococcus epidermidis
ESIPVEKSSGDSVIGSTMNKNG

SEQ ID NO: 1726025 - protein, 9 aa, Staphylococcus epidermidis
ESKLEPPLN

SEQ ID NO: 1726026 - protein, 9 aa, Staphylococcus epidermidis
ESKTLEQST

SEQ ID NO: 1726027 - protein, 7 aa, Staphylococcus epidermidis
ESQSNHP

SEQ ID NO: 1726028 - protein, 4 aa, Staphylococcus epidermidis
ESRL

SEQ ID NO: 1726029 - protein, 14 aa, Staphylococcus epidermidis
ESTNKDETGPLKRK

SEQ ID NO: 1726030 - protein, 4 aa, Staphylococcus epidermidis
ETFA

SEQ ID NO: 1726031 - protein, 15 aa, Staphylococcus epidermidis
ETFEEEQTQKNKRQK

SEQ ID NO: 1726032 - protein, 5 aa, Staphylococcus epidermidis
ETFKS

SEQ ID NO: 1726033 - protein, 4 aa, Staphylococcus epidermidis
ETGA

SEQ ID NO: 1726034 - protein, 9 aa, Staphylococcus epidermidis
ETIPGEGFS

SEQ ID NO: 1726035 - protein, 5 aa, Staphylococcus epidermidis
ETIQS

SEQ ID NO: 1726036 - protein, 8 aa, Staphylococcus epidermidis
ETKEKYGL

SEQ ID NO: 1726037 - protein, 25 aa, Staphylococcus epidermidis
ETPEGYTPTLKHSGTNPALDSEGNS

SEQ ID NO: 1726038 - protein, 11 aa, Staphylococcus epidermidis
ETQGGVGAENV

SEQ ID NO: 1726039 - protein, 8 aa, Staphylococcus epidermidis
ETQVQQSR

SEQ ID NO: 1726040 - protein, 9 aa, Staphylococcus epidermidis
EVAETEARL

SEQ ID NO: 1726041 - protein, 16 aa, Staphylococcus epidermidis
EVDPNIKDAGKGMGMT

SEQ ID NO: 1726042 - protein, 5 aa, Staphylococcus epidermidis
EVNPG

SEQ ID NO: 1726043 - protein, 13 aa, Staphylococcus epidermidis
EVNQAKKQLRGKQ

SEQ ID NO: 1726044 - protein, 12 aa, Staphylococcus epidermidis
EVSSKAEEKKQS

SEQ ID NO: 1726045 - protein, 9 aa, Staphylococcus epidermidis
EYEKKGNVG

SEQ ID NO: 1726046 - protein, 5 aa, Staphylococcus epidermidis
EYGHA

SEQ ID NO: 1726047 - protein, 11 aa, Staphylococcus epidermidis
EYRPEYNKKKN

SEQ ID NO: 1726048 - protein, 11 aa, Staphylococcus epidermidis
EYSKTGDNDHS

SEQ ID NO: 1726049 - protein, 13 aa, Staphylococcus epidermidis
EYTGEFRTASYDN

SEQ ID NO: 1726050 - protein, 10 aa, Staphylococcus epidermidis
FATPQQVNSA

SEQ ID NO: 1726051 - protein, 5 aa, Staphylococcus epidermidis
FFPNG

SEQ ID NO: 1726052 - protein, 6 aa, Staphylococcus epidermidis
FGDPNR

SEQ ID NO: 1726053 - protein, 4 aa, Staphylococcus epidermidis
FGPR

SEQ ID NO: 1726054 - protein, 18 aa, Staphylococcus epidermidis
FKAANSGLNLNDNDITVS

SEQ ID NO: 1726055 - protein, 9 aa, Staphylococcus epidermidis
FKGIKNGKK

SEQ ID NO: 1726056 - protein, 18 aa, Staphylococcus epidermidis
FKPQDSIDLKSKENKKRF

SEQ ID NO: 1726057 - protein, 27 aa, Staphylococcus epidermidis
FKTEEKEAVSTDYKNNQVYSAPNPLGG

SEQ ID NO: 1726058 - protein, 12 aa, Staphylococcus epidermidis
FNHPQGSQGATE

SEQ ID NO: 1726059 - protein, 8 aa, Staphylococcus epidermidis
FNSQETGY

SEQ ID NO: 1726060 - protein, 11 aa, Staphylococcus epidermidis
FNSQGTATADD

SEQ ID NO: 1726061 - protein, 24 aa, Staphylococcus epidermidis
FNSQTQEIQENQEATNEEKTEALN

SEQ ID NO: 1726062 - protein, 8 aa, Staphylococcus epidermidis
FNTPSSIA

SEQ ID NO: 1726063 - protein, 4 aa, Staphylococcus epidermidis
FPGK

SEQ ID NO: 1726064 - protein, 7 aa, Staphylococcus epidermidis
FPSGHSN

SEQ ID NO: 1726065 - protein, 4 aa, Staphylococcus epidermidis
FQPK

SEQ ID NO: 1726066 - protein, 5 aa, Staphylococcus epidermidis
FRTDE

SEQ ID NO: 1726067 - protein, 12 aa, Staphylococcus epidermidis
FSATQEEKDNAL

SEQ ID NO: 1726068 - protein, 18 aa, Staphylococcus epidermidis
FSENKLPDVEKDLKKANK

SEQ ID NO: 1726069 - protein, 6 aa, Staphylococcus epidermidis
FSETNL

SEQ ID NO: 1726070 - protein, 12 aa, Staphylococcus epidermidis
FSHGTNDAQKSM

SEQ ID NO: 1726071 - protein, 5 aa, Staphylococcus epidermidis
FSKGE

SEQ ID NO: 1726072 - protein, 5 aa, Staphylococcus epidermidis
FSPNK

SEQ ID NO: 1726073 - protein, 8 aa, Staphylococcus epidermidis
FSSETDTE

SEQ ID NO: 1726074 - protein, 11 aa, Staphylococcus epidermidis
FSTKGDNRGLG

SEQ ID NO: 1726075 - protein, 15 aa, Staphylococcus epidermidis
FSTPIKQTRHDEIGT

SEQ ID NO: 1726076 - protein, 15 aa, Staphylococcus epidermidis
FSTTAEKMGGVSSTV

SEQ ID NO: 1726077 - protein, 11 aa, Staphylococcus epidermidis
FTKNDNSKRQK

SEQ ID NO: 1726078 - protein, 6 aa, Staphylococcus epidermidis
GAGQVG

SEQ ID NO: 1726079 - protein, 9 aa, Staphylococcus epidermidis
GAQPPSPEW

SEQ ID NO: 1726080 - protein, 13 aa, Staphylococcus epidermidis
GARSGEYKQATNY

SEQ ID NO: 1726081 - protein, 14 aa, Staphylococcus epidermidis
GASNRAKGVKWSTA

SEQ ID NO: 1726082 - protein, 16 aa, Staphylococcus epidermidis
GASPAMSEAPEEAEDF

SEQ ID NO: 1726083 - protein, 6 aa, Staphylococcus epidermidis
GDAAFG

SEQ ID NO: 1726084 - protein, 10 aa, Staphylococcus epidermidis
GDAAGGLGGV

SEQ ID NO: 1726085 - protein, 7 aa, Staphylococcus epidermidis
GDEDEQA

SEQ ID NO: 1726086 - protein, 14 aa, Staphylococcus epidermidis
GDLQNELNTKYTPT

SEQ ID NO: 1726087 - protein, 7 aa, Staphylococcus epidermidis
GDNNEVA

SEQ ID NO: 1726088 - protein, 10 aa, Staphylococcus epidermidis
GDNNRTAQTI

SEQ ID NO: 1726089 - protein, 11 aa, Staphylococcus epidermidis
GDNQNLPDSNR

SEQ ID NO: 1726090 - protein, 11 aa, Staphylococcus epidermidis
GDQIKESSKQM

SEQ ID NO: 1726091 - protein, 8 aa, Staphylococcus epidermidis
GDRKSTIS

SEQ ID NO: 1726092 - protein, 10 aa, Staphylococcus epidermidis
GDSAPQGVAV

SEQ ID NO: 1726093 - protein, 4 aa, Staphylococcus epidermidis
GDTG

SEQ ID NO: 1726094 - protein, 5 aa, Staphylococcus epidermidis
GEERQ

SEQ ID NO: 1726095 - protein, 5 aa, Staphylococcus epidermidis
GEKIN

SEQ ID NO: 1726096 - protein, 20 aa, Staphylococcus epidermidis
GEKIPVDGKVTKGDTSIDES

SEQ ID NO: 1726097 - protein, 9 aa, Staphylococcus epidermidis
GEKPSLKYD

SEQ ID NO: 1726098 - protein, 9 aa, Staphylococcus epidermidis
GENQDEQSI

SEQ ID NO: 1726099 - protein, 4 aa, Staphylococcus epidermidis
GENY

SEQ ID NO: 1726100 - protein, 9 aa, Staphylococcus epidermidis
GEVTGKGTH

SEQ ID NO: 1726101 - protein, 5 aa, Staphylococcus epidermidis
GEYDS

SEQ ID NO: 1726102 - protein, 8 aa, Staphylococcus epidermidis
GFAGGELK

SEQ ID NO: 1726103 - protein, 5 aa, Staphylococcus epidermidis
GFEVD

SEQ ID NO: 1726104 - protein, 6 aa, Staphylococcus epidermidis
GGAAYE

SEQ ID NO: 1726105 - protein, 10 aa, Staphylococcus epidermidis
GGATDDIDKA

SEQ ID NO: 1726106 - protein, 8 aa, Staphylococcus epidermidis
GGDTSHNL

SEQ ID NO: 1726107 - protein, 6 aa, Staphylococcus epidermidis
GGEENL

SEQ ID NO: 1726108 - protein, 13 aa, Staphylococcus epidermidis
GGETTSLLKATLG

SEQ ID NO: 1726109 - protein, 4 aa, Staphylococcus epidermidis
GGGA

SEQ ID NO: 1726110 - protein, 12 aa, Staphylococcus epidermidis
GGGDGSKALNAI

SEQ ID NO: 1726111 - protein, 19 aa, Staphylococcus epidermidis
GGGGHLTNAATQIKGATID

SEQ ID NO: 1726112 - protein, 10 aa, Staphylococcus epidermidis
GGGGTFPIQT

SEQ ID NO: 1726113 - protein, 10 aa, Staphylococcus epidermidis
GGIEPGTTEI

SEQ ID NO: 1726114 - protein, 11 aa, Staphylococcus epidermidis
GGQGPDEPISE

SEQ ID NO: 1726115 - protein, 16 aa, Staphylococcus epidermidis
GGTDGDHDPEINPYTV

SEQ ID NO: 1726116 - protein, 4 aa, Staphylococcus epidermidis
GGVG

SEQ ID NO: 1726117 - protein, 12 aa, Staphylococcus epidermidis
GGVGDKVAHGGP

SEQ ID NO: 1726118 - protein, 11 aa, Staphylococcus epidermidis
GGYAQHTSDEL

SEQ ID NO: 1726119 - protein, 7 aa, Staphylococcus epidermidis
GHHKLNG

SEQ ID NO: 1726120 - protein, 6 aa, Staphylococcus epidermidis
GHTNTK

SEQ ID NO: 1726121 - protein, 5 aa, Staphylococcus epidermidis
GIASY

SEQ ID NO: 1726122 - protein, 6 aa, Staphylococcus epidermidis
GIDSNY

SEQ ID NO: 1726123 - protein, 7 aa, Staphylococcus epidermidis
GINDAPA

SEQ ID NO: 1726124 - protein, 5 aa, Staphylococcus epidermidis
GIPST

SEQ ID NO: 1726125 - protein, 14 aa, Staphylococcus epidermidis
GIRPDVSISTPKYQ

SEQ ID NO: 1726126 - protein, 4 aa, Staphylococcus epidermidis
GISE

SEQ ID NO: 1726127 - protein, 6 aa, Staphylococcus epidermidis
GISTPL

SEQ ID NO: 1726128 - protein, 13 aa, Staphylococcus epidermidis
GKATGLSEHAKGI

SEQ ID NO: 1726129 - protein, 10 aa, Staphylococcus epidermidis
GKDPKEVQKS

SEQ ID NO: 1726130 - protein, 5 aa, Staphylococcus epidermidis
GKDYD

SEQ ID NO: 1726131 - protein, 16 aa, Staphylococcus epidermidis
GKELTEYKDEVSHDGP

SEQ ID NO: 1726132 - protein, 8 aa, Staphylococcus epidermidis
GKKQPSLP

SEQ ID NO: 1726133 - protein, 7 aa, Staphylococcus epidermidis
GKNSQEV

SEQ ID NO: 1726134 - protein, 10 aa, Staphylococcus epidermidis
GKPGDSVEYK

SEQ ID NO: 1726135 - protein, 4 aa, Staphylococcus epidermidis
GKPI

SEQ ID NO: 1726136 - protein, 9 aa, Staphylococcus epidermidis
GKSKEGVDY

SEQ ID NO: 1726137 - protein, 11 aa, Staphylococcus epidermidis
GKTKKDEDYSS

SEQ ID NO: 1726138 - protein, 5 aa, Staphylococcus epidermidis
GKYAK

SEQ ID NO: 1726139 - protein, 9 aa, Staphylococcus epidermidis
GLDDHTSVG

SEQ ID NO: 1726140 - protein, 6 aa, Staphylococcus epidermidis
GMAGVP

SEQ ID NO: 1726141 - protein, 7 aa, Staphylococcus epidermidis
GNAGDAL

SEQ ID NO: 1726142 - protein, 5 aa, Staphylococcus epidermidis
GNASE

SEQ ID NO: 1726143 - protein, 10 aa, Staphylococcus epidermidis
GNDNPQVSQV

SEQ ID NO: 1726144 - protein, 15 aa, Staphylococcus epidermidis
GNEGKHQPNATQKKY

SEQ ID NO: 1726145 - protein, 8 aa, Staphylococcus epidermidis
GNMKNDGK

SEQ ID NO: 1726146 - protein, 16 aa, Staphylococcus epidermidis
GNNDATDEEKAEARKL

SEQ ID NO: 1726147 - protein, 4 aa, Staphylococcus epidermidis
GNNS

SEQ ID NO: 1726148 - protein, 13 aa, Staphylococcus epidermidis
GNPIAQSLAEKTA

SEQ ID NO: 1726149 - protein, 4 aa, Staphylococcus epidermidis
GNRY

SEQ ID NO: 1726150 - protein, 9 aa, Staphylococcus epidermidis
GNTAKKYLD

SEQ ID NO: 1726151 - protein, 16 aa, Staphylococcus epidermidis
GNTGHSSFPSGHTGNG

SEQ ID NO: 1726152 - protein, 5 aa, Staphylococcus epidermidis
GPKRP

SEQ ID NO: 1726153 - protein, 9 aa, Staphylococcus epidermidis
GPKSDQIKH

SEQ ID NO: 1726154 - protein, 13 aa, Staphylococcus epidermidis
GPLQFSSNSGGQV

SEQ ID NO: 1726155 - protein, 6 aa, Staphylococcus epidermidis
GQDDMT

SEQ ID NO: 1726156 - protein, 6 aa, Staphylococcus epidermidis
GQDDTS

SEQ ID NO: 1726157 - protein, 5 aa, Staphylococcus epidermidis
GQHDM

SEQ ID NO: 1726158 - protein, 9 aa, Staphylococcus epidermidis
GQSGMSYGA

SEQ ID NO: 1726159 - protein, 4 aa, Staphylococcus epidermidis
GQTG

SEQ ID NO: 1726160 - protein, 7 aa, Staphylococcus epidermidis
GQTSIDE

SEQ ID NO: 1726161 - protein, 13 aa, Staphylococcus epidermidis
GRFNSSGDAYPGN

SEQ ID NO: 1726162 - protein, 7 aa, Staphylococcus epidermidis
GRKQGPA

SEQ ID NO: 1726163 - protein, 9 aa, Staphylococcus epidermidis
GRSTRNSLG

SEQ ID NO: 1726164 - protein, 8 aa, Staphylococcus epidermidis
GSDEEEPE

SEQ ID NO: 1726165 - protein, 6 aa, Staphylococcus epidermidis
GSDHHV

SEQ ID NO: 1726166 - protein, 10 aa, Staphylococcus epidermidis
GSDKASSHQK

SEQ ID NO: 1726167 - protein, 7 aa, Staphylococcus epidermidis
GSFSSYS

SEQ ID NO: 1726168 - protein, 6 aa, Staphylococcus epidermidis
GSFSTY

SEQ ID NO: 1726169 - protein, 13 aa, Staphylococcus epidermidis
GSGDTQNNFIYNE

SEQ ID NO: 1726170 - protein, 5 aa, Staphylococcus epidermidis
GSGIG

SEQ ID NO: 1726171 - protein, 5 aa, Staphylococcus epidermidis
GSIAS

SEQ ID NO: 1726172 - protein, 7 aa, Staphylococcus epidermidis
GSKIGEY

SEQ ID NO: 1726173 - protein, 10 aa, Staphylococcus epidermidis
GSLPSSSEIS

SEQ ID NO: 1726174 - protein, 7 aa, Staphylococcus epidermidis
GSPAALS

SEQ ID NO: 1726175 - protein, 15 aa, Staphylococcus epidermidis
GSPFNDTKLNAQQKE

SEQ ID NO: 1726176 - protein, 11 aa, Staphylococcus epidermidis
GSPKNKITSRK

SEQ ID NO: 1726177 - protein, 10 aa, Staphylococcus epidermidis
GSPQRSPNTE

SEQ ID NO: 1726178 - protein, 8 aa, Staphylococcus epidermidis
GSRDLRKK

SEQ ID NO: 1726179 - protein, 12 aa, Staphylococcus epidermidis
GSVKPDKGKVVR

SEQ ID NO: 1726180 - protein, 18 aa, Staphylococcus epidermidis
GTFRGRNSNFNGEGFSRQ

SEQ ID NO: 1726181 - protein, 4 aa, Staphylococcus epidermidis
GTGD

SEQ ID NO: 1726182 - protein, 5 aa, Staphylococcus epidermidis
GTIQS

SEQ ID NO: 1726183 - protein, 4 aa, Staphylococcus epidermidis
GTIR

SEQ ID NO: 1726184 - protein, 7 aa, Staphylococcus epidermidis
GTKAYAA

SEQ ID NO: 1726185 - protein, 35 aa, Staphylococcus epidermidis
GTLPTGNITAKTSMTNNVTYTKQNSSGIASNTTED

SEQ ID NO: 1726186 - protein, 7 aa, Staphylococcus epidermidis
GTNATDG

SEQ ID NO: 1726187 - protein, 10 aa, Staphylococcus epidermidis
GTNDHQPTHD

SEQ ID NO: 1726188 - protein, 12 aa, Staphylococcus epidermidis
GTNTTERIAASE

SEQ ID NO: 1726189 - protein, 7 aa, Staphylococcus epidermidis
GTQALRP

SEQ ID NO: 1726190 - protein, 4 aa, Staphylococcus epidermidis
GTSL

SEQ ID NO: 1726191 - protein, 22 aa, Staphylococcus epidermidis
GTTTTTSYIESTSGVAVGARTG

SEQ ID NO: 1726192 - protein, 5 aa, Staphylococcus epidermidis
GVKSV

SEQ ID NO: 1726193 - protein, 17 aa, Staphylococcus epidermidis
GVPNYENSHPHQSTSGR

SEQ ID NO: 1726194 - protein, 4 aa, Staphylococcus epidermidis
GVPR

SEQ ID NO: 1726195 - protein, 6 aa, Staphylococcus epidermidis
GVTGIK

SEQ ID NO: 1726196 - protein, 6 aa, Staphylococcus epidermidis
GVTHPE

SEQ ID NO: 1726197 - protein, 16 aa, Staphylococcus epidermidis
GYPDATEDELQEANSK

SEQ ID NO: 1726198 - protein, 7 aa, Staphylococcus epidermidis
HAGTEKG

SEQ ID NO: 1726199 - protein, 10 aa, Staphylococcus epidermidis
HAKKNKKILE

SEQ ID NO: 1726200 - protein, 5 aa, Staphylococcus epidermidis
HDGNF

SEQ ID NO: 1726201 - protein, 9 aa, Staphylococcus epidermidis
HDPEGDFGR

SEQ ID NO: 1726202 - protein, 7 aa, Staphylococcus epidermidis
HDPNFDG

SEQ ID NO: 1726203 - protein, 5 aa, Staphylococcus epidermidis
HEDTL

SEQ ID NO: 1726204 - protein, 6 aa, Staphylococcus epidermidis
HEEATN

SEQ ID NO: 1726205 - protein, 19 aa, Staphylococcus epidermidis
HEGDTIEYEHTSHKAMKDY

SEQ ID NO: 1726206 - protein, 7 aa, Staphylococcus epidermidis
HESGTRD

SEQ ID NO: 1726207 - protein, 12 aa, Staphylococcus epidermidis
HESTQDNQVDNV

SEQ ID NO: 1726208 - protein, 10 aa, Staphylococcus epidermidis
HGGGYGGKLT

SEQ ID NO: 1726209 - protein, 8 aa, Staphylococcus epidermidis
HGKTEYAG

SEQ ID NO: 1726210 - protein, 4 aa, Staphylococcus epidermidis
HKGH

SEQ ID NO: 1726211 - protein, 6 aa, Staphylococcus epidermidis
HKQQPR

SEQ ID NO: 1726212 - protein, 7 aa, Staphylococcus epidermidis
HKRGTYS

SEQ ID NO: 1726213 - protein, 7 aa, Staphylococcus epidermidis
HNDSASQ

SEQ ID NO: 1726214 - protein, 9 aa, Staphylococcus epidermidis
HNRNPSNID

SEQ ID NO: 1726215 - protein, 17 aa, Staphylococcus epidermidis
HNSPFYKGNKSVREGDI

SEQ ID NO: 1726216 - protein, 7 aa, Staphylococcus epidermidis
HQDDLDA

SEQ ID NO: 1726217 - protein, 8 aa, Staphylococcus epidermidis
HQVGGDMS

SEQ ID NO: 1726218 - protein, 14 aa, Staphylococcus epidermidis
HSKKNDEEAYQVPR

SEQ ID NO: 1726219 - protein, 7 aa, Staphylococcus epidermidis
HSPPERN

SEQ ID NO: 1726220 - protein, 7 aa, Staphylococcus epidermidis
HSPTEIT

SEQ ID NO: 1726221 - protein, 7 aa, Staphylococcus epidermidis
HTHKDKG

SEQ ID NO: 1726222 - protein, 6 aa, Staphylococcus epidermidis
HTKNYD

SEQ ID NO: 1726223 - protein, 5 aa, Staphylococcus epidermidis
HVSID

SEQ ID NO: 1726224 - protein, 6 aa, Staphylococcus epidermidis
HYDPNK

SEQ ID NO: 1726225 - protein, 11 aa, Staphylococcus epidermidis
IAAGSASIGIA

SEQ ID NO: 1726226 - protein, 5 aa, Staphylococcus epidermidis
IADKI

SEQ ID NO: 1726227 - protein, 7 aa, Staphylococcus epidermidis
IADKYDK

SEQ ID NO: 1726228 - protein, 5 aa, Staphylococcus epidermidis
IAKDN

SEQ ID NO: 1726229 - protein, 6 aa, Staphylococcus epidermidis
IAQGGA

SEQ ID NO: 1726230 - protein, 22 aa, Staphylococcus epidermidis
IASEGIDAASGQLNDAKGYLTQ

SEQ ID NO: 1726231 - protein, 9 aa, Staphylococcus epidermidis
IDDEKDYSI

SEQ ID NO: 1726232 - protein, 21 aa, Staphylococcus epidermidis
IDGYSDDKINDISSRATNEEK

SEQ ID NO: 1726233 - protein, 9 aa, Staphylococcus epidermidis
IDKTEKDAL

SEQ ID NO: 1726234 - protein, 16 aa, Staphylococcus epidermidis
IDNEANPSKLINKNTK

SEQ ID NO: 1726235 - protein, 25 aa, Staphylococcus epidermidis
IDPSDDRYKGDDYFNKNSSQNNQNL

SEQ ID NO: 1726236 - protein, 35 aa, Staphylococcus epidermidis
IDQATQSVQNAEQALHGAEKLNQDKQTSSTELDGL

SEQ ID NO: 1726237 - protein, 9 aa, Staphylococcus epidermidis
IEASENLEE

SEQ ID NO: 1726238 - protein, 11 aa, Staphylococcus epidermidis
IEDTKDALNGI

SEQ ID NO: 1726239 - protein, 11 aa, Staphylococcus epidermidis
IEEKTKDDNYT

SEQ ID NO: 1726240 - protein, 13 aa, Staphylococcus epidermidis
IEPTEALSESKDV

SEQ ID NO: 1726241 - protein, 11 aa, Staphylococcus epidermidis
IEQKKKKRTTL

SEQ ID NO: 1726242 - protein, 7 aa, Staphylococcus epidermidis
IEQSHTP

SEQ ID NO: 1726243 - protein, 4 aa, Staphylococcus epidermidis
IETV

SEQ ID NO: 1726244 - protein, 11 aa, Staphylococcus epidermidis
IGAGGAEKLLG

SEQ ID NO: 1726245 - protein, 6 aa, Staphylococcus epidermidis
IGDTPA

SEQ ID NO: 1726246 - protein, 15 aa, Staphylococcus epidermidis
IGGPTPQDPTGSTNS

SEQ ID NO: 1726247 - protein, 6 aa, Staphylococcus epidermidis
IGNKGN

SEQ ID NO: 1726248 - protein, 4 aa, Staphylococcus epidermidis
IGPE

SEQ ID NO: 1726249 - protein, 19 aa, Staphylococcus epidermidis
IGRGDNELIDPTSNDTSEM

SEQ ID NO: 1726250 - protein, 6 aa, Staphylococcus epidermidis
IGSRTP

SEQ ID NO: 1726251 - protein, 6 aa, Staphylococcus epidermidis
IHPPSG

SEQ ID NO: 1726252 - protein, 11 aa, Staphylococcus epidermidis
IIEDGGNAVDA

SEQ ID NO: 1726253 - protein, 18 aa, Staphylococcus epidermidis
IIENTPDATLEEKAEANR

SEQ ID NO: 1726254 - protein, 10 aa, Staphylococcus epidermidis
IKASKATIKN

SEQ ID NO: 1726255 - protein, 4 aa, Staphylococcus epidermidis
IKET

SEQ ID NO: 1726256 - protein, 10 aa, Staphylococcus epidermidis
IKGRKETNFP

SEQ ID NO: 1726257 - protein, 12 aa, Staphylococcus epidermidis
IKNDSDVGEGQP

SEQ ID NO: 1726258 - protein, 9 aa, Staphylococcus epidermidis
IKNKGNSQS

SEQ ID NO: 1726259 - protein, 7 aa, Staphylococcus epidermidis
IKPDALN

SEQ ID NO: 1726260 - protein, 25 aa, Staphylococcus epidermidis
IKQAQDNLHGAQKLQQDKNTTNQAI

SEQ ID NO: 1726261 - protein, 24 aa, Staphylococcus epidermidis
IKQQEFQSSEPRYYQKSDKKRSKM

SEQ ID NO: 1726262 - protein, 20 aa, Staphylococcus epidermidis
IKQVKEANNSINDNLKSTNQ

SEQ ID NO: 1726263 - protein, 12 aa, Staphylococcus epidermidis
IKSNPKEFLEEE

SEQ ID NO: 1726264 - protein, 5 aa, Staphylococcus epidermidis
IKTPT

SEQ ID NO: 1726265 - protein, 22 aa, Staphylococcus epidermidis
IKTPYTKDTKIDEIKEDMKHTK

SEQ ID NO: 1726266 - protein, 4 aa, Staphylococcus epidermidis
IKWT

SEQ ID NO: 1726267 - protein, 9 aa, Staphylococcus epidermidis
IKYAKESSD

SEQ ID NO: 1726268 - protein, 6 aa, Staphylococcus epidermidis
ILGTNN

SEQ ID NO: 1726269 - protein, 6 aa, Staphylococcus epidermidis
INDAPS

SEQ ID NO: 1726270 - protein, 4 aa, Staphylococcus epidermidis
INER

SEQ ID NO: 1726271 - protein, 9 aa, Staphylococcus epidermidis
INGETKDLG

SEQ ID NO: 1726272 - protein, 7 aa, Staphylococcus epidermidis
INKDKAK

SEQ ID NO: 1726273 - protein, 7 aa, Staphylococcus epidermidis
INNKPNY

SEQ ID NO: 1726274 - protein, 10 aa, Staphylococcus epidermidis
INPNNNTEGT

SEQ ID NO: 1726275 - protein, 18 aa, Staphylococcus epidermidis
INQTSNPTLDKQKIADTL

SEQ ID NO: 1726276 - protein, 14 aa, Staphylococcus epidermidis
INSSGTTVAEGTVK

SEQ ID NO: 1726277 - protein, 21 aa, Staphylococcus epidermidis
INTAQGNDDVTEAQNNGTNTI

SEQ ID NO: 1726278 - protein, 18 aa, Staphylococcus epidermidis
INTQASIQNQNKDTYEEK

SEQ ID NO: 1726279 - protein, 5 aa, Staphylococcus epidermidis
IPDGD

SEQ ID NO: 1726280 - protein, 6 aa, Staphylococcus epidermidis
IPENYR

SEQ ID NO: 1726281 - protein, 12 aa, Staphylococcus epidermidis
IPESKDESAYNK

SEQ ID NO: 1726282 - protein, 5 aa, Staphylococcus epidermidis
IPGYD

SEQ ID NO: 1726283 - protein, 7 aa, Staphylococcus epidermidis
IPNDTTA

SEQ ID NO: 1726284 - protein, 5 aa, Staphylococcus epidermidis
IPQGE

SEQ ID NO: 1726285 - protein, 17 aa, Staphylococcus epidermidis
IPSDTLKELKAKDQNIG

SEQ ID NO: 1726286 - protein, 11 aa, Staphylococcus epidermidis
IPSEHTNLKRS

SEQ ID NO: 1726287 - protein, 9 aa, Staphylococcus epidermidis
IPSNEAYNT

SEQ ID NO: 1726288 - protein, 10 aa, Staphylococcus epidermidis
IPTPPSVKKS

SEQ ID NO: 1726289 - protein, 5 aa, Staphylococcus epidermidis
IQPEV

SEQ ID NO: 1726290 - protein, 5 aa, Staphylococcus epidermidis
IQPKL

SEQ ID NO: 1726291 - protein, 5 aa, Staphylococcus epidermidis
IQTAT

SEQ ID NO: 1726292 - protein, 7 aa, Staphylococcus epidermidis
IQTNGRS

SEQ ID NO: 1726293 - protein, 16 aa, Staphylococcus epidermidis
IRAVPSSVREASYGLG

SEQ ID NO: 1726294 - protein, 10 aa, Staphylococcus epidermidis
IREPKEAIKD

SEQ ID NO: 1726295 - protein, 4 aa, Staphylococcus epidermidis
IRNS

SEQ ID NO: 1726296 - protein, 9 aa, Staphylococcus epidermidis
ISDNAKTLI

SEQ ID NO: 1726297 - protein, 9 aa, Staphylococcus epidermidis
ISDTASGGI

SEQ ID NO: 1726298 - protein, 7 aa, Staphylococcus epidermidis
ISETDQK

SEQ ID NO: 1726299 - protein, 4 aa, Staphylococcus epidermidis
ISGA

SEQ ID NO: 1726300 - protein, 10 aa, Staphylococcus epidermidis
ISKGAKASIS

SEQ ID NO: 1726301 - protein, 9 aa, Staphylococcus epidermidis
ISKGQLNGQ

SEQ ID NO: 1726302 - protein, 4 aa, Staphylococcus epidermidis
ISPS

SEQ ID NO: 1726303 - protein, 13 aa, Staphylococcus epidermidis
ISRNYSDKYPENQ

SEQ ID NO: 1726304 - protein, 9 aa, Staphylococcus epidermidis
ISSSKNIRD

SEQ ID NO: 1726305 - protein, 9 aa, Staphylococcus epidermidis
ISSTHKTLG

SEQ ID NO: 1726306 - protein, 9 aa, Staphylococcus epidermidis
ISTNTQSEI

SEQ ID NO: 1726307 - protein, 10 aa, Staphylococcus epidermidis
ISTSDQQLAK

SEQ ID NO: 1726308 - protein, 5 aa, Staphylococcus epidermidis
ITETT

SEQ ID NO: 1726309 - protein, 10 aa, Staphylococcus epidermidis
ITGDPVSERM

SEQ ID NO: 1726310 - protein, 21 aa, Staphylococcus epidermidis
ITGKEASTTSEVKDKSSKHMN

SEQ ID NO: 1726311 - protein, 9 aa, Staphylococcus epidermidis
ITNATTTQL

SEQ ID NO: 1726312 - protein, 25 aa, Staphylococcus epidermidis
ITNHKQAGKPKNYGVASNNKIATKV

SEQ ID NO: 1726313 - protein, 16 aa, Staphylococcus epidermidis
ITNPNTIAKETLKSGT

SEQ ID NO: 1726314 - protein, 11 aa, Staphylococcus epidermidis
ITPPTRKSEGI

SEQ ID NO: 1726315 - protein, 4 aa, Staphylococcus epidermidis
ITQA

SEQ ID NO: 1726316 - protein, 8 aa, Staphylococcus epidermidis
KAAEQTTL

SEQ ID NO: 1726317 - protein, 6 aa, Staphylococcus epidermidis
KAIRNL

SEQ ID NO: 1726318 - protein, 12 aa, Staphylococcus epidermidis
KAKKQGMSLEND

SEQ ID NO: 1726319 - protein, 7 aa, Staphylococcus epidermidis
KALNNDM

SEQ ID NO: 1726320 - protein, 8 aa, Staphylococcus epidermidis
KANAANNG

SEQ ID NO: 1726321 - protein, 5 aa, Staphylococcus epidermidis
KANEI

SEQ ID NO: 1726322 - protein, 6 aa, Staphylococcus epidermidis
KANELD

SEQ ID NO: 1726323 - protein, 5 aa, Staphylococcus epidermidis
KANHP

SEQ ID NO: 1726324 - protein, 11 aa, Staphylococcus epidermidis
KASKDMEGKNF

SEQ ID NO: 1726325 - protein, 5 aa, Staphylococcus epidermidis
KASPE

SEQ ID NO: 1726326 - protein, 4 aa, Staphylococcus epidermidis
KAVA

SEQ ID NO: 1726327 - protein, 5 aa, Staphylococcus epidermidis
KAVDE

SEQ ID NO: 1726328 - protein, 11 aa, Staphylococcus epidermidis
KAYGSAYGHGV

SEQ ID NO: 1726329 - protein, 7 aa, Staphylococcus epidermidis
KDALNGI

SEQ ID NO: 1726330 - protein, 10 aa, Staphylococcus epidermidis
KDAPDTYEGR

SEQ ID NO: 1726331 - protein, 8 aa, Staphylococcus epidermidis
KDDAAGLA

SEQ ID NO: 1726332 - protein, 10 aa, Staphylococcus epidermidis
KDESKVQESA

SEQ ID NO: 1726333 - protein, 15 aa, Staphylococcus epidermidis
KDGIQNTNDNEKPLS

SEQ ID NO: 1726334 - protein, 4 aa, Staphylococcus epidermidis
KDGN

SEQ ID NO: 1726335 - protein, 11 aa, Staphylococcus epidermidis
KDIADKQRELE

SEQ ID NO: 1726336 - protein, 23 aa, Staphylococcus epidermidis
KDIDSNNELTSTQREDAKAEIER

SEQ ID NO: 1726337 - protein, 6 aa, Staphylococcus epidermidis
KDKLNH

SEQ ID NO: 1726338 - protein, 8 aa, Staphylococcus epidermidis
KDKPKPAQ

SEQ ID NO: 1726339 - protein, 4 aa, Staphylococcus epidermidis
KDNK

SEQ ID NO: 1726340 - protein, 7 aa, Staphylococcus epidermidis
KDNTRDE

SEQ ID NO: 1726341 - protein, 7 aa, Staphylococcus epidermidis
KDRREAV

SEQ ID NO: 1726342 - protein, 6 aa, Staphylococcus epidermidis
KDSLTR

SEQ ID NO: 1726343 - protein, 18 aa, Staphylococcus epidermidis
KDSRPRQGEDKHEKDVPG

SEQ ID NO: 1726344 - protein, 18 aa, Staphylococcus epidermidis
KDSTNSEAGYRSHDDRSH

SEQ ID NO: 1726345 - protein, 13 aa, Staphylococcus epidermidis
KDVKKAEKIASKV

SEQ ID NO: 1726346 - protein, 7 aa, Staphylococcus epidermidis
KEAQNIQ

SEQ ID NO: 1726347 - protein, 22 aa, Staphylococcus epidermidis
KEGQKTCKSGQTISIANGEAVA

SEQ ID NO: 1726348 - protein, 4 aa, Staphylococcus epidermidis
KEGS

SEQ ID NO: 1726349 - protein, 6 aa, Staphylococcus epidermidis
KEIPKD

SEQ ID NO: 1726350 - protein, 8 aa, Staphylococcus epidermidis
KEKYSPNW

SEQ ID NO: 1726351 - protein, 11 aa, Staphylococcus epidermidis
KELGETEESMG

SEQ ID NO: 1726352 - protein, 8 aa, Staphylococcus epidermidis
KELSDADI

SEQ ID NO: 1726353 - protein, 9 aa, Staphylococcus epidermidis
KENKNGAPM

SEQ ID NO: 1726354 - protein, 14 aa, Staphylococcus epidermidis
KEPLETAKTALQNN

SEQ ID NO: 1726355 - protein, 8 aa, Staphylococcus epidermidis
KEPMTRDQ

SEQ ID NO: 1726356 - protein, 6 aa, Staphylococcus epidermidis
KEPQLE

SEQ ID NO: 1726357 - protein, 13 aa, Staphylococcus epidermidis
KEQGQNVTNDDIN

SEQ ID NO: 1726358 - protein, 4 aa, Staphylococcus epidermidis
KEQL

SEQ ID NO: 1726359 - protein, 6 aa, Staphylococcus epidermidis
KESFGK

SEQ ID NO: 1726360 - protein, 6 aa, Staphylococcus epidermidis
KESGPV

SEQ ID NO: 1726361 - protein, 22 aa, Staphylococcus epidermidis
KETVGDKNAINRKGQMPPSSNA

SEQ ID NO: 1726362 - protein, 8 aa, Staphylococcus epidermidis
KFGNSPKA

SEQ ID NO: 1726363 - protein, 4 aa, Staphylococcus epidermidis
KFKD

SEQ ID NO: 1726364 - protein, 6 aa, Staphylococcus epidermidis
KFPNSG

SEQ ID NO: 1726365 - protein, 15 aa, Staphylococcus epidermidis
KFQSGKNAIKGITGR

SEQ ID NO: 1726366 - protein, 9 aa, Staphylococcus epidermidis
KGDANTQQI

SEQ ID NO: 1726367 - protein, 9 aa, Staphylococcus epidermidis
KGDKKVDTH

SEQ ID NO: 1726368 - protein, 21 aa, Staphylococcus epidermidis
KGDSYKKEAKKQQEGKKPKFI

SEQ ID NO: 1726369 - protein, 5 aa, Staphylococcus epidermidis
KGFGT

SEQ ID NO: 1726370 - protein, 7 aa, Staphylococcus epidermidis
KGISESQ

SEQ ID NO: 1726371 - protein, 7 aa, Staphylococcus epidermidis
KGNAFKE

SEQ ID NO: 1726372 - protein, 7 aa, Staphylococcus epidermidis
KGPEKVK

SEQ ID NO: 1726373 - protein, 7 aa, Staphylococcus epidermidis
KGPVASS

SEQ ID NO: 1726374 - protein, 5 aa, Staphylococcus epidermidis
KGQMP

SEQ ID NO: 1726375 - protein, 7 aa, Staphylococcus epidermidis
KGQNQHS

SEQ ID NO: 1726376 - protein, 5 aa, Staphylococcus epidermidis
KGRIA

SEQ ID NO: 1726377 - protein, 7 aa, Staphylococcus epidermidis
KGRRGPA

SEQ ID NO: 1726378 - protein, 7 aa, Staphylococcus epidermidis
KGSAHGD

SEQ ID NO: 1726379 - protein, 7 aa, Staphylococcus epidermidis
KGSGDVS

SEQ ID NO: 1726380 - protein, 6 aa, Staphylococcus epidermidis
KGSSYP

SEQ ID NO: 1726381 - protein, 33 aa, Staphylococcus epidermidis
KGSYQDINTNNDGSALQIDSEKNKQAIKNFFED

SEQ ID NO: 1726382 - protein, 18 aa, Staphylococcus epidermidis
KGTKKQMKYTTDKSGRVI

SEQ ID NO: 1726383 - protein, 9 aa, Staphylococcus epidermidis
KGTSSYVDP

SEQ ID NO: 1726384 - protein, 9 aa, Staphylococcus epidermidis
KGVGDSNSI

SEQ ID NO: 1726385 - protein, 7 aa, Staphylococcus epidermidis
KGVNVKG

SEQ ID NO: 1726386 - protein, 11 aa, Staphylococcus epidermidis
KHATKSKTYGY

SEQ ID NO: 1726387 - protein, 13 aa, Staphylococcus epidermidis
KHATSQEERNAAN

SEQ ID NO: 1726388 - protein, 7 aa, Staphylococcus epidermidis
KHKGRNV

SEQ ID NO: 1726389 - protein, 14 aa, Staphylococcus epidermidis
KIDKGQTNDDVEKT

SEQ ID NO: 1726390 - protein, 9 aa, Staphylococcus epidermidis
KIKDKGPDY

SEQ ID NO: 1726391 - protein, 8 aa, Staphylococcus epidermidis
KINGNEEN

SEQ ID NO: 1726392 - protein, 18 aa, Staphylococcus epidermidis
KINNAQKSALEDKVTQSH

SEQ ID NO: 1726393 - protein, 8 aa, Staphylococcus epidermidis
KKAANTLN

SEQ ID NO: 1726394 - protein, 7 aa, Staphylococcus epidermidis
KKAEEGI

SEQ ID NO: 1726395 - protein, 9 aa, Staphylococcus epidermidis
KKAKVNPHT

SEQ ID NO: 1726396 - protein, 5 aa, Staphylococcus epidermidis
KKDII

SEQ ID NO: 1726397 - protein, 12 aa, Staphylococcus epidermidis
KKEEKEEEVEEN

SEQ ID NO: 1726398 - protein, 6 aa, Staphylococcus epidermidis
KKGDIP

SEQ ID NO: 1726399 - protein, 6 aa, Staphylococcus epidermidis
KKGITT

SEQ ID NO: 1726400 - protein, 21 aa, Staphylococcus epidermidis
KKKAQLSAEKANAEDYPSQQD

SEQ ID NO: 1726401 - protein, 9 aa, Staphylococcus epidermidis
KKKEKHTPH

SEQ ID NO: 1726402 - protein, 12 aa, Staphylococcus epidermidis
KKLKGVASAAGI

SEQ ID NO: 1726403 - protein, 8 aa, Staphylococcus epidermidis
KKNPPINE

SEQ ID NO: 1726404 - protein, 9 aa, Staphylococcus epidermidis
KKNSESGKM

SEQ ID NO: 1726405 - protein, 10 aa, Staphylococcus epidermidis
KKQGKNPDKL

SEQ ID NO: 1726406 - protein, 13 aa, Staphylococcus epidermidis
KKSPADEAGLHKG

SEQ ID NO: 1726407 - protein, 6 aa, Staphylococcus epidermidis
KKSTSH

SEQ ID NO: 1726408 - protein, 36 aa, Staphylococcus epidermidis
KKSYTPSKLTQEDGDYATTVTGKVTDKDVGGKSQQV

SEQ ID NO: 1726409 - protein, 8 aa, Staphylococcus epidermidis
KKTAKSQR

SEQ ID NO: 1726410 - protein, 6 aa, Staphylococcus epidermidis
KKTSKE

SEQ ID NO: 1726411 - protein, 11 aa, Staphylococcus epidermidis
KKVGKLKDNVG

SEQ ID NO: 1726412 - protein, 9 aa, Staphylococcus epidermidis
KLEQAAKDM

SEQ ID NO: 1726413 - protein, 6 aa, Staphylococcus epidermidis
KLGHKS

SEQ ID NO: 1726414 - protein, 6 aa, Staphylococcus epidermidis
KLGPVS

SEQ ID NO: 1726415 - protein, 6 aa, Staphylococcus epidermidis
KLKKDH

SEQ ID NO: 1726416 - protein, 22 aa, Staphylococcus epidermidis
KLNGNETQKSFTITKNNNGKWT

SEQ ID NO: 1726417 - protein, 7 aa, Staphylococcus epidermidis
KLPDDVT

SEQ ID NO: 1726418 - protein, 11 aa, Staphylococcus epidermidis
KLRSQGAKDMD

SEQ ID NO: 1726419 - protein, 18 aa, Staphylococcus epidermidis
KLTDVDEGKGFTNDDNEV

SEQ ID NO: 1726420 - protein, 7 aa, Staphylococcus epidermidis
KMGPQMG

SEQ ID NO: 1726421 - protein, 21 aa, Staphylococcus epidermidis
KMNKGYGYQDIEKGKKNTANT

SEQ ID NO: 1726422 - protein, 4 aa, Staphylococcus epidermidis
KNAI

SEQ ID NO: 1726423 - protein, 7 aa, Staphylococcus epidermidis
KNATTRI

SEQ ID NO: 1726424 - protein, 6 aa, Staphylococcus epidermidis
KNDALK

SEQ ID NO: 1726425 - protein, 5 aa, Staphylococcus epidermidis
KNEDN

SEQ ID NO: 1726426 - protein, 7 aa, Staphylococcus epidermidis
KNGNKLT

SEQ ID NO: 1726427 - protein, 6 aa, Staphylococcus epidermidis
KNHKDF

SEQ ID NO: 1726428 - protein, 15 aa, Staphylococcus epidermidis
KNIADEYDVDPRKSA

SEQ ID NO: 1726429 - protein, 6 aa, Staphylococcus epidermidis
KNKDKY

SEQ ID NO: 1726430 - protein, 9 aa, Staphylococcus epidermidis
KNKELRNTL

SEQ ID NO: 1726431 - protein, 7 aa, Staphylococcus epidermidis
KNKTHKV

SEQ ID NO: 1726432 - protein, 11 aa, Staphylococcus epidermidis
KNNAKKGGLSD

SEQ ID NO: 1726433 - protein, 9 aa, Staphylococcus epidermidis
KNPKDATII

SEQ ID NO: 1726434 - protein, 7 aa, Staphylococcus epidermidis
KNQEVKS

SEQ ID NO: 1726435 - protein, 9 aa, Staphylococcus epidermidis
KNQISEQQH

SEQ ID NO: 1726436 - protein, 6 aa, Staphylococcus epidermidis
KNRGEL

SEQ ID NO: 1726437 - protein, 6 aa, Staphylococcus epidermidis
KNRPSL

SEQ ID NO: 1726438 - protein, 10 aa, Staphylococcus epidermidis
KNSGGNPDLQ

SEQ ID NO: 1726439 - protein, 5 aa, Staphylococcus epidermidis
KNSPV

SEQ ID NO: 1726440 - protein, 8 aa, Staphylococcus epidermidis
KNTISQSA

SEQ ID NO: 1726441 - protein, 9 aa, Staphylococcus epidermidis
KNTVPSDLT

SEQ ID NO: 1726442 - protein, 16 aa, Staphylococcus epidermidis
KNVSFTNPQDVNNIPG

SEQ ID NO: 1726443 - protein, 7 aa, Staphylococcus epidermidis
KNYRSGT

SEQ ID NO: 1726444 - protein, 10 aa, Staphylococcus epidermidis
KPADQNHPYG

SEQ ID NO: 1726445 - protein, 6 aa, Staphylococcus epidermidis
KPAFKD

SEQ ID NO: 1726446 - protein, 9 aa, Staphylococcus epidermidis
KPAKYTENS

SEQ ID NO: 1726447 - protein, 5 aa, Staphylococcus epidermidis
KPEAI

SEQ ID NO: 1726448 - protein, 12 aa, Staphylococcus epidermidis
KPEALPKQAHES

SEQ ID NO: 1726449 - protein, 6 aa, Staphylococcus epidermidis
KPIDAK

SEQ ID NO: 1726450 - protein, 6 aa, Staphylococcus epidermidis
KPNVQK

SEQ ID NO: 1726451 - protein, 6 aa, Staphylococcus epidermidis
KPQADT

SEQ ID NO: 1726452 - protein, 5 aa, Staphylococcus epidermidis
KPSKI

SEQ ID NO: 1726453 - protein, 4 aa, Staphylococcus epidermidis
KPTL

SEQ ID NO: 1726454 - protein, 6 aa, Staphylococcus epidermidis
KQDIEK

SEQ ID NO: 1726455 - protein, 4 aa, Staphylococcus epidermidis
KQDY

SEQ ID NO: 1726456 - protein, 4 aa, Staphylococcus epidermidis
KQED

SEQ ID NO: 1726457 - protein, 6 aa, Staphylococcus epidermidis
KQEEQM

SEQ ID NO: 1726458 - protein, 7 aa, Staphylococcus epidermidis
KQIDEAE

SEQ ID NO: 1726459 - protein, 12 aa, Staphylococcus epidermidis
KQIDKQGKLKDY

SEQ ID NO: 1726460 - protein, 12 aa, Staphylococcus epidermidis
KQKNQSSEVNDH

SEQ ID NO: 1726461 - protein, 13 aa, Staphylococcus epidermidis
KQNKQTDWSSQKI

SEQ ID NO: 1726462 - protein, 9 aa, Staphylococcus epidermidis
KQNTYPSIK

SEQ ID NO: 1726463 - protein, 11 aa, Staphylococcus epidermidis
KQNYDKSKLKY

SEQ ID NO: 1726464 - protein, 21 aa, Staphylococcus epidermidis
KQPGEWKNQDLGTGAGNNSVE

SEQ ID NO: 1726465 - protein, 12 aa, Staphylococcus epidermidis
KQPINLKPIEAY

SEQ ID NO: 1726466 - protein, 10 aa, Staphylococcus epidermidis
KQQGQKPTRY

SEQ ID NO: 1726467 - protein, 11 aa, Staphylococcus epidermidis
KQQIENATTKL

SEQ ID NO: 1726468 - protein, 7 aa, Staphylococcus epidermidis
KQSNTYA

SEQ ID NO: 1726469 - protein, 15 aa, Staphylococcus epidermidis
KQSQALSKIESTPAI

SEQ ID NO: 1726470 - protein, 13 aa, Staphylococcus epidermidis
KQTSHIQSTGCDA

SEQ ID NO: 1726471 - protein, 6 aa, Staphylococcus epidermidis
KQYGTN

SEQ ID NO: 1726472 - protein, 20 aa, Staphylococcus epidermidis
KRANGLSSNNIHNGQTLVIP

SEQ ID NO: 1726473 - protein, 11 aa, Staphylococcus epidermidis
KREGKDLPKPE

SEQ ID NO: 1726474 - protein, 4 aa, Staphylococcus epidermidis
KREP

SEQ ID NO: 1726475 - protein, 8 aa, Staphylococcus epidermidis
KRFGGNPY

SEQ ID NO: 1726476 - protein, 5 aa, Staphylococcus epidermidis
KRGPQ

SEQ ID NO: 1726477 - protein, 6 aa, Staphylococcus epidermidis
KRIRPE

SEQ ID NO: 1726478 - protein, 9 aa, Staphylococcus epidermidis
KRKKQQTSH

SEQ ID NO: 1726479 - protein, 6 aa, Staphylococcus epidermidis
KRLQDA

SEQ ID NO: 1726480 - protein, 12 aa, Staphylococcus epidermidis
KRQSQDKNQTHA

SEQ ID NO: 1726481 - protein, 7 aa, Staphylococcus epidermidis
KRREEIA

SEQ ID NO: 1726482 - protein, 8 aa, Staphylococcus epidermidis
KRSAGNGA

SEQ ID NO: 1726483 - protein, 10 aa, Staphylococcus epidermidis
KSASTSGYRG

SEQ ID NO: 1726484 - protein, 7 aa, Staphylococcus epidermidis
KSEDTGG

SEQ ID NO: 1726485 - protein, 15 aa, Staphylococcus epidermidis
KSEGRNKVMFNPIVK

SEQ ID NO: 1726486 - protein, 5 aa, Staphylococcus epidermidis
KSFEE

SEQ ID NO: 1726487 - protein, 6 aa, Staphylococcus epidermidis
KSGKSV

SEQ ID NO: 1726488 - protein, 12 aa, Staphylococcus epidermidis
KSGLNKEQRANL

SEQ ID NO: 1726489 - protein, 8 aa, Staphylococcus epidermidis
KSIENKSD

SEQ ID NO: 1726490 - protein, 8 aa, Staphylococcus epidermidis
KSIEPDMQ

SEQ ID NO: 1726491 - protein, 5 aa, Staphylococcus epidermidis
KSIVG

SEQ ID NO: 1726492 - protein, 5 aa, Staphylococcus epidermidis
KSKHV

SEQ ID NO: 1726493 - protein, 13 aa, Staphylococcus epidermidis
KSKNGSDMSTNTT

SEQ ID NO: 1726494 - protein, 11 aa, Staphylococcus epidermidis
KSKVPNNNTKL

SEQ ID NO: 1726495 - protein, 7 aa, Staphylococcus epidermidis
KSLGASG

SEQ ID NO: 1726496 - protein, 10 aa, Staphylococcus epidermidis
KSLNDEKGDV

SEQ ID NO: 1726497 - protein, 7 aa, Staphylococcus epidermidis
KSLNEAE

SEQ ID NO: 1726498 - protein, 6 aa, Staphylococcus epidermidis
KSLQTA

SEQ ID NO: 1726499 - protein, 12 aa, Staphylococcus epidermidis
KSLSNPFGSNGG

SEQ ID NO: 1726500 - protein, 11 aa, Staphylococcus epidermidis
KSMGDGATSIL

SEQ ID NO: 1726501 - protein, 6 aa, Staphylococcus epidermidis
KSNSLA

SEQ ID NO: 1726502 - protein, 7 aa, Staphylococcus epidermidis
KSPYATI

SEQ ID NO: 1726503 - protein, 5 aa, Staphylococcus epidermidis
KSRGQ

SEQ ID NO: 1726504 - protein, 12 aa, Staphylococcus epidermidis
KSRLENASKYNQ

SEQ ID NO: 1726505 - protein, 9 aa, Staphylococcus epidermidis
KSRLSETNQ

SEQ ID NO: 1726506 - protein, 13 aa, Staphylococcus epidermidis
KSSKEEHFNESVN

SEQ ID NO: 1726507 - protein, 10 aa, Staphylococcus epidermidis
KSTERKDRDI

SEQ ID NO: 1726508 - protein, 5 aa, Staphylococcus epidermidis
KSTKF

SEQ ID NO: 1726509 - protein, 7 aa, Staphylococcus epidermidis
KSTTPVK

SEQ ID NO: 1726510 - protein, 15 aa, Staphylococcus epidermidis
KSVSKQLDNKLTERD

SEQ ID NO: 1726511 - protein, 6 aa, Staphylococcus epidermidis
KSYDQD

SEQ ID NO: 1726512 - protein, 13 aa, Staphylococcus epidermidis
KTAQKARIQPKRA

SEQ ID NO: 1726513 - protein, 9 aa, Staphylococcus epidermidis
KTAQNKEGA

SEQ ID NO: 1726514 - protein, 8 aa, Staphylococcus epidermidis
KTAVQGFG

SEQ ID NO: 1726515 - protein, 5 aa, Staphylococcus epidermidis
KTDDG

SEQ ID NO: 1726516 - protein, 6 aa, Staphylococcus epidermidis
KTEDLG

SEQ ID NO: 1726517 - protein, 6 aa, Staphylococcus epidermidis
KTEGAQ

SEQ ID NO: 1726518 - protein, 14 aa, Staphylococcus epidermidis
KTKVPKAKIDGKVG

SEQ ID NO: 1726519 - protein, 4 aa, Staphylococcus epidermidis
KTME

SEQ ID NO: 1726520 - protein, 12 aa, Staphylococcus epidermidis
KTNGRSNEDIAN

SEQ ID NO: 1726521 - protein, 13 aa, Staphylococcus epidermidis
KTPPNFKQPFKAK

SEQ ID NO: 1726522 - protein, 4 aa, Staphylococcus epidermidis
KTTD

SEQ ID NO: 1726523 - protein, 6 aa, Staphylococcus epidermidis
KVDDEE

SEQ ID NO: 1726524 - protein, 17 aa, Staphylococcus epidermidis
KVDEPYLSENKKHKVGE

SEQ ID NO: 1726525 - protein, 8 aa, Staphylococcus epidermidis
KVDNQSSI

SEQ ID NO: 1726526 - protein, 7 aa, Staphylococcus epidermidis
KVITPGT

SEQ ID NO: 1726527 - protein, 9 aa, Staphylococcus epidermidis
KVKGDDTTY

SEQ ID NO: 1726528 - protein, 6 aa, Staphylococcus epidermidis
KVKRNV

SEQ ID NO: 1726529 - protein, 6 aa, Staphylococcus epidermidis
KVLPKG

SEQ ID NO: 1726530 - protein, 7 aa, Staphylococcus epidermidis
KVNAPSV

SEQ ID NO: 1726531 - protein, 10 aa, Staphylococcus epidermidis
KVPGTQKELD

SEQ ID NO: 1726532 - protein, 6 aa, Staphylococcus epidermidis
KVTGTG

SEQ ID NO: 1726533 - protein, 6 aa, Staphylococcus epidermidis
KVVQPE

SEQ ID NO: 1726534 - protein, 8 aa, Staphylococcus epidermidis
KYDEMGGE

SEQ ID NO: 1726535 - protein, 13 aa, Staphylococcus epidermidis
KYDPNKDDYTTIQ

SEQ ID NO: 1726536 - protein, 5 aa, Staphylococcus epidermidis
KYGPR

SEQ ID NO: 1726537 - protein, 6 aa, Staphylococcus epidermidis
KYKGNV

SEQ ID NO: 1726538 - protein, 13 aa, Staphylococcus epidermidis
KYLNEDSKYQQQY

SEQ ID NO: 1726539 - protein, 4 aa, Staphylococcus epidermidis
KYNI

SEQ ID NO: 1726540 - protein, 11 aa, Staphylococcus epidermidis
KYQDYTKKGQS

SEQ ID NO: 1726541 - protein, 4 aa, Staphylococcus epidermidis
KYRK

SEQ ID NO: 1726542 - protein, 5 aa, Staphylococcus epidermidis
KYVPD

SEQ ID NO: 1726543 - protein, 7 aa, Staphylococcus epidermidis
LAGQQGD

SEQ ID NO: 1726544 - protein, 9 aa, Staphylococcus epidermidis
LAGTGTARL

SEQ ID NO: 1726545 - protein, 11 aa, Staphylococcus epidermidis
LAHSNDGGNAR

SEQ ID NO: 1726546 - protein, 6 aa, Staphylococcus epidermidis
LANTPN

SEQ ID NO: 1726547 - protein, 6 aa, Staphylococcus epidermidis
LAPKAF

SEQ ID NO: 1726548 - protein, 5 aa, Staphylococcus epidermidis
LATSD

SEQ ID NO: 1726549 - protein, 8 aa, Staphylococcus epidermidis
LAVSSEQL

SEQ ID NO: 1726550 - protein, 4 aa, Staphylococcus epidermidis
LDAN

SEQ ID NO: 1726551 - protein, 5 aa, Staphylococcus epidermidis
LDDKK

SEQ ID NO: 1726552 - protein, 16 aa, Staphylococcus epidermidis
LDEEISKENKTPSSIR

SEQ ID NO: 1726553 - protein, 6 aa, Staphylococcus epidermidis
LDEEQL

SEQ ID NO: 1726554 - protein, 6 aa, Staphylococcus epidermidis
LDESNP

SEQ ID NO: 1726555 - protein, 7 aa, Staphylococcus epidermidis
LDKPNYL

SEQ ID NO: 1726556 - protein, 11 aa, Staphylococcus epidermidis
LDKSNQPKTEL

SEQ ID NO: 1726557 - protein, 20 aa, Staphylococcus epidermidis
LDPTRKNKKDSMQKHQVQKL

SEQ ID NO: 1726558 - protein, 27 aa, Staphylococcus epidermidis
LDSDPIKTGAEYAKKHGWDTPQKAIYG

SEQ ID NO: 1726559 - protein, 21 aa, Staphylococcus epidermidis
LDSNPSKNVVPGMNAEVKIHK

SEQ ID NO: 1726560 - protein, 6 aa, Staphylococcus epidermidis
LEAPSM

SEQ ID NO: 1726561 - protein, 10 aa, Staphylococcus epidermidis
LESDDVSHGT

SEQ ID NO: 1726562 - protein, 9 aa, Staphylococcus epidermidis
LETKNSLIT

SEQ ID NO: 1726563 - protein, 4 aa, Staphylococcus epidermidis
LGGD

SEQ ID NO: 1726564 - protein, 17 aa, Staphylococcus epidermidis
LGGTTGYAINPARDLAP

SEQ ID NO: 1726565 - protein, 11 aa, Staphylococcus epidermidis
LGKPNDKPEFN

SEQ ID NO: 1726566 - protein, 7 aa, Staphylococcus epidermidis
LGNPGKA

SEQ ID NO: 1726567 - protein, 4 aa, Staphylococcus epidermidis
LGQS

SEQ ID NO: 1726568 - protein, 7 aa, Staphylococcus epidermidis
LGRQINT

SEQ ID NO: 1726569 - protein, 4 aa, Staphylococcus epidermidis
LGTT

SEQ ID NO: 1726570 - protein, 9 aa, Staphylococcus epidermidis
LGYPESNSF

SEQ ID NO: 1726571 - protein, 15 aa, Staphylococcus epidermidis
LKAKSEGKSDNPEFK

SEQ ID NO: 1726572 - protein, 8 aa, Staphylococcus epidermidis
LKDDKKGV

SEQ ID NO: 1726573 - protein, 21 aa, Staphylococcus epidermidis
LKDENGNIISTTTTDENGKYQ

SEQ ID NO: 1726574 - protein, 5 aa, Staphylococcus epidermidis
LKDGY

SEQ ID NO: 1726575 - protein, 6 aa, Staphylococcus epidermidis
LKGPAG

SEQ ID NO: 1726576 - protein, 18 aa, Staphylococcus epidermidis
LKNANNAQLNNENQSKVN

SEQ ID NO: 1726577 - protein, 13 aa, Staphylococcus epidermidis
LKQNEETNADSKF

SEQ ID NO: 1726578 - protein, 7 aa, Staphylococcus epidermidis
LKSQSLG

SEQ ID NO: 1726579 - protein, 11 aa, Staphylococcus epidermidis
LKTKKLPNNVL

SEQ ID NO: 1726580 - protein, 28 aa, Staphylococcus epidermidis
LKTQAQKVSEGDYSQISTVATKDEIGDL

SEQ ID NO: 1726581 - protein, 5 aa, Staphylococcus epidermidis
LKTRS

SEQ ID NO: 1726582 - protein, 8 aa, Staphylococcus epidermidis
LNAPQRDA

SEQ ID NO: 1726583 - protein, 17 aa, Staphylococcus epidermidis
LNDQNKRENHNHDNQPY

SEQ ID NO: 1726584 - protein, 10 aa, Staphylococcus epidermidis
LNEKSAQQAA

SEQ ID NO: 1726585 - protein, 6 aa, Staphylococcus epidermidis
LNGDMS

SEQ ID NO: 1726586 - protein, 6 aa, Staphylococcus epidermidis
LNGEGF

SEQ ID NO: 1726587 - protein, 8 aa, Staphylococcus epidermidis
LNKEGDTY

SEQ ID NO: 1726588 - protein, 21 aa, Staphylococcus epidermidis
LNKGDKIDKKALQATSQTLEN

SEQ ID NO: 1726589 - protein, 9 aa, Staphylococcus epidermidis
LNKPTGGTI

SEQ ID NO: 1726590 - protein, 5 aa, Staphylococcus epidermidis
LNNNT

SEQ ID NO: 1726591 - protein, 9 aa, Staphylococcus epidermidis
LNPGSRGHD

SEQ ID NO: 1726592 - protein, 10 aa, Staphylococcus epidermidis
LNQAQKEALT

SEQ ID NO: 1726593 - protein, 5 aa, Staphylococcus epidermidis
LNSAQ

SEQ ID NO: 1726594 - protein, 6 aa, Staphylococcus epidermidis
LNTGQS

SEQ ID NO: 1726595 - protein, 7 aa, Staphylococcus epidermidis
LNYRNAD

SEQ ID NO: 1726596 - protein, 11 aa, Staphylococcus epidermidis
LPGRKKGEEEV

SEQ ID NO: 1726597 - protein, 6 aa, Staphylococcus epidermidis
LPKNPY

SEQ ID NO: 1726598 - protein, 8 aa, Staphylococcus epidermidis
LPLGDKEL

SEQ ID NO: 1726599 - protein, 7 aa, Staphylococcus epidermidis
LPPKQRK

SEQ ID NO: 1726600 - protein, 6 aa, Staphylococcus epidermidis
LPSSLE

SEQ ID NO: 1726601 - protein, 11 aa, Staphylococcus epidermidis
LPSTSNKELTF

SEQ ID NO: 1726602 - protein, 25 aa, Staphylococcus epidermidis
LQDEIDQGTNTDGMTQDSVDNYNDS

SEQ ID NO: 1726603 - protein, 4 aa, Staphylococcus epidermidis
LQDS

SEQ ID NO: 1726604 - protein, 6 aa, Staphylococcus epidermidis
LQGGLK

SEQ ID NO: 1726605 - protein, 6 aa, Staphylococcus epidermidis
LQKGTS

SEQ ID NO: 1726606 - protein, 7 aa, Staphylococcus epidermidis
LQPNGVP

SEQ ID NO: 1726607 - protein, 4 aa, Staphylococcus epidermidis
LQQS

SEQ ID NO: 1726608 - protein, 4 aa, Staphylococcus epidermidis
LRGM

SEQ ID NO: 1726609 - protein, 5 aa, Staphylococcus epidermidis
LRHPD

SEQ ID NO: 1726610 - protein, 16 aa, Staphylococcus epidermidis
LRSSEIDEAERSSNDI

SEQ ID NO: 1726611 - protein, 12 aa, Staphylococcus epidermidis
LSASTRVKQNAR

SEQ ID NO: 1726612 - protein, 4 aa, Staphylococcus epidermidis
LSDI

SEQ ID NO: 1726613 - protein, 5 aa, Staphylococcus epidermidis
LSDKI

SEQ ID NO: 1726614 - protein, 4 aa, Staphylococcus epidermidis
LSDL

SEQ ID NO: 1726615 - protein, 17 aa, Staphylococcus epidermidis
LSEDAKSSSNMQETIPG

SEQ ID NO: 1726616 - protein, 10 aa, Staphylococcus epidermidis
LSKSDKNKIN

SEQ ID NO: 1726617 - protein, 10 aa, Staphylococcus epidermidis
LSNGSSGQLE

SEQ ID NO: 1726618 - protein, 25 aa, Staphylococcus epidermidis
LSNIDNTDNSKSDKPKPLTKPMTAE

SEQ ID NO: 1726619 - protein, 5 aa, Staphylococcus epidermidis
LSQSG

SEQ ID NO: 1726620 - protein, 19 aa, Staphylococcus epidermidis
LSRRGDTNNKKPSSVSAYN

SEQ ID NO: 1726621 - protein, 8 aa, Staphylococcus epidermidis
LSSGNQDF

SEQ ID NO: 1726622 - protein, 9 aa, Staphylococcus epidermidis
LTATTKDNI

SEQ ID NO: 1726623 - protein, 4 aa, Staphylococcus epidermidis
LTEG

SEQ ID NO: 1726624 - protein, 4 aa, Staphylococcus epidermidis
LTKD

SEQ ID NO: 1726625 - protein, 11 aa, Staphylococcus epidermidis
LTNRGSRQQNY

SEQ ID NO: 1726626 - protein, 11 aa, Staphylococcus epidermidis
LTQSQKDKQHD

SEQ ID NO: 1726627 - protein, 6 aa, Staphylococcus epidermidis
LTSSDD

SEQ ID NO: 1726628 - protein, 6 aa, Staphylococcus epidermidis
LTTNKS

SEQ ID NO: 1726629 - protein, 28 aa, Staphylococcus epidermidis
LVTGESKKVQKNQNDNVIGGSINGSGTI

SEQ ID NO: 1726630 - protein, 5 aa, Staphylococcus epidermidis
LVTPD

SEQ ID NO: 1726631 - protein, 11 aa, Staphylococcus epidermidis
MAGAVGGGGIG

SEQ ID NO: 1726632 - protein, 5 aa, Staphylococcus epidermidis
MERPE

SEQ ID NO: 1726633 - protein, 13 aa, Staphylococcus epidermidis
MGAKTGTGTYGQE

SEQ ID NO: 1726634 - protein, 8 aa, Staphylococcus epidermidis
MGGGQYSA

SEQ ID NO: 1726635 - protein, 7 aa, Staphylococcus epidermidis
MGGKENI

SEQ ID NO: 1726636 - protein, 4 aa, Staphylococcus epidermidis
MGIP

SEQ ID NO: 1726637 - protein, 17 aa, Staphylococcus epidermidis
MKPTNPLSSSEKKKYGT

SEQ ID NO: 1726638 - protein, 8 aa, Staphylococcus epidermidis
MKQEGNII

SEQ ID NO: 1726639 - protein, 10 aa, Staphylococcus epidermidis
MNKEEKEDIL

SEQ ID NO: 1726640 - protein, 11 aa, Staphylococcus epidermidis
MPRKSQDEKLK

SEQ ID NO: 1726641 - protein, 28 aa, Staphylococcus epidermidis
MQKKNEQISVTSPMKDSPAEKAGIQPKD

SEQ ID NO: 1726642 - protein, 7 aa, Staphylococcus epidermidis
MRPEQTQ

SEQ ID NO: 1726643 - protein, 6 aa, Staphylococcus epidermidis
MSGNPS

SEQ ID NO: 1726644 - protein, 7 aa, Staphylococcus epidermidis
NAAGEII

SEQ ID NO: 1726645 - protein, 17 aa, Staphylococcus epidermidis
NADNDKKQNYDNAIKEA

SEQ ID NO: 1726646 - protein, 10 aa, Staphylococcus epidermidis
NADTRDEVNK

SEQ ID NO: 1726647 - protein, 7 aa, Staphylococcus epidermidis
NAGITAP

SEQ ID NO: 1726648 - protein, 26 aa, Staphylococcus epidermidis
NAGSTLDPQTIKNEDVSEKEYAAVSQ

SEQ ID NO: 1726649 - protein, 8 aa, Staphylococcus epidermidis
NAHKRQDA

SEQ ID NO: 1726650 - protein, 5 aa, Staphylococcus epidermidis
NAHTN

SEQ ID NO: 1726651 - protein, 9 aa, Staphylococcus epidermidis
NAKADEQKR

SEQ ID NO: 1726652 - protein, 23 aa, Staphylococcus epidermidis
NAKPNQPTITQSKTGDVTVTPGA

SEQ ID NO: 1726653 - protein, 7 aa, Staphylococcus epidermidis
NAKQNLN

SEQ ID NO: 1726654 - protein, 8 aa, Staphylococcus epidermidis
NAPTGNNR

SEQ ID NO: 1726655 - protein, 18 aa, Staphylococcus epidermidis
NAQDKNQQQEGVPTSLGK

SEQ ID NO: 1726656 - protein, 5 aa, Staphylococcus epidermidis
NASEN

SEQ ID NO: 1726657 - protein, 9 aa, Staphylococcus epidermidis
NATDEENEY

SEQ ID NO: 1726658 - protein, 9 aa, Staphylococcus epidermidis
NATGTATPI

SEQ ID NO: 1726659 - protein, 8 aa, Staphylococcus epidermidis
NDDGTKLF

SEQ ID NO: 1726660 - protein, 10 aa, Staphylococcus epidermidis
NDFKHGSATN

SEQ ID NO: 1726661 - protein, 31 aa, Staphylococcus epidermidis
NDIPQTQGMTQQTINNYNDKQREAERALTSA

SEQ ID NO: 1726662 - protein, 8 aa, Staphylococcus epidermidis
NDLKKQAD

SEQ ID NO: 1726663 - protein, 6 aa, Staphylococcus epidermidis
NDLSND

SEQ ID NO: 1726664 - protein, 23 aa, Staphylococcus epidermidis
NDLSNDTTVSDNKNESDNEIGSG

SEQ ID NO: 1726665 - protein, 7 aa, Staphylococcus epidermidis
NDNNDTH

SEQ ID NO: 1726666 - protein, 22 aa, Staphylococcus epidermidis
NDNTVKQNSDFINEDSSQQDAY

SEQ ID NO: 1726667 - protein, 5 aa, Staphylococcus epidermidis
NDPIE

SEQ ID NO: 1726668 - protein, 6 aa, Staphylococcus epidermidis
NDPTMD

SEQ ID NO: 1726669 - protein, 7 aa, Staphylococcus epidermidis
NDTSIAN

SEQ ID NO: 1726670 - protein, 6 aa, Staphylococcus epidermidis
NDVPAQ

SEQ ID NO: 1726671 - protein, 16 aa, Staphylococcus epidermidis
NDYATSTKQTIETELT

SEQ ID NO: 1726672 - protein, 7 aa, Staphylococcus epidermidis
NDYIQAS

SEQ ID NO: 1726673 - protein, 4 aa, Staphylococcus epidermidis
NEAL

SEQ ID NO: 1726674 - protein, 16 aa, Staphylococcus epidermidis
NEDIETRSEAASEISS

SEQ ID NO: 1726675 - protein, 5 aa, Staphylococcus epidermidis
NEDPA

SEQ ID NO: 1726676 - protein, 16 aa, Staphylococcus epidermidis
NEDQGEKVRGKNINVG

SEQ ID NO: 1726677 - protein, 18 aa, Staphylococcus epidermidis
NEEPNSWKNNIGTTTKTV

SEQ ID NO: 1726678 - protein, 27 aa, Staphylococcus epidermidis
NEKHHKETGDEHHFDETGNEKEVGPKS

SEQ ID NO: 1726679 - protein, 45 aa, Staphylococcus epidermidis
NEKYDNEFKKEEDHNSKEMEKISKGAKDENASKLHKKEHDDHGGG

SEQ ID NO: 1726680 - protein, 8 aa, Staphylococcus epidermidis
NENEKNKI

SEQ ID NO: 1726681 - protein, 10 aa, Staphylococcus epidermidis
NENKVAQPEF

SEQ ID NO: 1726682 - protein, 10 aa, Staphylococcus epidermidis
NEPDDRNSSQ

SEQ ID NO: 1726683 - protein, 5 aa, Staphylococcus epidermidis
NEQDN

SEQ ID NO: 1726684 - protein, 7 aa, Staphylococcus epidermidis
NERSFTR

SEQ ID NO: 1726685 - protein, 10 aa, Staphylococcus epidermidis
NESDAQSVRQ

SEQ ID NO: 1726686 - protein, 8 aa, Staphylococcus epidermidis
NESGMKSI

SEQ ID NO: 1726687 - protein, 8 aa, Staphylococcus epidermidis
NETNPNLN

SEQ ID NO: 1726688 - protein, 11 aa, Staphylococcus epidermidis
NGANITGISSA

SEQ ID NO: 1726689 - protein, 12 aa, Staphylococcus epidermidis
NGASNKKQATED

SEQ ID NO: 1726690 - protein, 7 aa, Staphylococcus epidermidis
NGESQLG

SEQ ID NO: 1726691 - protein, 9 aa, Staphylococcus epidermidis
NGESTTTRI

SEQ ID NO: 1726692 - protein, 7 aa, Staphylococcus epidermidis
NGGNPIG

SEQ ID NO: 1726693 - protein, 7 aa, Staphylococcus epidermidis
NGGTSLK

SEQ ID NO: 1726694 - protein, 6 aa, Staphylococcus epidermidis
NGIGIS

SEQ ID NO: 1726695 - protein, 11 aa, Staphylococcus epidermidis
NGKLASTTNTL

SEQ ID NO: 1726696 - protein, 12 aa, Staphylococcus epidermidis
NGKPLKVQQGNG

SEQ ID NO: 1726697 - protein, 9 aa, Staphylococcus epidermidis
NGLGMDKTT

SEQ ID NO: 1726698 - protein, 7 aa, Staphylococcus epidermidis
NGMSPKQ

SEQ ID NO: 1726699 - protein, 12 aa, Staphylococcus epidermidis
NGQSTGNESNDL

SEQ ID NO: 1726700 - protein, 18 aa, Staphylococcus epidermidis
NGVKSAKVKEDKDSTYSV

SEQ ID NO: 1726701 - protein, 13 aa, Staphylococcus epidermidis
NHFSKKAKNQLSS

SEQ ID NO: 1726702 - protein, 12 aa, Staphylococcus epidermidis
NHPAFNKKSKQK

SEQ ID NO: 1726703 - protein, 23 aa, Staphylococcus epidermidis
NIQPSTQTKTNAKQEINDKAQEQ

SEQ ID NO: 1726704 - protein, 11 aa, Staphylococcus epidermidis
NIQSSQSGTTV

SEQ ID NO: 1726705 - protein, 9 aa, Staphylococcus epidermidis
NKAAEEYEV

SEQ ID NO: 1726706 - protein, 10 aa, Staphylococcus epidermidis
NKAEQEMGKA

SEQ ID NO: 1726707 - protein, 15 aa, Staphylococcus epidermidis
NKDGIQGDDEKGISG

SEQ ID NO: 1726708 - protein, 5 aa, Staphylococcus epidermidis
NKDYE

SEQ ID NO: 1726709 - protein, 5 aa, Staphylococcus epidermidis
NKEIS

SEQ ID NO: 1726710 - protein, 9 aa, Staphylococcus epidermidis
NKENNTELV

SEQ ID NO: 1726711 - protein, 7 aa, Staphylococcus epidermidis
NKEQDKL

SEQ ID NO: 1726712 - protein, 7 aa, Staphylococcus epidermidis
NKGTITS

SEQ ID NO: 1726713 - protein, 8 aa, Staphylococcus epidermidis
NKHRQTIN

SEQ ID NO: 1726714 - protein, 32 aa, Staphylococcus epidermidis
NKLNKKMGDKLRKTRKKARHKDWKERDRQEQN

SEQ ID NO: 1726715 - protein, 8 aa, Staphylococcus epidermidis
NKNDLPEL

SEQ ID NO: 1726716 - protein, 6 aa, Staphylococcus epidermidis
NKNKAI

SEQ ID NO: 1726717 - protein, 12 aa, Staphylococcus epidermidis
NKNRNNKRSNDL

SEQ ID NO: 1726718 - protein, 12 aa, Staphylococcus epidermidis
NKQETNERDRVE

SEQ ID NO: 1726719 - protein, 7 aa, Staphylococcus epidermidis
NKQFNKT

SEQ ID NO: 1726720 - protein, 9 aa, Staphylococcus epidermidis
NKQNASKET

SEQ ID NO: 1726721 - protein, 8 aa, Staphylococcus epidermidis
NKRKIKRD

SEQ ID NO: 1726722 - protein, 13 aa, Staphylococcus epidermidis
NKRTDQNDDESPQ

SEQ ID NO: 1726723 - protein, 9 aa, Staphylococcus epidermidis
NKSGAGVGT

SEQ ID NO: 1726724 - protein, 13 aa, Staphylococcus epidermidis
NKSQVNDSEKVNE

SEQ ID NO: 1726725 - protein, 6 aa, Staphylococcus epidermidis
NKTELK

SEQ ID NO: 1726726 - protein, 25 aa, Staphylococcus epidermidis
NKTITNINQAQTNNQVDNAKDNGMN

SEQ ID NO: 1726727 - protein, 5 aa, Staphylococcus epidermidis
NKTQS

SEQ ID NO: 1726728 - protein, 11 aa, Staphylococcus epidermidis
NKTTTSKYYQN

SEQ ID NO: 1726729 - protein, 6 aa, Staphylococcus epidermidis
NKVHKR

SEQ ID NO: 1726730 - protein, 10 aa, Staphylococcus epidermidis
NKVTTNKEVD

SEQ ID NO: 1726731 - protein, 5 aa, Staphylococcus epidermidis
NLEGS

SEQ ID NO: 1726732 - protein, 12 aa, Staphylococcus epidermidis
NLGDSKKVGSYG

SEQ ID NO: 1726733 - protein, 8 aa, Staphylococcus epidermidis
NLGEGGSI

SEQ ID NO: 1726734 - protein, 8 aa, Staphylococcus epidermidis
NLGEGGVT

SEQ ID NO: 1726735 - protein, 7 aa, Staphylococcus epidermidis
NLKQNLS

SEQ ID NO: 1726736 - protein, 11 aa, Staphylococcus epidermidis
NLRKDNFTQAI

SEQ ID NO: 1726737 - protein, 7 aa, Staphylococcus epidermidis
NLTRTNR

SEQ ID NO: 1726738 - protein, 15 aa, Staphylococcus epidermidis
NLTTEKATIDYESDD

SEQ ID NO: 1726739 - protein, 5 aa, Staphylococcus epidermidis
NMYPT

SEQ ID NO: 1726740 - protein, 6 aa, Staphylococcus epidermidis
NNADNQ

SEQ ID NO: 1726741 - protein, 17 aa, Staphylococcus epidermidis
NNAKTGLRADKEELQNA

SEQ ID NO: 1726742 - protein, 27 aa, Staphylococcus epidermidis
NNDGRWTVETGSPDINGIGPTNNGTAI

SEQ ID NO: 1726743 - protein, 48 aa, Staphylococcus epidermidis
NNDKVSNDPNVSQNYKKEVENQNDDINRQVDSAKSDIKNKKDTQSQID

SEQ ID NO: 1726744 - protein, 11 aa, Staphylococcus epidermidis
NNIRRATPKIV

SEQ ID NO: 1726745 - protein, 9 aa, Staphylococcus epidermidis
NNKEKEITN

SEQ ID NO: 1726746 - protein, 19 aa, Staphylococcus epidermidis
NNLNGEAKLTKAKEDAVAS

SEQ ID NO: 1726747 - protein, 11 aa, Staphylococcus epidermidis
NNPKEANNRKD

SEQ ID NO: 1726748 - protein, 5 aa, Staphylococcus epidermidis
NNQDE

SEQ ID NO: 1726749 - protein, 9 aa, Staphylococcus epidermidis
NNQNIPSEQ

SEQ ID NO: 1726750 - protein, 4 aa, Staphylococcus epidermidis
NNQV

SEQ ID NO: 1726751 - protein, 10 aa, Staphylococcus epidermidis
NNSKQLDNSM

SEQ ID NO: 1726752 - protein, 27 aa, Staphylococcus epidermidis
NNSQRQSEHDEINSAPSRTEVSNDLNH

SEQ ID NO: 1726753 - protein, 5 aa, Staphylococcus epidermidis
NNYQQ

SEQ ID NO: 1726754 - protein, 5 aa, Staphylococcus epidermidis
NPAGS

SEQ ID NO: 1726755 - protein, 4 aa, Staphylococcus epidermidis
NPGL

SEQ ID NO: 1726756 - protein, 10 aa, Staphylococcus epidermidis
NPINKKTTDV

SEQ ID NO: 1726757 - protein, 10 aa, Staphylococcus epidermidis
NPKEALGPEA

SEQ ID NO: 1726758 - protein, 6 aa, Staphylococcus epidermidis
NPKNGD

SEQ ID NO: 1726759 - protein, 11 aa, Staphylococcus epidermidis
NPKNPGEHQYA

SEQ ID NO: 1726760 - protein, 8 aa, Staphylococcus epidermidis
NPNEQEET

SEQ ID NO: 1726761 - protein, 8 aa, Staphylococcus epidermidis
NPNPPKGL

SEQ ID NO: 1726762 - protein, 8 aa, Staphylococcus epidermidis
NPYSGDDS

SEQ ID NO: 1726763 - protein, 22 aa, Staphylococcus epidermidis
NQAQSQVNDDYQKVNQSPNNHQ

SEQ ID NO: 1726764 - protein, 6 aa, Staphylococcus epidermidis
NQDNGK

SEQ ID NO: 1726765 - protein, 11 aa, Staphylococcus epidermidis
NQLDGKVTDSD

SEQ ID NO: 1726766 - protein, 4 aa, Staphylococcus epidermidis
NQMI

SEQ ID NO: 1726767 - protein, 10 aa, Staphylococcus epidermidis
NQMSPEKQAT

SEQ ID NO: 1726768 - protein, 18 aa, Staphylococcus epidermidis
NQNQAPPTFASTNKHGVP

SEQ ID NO: 1726769 - protein, 10 aa, Staphylococcus epidermidis
NQNVTDEKNN

SEQ ID NO: 1726770 - protein, 4 aa, Staphylococcus epidermidis
NQRN

SEQ ID NO: 1726771 - protein, 10 aa, Staphylococcus epidermidis
NQTPYRGHDK

SEQ ID NO: 1726772 - protein, 9 aa, Staphylococcus epidermidis
NQTQGVQQA

SEQ ID NO: 1726773 - protein, 10 aa, Staphylococcus epidermidis
NQTSNPTMNP

SEQ ID NO: 1726774 - protein, 10 aa, Staphylococcus epidermidis
NQTTNPTLEP

SEQ ID NO: 1726775 - protein, 4 aa, Staphylococcus epidermidis
NQVG

SEQ ID NO: 1726776 - protein, 7 aa, Staphylococcus epidermidis
NQYTVEG

SEQ ID NO: 1726777 - protein, 4 aa, Staphylococcus epidermidis
NRAY

SEQ ID NO: 1726778 - protein, 6 aa, Staphylococcus epidermidis
NRHKNT

SEQ ID NO: 1726779 - protein, 21 aa, Staphylococcus epidermidis
NRLNEEKYELDKTKTVPLTKD

SEQ ID NO: 1726780 - protein, 6 aa, Staphylococcus epidermidis
NRNLAS

SEQ ID NO: 1726781 - protein, 15 aa, Staphylococcus epidermidis
NRTPKDNEAIDITGP

SEQ ID NO: 1726782 - protein, 29 aa, Staphylococcus epidermidis
NRYNRRGSANYKTNTVADDANHSYNSRVN

SEQ ID NO: 1726783 - protein, 4 aa, Staphylococcus epidermidis
NSAI

SEQ ID NO: 1726784 - protein, 6 aa, Staphylococcus epidermidis
NSFNTK

SEQ ID NO: 1726785 - protein, 4 aa, Staphylococcus epidermidis
NSGM

SEQ ID NO: 1726786 - protein, 6 aa, Staphylococcus epidermidis
NSLNAG

SEQ ID NO: 1726787 - protein, 6 aa, Staphylococcus epidermidis
NSLSGS

SEQ ID NO: 1726788 - protein, 7 aa, Staphylococcus epidermidis
NSSIDRT

SEQ ID NO: 1726789 - protein, 9 aa, Staphylococcus epidermidis
NSSKYYENL

SEQ ID NO: 1726790 - protein, 6 aa, Staphylococcus epidermidis
NTDDPI

SEQ ID NO: 1726791 - protein, 5 aa, Staphylococcus epidermidis
NTEKI

SEQ ID NO: 1726792 - protein, 7 aa, Staphylococcus epidermidis
NTGDKTG

SEQ ID NO: 1726793 - protein, 11 aa, Staphylococcus epidermidis
NTIAESLNTQY

SEQ ID NO: 1726794 - protein, 6 aa, Staphylococcus epidermidis
NTKAFT

SEQ ID NO: 1726795 - protein, 6 aa, Staphylococcus epidermidis
NTKTKD

SEQ ID NO: 1726796 - protein, 11 aa, Staphylococcus epidermidis
NTLRHSNGTKV

SEQ ID NO: 1726797 - protein, 4 aa, Staphylococcus epidermidis
NTPN

SEQ ID NO: 1726798 - protein, 7 aa, Staphylococcus epidermidis
NTSIKST

SEQ ID NO: 1726799 - protein, 16 aa, Staphylococcus epidermidis
NTTKSIGRLAGNDESL

SEQ ID NO: 1726800 - protein, 6 aa, Staphylococcus epidermidis
NTTYGV

SEQ ID NO: 1726801 - protein, 8 aa, Staphylococcus epidermidis
NTVQPKVN

SEQ ID NO: 1726802 - protein, 8 aa, Staphylococcus epidermidis
NVDTEGGY

SEQ ID NO: 1726803 - protein, 9 aa, Staphylococcus epidermidis
NVGDDQEDI

SEQ ID NO: 1726804 - protein, 14 aa, Staphylococcus epidermidis
NVKQGDKLDKGDKV

SEQ ID NO: 1726805 - protein, 36 aa, Staphylococcus epidermidis
NVSTNGKKPASIRQYETAKARIQNQINDAKNEAERI

SEQ ID NO: 1726806 - protein, 9 aa, Staphylococcus epidermidis
NVTQSVNQK

SEQ ID NO: 1726807 - protein, 5 aa, Staphylococcus epidermidis
NYGNI

SEQ ID NO: 1726808 - protein, 6 aa, Staphylococcus epidermidis
NYKTRT

SEQ ID NO: 1726809 - protein, 10 aa, Staphylococcus epidermidis
NYNTKPVKAQ

SEQ ID NO: 1726810 - protein, 8 aa, Staphylococcus epidermidis
NYSKTYGS

SEQ ID NO: 1726811 - protein, 8 aa, Staphylococcus epidermidis
NYSSEDNK

SEQ ID NO: 1726812 - protein, 11 aa, Staphylococcus epidermidis
NYTPEATQKRI

SEQ ID NO: 1726813 - protein, 4 aa, Staphylococcus epidermidis
NYTY

SEQ ID NO: 1726814 - protein, 7 aa, Staphylococcus epidermidis
PAASATA

SEQ ID NO: 1726815 - protein, 14 aa, Staphylococcus epidermidis
PADQSLSSNPLKGK

SEQ ID NO: 1726816 - protein, 14 aa, Staphylococcus epidermidis
PAFSESKLDDPIPA

SEQ ID NO: 1726817 - protein, 9 aa, Staphylococcus epidermidis
PAPKTSLGS

SEQ ID NO: 1726818 - protein, 13 aa, Staphylococcus epidermidis
PDETFEKKKEYTQ

SEQ ID NO: 1726819 - protein, 7 aa, Staphylococcus epidermidis
PDKTNTL

SEQ ID NO: 1726820 - protein, 17 aa, Staphylococcus epidermidis
PDNKTYHQGEKDKNVKT

SEQ ID NO: 1726821 - protein, 13 aa, Staphylococcus epidermidis
PDNSRNSLNPTER

SEQ ID NO: 1726822 - protein, 6 aa, Staphylococcus epidermidis
PDREEI

SEQ ID NO: 1726823 - protein, 11 aa, Staphylococcus epidermidis
PDSQSSNNTDL

SEQ ID NO: 1726824 - protein, 4 aa, Staphylococcus epidermidis
PDTL

SEQ ID NO: 1726825 - protein, 12 aa, Staphylococcus epidermidis
PEEKKREQQQYN

SEQ ID NO: 1726826 - protein, 27 aa, Staphylococcus epidermidis
PEKMADNLKKQGSYVPGIRPGEQTKKY

SEQ ID NO: 1726827 - protein, 6 aa, Staphylococcus epidermidis
PEKRGV

SEQ ID NO: 1726828 - protein, 6 aa, Staphylococcus epidermidis
PENDEL

SEQ ID NO: 1726829 - protein, 5 aa, Staphylococcus epidermidis
PFGNT

SEQ ID NO: 1726830 - protein, 30 aa, Staphylococcus epidermidis
PGHGGSDQGASSSTPSKSLEKNYTLKTAKE

SEQ ID NO: 1726831 - protein, 14 aa, Staphylococcus epidermidis
PGKSGGVNKEYAGQ

SEQ ID NO: 1726832 - protein, 4 aa, Staphylococcus epidermidis
PGLE

SEQ ID NO: 1726833 - protein, 32 aa, Staphylococcus epidermidis
PGSGLDPDKLPKGDITKYQSSAHSAEQATTYG

SEQ ID NO: 1726834 - protein, 6 aa, Staphylococcus epidermidis
PGYKAQ

SEQ ID NO: 1726835 - protein, 8 aa, Staphylococcus epidermidis
PIGNTKSF

SEQ ID NO: 1726836 - protein, 4 aa, Staphylococcus epidermidis
PKGA

SEQ ID NO: 1726837 - protein, 11 aa, Staphylococcus epidermidis
PKKAAGTAAGL

SEQ ID NO: 1726838 - protein, 8 aa, Staphylococcus epidermidis
PKKDNDVT

SEQ ID NO: 1726839 - protein, 6 aa, Staphylococcus epidermidis
PKMTRP

SEQ ID NO: 1726840 - protein, 4 aa, Staphylococcus epidermidis
PKTL

SEQ ID NO: 1726841 - protein, 7 aa, Staphylococcus epidermidis
PKYARTY

SEQ ID NO: 1726842 - protein, 9 aa, Staphylococcus epidermidis
PLAKGSQKR

SEQ ID NO: 1726843 - protein, 4 aa, Staphylococcus epidermidis
PLPS

SEQ ID NO: 1726844 - protein, 7 aa, Staphylococcus epidermidis
PLSAAGG

SEQ ID NO: 1726845 - protein, 4 aa, Staphylococcus epidermidis
PLSG

SEQ ID NO: 1726846 - protein, 5 aa, Staphylococcus epidermidis
PNEEM

SEQ ID NO: 1726847 - protein, 5 aa, Staphylococcus epidermidis
PNHIS

SEQ ID NO: 1726848 - protein, 8 aa, Staphylococcus epidermidis
PNHQGTRT

SEQ ID NO: 1726849 - protein, 10 aa, Staphylococcus epidermidis
PNIKKGLTTG

SEQ ID NO: 1726850 - protein, 5 aa, Staphylococcus epidermidis
PNKTI

SEQ ID NO: 1726851 - protein, 4 aa, Staphylococcus epidermidis
PNNT

SEQ ID NO: 1726852 - protein, 6 aa, Staphylococcus epidermidis
PNTAIG

SEQ ID NO: 1726853 - protein, 6 aa, Staphylococcus epidermidis
PPEVQS

SEQ ID NO: 1726854 - protein, 12 aa, Staphylococcus epidermidis
PPNGAKSMSDQA

SEQ ID NO: 1726855 - protein, 48 aa, Staphylococcus epidermidis
PQIDPKELKAQRKREKAEIRAKKKEKRKAYNKRMKERRKNQPSAVNQR

SEQ ID NO: 1726856 - protein, 23 aa, Staphylococcus epidermidis
PQKGTIVKTDGIEGSMTQAGNPI

SEQ ID NO: 1726857 - protein, 4 aa, Staphylococcus epidermidis
PQNA

SEQ ID NO: 1726858 - protein, 8 aa, Staphylococcus epidermidis
PSATNTEA

SEQ ID NO: 1726859 - protein, 24 aa, Staphylococcus epidermidis
PSGMTQTTTDSGDDDEQDADGEEV

SEQ ID NO: 1726860 - protein, 6 aa, Staphylococcus epidermidis
PSISDN

SEQ ID NO: 1726861 - protein, 5 aa, Staphylococcus epidermidis
PSTSH

SEQ ID NO: 1726862 - protein, 8 aa, Staphylococcus epidermidis
PTQSHSDI

SEQ ID NO: 1726863 - protein, 5 aa, Staphylococcus epidermidis
PTRKN

SEQ ID NO: 1726864 - protein, 7 aa, Staphylococcus epidermidis
PTTGSFA

SEQ ID NO: 1726865 - protein, 4 aa, Staphylococcus epidermidis
PVDV

SEQ ID NO: 1726866 - protein, 5 aa, Staphylococcus epidermidis
PVGEA

SEQ ID NO: 1726867 - protein, 8 aa, Staphylococcus epidermidis
PVKDGGFS

SEQ ID NO: 1726868 - protein, 4 aa, Staphylococcus epidermidis
PVKR

SEQ ID NO: 1726869 - protein, 10 aa, Staphylococcus epidermidis
PVNKKAETGI

SEQ ID NO: 1726870 - protein, 4 aa, Staphylococcus epidermidis
PVYK

SEQ ID NO: 1726871 - protein, 9 aa, Staphylococcus epidermidis
PYETINSPN

SEQ ID NO: 1726872 - protein, 7 aa, Staphylococcus epidermidis
PYSPKGY

SEQ ID NO: 1726873 - protein, 6 aa, Staphylococcus epidermidis
PYTSED

SEQ ID NO: 1726874 - protein, 13 aa, Staphylococcus epidermidis
QAHNELNGESRFK

SEQ ID NO: 1726875 - protein, 5 aa, Staphylococcus epidermidis
QAKAH

SEQ ID NO: 1726876 - protein, 6 aa, Staphylococcus epidermidis
QALQNA

SEQ ID NO: 1726877 - protein, 15 aa, Staphylococcus epidermidis
QANEISRQITNGTMT

SEQ ID NO: 1726878 - protein, 12 aa, Staphylococcus epidermidis
QAQNDKSSAELL

SEQ ID NO: 1726879 - protein, 6 aa, Staphylococcus epidermidis
QATGNL

SEQ ID NO: 1726880 - protein, 11 aa, Staphylococcus epidermidis
QATQGAEAFNR

SEQ ID NO: 1726881 - protein, 9 aa, Staphylococcus epidermidis
QDEIPETQY

SEQ ID NO: 1726882 - protein, 9 aa, Staphylococcus epidermidis
QDGEPRVNS

SEQ ID NO: 1726883 - protein, 11 aa, Staphylococcus epidermidis
QDGQTVKQGER

SEQ ID NO: 1726884 - protein, 8 aa, Staphylococcus epidermidis
QDGSNVEP

SEQ ID NO: 1726885 - protein, 5 aa, Staphylococcus epidermidis
QDYKM

SEQ ID NO: 1726886 - protein, 9 aa, Staphylococcus epidermidis
QEETSPKNM

SEQ ID NO: 1726887 - protein, 4 aa, Staphylococcus epidermidis
QEKR

SEQ ID NO: 1726888 - protein, 8 aa, Staphylococcus epidermidis
QELGGTDT

SEQ ID NO: 1726889 - protein, 12 aa, Staphylococcus epidermidis
QELQKAKELNDA

SEQ ID NO: 1726890 - protein, 8 aa, Staphylococcus epidermidis
QERNRISQ

SEQ ID NO: 1726891 - protein, 8 aa, Staphylococcus epidermidis
QERWQGAN

SEQ ID NO: 1726892 - protein, 14 aa, Staphylococcus epidermidis
QESPLGGDDRPYSG

SEQ ID NO: 1726893 - protein, 7 aa, Staphylococcus epidermidis
QEVASTT

SEQ ID NO: 1726894 - protein, 9 aa, Staphylococcus epidermidis
QFKKTKNNK

SEQ ID NO: 1726895 - protein, 5 aa, Staphylococcus epidermidis
QFPVN

SEQ ID NO: 1726896 - protein, 11 aa, Staphylococcus epidermidis
QGAQSEQTYEM

SEQ ID NO: 1726897 - protein, 9 aa, Staphylococcus epidermidis
QGEKNGKLD

SEQ ID NO: 1726898 - protein, 8 aa, Staphylococcus epidermidis
QGLATEDA

SEQ ID NO: 1726899 - protein, 6 aa, Staphylococcus epidermidis
QGLGPK

SEQ ID NO: 1726900 - protein, 12 aa, Staphylococcus epidermidis
QGPDINSNQIGR

SEQ ID NO: 1726901 - protein, 16 aa, Staphylococcus epidermidis
QGSGTPSSRNAGSFTK

SEQ ID NO: 1726902 - protein, 7 aa, Staphylococcus epidermidis
QGTPNIT

SEQ ID NO: 1726903 - protein, 7 aa, Staphylococcus epidermidis
QGTPTNV

SEQ ID NO: 1726904 - protein, 20 aa, Staphylococcus epidermidis
QIKQDDKRLKQRKVDIKRRY

SEQ ID NO: 1726905 - protein, 5 aa, Staphylococcus epidermidis
QINQK

SEQ ID NO: 1726906 - protein, 4 aa, Staphylococcus epidermidis
QIQN

SEQ ID NO: 1726907 - protein, 6 aa, Staphylococcus epidermidis
QKDKSD

SEQ ID NO: 1726908 - protein, 7 aa, Staphylococcus epidermidis
QKEGKAL

SEQ ID NO: 1726909 - protein, 7 aa, Staphylococcus epidermidis
QKKIPSM

SEQ ID NO: 1726910 - protein, 12 aa, Staphylococcus epidermidis
QKKPYNTAGVKV

SEQ ID NO: 1726911 - protein, 14 aa, Staphylococcus epidermidis
QKNLDEKGLTANDV

SEQ ID NO: 1726912 - protein, 11 aa, Staphylococcus epidermidis
QLTDAQNALQG

SEQ ID NO: 1726913 - protein, 7 aa, Staphylococcus epidermidis
QNEDQHS

SEQ ID NO: 1726914 - protein, 10 aa, Staphylococcus epidermidis
QNKADNSQLV

SEQ ID NO: 1726915 - protein, 14 aa, Staphylococcus epidermidis
QNKSKKGNKKRSKT

SEQ ID NO: 1726916 - protein, 8 aa, Staphylococcus epidermidis
QNLSNTNN

SEQ ID NO: 1726917 - protein, 9 aa, Staphylococcus epidermidis
QNLTNENYN

SEQ ID NO: 1726918 - protein, 6 aa, Staphylococcus epidermidis
QNNTSH

SEQ ID NO: 1726919 - protein, 10 aa, Staphylococcus epidermidis
QNQDATLEEK

SEQ ID NO: 1726920 - protein, 8 aa, Staphylococcus epidermidis
QNSAQNTE

SEQ ID NO: 1726921 - protein, 4 aa, Staphylococcus epidermidis
QNSI

SEQ ID NO: 1726922 - protein, 4 aa, Staphylococcus epidermidis
QNSS

SEQ ID NO: 1726923 - protein, 17 aa, Staphylococcus epidermidis
QNTPDATNEEKQEAINR

SEQ ID NO: 1726924 - protein, 13 aa, Staphylococcus epidermidis
QNYLDKKDKVETV

SEQ ID NO: 1726925 - protein, 4 aa, Staphylococcus epidermidis
QPAL

SEQ ID NO: 1726926 - protein, 4 aa, Staphylococcus epidermidis
QPLI

SEQ ID NO: 1726927 - protein, 9 aa, Staphylococcus epidermidis
QPPASTYSR

SEQ ID NO: 1726928 - protein, 17 aa, Staphylococcus epidermidis
QQASATSSKTSENPATI

SEQ ID NO: 1726929 - protein, 22 aa, Staphylococcus epidermidis
QQDNVRQSNNYINEDSTPQNMY

SEQ ID NO: 1726930 - protein, 8 aa, Staphylococcus epidermidis
QQEDYETD

SEQ ID NO: 1726931 - protein, 9 aa, Staphylococcus epidermidis
QQETEIKQK

SEQ ID NO: 1726932 - protein, 9 aa, Staphylococcus epidermidis
QQKRAKEHR

SEQ ID NO: 1726933 - protein, 13 aa, Staphylococcus epidermidis
QRQRKEGKRPVFK

SEQ ID NO: 1726934 - protein, 9 aa, Staphylococcus epidermidis
QSADTSQGL

SEQ ID NO: 1726935 - protein, 4 aa, Staphylococcus epidermidis
QSEI

SEQ ID NO: 1726936 - protein, 8 aa, Staphylococcus epidermidis
QSHTEKLR

SEQ ID NO: 1726937 - protein, 4 aa, Staphylococcus epidermidis
QSKI

SEQ ID NO: 1726938 - protein, 15 aa, Staphylococcus epidermidis
QSLSRDDSGELKTNG

SEQ ID NO: 1726939 - protein, 6 aa, Staphylococcus epidermidis
QSPLSY

SEQ ID NO: 1726940 - protein, 17 aa, Staphylococcus epidermidis
QSQKVTDEHKNKDIKYK

SEQ ID NO: 1726941 - protein, 4 aa, Staphylococcus epidermidis
QSRC

SEQ ID NO: 1726942 - protein, 27 aa, Staphylococcus epidermidis
QSSDLPQQSSSDMLPNTGMKDKNFNTN

SEQ ID NO: 1726943 - protein, 10 aa, Staphylococcus epidermidis
QSTGTTSDQW

SEQ ID NO: 1726944 - protein, 8 aa, Staphylococcus epidermidis
QSTNTRTN

SEQ ID NO: 1726945 - protein, 6 aa, Staphylococcus epidermidis
QSVTEP

SEQ ID NO: 1726946 - protein, 4 aa, Staphylococcus epidermidis
QSYT

SEQ ID NO: 1726947 - protein, 7 aa, Staphylococcus epidermidis
QTAGSNV

SEQ ID NO: 1726948 - protein, 5 aa, Staphylococcus epidermidis
QTGST

SEQ ID NO: 1726949 - protein, 6 aa, Staphylococcus epidermidis
QTIDNV

SEQ ID NO: 1726950 - protein, 16 aa, Staphylococcus epidermidis
QTKQSEQQLYKDSTRF

SEQ ID NO: 1726951 - protein, 8 aa, Staphylococcus epidermidis
QTNPEMDP

SEQ ID NO: 1726952 - protein, 5 aa, Staphylococcus epidermidis
QTPMR

SEQ ID NO: 1726953 - protein, 7 aa, Staphylococcus epidermidis
QVESSNE

SEQ ID NO: 1726954 - protein, 7 aa, Staphylococcus epidermidis
QVGGDTA

SEQ ID NO: 1726955 - protein, 7 aa, Staphylococcus epidermidis
QVTGGAV

SEQ ID NO: 1726956 - protein, 4 aa, Staphylococcus epidermidis
QYND

SEQ ID NO: 1726957 - protein, 4 aa, Staphylococcus epidermidis
RAGA

SEQ ID NO: 1726958 - protein, 9 aa, Staphylococcus epidermidis
RDEADSTED

SEQ ID NO: 1726959 - protein, 4 aa, Staphylococcus epidermidis
RDGP

SEQ ID NO: 1726960 - protein, 20 aa, Staphylococcus epidermidis
RDGSSTSTGGVGFGSGAPLP

SEQ ID NO: 1726961 - protein, 8 aa, Staphylococcus epidermidis
RDISGDPI

SEQ ID NO: 1726962 - protein, 6 aa, Staphylococcus epidermidis
RDYSQG

SEQ ID NO: 1726963 - protein, 4 aa, Staphylococcus epidermidis
REDV

SEQ ID NO: 1726964 - protein, 9 aa, Staphylococcus epidermidis
REEYRKSAQ

SEQ ID NO: 1726965 - protein, 14 aa, Staphylococcus epidermidis
REGATQTNKYYGDE

SEQ ID NO: 1726966 - protein, 8 aa, Staphylococcus epidermidis
REQSYEEE

SEQ ID NO: 1726967 - protein, 4 aa, Staphylococcus epidermidis
RERL

SEQ ID NO: 1726968 - protein, 8 aa, Staphylococcus epidermidis
RFGSPKDV

SEQ ID NO: 1726969 - protein, 9 aa, Staphylococcus epidermidis
RGDKDVQSL

SEQ ID NO: 1726970 - protein, 11 aa, Staphylococcus epidermidis
RGKRYGKKKRS

SEQ ID NO: 1726971 - protein, 8 aa, Staphylococcus epidermidis
RGLDSYNA

SEQ ID NO: 1726972 - protein, 19 aa, Staphylococcus epidermidis
RGLEENKIERNSNSNEINQ

SEQ ID NO: 1726973 - protein, 6 aa, Staphylococcus epidermidis
RGQEIS

SEQ ID NO: 1726974 - protein, 7 aa, Staphylococcus epidermidis
RGQFSPR

SEQ ID NO: 1726975 - protein, 12 aa, Staphylococcus epidermidis
RHTRSDSDKYTK

SEQ ID NO: 1726976 - protein, 6 aa, Staphylococcus epidermidis
RIDAVS

SEQ ID NO: 1726977 - protein, 13 aa, Staphylococcus epidermidis
RITTSSSNQTPVR

SEQ ID NO: 1726978 - protein, 4 aa, Staphylococcus epidermidis
RKDH

SEQ ID NO: 1726979 - protein, 8 aa, Staphylococcus epidermidis
RKEKNNSI

SEQ ID NO: 1726980 - protein, 16 aa, Staphylococcus epidermidis
RKEPEKYSYPKERIQI

SEQ ID NO: 1726981 - protein, 9 aa, Staphylococcus epidermidis
RKESNQTKW

SEQ ID NO: 1726982 - protein, 27 aa, Staphylococcus epidermidis
RKETPISLEGKASPESVKTYNNNQSVG

SEQ ID NO: 1726983 - protein, 16 aa, Staphylococcus epidermidis
RKGNKKTNKKKQNETP

SEQ ID NO: 1726984 - protein, 4 aa, Staphylococcus epidermidis
RKIN

SEQ ID NO: 1726985 - protein, 8 aa, Staphylococcus epidermidis
RKKANDKN

SEQ ID NO: 1726986 - protein, 6 aa, Staphylococcus epidermidis
RKNRRK

SEQ ID NO: 1726987 - protein, 8 aa, Staphylococcus epidermidis
RKQPEHGS

SEQ ID NO: 1726988 - protein, 8 aa, Staphylococcus epidermidis
RKSNNDQL

SEQ ID NO: 1726989 - protein, 7 aa, Staphylococcus epidermidis
RLGGSSS

SEQ ID NO: 1726990 - protein, 10 aa, Staphylococcus epidermidis
RLGNDEADRI

SEQ ID NO: 1726991 - protein, 4 aa, Staphylococcus epidermidis
RLGY

SEQ ID NO: 1726992 - protein, 7 aa, Staphylococcus epidermidis
RNEEAAR

SEQ ID NO: 1726993 - protein, 4 aa, Staphylococcus epidermidis
RNGL

SEQ ID NO: 1726994 - protein, 6 aa, Staphylococcus epidermidis
RNGTVS

SEQ ID NO: 1726995 - protein, 16 aa, Staphylococcus epidermidis
RNLIEKTEERKNEIEQ

SEQ ID NO: 1726996 - protein, 15 aa, Staphylococcus epidermidis
RNNRGEDKHDPLTNR

SEQ ID NO: 1726997 - protein, 4 aa, Staphylococcus epidermidis
RNQG

SEQ ID NO: 1726998 - protein, 9 aa, Staphylococcus epidermidis
RNSSQKRHT

SEQ ID NO: 1726999 - protein, 10 aa, Staphylococcus epidermidis
RPDATDDEVV

SEQ ID NO: 1727000 - protein, 11 aa, Staphylococcus epidermidis
RPDFSKKRNAV

SEQ ID NO: 1727001 - protein, 4 aa, Staphylococcus epidermidis
RPER

SEQ ID NO: 1727002 - protein, 9 aa, Staphylococcus epidermidis
RPKEITVTS

SEQ ID NO: 1727003 - protein, 15 aa, Staphylococcus epidermidis
RPKRNRDLKNEKISK

SEQ ID NO: 1727004 - protein, 5 aa, Staphylococcus epidermidis
RPMTT

SEQ ID NO: 1727005 - protein, 6 aa, Staphylococcus epidermidis
RQSFTG

SEQ ID NO: 1727006 - protein, 12 aa, Staphylococcus epidermidis
RQYGEGYYSRRE

SEQ ID NO: 1727007 - protein, 4 aa, Staphylococcus epidermidis
RRDI

SEQ ID NO: 1727008 - protein, 14 aa, Staphylococcus epidermidis
RRDKHGWKTKRSNN

SEQ ID NO: 1727009 - protein, 5 aa, Staphylococcus epidermidis
RRNIK

SEQ ID NO: 1727010 - protein, 5 aa, Staphylococcus epidermidis
RSDEY

SEQ ID NO: 1727011 - protein, 4 aa, Staphylococcus epidermidis
RSEG

SEQ ID NO: 1727012 - protein, 6 aa, Staphylococcus epidermidis
RSGNIG

SEQ ID NO: 1727013 - protein, 9 aa, Staphylococcus epidermidis
RSKDEAIQN

SEQ ID NO: 1727014 - protein, 9 aa, Staphylococcus epidermidis
RSKGHTEYF

SEQ ID NO: 1727015 - protein, 9 aa, Staphylococcus epidermidis
RSKPTPPRI

SEQ ID NO: 1727016 - protein, 6 aa, Staphylococcus epidermidis
RSLDEI

SEQ ID NO: 1727017 - protein, 11 aa, Staphylococcus epidermidis
RSLQGSDKIEK

SEQ ID NO: 1727018 - protein, 6 aa, Staphylococcus epidermidis
RSMKSD

SEQ ID NO: 1727019 - protein, 4 aa, Staphylococcus epidermidis
RSMS

SEQ ID NO: 1727020 - protein, 5 aa, Staphylococcus epidermidis
RSPVG

SEQ ID NO: 1727021 - protein, 7 aa, Staphylococcus epidermidis
RSTSIGA

SEQ ID NO: 1727022 - protein, 5 aa, Staphylococcus epidermidis
RSVEE

SEQ ID NO: 1727023 - protein, 8 aa, Staphylococcus epidermidis
RSVSGIGA

SEQ ID NO: 1727024 - protein, 7 aa, Staphylococcus epidermidis
RTASTSF

SEQ ID NO: 1727025 - protein, 5 aa, Staphylococcus epidermidis
RTEVY

SEQ ID NO: 1727026 - protein, 5 aa, Staphylococcus epidermidis
RTPLT

SEQ ID NO: 1727027 - protein, 10 aa, Staphylococcus epidermidis
RTQKTKMSDK

SEQ ID NO: 1727028 - protein, 9 aa, Staphylococcus epidermidis
RYLSDSQQR

SEQ ID NO: 1727029 - protein, 9 aa, Staphylococcus epidermidis
RYNEKPTFK

SEQ ID NO: 1727030 - protein, 20 aa, Staphylococcus epidermidis
RYYGNDAGEYTITEEEKGIK

SEQ ID NO: 1727031 - protein, 7 aa, Staphylococcus epidermidis
SAEANIS

SEQ ID NO: 1727032 - protein, 4 aa, Staphylococcus epidermidis
SAEY

SEQ ID NO: 1727033 - protein, 5 aa, Staphylococcus epidermidis
SAGNM

SEQ ID NO: 1727034 - protein, 5 aa, Staphylococcus epidermidis
SAIKS

SEQ ID NO: 1727035 - protein, 12 aa, Staphylococcus epidermidis
SAITSVGDNNPY

SEQ ID NO: 1727036 - protein, 20 aa, Staphylococcus epidermidis
SAKETNVNISGNGDEGSTII

SEQ ID NO: 1727037 - protein, 7 aa, Staphylococcus epidermidis
SAKNRGK

SEQ ID NO: 1727038 - protein, 8 aa, Staphylococcus epidermidis
SAMPETSA

SEQ ID NO: 1727039 - protein, 4 aa, Staphylococcus epidermidis
SAPQ

SEQ ID NO: 1727040 - protein, 7 aa, Staphylococcus epidermidis
SAQAING

SEQ ID NO: 1727041 - protein, 6 aa, Staphylococcus epidermidis
SASKLR

SEQ ID NO: 1727042 - protein, 5 aa, Staphylococcus epidermidis
SASTG

SEQ ID NO: 1727043 - protein, 6 aa, Staphylococcus epidermidis
SASTTQ

SEQ ID NO: 1727044 - protein, 5 aa, Staphylococcus epidermidis
SATDV

SEQ ID NO: 1727045 - protein, 8 aa, Staphylococcus epidermidis
SDDKNEHS

SEQ ID NO: 1727046 - protein, 5 aa, Staphylococcus epidermidis
SDEID

SEQ ID NO: 1727047 - protein, 9 aa, Staphylococcus epidermidis
SDESSSNGL

SEQ ID NO: 1727048 - protein, 8 aa, Staphylococcus epidermidis
SDGIGGVK

SEQ ID NO: 1727049 - protein, 12 aa, Staphylococcus epidermidis
SDGKPSGKNAEL

SEQ ID NO: 1727050 - protein, 16 aa, Staphylococcus epidermidis
SDIDSTSDSVFKTASK

SEQ ID NO: 1727051 - protein, 8 aa, Staphylococcus epidermidis
SDITGRKK

SEQ ID NO: 1727052 - protein, 10 aa, Staphylococcus epidermidis
SDKPSEFKEP

SEQ ID NO: 1727053 - protein, 6 aa, Staphylococcus epidermidis
SDKTIN

SEQ ID NO: 1727054 - protein, 9 aa, Staphylococcus epidermidis
SDPNEKLKG

SEQ ID NO: 1727055 - protein, 7 aa, Staphylococcus epidermidis
SDQQTNK

SEQ ID NO: 1727056 - protein, 9 aa, Staphylococcus epidermidis
SDQTPTGPV

SEQ ID NO: 1727057 - protein, 8 aa, Staphylococcus epidermidis
SDVQGNAY

SEQ ID NO: 1727058 - protein, 12 aa, Staphylococcus epidermidis
SEDKADSPTLKV

SEQ ID NO: 1727059 - protein, 4 aa, Staphylococcus epidermidis
SEEW

SEQ ID NO: 1727060 - protein, 9 aa, Staphylococcus epidermidis
SEGHEDRDA

SEQ ID NO: 1727061 - protein, 8 aa, Staphylococcus epidermidis
SEGVNPTI

SEQ ID NO: 1727062 - protein, 11 aa, Staphylococcus epidermidis
SEKLGNPKSGD

SEQ ID NO: 1727063 - protein, 8 aa, Staphylococcus epidermidis
SEKPDQIR

SEQ ID NO: 1727064 - protein, 14 aa, Staphylococcus epidermidis
SEKPDSSYKDTKKQ

SEQ ID NO: 1727065 - protein, 4 aa, Staphylococcus epidermidis
SENI

SEQ ID NO: 1727066 - protein, 8 aa, Staphylococcus epidermidis
SERGSKTS

SEQ ID NO: 1727067 - protein, 9 aa, Staphylococcus epidermidis
SESDSIAYE

SEQ ID NO: 1727068 - protein, 13 aa, Staphylococcus epidermidis
SESQYQEAMSQLG

SEQ ID NO: 1727069 - protein, 8 aa, Staphylococcus epidermidis
SESTGRMG

SEQ ID NO: 1727070 - protein, 11 aa, Staphylococcus epidermidis
SFKAYKNKDFS

SEQ ID NO: 1727071 - protein, 11 aa, Staphylococcus epidermidis
SFKPDSSEYNA

SEQ ID NO: 1727072 - protein, 6 aa, Staphylococcus epidermidis
SFRGNE

SEQ ID NO: 1727073 - protein, 10 aa, Staphylococcus epidermidis
SGAEGTRVED

SEQ ID NO: 1727074 - protein, 14 aa, Staphylococcus epidermidis
SGAINKPVSIPNTY

SEQ ID NO: 1727075 - protein, 7 aa, Staphylococcus epidermidis
SGAKKNN

SEQ ID NO: 1727076 - protein, 6 aa, Staphylococcus epidermidis
SGAPPL

SEQ ID NO: 1727077 - protein, 7 aa, Staphylococcus epidermidis
SGASLGS

SEQ ID NO: 1727078 - protein, 8 aa, Staphylococcus epidermidis
SGETADSR

SEQ ID NO: 1727079 - protein, 6 aa, Staphylococcus epidermidis
SGETFK

SEQ ID NO: 1727080 - protein, 11 aa, Staphylococcus epidermidis
SGGPGTQGKTI

SEQ ID NO: 1727081 - protein, 9 aa, Staphylococcus epidermidis
SGHAMGSTS

SEQ ID NO: 1727082 - protein, 5 aa, Staphylococcus epidermidis
SGKVA

SEQ ID NO: 1727083 - protein, 4 aa, Staphylococcus epidermidis
SGLS

SEQ ID NO: 1727084 - protein, 4 aa, Staphylococcus epidermidis
SGQK

SEQ ID NO: 1727085 - protein, 8 aa, Staphylococcus epidermidis
SGTKESAG

SEQ ID NO: 1727086 - protein, 8 aa, Staphylococcus epidermidis
SHTKDEAD

SEQ ID NO: 1727087 - protein, 7 aa, Staphylococcus epidermidis
SHTSEEL

SEQ ID NO: 1727088 - protein, 28 aa, Staphylococcus epidermidis
SIDLGSAEHSRGTEISKQAKDLTANTLP

SEQ ID NO: 1727089 - protein, 10 aa, Staphylococcus epidermidis
SIGDNYDGDE

SEQ ID NO: 1727090 - protein, 7 aa, Staphylococcus epidermidis
SIKAPHG

SEQ ID NO: 1727091 - protein, 4 aa, Staphylococcus epidermidis
SIKE

SEQ ID NO: 1727092 - protein, 16 aa, Staphylococcus epidermidis
SINPEPTVKTKGKTYK

SEQ ID NO: 1727093 - protein, 7 aa, Staphylococcus epidermidis
SKDERIQ

SEQ ID NO: 1727094 - protein, 6 aa, Staphylococcus epidermidis
SKDGKK

SEQ ID NO: 1727095 - protein, 6 aa, Staphylococcus epidermidis
SKDSRL

SEQ ID NO: 1727096 - protein, 8 aa, Staphylococcus epidermidis
SKESIEQQ

SEQ ID NO: 1727097 - protein, 10 aa, Staphylococcus epidermidis
SKGFKDGPRT

SEQ ID NO: 1727098 - protein, 6 aa, Staphylococcus epidermidis
SKHKTP

SEQ ID NO: 1727099 - protein, 9 aa, Staphylococcus epidermidis
SKKDKQFQV

SEQ ID NO: 1727100 - protein, 7 aa, Staphylococcus epidermidis
SKKEEVY

SEQ ID NO: 1727101 - protein, 7 aa, Staphylococcus epidermidis
SKKHRQR

SEQ ID NO: 1727102 - protein, 6 aa, Staphylococcus epidermidis
SKKNLQ

SEQ ID NO: 1727103 - protein, 9 aa, Staphylococcus epidermidis
SKLPGVNTT

SEQ ID NO: 1727104 - protein, 11 aa, Staphylococcus epidermidis
SKLSYEPSSQE

SEQ ID NO: 1727105 - protein, 16 aa, Staphylococcus epidermidis
SKNDEDKVTESKPKRS

SEQ ID NO: 1727106 - protein, 9 aa, Staphylococcus epidermidis
SKNFGSNSG

SEQ ID NO: 1727107 - protein, 5 aa, Staphylococcus epidermidis
SKPKV

SEQ ID NO: 1727108 - protein, 4 aa, Staphylococcus epidermidis
SKRS

SEQ ID NO: 1727109 - protein, 19 aa, Staphylococcus epidermidis
SKRTKSSSLKSAAKDNLSD

SEQ ID NO: 1727110 - protein, 11 aa, Staphylococcus epidermidis
SKSEYHASDSV

SEQ ID NO: 1727111 - protein, 8 aa, Staphylococcus epidermidis
SKTHTDPM

SEQ ID NO: 1727112 - protein, 6 aa, Staphylococcus epidermidis
SKTNGV

SEQ ID NO: 1727113 - protein, 10 aa, Staphylococcus epidermidis
SKTVQHPQTV

SEQ ID NO: 1727114 - protein, 13 aa, Staphylococcus epidermidis
SKVQAAQNKINEA

SEQ ID NO: 1727115 - protein, 8 aa, Staphylococcus epidermidis
SKYRMQSE

SEQ ID NO: 1727116 - protein, 49 aa, Staphylococcus epidermidis
SLGKEHDKQQAAKQKSFKTNQKAKPKKPDENNQDKSSQQHFNPKEASPL

SEQ ID NO: 1727117 - protein, 6 aa, Staphylococcus epidermidis
SLGQTN

SEQ ID NO: 1727118 - protein, 12 aa, Staphylococcus epidermidis
SLNEPQKNAEVA

SEQ ID NO: 1727119 - protein, 14 aa, Staphylococcus epidermidis
SLQTSEGNIHTKEV

SEQ ID NO: 1727120 - protein, 9 aa, Staphylococcus epidermidis
SLTNGQKDT

SEQ ID NO: 1727121 - protein, 7 aa, Staphylococcus epidermidis
SLTNQEK

SEQ ID NO: 1727122 - protein, 18 aa, Staphylococcus epidermidis
SMSMEGGHGNAAAYGKTL

SEQ ID NO: 1727123 - protein, 5 aa, Staphylococcus epidermidis
SNGQV

SEQ ID NO: 1727124 - protein, 11 aa, Staphylococcus epidermidis
SNGSDLPNRDF

SEQ ID NO: 1727125 - protein, 9 aa, Staphylococcus epidermidis
SNHTSKPSL

SEQ ID NO: 1727126 - protein, 7 aa, Staphylococcus epidermidis
SNIQTEN

SEQ ID NO: 1727127 - protein, 7 aa, Staphylococcus epidermidis
SNITQSA

SEQ ID NO: 1727128 - protein, 10 aa, Staphylococcus epidermidis
SNKKTYSRKA

SEQ ID NO: 1727129 - protein, 7 aa, Staphylococcus epidermidis
SNKNREI

SEQ ID NO: 1727130 - protein, 10 aa, Staphylococcus epidermidis
SNLREAGRSM

SEQ ID NO: 1727131 - protein, 7 aa, Staphylococcus epidermidis
SNPQINA

SEQ ID NO: 1727132 - protein, 5 aa, Staphylococcus epidermidis
SNPSD

SEQ ID NO: 1727133 - protein, 8 aa, Staphylococcus epidermidis
SNPTDESM

SEQ ID NO: 1727134 - protein, 5 aa, Staphylococcus epidermidis
SNQSG

SEQ ID NO: 1727135 - protein, 16 aa, Staphylococcus epidermidis
SNQTDQQAQATQQDIK

SEQ ID NO: 1727136 - protein, 5 aa, Staphylococcus epidermidis
SNRIE

SEQ ID NO: 1727137 - protein, 11 aa, Staphylococcus epidermidis
SNSDVKSMNTA

SEQ ID NO: 1727138 - protein, 11 aa, Staphylococcus epidermidis
SNSKTKPDAAI

SEQ ID NO: 1727139 - protein, 8 aa, Staphylococcus epidermidis
SNTAGGVA

SEQ ID NO: 1727140 - protein, 11 aa, Staphylococcus epidermidis
SNWENDKSYPD

SEQ ID NO: 1727141 - protein, 9 aa, Staphylococcus epidermidis
SPDKEHKVG

SEQ ID NO: 1727142 - protein, 16 aa, Staphylococcus epidermidis
SPEQAKGEATDESTDI

SEQ ID NO: 1727143 - protein, 5 aa, Staphylococcus epidermidis
SPLTT

SEQ ID NO: 1727144 - protein, 5 aa, Staphylococcus epidermidis
SQATG

SEQ ID NO: 1727145 - protein, 8 aa, Staphylococcus epidermidis
SQDANTVQ

SEQ ID NO: 1727146 - protein, 17 aa, Staphylococcus epidermidis
SQLSEKTTAQLEEEDHR

SEQ ID NO: 1727147 - protein, 9 aa, Staphylococcus epidermidis
SQNLSNSQI

SEQ ID NO: 1727148 - protein, 9 aa, Staphylococcus epidermidis
SQNTNLQKD

SEQ ID NO: 1727149 - protein, 5 aa, Staphylococcus epidermidis
SQRTK

SEQ ID NO: 1727150 - protein, 6 aa, Staphylococcus epidermidis
SQSDEK

SEQ ID NO: 1727151 - protein, 5 aa, Staphylococcus epidermidis
SQSLS

SEQ ID NO: 1727152 - protein, 5 aa, Staphylococcus epidermidis
SRGRT

SEQ ID NO: 1727153 - protein, 4 aa, Staphylococcus epidermidis
SRGS

SEQ ID NO: 1727154 - protein, 7 aa, Staphylococcus epidermidis
SRPNEVA

SEQ ID NO: 1727155 - protein, 5 aa, Staphylococcus epidermidis
SRTKN

SEQ ID NO: 1727156 - protein, 8 aa, Staphylococcus epidermidis
SRVKSSAI

SEQ ID NO: 1727157 - protein, 6 aa, Staphylococcus epidermidis
SSAKKL

SEQ ID NO: 1727158 - protein, 6 aa, Staphylococcus epidermidis
SSATGH

SEQ ID NO: 1727159 - protein, 22 aa, Staphylococcus epidermidis
SSEDSINAISEQSGFSSHTNFT

SEQ ID NO: 1727160 - protein, 10 aa, Staphylococcus epidermidis
SSEKTSKELS

SEQ ID NO: 1727161 - protein, 13 aa, Staphylococcus epidermidis
SSELEKDDPFNPG

SEQ ID NO: 1727162 - protein, 6 aa, Staphylococcus epidermidis
SSFSTL

SEQ ID NO: 1727163 - protein, 9 aa, Staphylococcus epidermidis
SSGKNNKYH

SEQ ID NO: 1727164 - protein, 6 aa, Staphylococcus epidermidis
SSGTAQ

SEQ ID NO: 1727165 - protein, 9 aa, Staphylococcus epidermidis
SSKISTTQA

SEQ ID NO: 1727166 - protein, 7 aa, Staphylococcus epidermidis
SSMAGPA

SEQ ID NO: 1727167 - protein, 9 aa, Staphylococcus epidermidis
SSQTDSRTI

SEQ ID NO: 1727168 - protein, 12 aa, Staphylococcus epidermidis
SSRKKKKDKKVN

SEQ ID NO: 1727169 - protein, 6 aa, Staphylococcus epidermidis
SSRSRG

SEQ ID NO: 1727170 - protein, 8 aa, Staphylococcus epidermidis
SSSESGLT

SEQ ID NO: 1727171 - protein, 11 aa, Staphylococcus epidermidis
SSSTPADAGIK

SEQ ID NO: 1727172 - protein, 6 aa, Staphylococcus epidermidis
SSTGSL

SEQ ID NO: 1727173 - protein, 10 aa, Staphylococcus epidermidis
SSTTRSAGLQ

SEQ ID NO: 1727174 - protein, 8 aa, Staphylococcus epidermidis
SSVAYGPE

SEQ ID NO: 1727175 - protein, 5 aa, Staphylococcus epidermidis
STAKS

SEQ ID NO: 1727176 - protein, 6 aa, Staphylococcus epidermidis
STDAEL

SEQ ID NO: 1727177 - protein, 8 aa, Staphylococcus epidermidis
STGNQTRI

SEQ ID NO: 1727178 - protein, 4 aa, Staphylococcus epidermidis
STGV

SEQ ID NO: 1727179 - protein, 6 aa, Staphylococcus epidermidis
STIGQS

SEQ ID NO: 1727180 - protein, 7 aa, Staphylococcus epidermidis
STKAYTA

SEQ ID NO: 1727181 - protein, 6 aa, Staphylococcus epidermidis
STLGGT

SEQ ID NO: 1727182 - protein, 9 aa, Staphylococcus epidermidis
STNEDPTLK

SEQ ID NO: 1727183 - protein, 6 aa, Staphylococcus epidermidis
STNEFE

SEQ ID NO: 1727184 - protein, 16 aa, Staphylococcus epidermidis
STPYTSLESNGEDVYS

SEQ ID NO: 1727185 - protein, 18 aa, Staphylococcus epidermidis
STSSGQGQGDLPPEKTYK

SEQ ID NO: 1727186 - protein, 11 aa, Staphylococcus epidermidis
STYANEDENWT

SEQ ID NO: 1727187 - protein, 14 aa, Staphylococcus epidermidis
STYSDEIYKFEISK

SEQ ID NO: 1727188 - protein, 13 aa, Staphylococcus epidermidis
SVEEDDDKELGTF

SEQ ID NO: 1727189 - protein, 18 aa, Staphylococcus epidermidis
SVGDERTSISKTNGKDAV

SEQ ID NO: 1727190 - protein, 5 aa, Staphylococcus epidermidis
SVYST

SEQ ID NO: 1727191 - protein, 5 aa, Staphylococcus epidermidis
SYDDE

SEQ ID NO: 1727192 - protein, 7 aa, Staphylococcus epidermidis
SYGGTGL

SEQ ID NO: 1727193 - protein, 4 aa, Staphylococcus epidermidis
SYGI

SEQ ID NO: 1727194 - protein, 8 aa, Staphylococcus epidermidis
SYKAEQTP

SEQ ID NO: 1727195 - protein, 11 aa, Staphylococcus epidermidis
SYKSASQNVGY

SEQ ID NO: 1727196 - protein, 12 aa, Staphylococcus epidermidis
SYVGSGAAQFKQ

SEQ ID NO: 1727197 - protein, 26 aa, Staphylococcus epidermidis
SYVTTDNAKVDGDQIKISSPASGQIK

SEQ ID NO: 1727198 - protein, 10 aa, Staphylococcus epidermidis
TAAKSKAEKL

SEQ ID NO: 1727199 - protein, 6 aa, Staphylococcus epidermidis
TADPVL

SEQ ID NO: 1727200 - protein, 13 aa, Staphylococcus epidermidis
TAEETKQFNEGVS

SEQ ID NO: 1727201 - protein, 31 aa, Staphylococcus epidermidis
TAGASEADTDDTSSVDETTSTSSTDTISEQT

SEQ ID NO: 1727202 - protein, 4 aa, Staphylococcus epidermidis
TAGL

SEQ ID NO: 1727203 - protein, 7 aa, Staphylococcus epidermidis
TAHTVTD

SEQ ID NO: 1727204 - protein, 8 aa, Staphylococcus epidermidis
TAKPENKK

SEQ ID NO: 1727205 - protein, 7 aa, Staphylococcus epidermidis
TALSAGF

SEQ ID NO: 1727206 - protein, 11 aa, Staphylococcus epidermidis
TANLDSESELK

SEQ ID NO: 1727207 - protein, 10 aa, Staphylococcus epidermidis
TARELNPEHQ

SEQ ID NO: 1727208 - protein, 5 aa, Staphylococcus epidermidis
TATPK

SEQ ID NO: 1727209 - protein, 6 aa, Staphylococcus epidermidis
TDENPI

SEQ ID NO: 1727210 - protein, 10 aa, Staphylococcus epidermidis
TDEPVTQGQP

SEQ ID NO: 1727211 - protein, 7 aa, Staphylococcus epidermidis
TDHDSQG

SEQ ID NO: 1727212 - protein, 8 aa, Staphylococcus epidermidis
TDNRTGKL

SEQ ID NO: 1727213 - protein, 24 aa, Staphylococcus epidermidis
TDPSSLSNSEREEVKRKISEANAN

SEQ ID NO: 1727214 - protein, 8 aa, Staphylococcus epidermidis
TDSTEAMK

SEQ ID NO: 1727215 - protein, 5 aa, Staphylococcus epidermidis
TEAQA

SEQ ID NO: 1727216 - protein, 9 aa, Staphylococcus epidermidis
TEDIQGKVD

SEQ ID NO: 1727217 - protein, 5 aa, Staphylococcus epidermidis
TEDPA

SEQ ID NO: 1727218 - protein, 5 aa, Staphylococcus epidermidis
TEFRN

SEQ ID NO: 1727219 - protein, 6 aa, Staphylococcus epidermidis
TEGIEK

SEQ ID NO: 1727220 - protein, 5 aa, Staphylococcus epidermidis
TEPYS

SEQ ID NO: 1727221 - protein, 8 aa, Staphylococcus epidermidis
TEQDIERA

SEQ ID NO: 1727222 - protein, 5 aa, Staphylococcus epidermidis
TEQGK

SEQ ID NO: 1727223 - protein, 4 aa, Staphylococcus epidermidis
TESI

SEQ ID NO: 1727224 - protein, 4 aa, Staphylococcus epidermidis
TESQ

SEQ ID NO: 1727225 - protein, 6 aa, Staphylococcus epidermidis
TETYPR

SEQ ID NO: 1727226 - protein, 12 aa, Staphylococcus epidermidis
TFDSNDYGDLSA

SEQ ID NO: 1727227 - protein, 7 aa, Staphylococcus epidermidis
TFSTGGQ

SEQ ID NO: 1727228 - protein, 16 aa, Staphylococcus epidermidis
TGAAKSELANGVEIDG

SEQ ID NO: 1727229 - protein, 4 aa, Staphylococcus epidermidis
TGAY

SEQ ID NO: 1727230 - protein, 5 aa, Staphylococcus epidermidis
TGDFG

SEQ ID NO: 1727231 - protein, 9 aa, Staphylococcus epidermidis
TGENNKRYR

SEQ ID NO: 1727232 - protein, 6 aa, Staphylococcus epidermidis
TGGAGA

SEQ ID NO: 1727233 - protein, 6 aa, Staphylococcus epidermidis
TGGPVD

SEQ ID NO: 1727234 - protein, 4 aa, Staphylococcus epidermidis
TGID

SEQ ID NO: 1727235 - protein, 5 aa, Staphylococcus epidermidis
TGLDG

SEQ ID NO: 1727236 - protein, 12 aa, Staphylococcus epidermidis
TGQGKTSDSEFT

SEQ ID NO: 1727237 - protein, 10 aa, Staphylococcus epidermidis
TGTITNGQPV

SEQ ID NO: 1727238 - protein, 8 aa, Staphylococcus epidermidis
TGTLTEGN

SEQ ID NO: 1727239 - protein, 6 aa, Staphylococcus epidermidis
THEGEL

SEQ ID NO: 1727240 - protein, 8 aa, Staphylococcus epidermidis
THQPQLSD

SEQ ID NO: 1727241 - protein, 7 aa, Staphylococcus epidermidis
THRKPGL

SEQ ID NO: 1727242 - protein, 6 aa, Staphylococcus epidermidis
TIAEGT

SEQ ID NO: 1727243 - protein, 8 aa, Staphylococcus epidermidis
TIDPGPME

SEQ ID NO: 1727244 - protein, 26 aa, Staphylococcus epidermidis
TIKPNSQITITPKAGQGNTENTNPTV

SEQ ID NO: 1727245 - protein, 11 aa, Staphylococcus epidermidis
TINDSSYRSPV

SEQ ID NO: 1727246 - protein, 15 aa, Staphylococcus epidermidis
TKEDEISALKGDEDD

SEQ ID NO: 1727247 - protein, 8 aa, Staphylococcus epidermidis
TKEQRGSI

SEQ ID NO: 1727248 - protein, 15 aa, Staphylococcus epidermidis
TKEYVDELKQELEFY

SEQ ID NO: 1727249 - protein, 8 aa, Staphylococcus epidermidis
TKHRKNKD

SEQ ID NO: 1727250 - protein, 19 aa, Staphylococcus epidermidis
TKKSKEPRLEPRLGNQYGG

SEQ ID NO: 1727251 - protein, 7 aa, Staphylococcus epidermidis
TKNHTVE

SEQ ID NO: 1727252 - protein, 4 aa, Staphylococcus epidermidis
TKPH

SEQ ID NO: 1727253 - protein, 4 aa, Staphylococcus epidermidis
TKPL

SEQ ID NO: 1727254 - protein, 20 aa, Staphylococcus epidermidis
TKQKRTEPNPEYYGAAKKKN

SEQ ID NO: 1727255 - protein, 10 aa, Staphylococcus epidermidis
TKQQEYSKNL

SEQ ID NO: 1727256 - protein, 8 aa, Staphylococcus epidermidis
TKQSNRGL

SEQ ID NO: 1727257 - protein, 8 aa, Staphylococcus epidermidis
TKRTTPHI

SEQ ID NO: 1727258 - protein, 9 aa, Staphylococcus epidermidis
TKTNSNGVP

SEQ ID NO: 1727259 - protein, 15 aa, Staphylococcus epidermidis
TLNSEESKSVPTVES

SEQ ID NO: 1727260 - protein, 15 aa, Staphylococcus epidermidis
TLTSDDKTQFIVKLF

SEQ ID NO: 1727261 - protein, 13 aa, Staphylococcus epidermidis
TMKGTDSDSELDS

SEQ ID NO: 1727262 - protein, 22 aa, Staphylococcus epidermidis
TMSGATPQSTQDEISSKIDNQV

SEQ ID NO: 1727263 - protein, 10 aa, Staphylococcus epidermidis
TNERSDLDGG

SEQ ID NO: 1727264 - protein, 9 aa, Staphylococcus epidermidis
TNGDFTKEQ

SEQ ID NO: 1727265 - protein, 8 aa, Staphylococcus epidermidis
TNIQSSTG

SEQ ID NO: 1727266 - protein, 5 aa, Staphylococcus epidermidis
TNMPN

SEQ ID NO: 1727267 - protein, 8 aa, Staphylococcus epidermidis
TNNGTYPL

SEQ ID NO: 1727268 - protein, 13 aa, Staphylococcus epidermidis
TNPFSQESGTGYH

SEQ ID NO: 1727269 - protein, 7 aa, Staphylococcus epidermidis
TNPLSKK

SEQ ID NO: 1727270 - protein, 8 aa, Staphylococcus epidermidis
TNPNYERH

SEQ ID NO: 1727271 - protein, 6 aa, Staphylococcus epidermidis
TNQSSL

SEQ ID NO: 1727272 - protein, 6 aa, Staphylococcus epidermidis
TNQYKE

SEQ ID NO: 1727273 - protein, 10 aa, Staphylococcus epidermidis
TNRSHSTDRY

SEQ ID NO: 1727274 - protein, 14 aa, Staphylococcus epidermidis
TNSNQSSGGSTITQ

SEQ ID NO: 1727275 - protein, 13 aa, Staphylococcus epidermidis
TNTHGSSDASLKK

SEQ ID NO: 1727276 - protein, 13 aa, Staphylococcus epidermidis
TNVKSDLSQTYDQ

SEQ ID NO: 1727277 - protein, 19 aa, Staphylococcus epidermidis
TPEHKHDESTLCSGIHEHS

SEQ ID NO: 1727278 - protein, 18 aa, Staphylococcus epidermidis
TPETKAEPIGDQPTETKK

SEQ ID NO: 1727279 - protein, 9 aa, Staphylococcus epidermidis
TPLDDGTTE

SEQ ID NO: 1727280 - protein, 8 aa, Staphylococcus epidermidis
TPSDGIEL

SEQ ID NO: 1727281 - protein, 4 aa, Staphylococcus epidermidis
TPSY

SEQ ID NO: 1727282 - protein, 7 aa, Staphylococcus epidermidis
TQATSLN

SEQ ID NO: 1727283 - protein, 30 aa, Staphylococcus epidermidis
TQDQSALNEAQQSLSQYDRQLNDSMNASFD

SEQ ID NO: 1727284 - protein, 5 aa, Staphylococcus epidermidis
TQEAT

SEQ ID NO: 1727285 - protein, 11 aa, Staphylococcus epidermidis
TQEDRKSQRKV

SEQ ID NO: 1727286 - protein, 6 aa, Staphylococcus epidermidis
TQENGR

SEQ ID NO: 1727287 - protein, 7 aa, Staphylococcus epidermidis
TQEYPEE

SEQ ID NO: 1727288 - protein, 8 aa, Staphylococcus epidermidis
TQGAPTAR

SEQ ID NO: 1727289 - protein, 9 aa, Staphylococcus epidermidis
TQKELPGQF

SEQ ID NO: 1727290 - protein, 8 aa, Staphylococcus epidermidis
TQNEEEKQ

SEQ ID NO: 1727291 - protein, 4 aa, Staphylococcus epidermidis
TQPS

SEQ ID NO: 1727292 - protein, 4 aa, Staphylococcus epidermidis
TQQL

SEQ ID NO: 1727293 - protein, 16 aa, Staphylococcus epidermidis
TRDGEAALEFVKQQFN

SEQ ID NO: 1727294 - protein, 4 aa, Staphylococcus epidermidis
TRDT

SEQ ID NO: 1727295 - protein, 7 aa, Staphylococcus epidermidis
TRENEED

SEQ ID NO: 1727296 - protein, 10 aa, Staphylococcus epidermidis
TRIQSDTGEI

SEQ ID NO: 1727297 - protein, 12 aa, Staphylococcus epidermidis
TRNRKTSQKEML

SEQ ID NO: 1727298 - protein, 6 aa, Staphylococcus epidermidis
TSALDL

SEQ ID NO: 1727299 - protein, 7 aa, Staphylococcus epidermidis
TSGRFTD

SEQ ID NO: 1727300 - protein, 5 aa, Staphylococcus epidermidis
TSNQN

SEQ ID NO: 1727301 - protein, 4 aa, Staphylococcus epidermidis
TSQS

SEQ ID NO: 1727302 - protein, 12 aa, Staphylococcus epidermidis
TSSGRIVFAKFV

SEQ ID NO: 1727303 - protein, 13 aa, Staphylococcus epidermidis
TSTSGGNGKLSKR

SEQ ID NO: 1727304 - protein, 5 aa, Staphylococcus epidermidis
TSVAT

SEQ ID NO: 1727305 - protein, 6 aa, Staphylococcus epidermidis
TSVSDG

SEQ ID NO: 1727306 - protein, 4 aa, Staphylococcus epidermidis
TSYH

SEQ ID NO: 1727307 - protein, 9 aa, Staphylococcus epidermidis
TSYISTGDN

SEQ ID NO: 1727308 - protein, 5 aa, Staphylococcus epidermidis
TSYKN

SEQ ID NO: 1727309 - protein, 19 aa, Staphylococcus epidermidis
TTAKSLTDSYNRKLDKTNQ

SEQ ID NO: 1727310 - protein, 12 aa, Staphylococcus epidermidis
TTFSDGTTNTIT

SEQ ID NO: 1727311 - protein, 5 aa, Staphylococcus epidermidis
TTGIQ

SEQ ID NO: 1727312 - protein, 19 aa, Staphylococcus epidermidis
TTIKTDAKTAIDKKAEQQV

SEQ ID NO: 1727313 - protein, 10 aa, Staphylococcus epidermidis
TTMKGNNVDK

SEQ ID NO: 1727314 - protein, 9 aa, Staphylococcus epidermidis
TTNYEETDN

SEQ ID NO: 1727315 - protein, 9 aa, Staphylococcus epidermidis
TTPKENRKK

SEQ ID NO: 1727316 - protein, 7 aa, Staphylococcus epidermidis
TTRTAGF

SEQ ID NO: 1727317 - protein, 21 aa, Staphylococcus epidermidis
TTRTTVRGQQFPTGKGTSPND

SEQ ID NO: 1727318 - protein, 11 aa, Staphylococcus epidermidis
TTTPERKKEVD

SEQ ID NO: 1727319 - protein, 11 aa, Staphylococcus epidermidis
TVAPPAKKTQA

SEQ ID NO: 1727320 - protein, 10 aa, Staphylococcus epidermidis
TVGSSVKGGT

SEQ ID NO: 1727321 - protein, 11 aa, Staphylococcus epidermidis
TVKNDAKQAIK

SEQ ID NO: 1727322 - protein, 5 aa, Staphylococcus epidermidis
TVNNE

SEQ ID NO: 1727323 - protein, 13 aa, Staphylococcus epidermidis
TVNSTGKKGKGKI

SEQ ID NO: 1727324 - protein, 12 aa, Staphylococcus epidermidis
TWMNTGEGGLSE

SEQ ID NO: 1727325 - protein, 12 aa, Staphylococcus epidermidis
VADNSDEDGTLG

SEQ ID NO: 1727326 - protein, 8 aa, Staphylococcus epidermidis
VATTATGT

SEQ ID NO: 1727327 - protein, 8 aa, Staphylococcus epidermidis
VDDRYSKS

SEQ ID NO: 1727328 - protein, 5 aa, Staphylococcus epidermidis
VDGNE

SEQ ID NO: 1727329 - protein, 13 aa, Staphylococcus epidermidis
VDKPRNLAKSVTV

SEQ ID NO: 1727330 - protein, 7 aa, Staphylococcus epidermidis
VDNAQNS

SEQ ID NO: 1727331 - protein, 7 aa, Staphylococcus epidermidis
VDNKKSM

SEQ ID NO: 1727332 - protein, 8 aa, Staphylococcus epidermidis
VDNPQKKN

SEQ ID NO: 1727333 - protein, 7 aa, Staphylococcus epidermidis
VDPDNSP

SEQ ID NO: 1727334 - protein, 27 aa, Staphylococcus epidermidis
VDQPINSSSVEISGGFNGKKGVEEAKQ

SEQ ID NO: 1727335 - protein, 4 aa, Staphylococcus epidermidis
VDYD

SEQ ID NO: 1727336 - protein, 16 aa, Staphylococcus epidermidis
VEDAKTPASERQPVKI

SEQ ID NO: 1727337 - protein, 7 aa, Staphylococcus epidermidis
VEDSRNG

SEQ ID NO: 1727338 - protein, 5 aa, Staphylococcus epidermidis
VEEQE

SEQ ID NO: 1727339 - protein, 6 aa, Staphylococcus epidermidis
VEGQGT

SEQ ID NO: 1727340 - protein, 4 aa, Staphylococcus epidermidis
VEKT

SEQ ID NO: 1727341 - protein, 12 aa, Staphylococcus epidermidis
VEPDEDATSKQR

SEQ ID NO: 1727342 - protein, 21 aa, Staphylococcus epidermidis
VERTKKERQVTGNEKNPEYDS

SEQ ID NO: 1727343 - protein, 7 aa, Staphylococcus epidermidis
VETGTHQ

SEQ ID NO: 1727344 - protein, 12 aa, Staphylococcus epidermidis
VETNGSSGIKNH

SEQ ID NO: 1727345 - protein, 4 aa, Staphylococcus epidermidis
VEVN

SEQ ID NO: 1727346 - protein, 5 aa, Staphylococcus epidermidis
VGAGG

SEQ ID NO: 1727347 - protein, 6 aa, Staphylococcus epidermidis
VGAGGL

SEQ ID NO: 1727348 - protein, 9 aa, Staphylococcus epidermidis
VGAQFGQDA

SEQ ID NO: 1727349 - protein, 5 aa, Staphylococcus epidermidis
VGGKL

SEQ ID NO: 1727350 - protein, 5 aa, Staphylococcus epidermidis
VGKNY

SEQ ID NO: 1727351 - protein, 6 aa, Staphylococcus epidermidis
VGSTFS

SEQ ID NO: 1727352 - protein, 6 aa, Staphylococcus epidermidis
VGSTVP

SEQ ID NO: 1727353 - protein, 9 aa, Staphylococcus epidermidis
VHNSSQLSH

SEQ ID NO: 1727354 - protein, 5 aa, Staphylococcus epidermidis
VHTDN

SEQ ID NO: 1727355 - protein, 21 aa, Staphylococcus epidermidis
VIGPQKGSKPRQILVDLENDE

SEQ ID NO: 1727356 - protein, 7 aa, Staphylococcus epidermidis
VKDKGDY

SEQ ID NO: 1727357 - protein, 7 aa, Staphylococcus epidermidis
VKEGQTK

SEQ ID NO: 1727358 - protein, 10 aa, Staphylococcus epidermidis
VKGATSDMKM

SEQ ID NO: 1727359 - protein, 9 aa, Staphylococcus epidermidis
VKGKSKQSI

SEQ ID NO: 1727360 - protein, 14 aa, Staphylococcus epidermidis
VKGPNTSAMKDTVN

SEQ ID NO: 1727361 - protein, 8 aa, Staphylococcus epidermidis
VKKERNGF

SEQ ID NO: 1727362 - protein, 4 aa, Staphylococcus epidermidis
VKPQ

SEQ ID NO: 1727363 - protein, 23 aa, Staphylococcus epidermidis
VKSNYEKYSQVRSTSGKTGREVA

SEQ ID NO: 1727364 - protein, 14 aa, Staphylococcus epidermidis
VKSQAGNDAPQKFA

SEQ ID NO: 1727365 - protein, 9 aa, Staphylococcus epidermidis
VNEKSKVDV

SEQ ID NO: 1727366 - protein, 11 aa, Staphylococcus epidermidis
VNEYSQERNRL

SEQ ID NO: 1727367 - protein, 12 aa, Staphylococcus epidermidis
VNGNEPSNEQHL

SEQ ID NO: 1727368 - protein, 7 aa, Staphylococcus epidermidis
VNKSNHK

SEQ ID NO: 1727369 - protein, 5 aa, Staphylococcus epidermidis
VNPHD

SEQ ID NO: 1727370 - protein, 5 aa, Staphylococcus epidermidis
VNPTL

SEQ ID NO: 1727371 - protein, 14 aa, Staphylococcus epidermidis
VNQASTKPEVQEAL

SEQ ID NO: 1727372 - protein, 7 aa, Staphylococcus epidermidis
VNYTPKD

SEQ ID NO: 1727373 - protein, 4 aa, Staphylococcus epidermidis
VPAG

SEQ ID NO: 1727374 - protein, 10 aa, Staphylococcus epidermidis
VPESPHKNPD

SEQ ID NO: 1727375 - protein, 4 aa, Staphylococcus epidermidis
VPFG

SEQ ID NO: 1727376 - protein, 4 aa, Staphylococcus epidermidis
VPNN

SEQ ID NO: 1727377 - protein, 17 aa, Staphylococcus epidermidis
VPPKDPKNYRYTKGHIH

SEQ ID NO: 1727378 - protein, 12 aa, Staphylococcus epidermidis
VPSAGKTGTAEV

SEQ ID NO: 1727379 - protein, 4 aa, Staphylococcus epidermidis
VPTE

SEQ ID NO: 1727380 - protein, 4 aa, Staphylococcus epidermidis
VQDL

SEQ ID NO: 1727381 - protein, 5 aa, Staphylococcus epidermidis
VQENT

SEQ ID NO: 1727382 - protein, 9 aa, Staphylococcus epidermidis
VQKKPQARQ

SEQ ID NO: 1727383 - protein, 6 aa, Staphylococcus epidermidis
VQSGSV

SEQ ID NO: 1727384 - protein, 7 aa, Staphylococcus epidermidis
VRPGDSI

SEQ ID NO: 1727385 - protein, 26 aa, Staphylococcus epidermidis
VRSSQSGTTTYNNNTGVANYNDKDEM

SEQ ID NO: 1727386 - protein, 7 aa, Staphylococcus epidermidis
VSDRSNA

SEQ ID NO: 1727387 - protein, 13 aa, Staphylococcus epidermidis
VSKDDDDSGFPPG

SEQ ID NO: 1727388 - protein, 19 aa, Staphylococcus epidermidis
VSNSHGGNQLDGKSNQYKS

SEQ ID NO: 1727389 - protein, 10 aa, Staphylococcus epidermidis
VSPSNKYGLA

SEQ ID NO: 1727390 - protein, 6 aa, Staphylococcus epidermidis
VSQTST

SEQ ID NO: 1727391 - protein, 8 aa, Staphylococcus epidermidis
VTETGDFG

SEQ ID NO: 1727392 - protein, 14 aa, Staphylococcus epidermidis
VTEYDEDGEEVGSG

SEQ ID NO: 1727393 - protein, 28 aa, Staphylococcus epidermidis
VTKENNDDVEKGNVISQSPKDKTVDEGS

SEQ ID NO: 1727394 - protein, 12 aa, Staphylococcus epidermidis
VTLNGSKDLKVP

SEQ ID NO: 1727395 - protein, 10 aa, Staphylococcus epidermidis
VTREDGESKW

SEQ ID NO: 1727396 - protein, 7 aa, Staphylococcus epidermidis
VTSTQEI

SEQ ID NO: 1727397 - protein, 6 aa, Staphylococcus epidermidis
VTYDEA

SEQ ID NO: 1727398 - protein, 4 aa, Staphylococcus epidermidis
WNPL

SEQ ID NO: 1727399 - protein, 10 aa, Staphylococcus epidermidis
WNPTGSSPEF

SEQ ID NO: 1727400 - protein, 5 aa, Staphylococcus epidermidis
WPPSG

SEQ ID NO: 1727401 - protein, 4 aa, Staphylococcus epidermidis
YAKG

SEQ ID NO: 1727402 - protein, 10 aa, Staphylococcus epidermidis
YAPTKNKQSR

SEQ ID NO: 1727403 - protein, 4 aa, Staphylococcus epidermidis
YATK

SEQ ID NO: 1727404 - protein, 21 aa, Staphylococcus epidermidis
YATPSTDTAVAQAPDDKVGVA

SEQ ID NO: 1727405 - protein, 23 aa, Staphylococcus epidermidis
YDAETKTSSKAQSNRKKQELKHK

SEQ ID NO: 1727406 - protein, 6 aa, Staphylococcus epidermidis
YDNLKG

SEQ ID NO: 1727407 - protein, 7 aa, Staphylococcus epidermidis
YDPNNRY

SEQ ID NO: 1727408 - protein, 5 aa, Staphylococcus epidermidis
YDTEH

SEQ ID NO: 1727409 - protein, 7 aa, Staphylococcus epidermidis
YEDTGTI

SEQ ID NO: 1727410 - protein, 18 aa, Staphylococcus epidermidis
YEDVTNDDYAQLGNNNDV

SEQ ID NO: 1727411 - protein, 6 aa, Staphylococcus epidermidis
YEEGRY

SEQ ID NO: 1727412 - protein, 11 aa, Staphylococcus epidermidis
YEKPPEKDKDP

SEQ ID NO: 1727413 - protein, 17 aa, Staphylococcus epidermidis
YENKSYESAKKELEDKG

SEQ ID NO: 1727414 - protein, 12 aa, Staphylococcus epidermidis
YFPTAKKDVAKA

SEQ ID NO: 1727415 - protein, 6 aa, Staphylococcus epidermidis
YGEGGS

SEQ ID NO: 1727416 - protein, 6 aa, Staphylococcus epidermidis
YGISKS

SEQ ID NO: 1727417 - protein, 5 aa, Staphylococcus epidermidis
YGPHM

SEQ ID NO: 1727418 - protein, 11 aa, Staphylococcus epidermidis
YHDNDPSKNGV

SEQ ID NO: 1727419 - protein, 13 aa, Staphylococcus epidermidis
YIPNVSTKKGQTD

SEQ ID NO: 1727420 - protein, 15 aa, Staphylococcus epidermidis
YKDKDKGSVNAQKDI

SEQ ID NO: 1727421 - protein, 5 aa, Staphylococcus epidermidis
YKGSR

SEQ ID NO: 1727422 - protein, 5 aa, Staphylococcus epidermidis
YKKNV

SEQ ID NO: 1727423 - protein, 4 aa, Staphylococcus epidermidis
YKPH

SEQ ID NO: 1727424 - protein, 4 aa, Staphylococcus epidermidis
YKPQ

SEQ ID NO: 1727425 - protein, 11 aa, Staphylococcus epidermidis
YLSSEKGERDI

SEQ ID NO: 1727426 - protein, 22 aa, Staphylococcus epidermidis
YNDKDATHHGRNQMDSSSMSPA

SEQ ID NO: 1727427 - protein, 7 aa, Staphylococcus epidermidis
YNENEKE

SEQ ID NO: 1727428 - protein, 4 aa, Staphylococcus epidermidis
YNGQ

SEQ ID NO: 1727429 - protein, 8 aa, Staphylococcus epidermidis
YPKDQRKT

SEQ ID NO: 1727430 - protein, 10 aa, Staphylococcus epidermidis
YPQDQTKNSK

SEQ ID NO: 1727431 - protein, 8 aa, Staphylococcus epidermidis
YPSSHGIT

SEQ ID NO: 1727432 - protein, 7 aa, Staphylococcus epidermidis
YPTGPHT

SEQ ID NO: 1727433 - protein, 10 aa, Staphylococcus epidermidis
YQANNSLPKI

SEQ ID NO: 1727434 - protein, 9 aa, Staphylococcus epidermidis
YQDEKGNLK

SEQ ID NO: 1727435 - protein, 6 aa, Staphylococcus epidermidis
YQGANS

SEQ ID NO: 1727436 - protein, 7 aa, Staphylococcus epidermidis
YQGIDKN

SEQ ID NO: 1727437 - protein, 30 aa, Staphylococcus epidermidis
YQGSSTVQSGTEQNVTKSTQEENDAKEELQ

SEQ ID NO: 1727438 - protein, 4 aa, Staphylococcus epidermidis
YQQN

SEQ ID NO: 1727439 - protein, 5 aa, Staphylococcus epidermidis
YQSST

SEQ ID NO: 1727440 - protein, 7 aa, Staphylococcus epidermidis
YQTPKYS

SEQ ID NO: 1727441 - protein, 20 aa, Staphylococcus epidermidis
YRRQKGTTSTPSRRRNKKRM

SEQ ID NO: 1727442 - protein, 8 aa, Staphylococcus epidermidis
YSETQNEL

SEQ ID NO: 1727443 - protein, 14 aa, Staphylococcus epidermidis
YSGFNGRLNEQSTG

SEQ ID NO: 1727444 - protein, 9 aa, Staphylococcus epidermidis
YSKEENQTG

SEQ ID NO: 1727445 - protein, 5 aa, Staphylococcus epidermidis
YSNNA

SEQ ID NO: 1727446 - protein, 7 aa, Staphylococcus epidermidis
YSRGEKR

SEQ ID NO: 1727447 - protein, 8 aa, Staphylococcus epidermidis
YSTPEKQD

SEQ ID NO: 1727448 - protein, 4 aa, Staphylococcus epidermidis
YTGI

SEQ ID NO: 1727449 - protein, 5 aa, Staphylococcus epidermidis
YTGLK

SEQ ID NO: 1727450 - protein, 7 aa, Staphylococcus epidermidis
YTNDTKK

SEQ ID NO: 1727451 - protein, 6 aa, Staphylococcus epidermidis
YTQSSN

SEQ ID NO: 1727452 - protein, 32 aa, Staphylococcus epidermidis
YVDNEDKYSQFPKRAVESEYASQQTEDEPTVM

SEQ ID NO: 1727453 - protein, 10 aa, Staphylococcus epidermidis
AAAKEINSAM

SEQ ID NO: 1727454 - protein, 15 aa, Staphylococcus epidermidis
AADGSLYGSEAGAGF

SEQ ID NO: 1727455 - protein, 8 aa, Staphylococcus epidermidis
AAEQGSNV

SEQ ID NO: 1727456 - protein, 9 aa, Staphylococcus epidermidis
AAQKGDKIT

SEQ ID NO: 1727457 - protein, 4 aa, Staphylococcus epidermidis
AAQP

SEQ ID NO: 1727458 - protein, 8 aa, Staphylococcus epidermidis
AAQTEIDD

SEQ ID NO: 1727459 - protein, 5 aa, Staphylococcus epidermidis
ADKGF

SEQ ID NO: 1727460 - protein, 10 aa, Staphylococcus epidermidis
ADKQNAHQSI

SEQ ID NO: 1727461 - protein, 7 aa, Staphylococcus epidermidis
ADPTRNG

SEQ ID NO: 1727462 - protein, 9 aa, Staphylococcus epidermidis
AEDYEKITE

SEQ ID NO: 1727463 - protein, 6 aa, Staphylococcus epidermidis
AEGLSV

SEQ ID NO: 1727464 - protein, 9 aa, Staphylococcus epidermidis
AENASEHPL

SEQ ID NO: 1727465 - protein, 16 aa, Staphylococcus epidermidis
AENNQEIASTDIQGGG

SEQ ID NO: 1727466 - protein, 6 aa, Staphylococcus epidermidis
AESDLK

SEQ ID NO: 1727467 - protein, 30 aa, Staphylococcus epidermidis
AESRASKNDKEKENLQEKDKSQQVHPPLDK

SEQ ID NO: 1727468 - protein, 35 aa, Staphylococcus epidermidis
AFADSESTSSNVENTSNSNSIADKIQQAKDDIKDL

SEQ ID NO: 1727469 - protein, 13 aa, Staphylococcus epidermidis
AGETKDPHKTIPQ

SEQ ID NO: 1727470 - protein, 11 aa, Staphylococcus epidermidis
AGETKNPQTNI

SEQ ID NO: 1727471 - protein, 6 aa, Staphylococcus epidermidis
AGGKAK

SEQ ID NO: 1727472 - protein, 4 aa, Staphylococcus epidermidis
AGPS

SEQ ID NO: 1727473 - protein, 9 aa, Staphylococcus epidermidis
AGTDVAVDS

SEQ ID NO: 1727474 - protein, 9 aa, Staphylococcus epidermidis
AHAQQDAAN

SEQ ID NO: 1727475 - protein, 33 aa, Staphylococcus epidermidis
AHHNNQNKHHNEEKNSNQNNQYNDQSEGKKKGG

SEQ ID NO: 1727476 - protein, 31 aa, Staphylococcus epidermidis
AIAQNQQINSNNMATTEEKEDALNQVEAHKQ

SEQ ID NO: 1727477 - protein, 16 aa, Staphylococcus epidermidis
AIESGGKRIDTDGDFT

SEQ ID NO: 1727478 - protein, 7 aa, Staphylococcus epidermidis
AKASNQL

SEQ ID NO: 1727479 - protein, 14 aa, Staphylococcus epidermidis
AKDSVKREKGQRGL

SEQ ID NO: 1727480 - protein, 21 aa, Staphylococcus epidermidis
AKEIVNEQQATLDANSINQKA

SEQ ID NO: 1727481 - protein, 6 aa, Staphylococcus epidermidis
AKGNST

SEQ ID NO: 1727482 - protein, 27 aa, Staphylococcus epidermidis
AKIEAKSNITNSDTEREVNGAKTNGLE

SEQ ID NO: 1727483 - protein, 11 aa, Staphylococcus epidermidis
AKPEVDGIQEK

SEQ ID NO: 1727484 - protein, 5 aa, Staphylococcus epidermidis
AKPHN

SEQ ID NO: 1727485 - protein, 9 aa, Staphylococcus epidermidis
AKTRTEVAQ

SEQ ID NO: 1727486 - protein, 6 aa, Staphylococcus epidermidis
AKVNYD

SEQ ID NO: 1727487 - protein, 13 aa, Staphylococcus epidermidis
ALMGGGDSIATSP

SEQ ID NO: 1727488 - protein, 5 aa, Staphylococcus epidermidis
ALSTA

SEQ ID NO: 1727489 - protein, 13 aa, Staphylococcus epidermidis
ANAKQQATQTVNG

SEQ ID NO: 1727490 - protein, 48 aa, Staphylococcus epidermidis
ANKESLKEARNRLESKINETVQTDGMTQQSVENYKQAKIKAQNESSIA

SEQ ID NO: 1727491 - protein, 38 aa, Staphylococcus epidermidis
ANNPDVNAIKTNKAEAERISNDLTQAKNNLQVDTQPLE

SEQ ID NO: 1727492 - protein, 10 aa, Staphylococcus epidermidis
ANNPDVNAIR

SEQ ID NO: 1727493 - protein, 8 aa, Staphylococcus epidermidis
ANPVPSCA

SEQ ID NO: 1727494 - protein, 10 aa, Staphylococcus epidermidis
ANQSPEFGRP

SEQ ID NO: 1727495 - protein, 4 aa, Staphylococcus epidermidis
APKQ

SEQ ID NO: 1727496 - protein, 4 aa, Staphylococcus epidermidis
APQN

SEQ ID NO: 1727497 - protein, 9 aa, Staphylococcus epidermidis
APSKPKDLK

SEQ ID NO: 1727498 - protein, 20 aa, Staphylococcus epidermidis
APTRSQVGEKIASAKQLNNT

SEQ ID NO: 1727499 - protein, 13 aa, Staphylococcus epidermidis
ARPKKPENVDNKS

SEQ ID NO: 1727500 - protein, 17 aa, Staphylococcus epidermidis
ASERTIDANTSAGNTKV

SEQ ID NO: 1727501 - protein, 7 aa, Staphylococcus epidermidis
ASITDGY

SEQ ID NO: 1727502 - protein, 7 aa, Staphylococcus epidermidis
ASKGMSL

SEQ ID NO: 1727503 - protein, 14 aa, Staphylococcus epidermidis
ASREINDKAQEMTD

SEQ ID NO: 1727504 - protein, 4 aa, Staphylococcus epidermidis
ATAP

SEQ ID NO: 1727505 - protein, 5 aa, Staphylococcus epidermidis
ATATT

SEQ ID NO: 1727506 - protein, 15 aa, Staphylococcus epidermidis
ATAVKSKAKKDIDQK

SEQ ID NO: 1727507 - protein, 8 aa, Staphylococcus epidermidis
ATEQQDET

SEQ ID NO: 1727508 - protein, 6 aa, Staphylococcus epidermidis
ATFPDK

SEQ ID NO: 1727509 - protein, 10 aa, Staphylococcus epidermidis
ATGGSINPTL

SEQ ID NO: 1727510 - protein, 6 aa, Staphylococcus epidermidis
ATKQHD

SEQ ID NO: 1727511 - protein, 6 aa, Staphylococcus epidermidis
ATNGRT

SEQ ID NO: 1727512 - protein, 16 aa, Staphylococcus epidermidis
ATPNKAARSKLPKKVR

SEQ ID NO: 1727513 - protein, 7 aa, Staphylococcus epidermidis
ATPSTKI

SEQ ID NO: 1727514 - protein, 7 aa, Staphylococcus epidermidis
ATQDINT

SEQ ID NO: 1727515 - protein, 12 aa, Staphylococcus epidermidis
AVDYSTAISQEI

SEQ ID NO: 1727516 - protein, 56 aa, Staphylococcus epidermidis
AVKEEARNHDLANPSASGEDTKSKSETETEKLAAAAKAKKDRINNNNEVASNTKNL

SEQ ID NO: 1727517 - protein, 6 aa, Staphylococcus epidermidis
AVQPEL

SEQ ID NO: 1727518 - protein, 5 aa, Staphylococcus epidermidis
AVTKT

SEQ ID NO: 1727519 - protein, 5 aa, Staphylococcus epidermidis
AVTTP

SEQ ID NO: 1727520 - protein, 20 aa, Staphylococcus epidermidis
CKCDTNTSSHKNKLNIPHIK

SEQ ID NO: 1727521 - protein, 6 aa, Staphylococcus epidermidis
CSPKQY

SEQ ID NO: 1727522 - protein, 8 aa, Staphylococcus epidermidis
DAIEGGKE

SEQ ID NO: 1727523 - protein, 37 aa, Staphylococcus epidermidis
DAKDKNNHLKSTDSSATSSKTEDDDTSEKDNDDMTKD

SEQ ID NO: 1727524 - protein, 15 aa, Staphylococcus epidermidis
DAKQQLTADTTELQT

SEQ ID NO: 1727525 - protein, 17 aa, Staphylococcus epidermidis
DANISDDLADTYENKSY

SEQ ID NO: 1727526 - protein, 22 aa, Staphylococcus epidermidis
DDAKNRHLGSYEPLKKHSELEE

SEQ ID NO: 1727527 - protein, 8 aa, Staphylococcus epidermidis
DDAKRYQN

SEQ ID NO: 1727528 - protein, 26 aa, Staphylococcus epidermidis
DDALTGNDAIKQTSNYINEDTSQQVN

SEQ ID NO: 1727529 - protein, 23 aa, Staphylococcus epidermidis
DDANEKIREANTDSEVLGTKSNA

SEQ ID NO: 1727530 - protein, 9 aa, Staphylococcus epidermidis
DDKEESIPL

SEQ ID NO: 1727531 - protein, 8 aa, Staphylococcus epidermidis
DDLSEQVN

SEQ ID NO: 1727532 - protein, 8 aa, Staphylococcus epidermidis
DDNDKDTI

SEQ ID NO: 1727533 - protein, 6 aa, Staphylococcus epidermidis
DDSSMK

SEQ ID NO: 1727534 - protein, 7 aa, Staphylococcus epidermidis
DDTSKRM

SEQ ID NO: 1727535 - protein, 6 aa, Staphylococcus epidermidis
DEKGDF

SEQ ID NO: 1727536 - protein, 4 aa, Staphylococcus epidermidis
DEQQ

SEQ ID NO: 1727537 - protein, 21 aa, Staphylococcus epidermidis
DFKKVNPGKYEYKSGPKGNEK

SEQ ID NO: 1727538 - protein, 9 aa, Staphylococcus epidermidis
DGSIAEEDA

SEQ ID NO: 1727539 - protein, 8 aa, Staphylococcus epidermidis
DGSTDTTI

SEQ ID NO: 1727540 - protein, 17 aa, Staphylococcus epidermidis
DHNNEVDQALDKARPKI

SEQ ID NO: 1727541 - protein, 4 aa, Staphylococcus epidermidis
DIDN

SEQ ID NO: 1727542 - protein, 12 aa, Staphylococcus epidermidis
DIKNGIGAQPIK

SEQ ID NO: 1727543 - protein, 9 aa, Staphylococcus epidermidis
DIKQDTDRL

SEQ ID NO: 1727544 - protein, 6 aa, Staphylococcus epidermidis
DKANEI

SEQ ID NO: 1727545 - protein, 10 aa, Staphylococcus epidermidis
DKDNSKIYPS

SEQ ID NO: 1727546 - protein, 5 aa, Staphylococcus epidermidis
DKDQI

SEQ ID NO: 1727547 - protein, 6 aa, Staphylococcus epidermidis
DKEDDE

SEQ ID NO: 1727548 - protein, 10 aa, Staphylococcus epidermidis
DKENGTNKDA

SEQ ID NO: 1727549 - protein, 4 aa, Staphylococcus epidermidis
DKEV

SEQ ID NO: 1727550 - protein, 18 aa, Staphylococcus epidermidis
DKEVTFKRSNRDIPEHET

SEQ ID NO: 1727551 - protein, 9 aa, Staphylococcus epidermidis
DKITERDKK

SEQ ID NO: 1727552 - protein, 7 aa, Staphylococcus epidermidis
DKNDNYD

SEQ ID NO: 1727553 - protein, 7 aa, Staphylococcus epidermidis
DKTERPI

SEQ ID NO: 1727554 - protein, 33 aa, Staphylococcus epidermidis
DKVAEKTNVKQSSDYINDSTEHQRGYDQALQEA

SEQ ID NO: 1727555 - protein, 15 aa, Staphylococcus epidermidis
DKVEENTKDIKNNHY

SEQ ID NO: 1727556 - protein, 6 aa, Staphylococcus epidermidis
DKVETN

SEQ ID NO: 1727557 - protein, 15 aa, Staphylococcus epidermidis
DKVGQQNNVHQQSNY

SEQ ID NO: 1727558 - protein, 4 aa, Staphylococcus epidermidis
DLDD

SEQ ID NO: 1727559 - protein, 20 aa, Staphylococcus epidermidis
DLHGSNKLSEDKKEASEQLQ

SEQ ID NO: 1727560 - protein, 36 aa, Staphylococcus epidermidis
DLTDAQREKLREQINTSNSRDDIKQKIEQAKALNDA

SEQ ID NO: 1727561 - protein, 6 aa, Staphylococcus epidermidis
DMPANL

SEQ ID NO: 1727562 - protein, 12 aa, Staphylococcus epidermidis
DNEEATKEEKDI

SEQ ID NO: 1727563 - protein, 6 aa, Staphylococcus epidermidis
DNSTEV

SEQ ID NO: 1727564 - protein, 4 aa, Staphylococcus epidermidis
DPSL

SEQ ID NO: 1727565 - protein, 10 aa, Staphylococcus epidermidis
DQENIDSQGM

SEQ ID NO: 1727566 - protein, 17 aa, Staphylococcus epidermidis
DQHHRQHQYDNQRDDID

SEQ ID NO: 1727567 - protein, 12 aa, Staphylococcus epidermidis
DQIDRNTAKSNI

SEQ ID NO: 1727568 - protein, 20 aa, Staphylococcus epidermidis
DQKAEDVKRTKTALDGNQRL

SEQ ID NO: 1727569 - protein, 10 aa, Staphylococcus epidermidis
DRADATEYQK

SEQ ID NO: 1727570 - protein, 13 aa, Staphylococcus epidermidis
DRPDLGQQFKETL

SEQ ID NO: 1727571 - protein, 10 aa, Staphylococcus epidermidis
DSADPKNYQA

SEQ ID NO: 1727572 - protein, 9 aa, Staphylococcus epidermidis
DSENAIKKG

SEQ ID NO: 1727573 - protein, 10 aa, Staphylococcus epidermidis
DSIADNNEIL

SEQ ID NO: 1727574 - protein, 7 aa, Staphylococcus epidermidis
DSNNDEQ

SEQ ID NO: 1727575 - protein, 13 aa, Staphylococcus epidermidis
DSTELTTEEKDTL

SEQ ID NO: 1727576 - protein, 8 aa, Staphylococcus epidermidis
DTFPKGTW

SEQ ID NO: 1727577 - protein, 5 aa, Staphylococcus epidermidis
DTKGI

SEQ ID NO: 1727578 - protein, 7 aa, Staphylococcus epidermidis
DVDTTPR

SEQ ID NO: 1727579 - protein, 39 aa, Staphylococcus epidermidis
DVPNPTKKAEARAAVTNSANSKIKDINNNTQATLDERND

SEQ ID NO: 1727580 - protein, 8 aa, Staphylococcus epidermidis
DYQSNGNK

SEQ ID NO: 1727581 - protein, 32 aa, Staphylococcus epidermidis
EADDEATKEEEAEANENATVSTDNSNQDNNEP

SEQ ID NO: 1727582 - protein, 9 aa, Staphylococcus epidermidis
EAESINPVD

SEQ ID NO: 1727583 - protein, 9 aa, Staphylococcus epidermidis
EAGKKDSGL

SEQ ID NO: 1727584 - protein, 9 aa, Staphylococcus epidermidis
EAGQKITTI

SEQ ID NO: 1727585 - protein, 8 aa, Staphylococcus epidermidis
EAHSSDAI

SEQ ID NO: 1727586 - protein, 5 aa, Staphylococcus epidermidis
EAPLL

SEQ ID NO: 1727587 - protein, 24 aa, Staphylococcus epidermidis
EAQRNKAKENVGKASTKTNITSQL

SEQ ID NO: 1727588 - protein, 19 aa, Staphylococcus epidermidis
EAQTREKVAEQLQSAQALN

SEQ ID NO: 1727589 - protein, 21 aa, Staphylococcus epidermidis
EDAVKTGKSFAKQKKWTTPEK

SEQ ID NO: 1727590 - protein, 5 aa, Staphylococcus epidermidis
EDDMP

SEQ ID NO: 1727591 - protein, 27 aa, Staphylococcus epidermidis
EDELSHPNQTPRSSSIESQTGSSVIRP

SEQ ID NO: 1727592 - protein, 8 aa, Staphylococcus epidermidis
EDNATMDP

SEQ ID NO: 1727593 - protein, 7 aa, Staphylococcus epidermidis
EDPNYSK

SEQ ID NO: 1727594 - protein, 17 aa, Staphylococcus epidermidis
EDVHESVEKAAQIKEEH

SEQ ID NO: 1727595 - protein, 44 aa, Staphylococcus epidermidis
EEIKPGHKDEFDPNAPKGSQEDVPGKPGVKNPDTGEVVTPPVDD

SEQ ID NO: 1727596 - protein, 6 aa, Staphylococcus epidermidis
EERPLT

SEQ ID NO: 1727597 - protein, 22 aa, Staphylococcus epidermidis
EFRTSGKKKTVIAEANKNTPLG

SEQ ID NO: 1727598 - protein, 19 aa, Staphylococcus epidermidis
EGERRAKDELNKKGLSELS

SEQ ID NO: 1727599 - protein, 28 aa, Staphylococcus epidermidis
EGSYEGKTFKSNSVNVASASEKDGGVTD

SEQ ID NO: 1727600 - protein, 5 aa, Staphylococcus epidermidis
EGTNL

SEQ ID NO: 1727601 - protein, 7 aa, Staphylococcus epidermidis
EHAGPAV

SEQ ID NO: 1727602 - protein, 8 aa, Staphylococcus epidermidis
EHVRDESE

SEQ ID NO: 1727603 - protein, 19 aa, Staphylococcus epidermidis
EITKPSETTIDEEVSDDPV

SEQ ID NO: 1727604 - protein, 25 aa, Staphylococcus epidermidis
EKAKNDVNQSQTNQQVENAEQNSLD

SEQ ID NO: 1727605 - protein, 19 aa, Staphylococcus epidermidis
EKESARNAIEQKATQQTQF

SEQ ID NO: 1727606 - protein, 11 aa, Staphylococcus epidermidis
EKGPNSQSTEN

SEQ ID NO: 1727607 - protein, 13 aa, Staphylococcus epidermidis
EKGSDKKDVGKKV

SEQ ID NO: 1727608 - protein, 8 aa, Staphylococcus epidermidis
EKISKTSN

SEQ ID NO: 1727609 - protein, 53 aa, Staphylococcus epidermidis
EKLDQAINSQPSLNGMTQESINNYTTKRREAQNIASSADTIINNGDASIEQIT

SEQ ID NO: 1727610 - protein, 20 aa, Staphylococcus epidermidis
EKNSSIVNGQVPEANGASAF

SEQ ID NO: 1727611 - protein, 5 aa, Staphylococcus epidermidis
EKQRD

SEQ ID NO: 1727612 - protein, 13 aa, Staphylococcus epidermidis
EKYHDKKSKKSYK

SEQ ID NO: 1727613 - protein, 14 aa, Staphylococcus epidermidis
ELEHKGKVNYPNTE

SEQ ID NO: 1727614 - protein, 9 aa, Staphylococcus epidermidis
ELNQDNRKN

SEQ ID NO: 1727615 - protein, 13 aa, Staphylococcus epidermidis
ELSKENLNEEKPI

SEQ ID NO: 1727616 - protein, 21 aa, Staphylococcus epidermidis
EMDREEENKLKHQKFPQSMMH

SEQ ID NO: 1727617 - protein, 21 aa, Staphylococcus epidermidis
ENAQPSVQQVSDEKSKVEQAL

SEQ ID NO: 1727618 - protein, 9 aa, Staphylococcus epidermidis
ENEDQEIRY

SEQ ID NO: 1727619 - protein, 8 aa, Staphylococcus epidermidis
ENGEGLPI

SEQ ID NO: 1727620 - protein, 12 aa, Staphylococcus epidermidis
ENGESNKETKSK

SEQ ID NO: 1727621 - protein, 7 aa, Staphylococcus epidermidis
ENLRTHK

SEQ ID NO: 1727622 - protein, 23 aa, Staphylococcus epidermidis
ENNKGVYDRYNRSSQHRHDDELR

SEQ ID NO: 1727623 - protein, 6 aa, Staphylococcus epidermidis
ENPGEY

SEQ ID NO: 1727624 - protein, 10 aa, Staphylococcus epidermidis
ENSNPSVNEV

SEQ ID NO: 1727625 - protein, 4 aa, Staphylococcus epidermidis
ENSV

SEQ ID NO: 1727626 - protein, 15 aa, Staphylococcus epidermidis
ENTADVTHEERNDAI

SEQ ID NO: 1727627 - protein, 12 aa, Staphylococcus epidermidis
EPDNGYGGRQVS

SEQ ID NO: 1727628 - protein, 10 aa, Staphylococcus epidermidis
EPKQHKESNY

SEQ ID NO: 1727629 - protein, 46 aa, Staphylococcus epidermidis
EQFQQSLPSTKNQSINNNQPSTTAENNQQQSQAEGSISEAGEEANI

SEQ ID NO: 1727630 - protein, 6 aa, Staphylococcus epidermidis
EQTERR

SEQ ID NO: 1727631 - protein, 16 aa, Staphylococcus epidermidis
ESDTPHPVTKPNARQV

SEQ ID NO: 1727632 - protein, 26 aa, Staphylococcus epidermidis
ESHLNNAQKDNFKAQVNSAPNHNTLE

SEQ ID NO: 1727633 - protein, 60 aa, Staphylococcus epidermidis
ESKKHSNNPHSQKNSNQTKNITATKEDSKGKQQHTPNQNKRNKQQKVEKTSSKIEKRTFN

SEQ ID NO: 1727634 - protein, 13 aa, Staphylococcus epidermidis
ESLEKSLRESSNI

SEQ ID NO: 1727635 - protein, 6 aa, Staphylococcus epidermidis
ESQDMA

SEQ ID NO: 1727636 - protein, 16 aa, Staphylococcus epidermidis
ESTYGYRQRVRYEEQR

SEQ ID NO: 1727637 - protein, 14 aa, Staphylococcus epidermidis
ETERTNELYEDSKP

SEQ ID NO: 1727638 - protein, 8 aa, Staphylococcus epidermidis
ETLSSERI

SEQ ID NO: 1727639 - protein, 7 aa, Staphylococcus epidermidis
ETQNPEL

SEQ ID NO: 1727640 - protein, 19 aa, Staphylococcus epidermidis
ETTPIRKDTTYKLSQSIPK

SEQ ID NO: 1727641 - protein, 9 aa, Staphylococcus epidermidis
EVQQKLNEA

SEQ ID NO: 1727642 - protein, 7 aa, Staphylococcus epidermidis
EYEPKTY

SEQ ID NO: 1727643 - protein, 6 aa, Staphylococcus epidermidis
EYHQTS

SEQ ID NO: 1727644 - protein, 6 aa, Staphylococcus epidermidis
EYIGKS

SEQ ID NO: 1727645 - protein, 5 aa, Staphylococcus epidermidis
FAEQN

SEQ ID NO: 1727646 - protein, 13 aa, Staphylococcus epidermidis
FANTQKEVSPKDE

SEQ ID NO: 1727647 - protein, 32 aa, Staphylococcus epidermidis
FGEAAEPLENEIENYEPKLNEYENLKSEGNYV

SEQ ID NO: 1727648 - protein, 15 aa, Staphylococcus epidermidis
FKNQHQSRRRRNQNG

SEQ ID NO: 1727649 - protein, 7 aa, Staphylococcus epidermidis
FKNRDER

SEQ ID NO: 1727650 - protein, 10 aa, Staphylococcus epidermidis
FKNRKKNNHI

SEQ ID NO: 1727651 - protein, 16 aa, Staphylococcus epidermidis
FLSGGKDEIATKKPGM

SEQ ID NO: 1727652 - protein, 20 aa, Staphylococcus epidermidis
FNEDEQPKHNYDNSVQAGQT

SEQ ID NO: 1727653 - protein, 8 aa, Staphylococcus epidermidis
FNEEKKQT

SEQ ID NO: 1727654 - protein, 17 aa, Staphylococcus epidermidis
FNSGRPSVNEEQEDDER

SEQ ID NO: 1727655 - protein, 11 aa, Staphylococcus epidermidis
FPEISQSDDIP

SEQ ID NO: 1727656 - protein, 6 aa, Staphylococcus epidermidis
FQSSSK

SEQ ID NO: 1727657 - protein, 12 aa, Staphylococcus epidermidis
FSENGNTNKKEA

SEQ ID NO: 1727658 - protein, 29 aa, Staphylococcus epidermidis
FTVKESPNKIDAKSSDNIANKNESNSGVQ

SEQ ID NO: 1727659 - protein, 14 aa, Staphylococcus epidermidis
FYEPESRNEHGYND

SEQ ID NO: 1727660 - protein, 6 aa, Staphylococcus epidermidis
GANPNN

SEQ ID NO: 1727661 - protein, 8 aa, Staphylococcus epidermidis
GASEGEVA

SEQ ID NO: 1727662 - protein, 9 aa, Staphylococcus epidermidis
GASMHPTFE

SEQ ID NO: 1727663 - protein, 4 aa, Staphylococcus epidermidis
GDAV

SEQ ID NO: 1727664 - protein, 22 aa, Staphylococcus epidermidis
GDFSKDKSSPNHGEPHKAPRSF

SEQ ID NO: 1727665 - protein, 18 aa, Staphylococcus epidermidis
GDISNATMSHTSNDISNT

SEQ ID NO: 1727666 - protein, 9 aa, Staphylococcus epidermidis
GDKHSGETL

SEQ ID NO: 1727667 - protein, 5 aa, Staphylococcus epidermidis
GDNDT

SEQ ID NO: 1727668 - protein, 13 aa, Staphylococcus epidermidis
GEDKAFNTRTCIS

SEQ ID NO: 1727669 - protein, 7 aa, Staphylococcus epidermidis
GENYDTL

SEQ ID NO: 1727670 - protein, 7 aa, Staphylococcus epidermidis
GESTTKP

SEQ ID NO: 1727671 - protein, 22 aa, Staphylococcus epidermidis
GFKKSTTEQFNDAGAGKNQASI

SEQ ID NO: 1727672 - protein, 19 aa, Staphylococcus epidermidis
GGDSIKKLQEQATFIFHLI

SEQ ID NO: 1727673 - protein, 8 aa, Staphylococcus epidermidis
GGHTTPKG

SEQ ID NO: 1727674 - protein, 5 aa, Staphylococcus epidermidis
GGREM

SEQ ID NO: 1727675 - protein, 5 aa, Staphylococcus epidermidis
GGRID

SEQ ID NO: 1727676 - protein, 4 aa, Staphylococcus epidermidis
GGTD

SEQ ID NO: 1727677 - protein, 5 aa, Staphylococcus epidermidis
GGTGA

SEQ ID NO: 1727678 - protein, 6 aa, Staphylococcus epidermidis
GIKGKS

SEQ ID NO: 1727679 - protein, 4 aa, Staphylococcus epidermidis
GIKT

SEQ ID NO: 1727680 - protein, 5 aa, Staphylococcus epidermidis
GKDKW

SEQ ID NO: 1727681 - protein, 18 aa, Staphylococcus epidermidis
GKDTISNKAQTFNTNEAD

SEQ ID NO: 1727682 - protein, 14 aa, Staphylococcus epidermidis
GKISKQQYENAKKY

SEQ ID NO: 1727683 - protein, 5 aa, Staphylococcus epidermidis
GKKPI

SEQ ID NO: 1727684 - protein, 9 aa, Staphylococcus epidermidis
GKNKSDKHI

SEQ ID NO: 1727685 - protein, 10 aa, Staphylococcus epidermidis
GKQIKDDTDL

SEQ ID NO: 1727686 - protein, 25 aa, Staphylococcus epidermidis
GLKSGDKVLKSPKGNLNDGEKVEVS

SEQ ID NO: 1727687 - protein, 10 aa, Staphylococcus epidermidis
GLNLGRSAQD

SEQ ID NO: 1727688 - protein, 12 aa, Staphylococcus epidermidis
GLTSNEKTQFDK

SEQ ID NO: 1727689 - protein, 8 aa, Staphylococcus epidermidis
GMQAKNDG

SEQ ID NO: 1727690 - protein, 13 aa, Staphylococcus epidermidis
GNPTLNKSEIEQK

SEQ ID NO: 1727691 - protein, 9 aa, Staphylococcus epidermidis
GNVPEDKLT

SEQ ID NO: 1727692 - protein, 12 aa, Staphylococcus epidermidis
GQADRSYPYKNG

SEQ ID NO: 1727693 - protein, 4 aa, Staphylococcus epidermidis
GQNE

SEQ ID NO: 1727694 - protein, 11 aa, Staphylococcus epidermidis
GQYGLGEKGTV

SEQ ID NO: 1727695 - protein, 12 aa, Staphylococcus epidermidis
GRAKNKKDVGTA

SEQ ID NO: 1727696 - protein, 6 aa, Staphylococcus epidermidis
GREGAF

SEQ ID NO: 1727697 - protein, 5 aa, Staphylococcus epidermidis
GSENS

SEQ ID NO: 1727698 - protein, 14 aa, Staphylococcus epidermidis
GSFARQKKSIATLK

SEQ ID NO: 1727699 - protein, 8 aa, Staphylococcus epidermidis
GSGSTFEQ

SEQ ID NO: 1727700 - protein, 11 aa, Staphylococcus epidermidis
GSISQDQFDTQ

SEQ ID NO: 1727701 - protein, 19 aa, Staphylococcus epidermidis
GSITESSTYGDNDHPAPIT

SEQ ID NO: 1727702 - protein, 6 aa, Staphylococcus epidermidis
GSPQSM

SEQ ID NO: 1727703 - protein, 5 aa, Staphylococcus epidermidis
GSTIP

SEQ ID NO: 1727704 - protein, 25 aa, Staphylococcus epidermidis
GTGVEPGKINKETQQPKLHKNDNDS

SEQ ID NO: 1727705 - protein, 6 aa, Staphylococcus epidermidis
GTPNDI

SEQ ID NO: 1727706 - protein, 16 aa, Staphylococcus epidermidis
GTVIPNTNTTIDSNGI

SEQ ID NO: 1727707 - protein, 7 aa, Staphylococcus epidermidis
HAEGNHP

SEQ ID NO: 1727708 - protein, 5 aa, Staphylococcus epidermidis
HAKPP

SEQ ID NO: 1727709 - protein, 13 aa, Staphylococcus epidermidis
HANPTRKSDALQE

SEQ ID NO: 1727710 - protein, 6 aa, Staphylococcus epidermidis
HANQTI

SEQ ID NO: 1727711 - protein, 15 aa, Staphylococcus epidermidis
HDKVTETLRPDKDKK

SEQ ID NO: 1727712 - protein, 5 aa, Staphylococcus epidermidis
HDTVS

SEQ ID NO: 1727713 - protein, 11 aa, Staphylococcus epidermidis
HEKDRTSLKSE

SEQ ID NO: 1727714 - protein, 4 aa, Staphylococcus epidermidis
HELR

SEQ ID NO: 1727715 - protein, 8 aa, Staphylococcus epidermidis
HEQKQKEV

SEQ ID NO: 1727716 - protein, 5 aa, Staphylococcus epidermidis
HKKPL

SEQ ID NO: 1727717 - protein, 17 aa, Staphylococcus epidermidis
HKPEPSTSGDRRSKPRR

SEQ ID NO: 1727718 - protein, 15 aa, Staphylococcus epidermidis
HLKTSTQRKSENQIE

SEQ ID NO: 1727719 - protein, 26 aa, Staphylococcus epidermidis
HNNDQDAVERKEKETEFQKQQDEEIA

SEQ ID NO: 1727720 - protein, 67 aa, Staphylococcus epidermidis
HPGQATASELEPSQNNDTTAQSDGGLENTSQSNPISEETTNTLSGQTVPSSTENKQTQNVPNHNAQP

SEQ ID NO: 1727721 - protein, 25 aa, Staphylococcus epidermidis
HQNITQKVSQKNNTLYSQPSNDKSY

SEQ ID NO: 1727722 - protein, 17 aa, Staphylococcus epidermidis
HQQTHQNINQSTQDNRN

SEQ ID NO: 1727723 - protein, 9 aa, Staphylococcus epidermidis
HQSSTDPLK

SEQ ID NO: 1727724 - protein, 4 aa, Staphylococcus epidermidis
HREE

SEQ ID NO: 1727725 - protein, 5 aa, Staphylococcus epidermidis
HSTDN

SEQ ID NO: 1727726 - protein, 9 aa, Staphylococcus epidermidis
HTEDRTYHT

SEQ ID NO: 1727727 - protein, 11 aa, Staphylococcus epidermidis
HTGKQSEGASD

SEQ ID NO: 1727728 - protein, 10 aa, Staphylococcus epidermidis
HTHHANEKQF

SEQ ID NO: 1727729 - protein, 15 aa, Staphylococcus epidermidis
HTTDEVNNIKNQAVQ

SEQ ID NO: 1727730 - protein, 4 aa, Staphylococcus epidermidis
IADR

SEQ ID NO: 1727731 - protein, 6 aa, Staphylococcus epidermidis
IAGPSS

SEQ ID NO: 1727732 - protein, 4 aa, Staphylococcus epidermidis
IAMT

SEQ ID NO: 1727733 - protein, 17 aa, Staphylococcus epidermidis
IATEGSGETISTSATSE

SEQ ID NO: 1727734 - protein, 6 aa, Staphylococcus epidermidis
IDEDSD

SEQ ID NO: 1727735 - protein, 8 aa, Staphylococcus epidermidis
IDGENSGA

SEQ ID NO: 1727736 - protein, 13 aa, Staphylococcus epidermidis
IDNDDSNMQLVKE

SEQ ID NO: 1727737 - protein, 21 aa, Staphylococcus epidermidis
IDNGDATTQEITSEKSKVEQA

SEQ ID NO: 1727738 - protein, 4 aa, Staphylococcus epidermidis
IDQA

SEQ ID NO: 1727739 - protein, 4 aa, Staphylococcus epidermidis
IDSQ

SEQ ID NO: 1727740 - protein, 13 aa, Staphylococcus epidermidis
IDTTEGEPTDNDG

SEQ ID NO: 1727741 - protein, 8 aa, Staphylococcus epidermidis
IEKAKSLN

SEQ ID NO: 1727742 - protein, 18 aa, Staphylococcus epidermidis
IEKTQGGAMNSEPGGTSE

SEQ ID NO: 1727743 - protein, 6 aa, Staphylococcus epidermidis
IENNGN

SEQ ID NO: 1727744 - protein, 7 aa, Staphylococcus epidermidis
IERNNGE

SEQ ID NO: 1727745 - protein, 8 aa, Staphylococcus epidermidis
IERSRPEN

SEQ ID NO: 1727746 - protein, 5 aa, Staphylococcus epidermidis
IGMSP

SEQ ID NO: 1727747 - protein, 5 aa, Staphylococcus epidermidis
IGQKP

SEQ ID NO: 1727748 - protein, 20 aa, Staphylococcus epidermidis
IGRTTTKPAVTQKLEEAKAI

SEQ ID NO: 1727749 - protein, 4 aa, Staphylococcus epidermidis
IHDG

SEQ ID NO: 1727750 - protein, 4 aa, Staphylococcus epidermidis
IIAK

SEQ ID NO: 1727751 - protein, 11 aa, Staphylococcus epidermidis
IKASNNSDVPN

SEQ ID NO: 1727752 - protein, 15 aa, Staphylococcus epidermidis
IKDKPTKSKDPKDHS

SEQ ID NO: 1727753 - protein, 8 aa, Staphylococcus epidermidis
IKEGDEVN

SEQ ID NO: 1727754 - protein, 14 aa, Staphylococcus epidermidis
IKGNDPNDHDGFNG

SEQ ID NO: 1727755 - protein, 11 aa, Staphylococcus epidermidis
IKNKADTLNQS

SEQ ID NO: 1727756 - protein, 9 aa, Staphylococcus epidermidis
IKNQAKNKF

SEQ ID NO: 1727757 - protein, 11 aa, Staphylococcus epidermidis
IKNSDGDTIPP

SEQ ID NO: 1727758 - protein, 12 aa, Staphylococcus epidermidis
IKTSTNRSRPEV

SEQ ID NO: 1727759 - protein, 16 aa, Staphylococcus epidermidis
IKYENSGPLTWPIKKA

SEQ ID NO: 1727760 - protein, 26 aa, Staphylococcus epidermidis
INATPNATEEEKQDAIQRLNGKRDEV

SEQ ID NO: 1727761 - protein, 46 aa, Staphylococcus epidermidis
INGTNQPTINKGNVTTATQTVKNTKDALDGDHRLEEAKNNANQTIR

SEQ ID NO: 1727762 - protein, 23 aa, Staphylococcus epidermidis
INHSPNINSVNQAKEKANTVNTA

SEQ ID NO: 1727763 - protein, 20 aa, Staphylococcus epidermidis
INNGDATEQQITNETNRVNQ

SEQ ID NO: 1727764 - protein, 16 aa, Staphylococcus epidermidis
INNSSNPNLNAQDITN

SEQ ID NO: 1727765 - protein, 17 aa, Staphylococcus epidermidis
INQAQTNQNVDTALTSG

SEQ ID NO: 1727766 - protein, 16 aa, Staphylococcus epidermidis
INQSDANQAQLDPAEI

SEQ ID NO: 1727767 - protein, 32 aa, Staphylococcus epidermidis
INQTVQTDGMTQQSIEAYQNAKRVAQNESNTA

SEQ ID NO: 1727768 - protein, 27 aa, Staphylococcus epidermidis
INTTQTALSGENKLHTDQESTNRQIEG

SEQ ID NO: 1727769 - protein, 15 aa, Staphylococcus epidermidis
IPDDSLKPTDSSEYK

SEQ ID NO: 1727770 - protein, 24 aa, Staphylococcus epidermidis
IPDEYAKEVSEEARNEQLPEGKTA

SEQ ID NO: 1727771 - protein, 16 aa, Staphylococcus epidermidis
IPNITTDKRDDVPQSL

SEQ ID NO: 1727772 - protein, 9 aa, Staphylococcus epidermidis
IQDKYNNPL

SEQ ID NO: 1727773 - protein, 8 aa, Staphylococcus epidermidis
IQKGTQSI

SEQ ID NO: 1727774 - protein, 10 aa, Staphylococcus epidermidis
IQPGQQTEKF

SEQ ID NO: 1727775 - protein, 11 aa, Staphylococcus epidermidis
IRAKRDKFKQK

SEQ ID NO: 1727776 - protein, 9 aa, Staphylococcus epidermidis
IRDDGEKSY

SEQ ID NO: 1727777 - protein, 14 aa, Staphylococcus epidermidis
IRDRVKDKASGRKT

SEQ ID NO: 1727778 - protein, 22 aa, Staphylococcus epidermidis
IRQNTDEANAHKQALDTARSQL

SEQ ID NO: 1727779 - protein, 8 aa, Staphylococcus epidermidis
ISGGSLDG

SEQ ID NO: 1727780 - protein, 16 aa, Staphylococcus epidermidis
ISSNMSRDQEESHKSN

SEQ ID NO: 1727781 - protein, 7 aa, Staphylococcus epidermidis
ISTPREV

SEQ ID NO: 1727782 - protein, 7 aa, Staphylococcus epidermidis
ITECTGS

SEQ ID NO: 1727783 - protein, 7 aa, Staphylococcus epidermidis
ITGTRGA

SEQ ID NO: 1727784 - protein, 7 aa, Staphylococcus epidermidis
ITGYPNT

SEQ ID NO: 1727785 - protein, 29 aa, Staphylococcus epidermidis
IYSNKDNELLTEKPKDFDKNKKQVEKDLE

SEQ ID NO: 1727786 - protein, 9 aa, Staphylococcus epidermidis
KAAKNKKNV

SEQ ID NO: 1727787 - protein, 8 aa, Staphylococcus epidermidis
KAKGTHSL

SEQ ID NO: 1727788 - protein, 10 aa, Staphylococcus epidermidis
KAQKGAQSHY

SEQ ID NO: 1727789 - protein, 52 aa, Staphylococcus epidermidis
KARVGDYQEAAGRAQDVNNQANQNLRNQTSTTPQSAIKSSHSEGKSHSSIKT

SEQ ID NO: 1727790 - protein, 11 aa, Staphylococcus epidermidis
KATDKSGNESI

SEQ ID NO: 1727791 - protein, 5 aa, Staphylococcus epidermidis
KAYHP

SEQ ID NO: 1727792 - protein, 5 aa, Staphylococcus epidermidis
KDAIK

SEQ ID NO: 1727793 - protein, 17 aa, Staphylococcus epidermidis
KDAQTKAHNDIKDTLKR

SEQ ID NO: 1727794 - protein, 11 aa, Staphylococcus epidermidis
KDASSISDREL

SEQ ID NO: 1727795 - protein, 9 aa, Staphylococcus epidermidis
KDDASRQST

SEQ ID NO: 1727796 - protein, 8 aa, Staphylococcus epidermidis
KDDPEELG

SEQ ID NO: 1727797 - protein, 9 aa, Staphylococcus epidermidis
KDDTSQCPN

SEQ ID NO: 1727798 - protein, 5 aa, Staphylococcus epidermidis
KDIPS

SEQ ID NO: 1727799 - protein, 6 aa, Staphylococcus epidermidis
KDIQNA

SEQ ID NO: 1727800 - protein, 4 aa, Staphylococcus epidermidis
KDKD

SEQ ID NO: 1727801 - protein, 7 aa, Staphylococcus epidermidis
KDKDKII

SEQ ID NO: 1727802 - protein, 8 aa, Staphylococcus epidermidis
KDKEMSHS

SEQ ID NO: 1727803 - protein, 5 aa, Staphylococcus epidermidis
KDKGL

SEQ ID NO: 1727804 - protein, 8 aa, Staphylococcus epidermidis
KDNTHSNE

SEQ ID NO: 1727805 - protein, 8 aa, Staphylococcus epidermidis
KDRKDIQV

SEQ ID NO: 1727806 - protein, 8 aa, Staphylococcus epidermidis
KDSLHGAN

SEQ ID NO: 1727807 - protein, 8 aa, Staphylococcus epidermidis
KDVTDNHN

SEQ ID NO: 1727808 - protein, 47 aa, Staphylococcus epidermidis
KEAEQEQKEQETSRDVSQQNVEQQTSSKDENNEQYEGKKQGHREEDD

SEQ ID NO: 1727809 - protein, 12 aa, Staphylococcus epidermidis
KEDKQRNRAENI

SEQ ID NO: 1727810 - protein, 7 aa, Staphylococcus epidermidis
KEEIESG

SEQ ID NO: 1727811 - protein, 43 aa, Staphylococcus epidermidis
KEFGPYPKTKDITISATGKAKGKTFSSETKTISADDLKDNTKV

SEQ ID NO: 1727812 - protein, 6 aa, Staphylococcus epidermidis
KEKLSK

SEQ ID NO: 1727813 - protein, 24 aa, Staphylococcus epidermidis
KELDTAKADASSTLRNTNPSVEQV

SEQ ID NO: 1727814 - protein, 46 aa, Staphylococcus epidermidis
KEPLETAKNQLQANIDQKPSTDGMTQQSVQSYERKLQEAKDKINSI

SEQ ID NO: 1727815 - protein, 10 aa, Staphylococcus epidermidis
KEQNPSVADV

SEQ ID NO: 1727816 - protein, 37 aa, Staphylococcus epidermidis
KEQVAQKDGVHANSDYTNEDSAQKDAYNNALKQAEDI

SEQ ID NO: 1727817 - protein, 7 aa, Staphylococcus epidermidis
KGAKFNE

SEQ ID NO: 1727818 - protein, 7 aa, Staphylococcus epidermidis
KGDSNAI

SEQ ID NO: 1727819 - protein, 22 aa, Staphylococcus epidermidis
KGQEIINSENNPTISSTDINRT

SEQ ID NO: 1727820 - protein, 5 aa, Staphylococcus epidermidis
KGQNF

SEQ ID NO: 1727821 - protein, 4 aa, Staphylococcus epidermidis
KHGV

SEQ ID NO: 1727822 - protein, 7 aa, Staphylococcus epidermidis
KHLSAAQ

SEQ ID NO: 1727823 - protein, 76 aa, Staphylococcus epidermidis
KIAKENDPAYIEKKGEKLAKQNRKEADKMDKKLQKNIEKRHKEEQKQREANQKQRIKDMKKTQKYEEQVGLTPGKI

SEQ ID NO: 1727824 - protein, 18 aa, Staphylococcus epidermidis
KIDKEEQIQNDDKHSIPV

SEQ ID NO: 1727825 - protein, 7 aa, Staphylococcus epidermidis
KIEQSSN

SEQ ID NO: 1727826 - protein, 21 aa, Staphylococcus epidermidis
KIGEAETDTTVNEARDNGTKL

SEQ ID NO: 1727827 - protein, 8 aa, Staphylococcus epidermidis
KIGESSSH

SEQ ID NO: 1727828 - protein, 18 aa, Staphylococcus epidermidis
KINSYVEKKEKEENSLKN

SEQ ID NO: 1727829 - protein, 11 aa, Staphylococcus epidermidis
KITEAKNDLHG

SEQ ID NO: 1727830 - protein, 7 aa, Staphylococcus epidermidis
KKAPGHA

SEQ ID NO: 1727831 - protein, 25 aa, Staphylococcus epidermidis
KKDDAKSLSKQLTSNDHRLNEEEAR

SEQ ID NO: 1727832 - protein, 6 aa, Staphylococcus epidermidis
KKEQSF

SEQ ID NO: 1727833 - protein, 12 aa, Staphylococcus epidermidis
KKFRQKGGHAES

SEQ ID NO: 1727834 - protein, 15 aa, Staphylococcus epidermidis
KKGNGKQHHYDEHHR

SEQ ID NO: 1727835 - protein, 6 aa, Staphylococcus epidermidis
KKIEDN

SEQ ID NO: 1727836 - protein, 6 aa, Staphylococcus epidermidis
KKIKNN

SEQ ID NO: 1727837 - protein, 8 aa, Staphylococcus epidermidis
KKKGVDTV

SEQ ID NO: 1727838 - protein, 22 aa, Staphylococcus epidermidis
KKKKRKIKDQSSQSSNENSTNI

SEQ ID NO: 1727839 - protein, 8 aa, Staphylococcus epidermidis
KKNSGQSA

SEQ ID NO: 1727840 - protein, 17 aa, Staphylococcus epidermidis
KKQASASESSQSQSQFA

SEQ ID NO: 1727841 - protein, 23 aa, Staphylococcus epidermidis
KKQIKQQKSITTNVTSLEKLNDD

SEQ ID NO: 1727842 - protein, 8 aa, Staphylococcus epidermidis
KKRPTGKQ

SEQ ID NO: 1727843 - protein, 13 aa, Staphylococcus epidermidis
KKSRKDDDDQDGS

SEQ ID NO: 1727844 - protein, 4 aa, Staphylococcus epidermidis
KLEQ

SEQ ID NO: 1727845 - protein, 8 aa, Staphylococcus epidermidis
KLGSEPSI

SEQ ID NO: 1727846 - protein, 8 aa, Staphylococcus epidermidis
KLKNDDVT

SEQ ID NO: 1727847 - protein, 7 aa, Staphylococcus epidermidis
KLNPQGL

SEQ ID NO: 1727848 - protein, 8 aa, Staphylococcus epidermidis
KLTPSQQT

SEQ ID NO: 1727849 - protein, 9 aa, Staphylococcus epidermidis
KMTTQNNYE

SEQ ID NO: 1727850 - protein, 21 aa, Staphylococcus epidermidis
KNDHTNDSAFNGTAKDETTAM

SEQ ID NO: 1727851 - protein, 7 aa, Staphylococcus epidermidis
KNEFKTY

SEQ ID NO: 1727852 - protein, 6 aa, Staphylococcus epidermidis
KNEHLK

SEQ ID NO: 1727853 - protein, 6 aa, Staphylococcus epidermidis
KNEPKV

SEQ ID NO: 1727854 - protein, 4 aa, Staphylococcus epidermidis
KNGV

SEQ ID NO: 1727855 - protein, 19 aa, Staphylococcus epidermidis
KNHQPNLKSGHYPKNGNQI

SEQ ID NO: 1727856 - protein, 9 aa, Staphylococcus epidermidis
KNKSPQQLK

SEQ ID NO: 1727857 - protein, 12 aa, Staphylococcus epidermidis
KNNAESLADRQR

SEQ ID NO: 1727858 - protein, 15 aa, Staphylococcus epidermidis
KNNKESTVEEKASAI

SEQ ID NO: 1727859 - protein, 9 aa, Staphylococcus epidermidis
KNPEQHQSS

SEQ ID NO: 1727860 - protein, 14 aa, Staphylococcus epidermidis
KNPTQLEQGHKEPK

SEQ ID NO: 1727861 - protein, 38 aa, Staphylococcus epidermidis
KNQLQQSVNDQPLTTGMTQDSINNYEAKRNEAQSAIRN

SEQ ID NO: 1727862 - protein, 16 aa, Staphylococcus epidermidis
KPQTQNDQINSQYSND

SEQ ID NO: 1727863 - protein, 4 aa, Staphylococcus epidermidis
KPSE

SEQ ID NO: 1727864 - protein, 36 aa, Staphylococcus epidermidis
KPTAINSLTQEANNQKTLIGNDGNATDDEKEAAKQL

SEQ ID NO: 1727865 - protein, 34 aa, Staphylococcus epidermidis
KPTAKSKIESAVEKKKTEINQTQNATHDEVREGL

SEQ ID NO: 1727866 - protein, 11 aa, Staphylococcus epidermidis
KQDGDQLNSRI

SEQ ID NO: 1727867 - protein, 4 aa, Staphylococcus epidermidis
KQDL

SEQ ID NO: 1727868 - protein, 23 aa, Staphylococcus epidermidis
KQDYKDKKGDSTRNHSPNSEYEE

SEQ ID NO: 1727869 - protein, 8 aa, Staphylococcus epidermidis
KQESLAQT

SEQ ID NO: 1727870 - protein, 17 aa, Staphylococcus epidermidis
KQGNALPTNLAGGSTSH

SEQ ID NO: 1727871 - protein, 17 aa, Staphylococcus epidermidis
KQKLEQNKDNSELLTEE

SEQ ID NO: 1727872 - protein, 21 aa, Staphylococcus epidermidis
KQKSLDNINSLSSNNDVENAK

SEQ ID NO: 1727873 - protein, 13 aa, Staphylococcus epidermidis
KQNEELDEKQPEL

SEQ ID NO: 1727874 - protein, 12 aa, Staphylococcus epidermidis
KQVDPGKAIMTI

SEQ ID NO: 1727875 - protein, 10 aa, Staphylococcus epidermidis
KRGDPDSNYT

SEQ ID NO: 1727876 - protein, 7 aa, Staphylococcus epidermidis
KRKNNRS

SEQ ID NO: 1727877 - protein, 16 aa, Staphylococcus epidermidis
KSDYNKNNKKIKLDDD

SEQ ID NO: 1727878 - protein, 5 aa, Staphylococcus epidermidis
KSGSG

SEQ ID NO: 1727879 - protein, 7 aa, Staphylococcus epidermidis
KSIPGHG

SEQ ID NO: 1727880 - protein, 30 aa, Staphylococcus epidermidis
KSKIIGKNDQTQDDIEEGKFDAEGGATVNN

SEQ ID NO: 1727881 - protein, 9 aa, Staphylococcus epidermidis
KSKTHEKSR

SEQ ID NO: 1727882 - protein, 15 aa, Staphylococcus epidermidis
KSNDKVKTQTRRERH

SEQ ID NO: 1727883 - protein, 12 aa, Staphylococcus epidermidis
KSQADSESFSKN

SEQ ID NO: 1727884 - protein, 16 aa, Staphylococcus epidermidis
KSQANTDFKPNPNLLS

SEQ ID NO: 1727885 - protein, 11 aa, Staphylococcus epidermidis
KSRGSEISSGS

SEQ ID NO: 1727886 - protein, 5 aa, Staphylococcus epidermidis
KSSLA

SEQ ID NO: 1727887 - protein, 47 aa, Staphylococcus epidermidis
KSSSNHASESIKQKREQNKIKKEEKAQLKEAKIERKKQKKSRQNNNV

SEQ ID NO: 1727888 - protein, 5 aa, Staphylococcus epidermidis
KSTNL

SEQ ID NO: 1727889 - protein, 8 aa, Staphylococcus epidermidis
KTEDISHG

SEQ ID NO: 1727890 - protein, 32 aa, Staphylococcus epidermidis
KTEINKKEQIKADSRYVNADSGLQANYNSALN

SEQ ID NO: 1727891 - protein, 20 aa, Staphylococcus epidermidis
KTPGREDKKSSVTTTSASQL

SEQ ID NO: 1727892 - protein, 6 aa, Staphylococcus epidermidis
KTQRTA

SEQ ID NO: 1727893 - protein, 7 aa, Staphylococcus epidermidis
KTRKEYR

SEQ ID NO: 1727894 - protein, 13 aa, Staphylococcus epidermidis
KVQSDNQSLDSNY

SEQ ID NO: 1727895 - protein, 14 aa, Staphylococcus epidermidis
KVTENEIQASQAMD

SEQ ID NO: 1727896 - protein, 40 aa, Staphylococcus epidermidis
KVTNATSKATSKTTSAISNKASDVKEYVGDKKQEFDNKRE

SEQ ID NO: 1727897 - protein, 81 aa, Staphylococcus epidermidis
KVVKNENSDYSDGKYGKSYNDIRKEQLEDDDKEDDDNHEKDEVNQDNTDREADNTSHTNEPGHQQSPNIDKPYNPNDPNHR

SEQ ID NO: 1727898 - protein, 4 aa, Staphylococcus epidermidis
LAER

SEQ ID NO: 1727899 - protein, 5 aa, Staphylococcus epidermidis
LASGV

SEQ ID NO: 1727900 - protein, 25 aa, Staphylococcus epidermidis
LDEKYDDSDDESDNDSSSGEVTREN

SEQ ID NO: 1727901 - protein, 5 aa, Staphylococcus epidermidis
LDQGN

SEQ ID NO: 1727902 - protein, 29 aa, Staphylococcus epidermidis
LDTNRKPFVAQGGSKKHDDNEEKLSPGKA

SEQ ID NO: 1727903 - protein, 6 aa, Staphylococcus epidermidis
LEEKNK

SEQ ID NO: 1727904 - protein, 12 aa, Staphylococcus epidermidis
LEEREKQDEQDN

SEQ ID NO: 1727905 - protein, 12 aa, Staphylococcus epidermidis
LETAQNNLHGDQ

SEQ ID NO: 1727906 - protein, 5 aa, Staphylococcus epidermidis
LGATN

SEQ ID NO: 1727907 - protein, 8 aa, Staphylococcus epidermidis
LGGQPTVA

SEQ ID NO: 1727908 - protein, 6 aa, Staphylococcus epidermidis
LGNPKL

SEQ ID NO: 1727909 - protein, 4 aa, Staphylococcus epidermidis
LGSK

SEQ ID NO: 1727910 - protein, 13 aa, Staphylococcus epidermidis
LGTDFKGSVSQGI

SEQ ID NO: 1727911 - protein, 9 aa, Staphylococcus epidermidis
LIDGDGPGG

SEQ ID NO: 1727912 - protein, 8 aa, Staphylococcus epidermidis
LKAYEPEQ

SEQ ID NO: 1727913 - protein, 22 aa, Staphylococcus epidermidis
LKGETKTKYDAMKKDNTETTNK

SEQ ID NO: 1727914 - protein, 9 aa, Staphylococcus epidermidis
LKNQKQANE

SEQ ID NO: 1727915 - protein, 11 aa, Staphylococcus epidermidis
LKPEHRDDSFK

SEQ ID NO: 1727916 - protein, 9 aa, Staphylococcus epidermidis
LKSPLDREQ

SEQ ID NO: 1727917 - protein, 21 aa, Staphylococcus epidermidis
LNDAQRQKAIENVQAQQTIPA

SEQ ID NO: 1727918 - protein, 12 aa, Staphylococcus epidermidis
LNDAQRQTLTDT

SEQ ID NO: 1727919 - protein, 9 aa, Staphylococcus epidermidis
LNGQKGHKK

SEQ ID NO: 1727920 - protein, 8 aa, Staphylococcus epidermidis
LNHVPGET

SEQ ID NO: 1727921 - protein, 22 aa, Staphylococcus epidermidis
LNNAQKDAEKNLVNSASTLEQV

SEQ ID NO: 1727922 - protein, 18 aa, Staphylococcus epidermidis
LNNSINNTPYATEEERQI

SEQ ID NO: 1727923 - protein, 6 aa, Staphylococcus epidermidis
LNPGQV

SEQ ID NO: 1727924 - protein, 11 aa, Staphylococcus epidermidis
LNQETNGVNDR

SEQ ID NO: 1727925 - protein, 8 aa, Staphylococcus epidermidis
LNQPQSRN

SEQ ID NO: 1727926 - protein, 17 aa, Staphylococcus epidermidis
LNRRGDTNNKKPRSINA

SEQ ID NO: 1727927 - protein, 7 aa, Staphylococcus epidermidis
LNSGPEL

SEQ ID NO: 1727928 - protein, 5 aa, Staphylococcus epidermidis
LNSSA

SEQ ID NO: 1727929 - protein, 6 aa, Staphylococcus epidermidis
LNSTTT

SEQ ID NO: 1727930 - protein, 8 aa, Staphylococcus epidermidis
LPDKNGDI

SEQ ID NO: 1727931 - protein, 4 aa, Staphylococcus epidermidis
LPQG

SEQ ID NO: 1727932 - protein, 50 aa, Staphylococcus epidermidis
LPTSYDTSDDSTASSAQAGAQGDSEEGTEMTTSNPTINQPTGGKSGETSK

SEQ ID NO: 1727933 - protein, 7 aa, Staphylococcus epidermidis
LSDTDKI

SEQ ID NO: 1727934 - protein, 13 aa, Staphylococcus epidermidis
LSNATEQSTRQRI

SEQ ID NO: 1727935 - protein, 18 aa, Staphylococcus epidermidis
LSRKISSKQLTIDEAKSE

SEQ ID NO: 1727936 - protein, 10 aa, Staphylococcus epidermidis
LSRSKQDNIS

SEQ ID NO: 1727937 - protein, 9 aa, Staphylococcus epidermidis
LSSENPPAS

SEQ ID NO: 1727938 - protein, 40 aa, Staphylococcus epidermidis
LSSQRSSTSMTEKSNQCYSSENNTIKSLPEAGNADKSLPL

SEQ ID NO: 1727939 - protein, 9 aa, Staphylococcus epidermidis
LSTAGGNSE

SEQ ID NO: 1727940 - protein, 12 aa, Staphylococcus epidermidis
LSYDKSNANDEI

SEQ ID NO: 1727941 - protein, 12 aa, Staphylococcus epidermidis
LTATSSVENAHQ

SEQ ID NO: 1727942 - protein, 7 aa, Staphylococcus epidermidis
LTEEQKN

SEQ ID NO: 1727943 - protein, 8 aa, Staphylococcus epidermidis
LTEPQKQA

SEQ ID NO: 1727944 - protein, 6 aa, Staphylococcus epidermidis
LTNDEI

SEQ ID NO: 1727945 - protein, 12 aa, Staphylococcus epidermidis
LTNDKKPASVRR

SEQ ID NO: 1727946 - protein, 6 aa, Staphylococcus epidermidis
LTPALP

SEQ ID NO: 1727947 - protein, 17 aa, Staphylococcus epidermidis
LTQASENLDGDQRVEEA

SEQ ID NO: 1727948 - protein, 18 aa, Staphylococcus epidermidis
LTSDGKTKENKKDNDVYT

SEQ ID NO: 1727949 - protein, 13 aa, Staphylococcus epidermidis
LTSEYGEKYPADV

SEQ ID NO: 1727950 - protein, 9 aa, Staphylococcus epidermidis
LTTANERLD

SEQ ID NO: 1727951 - protein, 9 aa, Staphylococcus epidermidis
MAKRQSEDI

SEQ ID NO: 1727952 - protein, 12 aa, Staphylococcus epidermidis
MEAPKNNPFKQE

SEQ ID NO: 1727953 - protein, 11 aa, Staphylococcus epidermidis
MNQTKNDDQRI

SEQ ID NO: 1727954 - protein, 24 aa, Staphylococcus epidermidis
MSKGHTDVSQESSNGEEQVTQEHS

SEQ ID NO: 1727955 - protein, 9 aa, Staphylococcus epidermidis
MSNQDRKYV

SEQ ID NO: 1727956 - protein, 9 aa, Staphylococcus epidermidis
MTMGDSNNI

SEQ ID NO: 1727957 - protein, 19 aa, Staphylococcus epidermidis
MTREEVEDKFGTSNGSVES

SEQ ID NO: 1727958 - protein, 10 aa, Staphylococcus epidermidis
MTRSNDKYVS

SEQ ID NO: 1727959 - protein, 11 aa, Staphylococcus epidermidis
MTTPKSKEQLQ

SEQ ID NO: 1727960 - protein, 18 aa, Staphylococcus epidermidis
NAEEQNEAWNKNQTETQL

SEQ ID NO: 1727961 - protein, 19 aa, Staphylococcus epidermidis
NAEHTTQGVKTIKDDAITS

SEQ ID NO: 1727962 - protein, 19 aa, Staphylococcus epidermidis
NAKDQLNGERRLKEHQQKS

SEQ ID NO: 1727963 - protein, 33 aa, Staphylococcus epidermidis
NAKQEIEQDAQSQIDTINANNKSTNEEKSAAID

SEQ ID NO: 1727964 - protein, 21 aa, Staphylococcus epidermidis
NALDGEEQLRRAKENADQEIN

SEQ ID NO: 1727965 - protein, 8 aa, Staphylococcus epidermidis
NAQKQSIK

SEQ ID NO: 1727966 - protein, 53 aa, Staphylococcus epidermidis
NARTSLVPDKTQLQEAKNRLENSINQQTDTDGMTQDSLNNYNDKLAKARQNLE

SEQ ID NO: 1727967 - protein, 7 aa, Staphylococcus epidermidis
NASQQNV

SEQ ID NO: 1727968 - protein, 11 aa, Staphylococcus epidermidis
NDAKNSGNTSI

SEQ ID NO: 1727969 - protein, 17 aa, Staphylococcus epidermidis
NDGVEALTDEILKNIKK

SEQ ID NO: 1727970 - protein, 5 aa, Staphylococcus epidermidis
NDIET

SEQ ID NO: 1727971 - protein, 5 aa, Staphylococcus epidermidis
NDKSQ

SEQ ID NO: 1727972 - protein, 12 aa, Staphylococcus epidermidis
NDTTANEKEINE

SEQ ID NO: 1727973 - protein, 16 aa, Staphylococcus epidermidis
NDTTTHAAEVTSHDAQ

SEQ ID NO: 1727974 - protein, 5 aa, Staphylococcus epidermidis
NEAAR

SEQ ID NO: 1727975 - protein, 9 aa, Staphylococcus epidermidis
NEAKSLNNA

SEQ ID NO: 1727976 - protein, 17 aa, Staphylococcus epidermidis
NEDEAAQNEYSNALQKA

SEQ ID NO: 1727977 - protein, 8 aa, Staphylococcus epidermidis
NEKQGMPM

SEQ ID NO: 1727978 - protein, 13 aa, Staphylococcus epidermidis
NELNSTKTNTDRI

SEQ ID NO: 1727979 - protein, 4 aa, Staphylococcus epidermidis
NEQS

SEQ ID NO: 1727980 - protein, 7 aa, Staphylococcus epidermidis
NEQSLNS

SEQ ID NO: 1727981 - protein, 8 aa, Staphylococcus epidermidis
NESVSQSP

SEQ ID NO: 1727982 - protein, 7 aa, Staphylococcus epidermidis
NFGEGYN

SEQ ID NO: 1727983 - protein, 9 aa, Staphylococcus epidermidis
NFKREKDSR

SEQ ID NO: 1727984 - protein, 6 aa, Staphylococcus epidermidis
NFQNRT

SEQ ID NO: 1727985 - protein, 24 aa, Staphylococcus epidermidis
NGDADEQQITTETDRVNQQTTNLT

SEQ ID NO: 1727986 - protein, 18 aa, Staphylococcus epidermidis
NGDATAQDISSEKSKVEQ

SEQ ID NO: 1727987 - protein, 9 aa, Staphylococcus epidermidis
NGKDMSNSV

SEQ ID NO: 1727988 - protein, 21 aa, Staphylococcus epidermidis
NGLNGDQKLQDAKTDAKQQIT

SEQ ID NO: 1727989 - protein, 6 aa, Staphylococcus epidermidis
NGQTEN

SEQ ID NO: 1727990 - protein, 6 aa, Staphylococcus epidermidis
NGSNVS

SEQ ID NO: 1727991 - protein, 13 aa, Staphylococcus epidermidis
NGVPSSTLDKATI

SEQ ID NO: 1727992 - protein, 13 aa, Staphylococcus epidermidis
NGYEPPYRRQSKE

SEQ ID NO: 1727993 - protein, 12 aa, Staphylococcus epidermidis
NHASADELNQNQ

SEQ ID NO: 1727994 - protein, 13 aa, Staphylococcus epidermidis
NHEATTEEQNEAI

SEQ ID NO: 1727995 - protein, 7 aa, Staphylococcus epidermidis
NHGRETD

SEQ ID NO: 1727996 - protein, 23 aa, Staphylococcus epidermidis
NHKNEISNNIDDELTDDGVERVK

SEQ ID NO: 1727997 - protein, 108 aa, Staphylococcus epidermidis
NHNDSKSDDQKIANQSKKDSDKKDGAQSEDNKDKKSDSNKDKKSDSDKNADDDSDNSSSNPNATSTNNNDNVANNNSNYTNQNQQDNANQNSNNQQATQGQQSHTVYG

SEQ ID NO: 1727998 - protein, 24 aa, Staphylococcus epidermidis
NIHNSDDLSSLANTLSKASDLDNA

SEQ ID NO: 1727999 - protein, 7 aa, Staphylococcus epidermidis
NINQKGN

SEQ ID NO: 1728000 - protein, 4 aa, Staphylococcus epidermidis
NIPG

SEQ ID NO: 1728001 - protein, 5 aa, Staphylococcus epidermidis
NIRDK

SEQ ID NO: 1728002 - protein, 8 aa, Staphylococcus epidermidis
NIRQNDDY

SEQ ID NO: 1728003 - protein, 17 aa, Staphylococcus epidermidis
NKAKNDLRADKSQLENA

SEQ ID NO: 1728004 - protein, 8 aa, Staphylococcus epidermidis
NKENNNAL

SEQ ID NO: 1728005 - protein, 9 aa, Staphylococcus epidermidis
NKENNSALV

SEQ ID NO: 1728006 - protein, 21 aa, Staphylococcus epidermidis
NKFKQSQEATIEEKQSAINEL

SEQ ID NO: 1728007 - protein, 5 aa, Staphylococcus epidermidis
NKGLP

SEQ ID NO: 1728008 - protein, 18 aa, Staphylococcus epidermidis
NKKGTGVSEGQYSYEDNE

SEQ ID NO: 1728009 - protein, 5 aa, Staphylococcus epidermidis
NKKKI

SEQ ID NO: 1728010 - protein, 9 aa, Staphylococcus epidermidis
NKLKERAQT

SEQ ID NO: 1728011 - protein, 18 aa, Staphylococcus epidermidis
NKNDGLNNKDTKKDIEDA

SEQ ID NO: 1728012 - protein, 15 aa, Staphylococcus epidermidis
NKNQEVYDTKDKTIE

SEQ ID NO: 1728013 - protein, 16 aa, Staphylococcus epidermidis
NKPTQVSTSMTSTTGI

SEQ ID NO: 1728014 - protein, 13 aa, Staphylococcus epidermidis
NKSAAKSLNPAKQ

SEQ ID NO: 1728015 - protein, 5 aa, Staphylococcus epidermidis
NLKKE

SEQ ID NO: 1728016 - protein, 9 aa, Staphylococcus epidermidis
NLSGGEAQR

SEQ ID NO: 1728017 - protein, 5 aa, Staphylococcus epidermidis
NLTTE

SEQ ID NO: 1728018 - protein, 15 aa, Staphylococcus epidermidis
NNARDALNKTQGQNL

SEQ ID NO: 1728019 - protein, 13 aa, Staphylococcus epidermidis
NNDNATDEEKEVA

SEQ ID NO: 1728020 - protein, 20 aa, Staphylococcus epidermidis
NNEQEDTDNNLNQQEDSKKE

SEQ ID NO: 1728021 - protein, 14 aa, Staphylococcus epidermidis
NNGDASDQEVSTEI

SEQ ID NO: 1728022 - protein, 12 aa, Staphylococcus epidermidis
NNHALDQGEQGV

SEQ ID NO: 1728023 - protein, 20 aa, Staphylococcus epidermidis
NNLHGDQKLAQSKQDANNQL

SEQ ID NO: 1728024 - protein, 15 aa, Staphylococcus epidermidis
NNNKDATNEEKDEAK

SEQ ID NO: 1728025 - protein, 12 aa, Staphylococcus epidermidis
NNNKHSDSRTYG

SEQ ID NO: 1728026 - protein, 27 aa, Staphylococcus epidermidis
NNQVNQEAKELNDENHTQTYQQHAKPQ

SEQ ID NO: 1728027 - protein, 10 aa, Staphylococcus epidermidis
NNRADQQKTL

SEQ ID NO: 1728028 - protein, 6 aa, Staphylococcus epidermidis
NNTDRE

SEQ ID NO: 1728029 - protein, 7 aa, Staphylococcus epidermidis
NPADSPY

SEQ ID NO: 1728030 - protein, 8 aa, Staphylococcus epidermidis
NPHQTQYS

SEQ ID NO: 1728031 - protein, 16 aa, Staphylococcus epidermidis
NQANSNDDVDQELSNA

SEQ ID NO: 1728032 - protein, 19 aa, Staphylococcus epidermidis
NQANTDNEVDNAKTSGLNN

SEQ ID NO: 1728033 - protein, 28 aa, Staphylococcus epidermidis
NQKSNEARTAIQNEHSNNGVAQAKSNGI

SEQ ID NO: 1728034 - protein, 10 aa, Staphylococcus epidermidis
NQKTQAVNTA

SEQ ID NO: 1728035 - protein, 22 aa, Staphylococcus epidermidis
NQNITNATTNRDVDQAQTTGSG

SEQ ID NO: 1728036 - protein, 11 aa, Staphylococcus epidermidis
NQPKDKNAPHP

SEQ ID NO: 1728037 - protein, 13 aa, Staphylococcus epidermidis
NQSFSDKQNTNKT

SEQ ID NO: 1728038 - protein, 11 aa, Staphylococcus epidermidis
NQSQASDTNSV

SEQ ID NO: 1728039 - protein, 7 aa, Staphylococcus epidermidis
NQTGSGS

SEQ ID NO: 1728040 - protein, 4 aa, Staphylococcus epidermidis
NQYD

SEQ ID NO: 1728041 - protein, 25 aa, Staphylococcus epidermidis
NRAEDEGQISESSDDKIPHEQNPNQ

SEQ ID NO: 1728042 - protein, 17 aa, Staphylococcus epidermidis
NRAQSQINTAKSDADQV

SEQ ID NO: 1728043 - protein, 31 aa, Staphylococcus epidermidis
NRATQTIKTAENNLNGQSKLAEAKSDGNQSI

SEQ ID NO: 1728044 - protein, 7 aa, Staphylococcus epidermidis
NRDTMSG

SEQ ID NO: 1728045 - protein, 21 aa, Staphylococcus epidermidis
NRLGGTASWKDNRQPDKNIAG

SEQ ID NO: 1728046 - protein, 7 aa, Staphylococcus epidermidis
NSEIQSR

SEQ ID NO: 1728047 - protein, 10 aa, Staphylococcus epidermidis
NSLNDGQKRE

SEQ ID NO: 1728048 - protein, 7 aa, Staphylococcus epidermidis
NSPNAQA

SEQ ID NO: 1728049 - protein, 6 aa, Staphylococcus epidermidis
NSSIYT

SEQ ID NO: 1728050 - protein, 20 aa, Staphylococcus epidermidis
NTAHTRTDVTAEQSKANQIN

SEQ ID NO: 1728051 - protein, 6 aa, Staphylococcus epidermidis
NTIDDK

SEQ ID NO: 1728052 - protein, 5 aa, Staphylococcus epidermidis
NTISN

SEQ ID NO: 1728053 - protein, 20 aa, Staphylococcus epidermidis
NTNATTREKVAKNLDNAQAL

SEQ ID NO: 1728054 - protein, 4 aa, Staphylococcus epidermidis
NTNE

SEQ ID NO: 1728055 - protein, 8 aa, Staphylococcus epidermidis
NVPNSTVN

SEQ ID NO: 1728056 - protein, 5 aa, Staphylococcus epidermidis
NWKNH

SEQ ID NO: 1728057 - protein, 4 aa, Staphylococcus epidermidis
NYAS

SEQ ID NO: 1728058 - protein, 10 aa, Staphylococcus epidermidis
PANGAAADIS

SEQ ID NO: 1728059 - protein, 8 aa, Staphylococcus epidermidis
PAPGVNPE

SEQ ID NO: 1728060 - protein, 6 aa, Staphylococcus epidermidis
PGTYEF

SEQ ID NO: 1728061 - protein, 5 aa, Staphylococcus epidermidis
PHDVT

SEQ ID NO: 1728062 - protein, 20 aa, Staphylococcus epidermidis
PIDPNSTEGRVNERIKNQES

SEQ ID NO: 1728063 - protein, 13 aa, Staphylococcus epidermidis
PIGKPPKKKKSKR

SEQ ID NO: 1728064 - protein, 5 aa, Staphylococcus epidermidis
PIPRK

SEQ ID NO: 1728065 - protein, 7 aa, Staphylococcus epidermidis
PKFDSDI

SEQ ID NO: 1728066 - protein, 11 aa, Staphylococcus epidermidis
PLPTTHKTLNS

SEQ ID NO: 1728067 - protein, 5 aa, Staphylococcus epidermidis
PLRKE

SEQ ID NO: 1728068 - protein, 22 aa, Staphylococcus epidermidis
PNGYDTEVGERGVKLSGGQKQR

SEQ ID NO: 1728069 - protein, 40 aa, Staphylococcus epidermidis
PNLTNTQKAKEKELVNSKQTRTEVQEQLNQAKSLDSSMGT

SEQ ID NO: 1728070 - protein, 18 aa, Staphylococcus epidermidis
PPLAEVKPATREDASWDE

SEQ ID NO: 1728071 - protein, 9 aa, Staphylococcus epidermidis
PQKATTDGF

SEQ ID NO: 1728072 - protein, 8 aa, Staphylococcus epidermidis
PQKVKKES

SEQ ID NO: 1728073 - protein, 4 aa, Staphylococcus epidermidis
PQTK

SEQ ID NO: 1728074 - protein, 14 aa, Staphylococcus epidermidis
PRTPSRDATNPPQQ

SEQ ID NO: 1728075 - protein, 4 aa, Staphylococcus epidermidis
PSLP

SEQ ID NO: 1728076 - protein, 9 aa, Staphylococcus epidermidis
PSNQEQQRL

SEQ ID NO: 1728077 - protein, 15 aa, Staphylococcus epidermidis
PTDLNNKKPASITAY

SEQ ID NO: 1728078 - protein, 9 aa, Staphylococcus epidermidis
PTSKSQAKL

SEQ ID NO: 1728079 - protein, 5 aa, Staphylococcus epidermidis
PTTAL

SEQ ID NO: 1728080 - protein, 17 aa, Staphylococcus epidermidis
PTVKETPNAKKWATEQL

SEQ ID NO: 1728081 - protein, 7 aa, Staphylococcus epidermidis
PVDRNNR

SEQ ID NO: 1728082 - protein, 15 aa, Staphylococcus epidermidis
PVNPGNSGGAVVDRD

SEQ ID NO: 1728083 - protein, 13 aa, Staphylococcus epidermidis
PYGYTPYDEHGKV

SEQ ID NO: 1728084 - protein, 20 aa, Staphylococcus epidermidis
QAAKEKRSKLTNGSKETQLT

SEQ ID NO: 1728085 - protein, 5 aa, Staphylococcus epidermidis
QAATT

SEQ ID NO: 1728086 - protein, 25 aa, Staphylococcus epidermidis
QAKYNKKSKNTDFEDAQQEHMEGNQ

SEQ ID NO: 1728087 - protein, 7 aa, Staphylococcus epidermidis
QALNDSM

SEQ ID NO: 1728088 - protein, 21 aa, Staphylococcus epidermidis
QAQRGNLETKVQNSNSRPEVQ

SEQ ID NO: 1728089 - protein, 9 aa, Staphylococcus epidermidis
QAQTKQQVD

SEQ ID NO: 1728090 - protein, 15 aa, Staphylococcus epidermidis
QDDNTKSTPSKNSKH

SEQ ID NO: 1728091 - protein, 4 aa, Staphylococcus epidermidis
QDEP

SEQ ID NO: 1728092 - protein, 9 aa, Staphylococcus epidermidis
QDGKQQTTL

SEQ ID NO: 1728093 - protein, 11 aa, Staphylococcus epidermidis
QDNGQGIPADQ

SEQ ID NO: 1728094 - protein, 13 aa, Staphylococcus epidermidis
QDTPEKLNGFGKV

SEQ ID NO: 1728095 - protein, 5 aa, Staphylococcus epidermidis
QEQSQ

SEQ ID NO: 1728096 - protein, 15 aa, Staphylococcus epidermidis
QETENAIKEDAKRIS

SEQ ID NO: 1728097 - protein, 6 aa, Staphylococcus epidermidis
QGLRND

SEQ ID NO: 1728098 - protein, 28 aa, Staphylococcus epidermidis
QHNQQGTTQNYKDKQNSEQNDQSVFALV

SEQ ID NO: 1728099 - protein, 7 aa, Staphylococcus epidermidis
QHPQSQK

SEQ ID NO: 1728100 - protein, 8 aa, Staphylococcus epidermidis
QILNNQSA

SEQ ID NO: 1728101 - protein, 13 aa, Staphylococcus epidermidis
QINGSGNKNATVQ

SEQ ID NO: 1728102 - protein, 4 aa, Staphylococcus epidermidis
QKFT

SEQ ID NO: 1728103 - protein, 13 aa, Staphylococcus epidermidis
QKPTARKAISGMA

SEQ ID NO: 1728104 - protein, 7 aa, Staphylococcus epidermidis
QKYQPPQ

SEQ ID NO: 1728105 - protein, 5 aa, Staphylococcus epidermidis
QMKGE

SEQ ID NO: 1728106 - protein, 17 aa, Staphylococcus epidermidis
QNAKNDLRADKRELQTA

SEQ ID NO: 1728107 - protein, 4 aa, Staphylococcus epidermidis
QNGD

SEQ ID NO: 1728108 - protein, 9 aa, Staphylococcus epidermidis
QNIQNTQVN

SEQ ID NO: 1728109 - protein, 9 aa, Staphylococcus epidermidis
QNKEDNSAL

SEQ ID NO: 1728110 - protein, 40 aa, Staphylococcus epidermidis
QNKTAKTTVKIKRDGQNKSVDLQPKKVERKITKTKTQTTY

SEQ ID NO: 1728111 - protein, 15 aa, Staphylococcus epidermidis
QNKTTEYARKTRRSV

SEQ ID NO: 1728112 - protein, 22 aa, Staphylococcus epidermidis
QNLHGQQKLEQAQSSANTEIGN

SEQ ID NO: 1728113 - protein, 10 aa, Staphylococcus epidermidis
QNLQTAQQLD

SEQ ID NO: 1728114 - protein, 18 aa, Staphylococcus epidermidis
QNNANLSIEDQNRVKSSL

SEQ ID NO: 1728115 - protein, 8 aa, Staphylococcus epidermidis
QNRSRIPE

SEQ ID NO: 1728116 - protein, 6 aa, Staphylococcus epidermidis
QNSELT

SEQ ID NO: 1728117 - protein, 8 aa, Staphylococcus epidermidis
QNTTYGIS

SEQ ID NO: 1728118 - protein, 12 aa, Staphylococcus epidermidis
QNTYEKSTTLKQ

SEQ ID NO: 1728119 - protein, 6 aa, Staphylococcus epidermidis
QNVKNQ

SEQ ID NO: 1728120 - protein, 14 aa, Staphylococcus epidermidis
QNYNAKRQKAEQVI

SEQ ID NO: 1728121 - protein, 7 aa, Staphylococcus epidermidis
QNYTIGP

SEQ ID NO: 1728122 - protein, 6 aa, Staphylococcus epidermidis
QPAYKD

SEQ ID NO: 1728123 - protein, 10 aa, Staphylococcus epidermidis
QPKENNSELV

SEQ ID NO: 1728124 - protein, 11 aa, Staphylococcus epidermidis
QPLSNNDALKA

SEQ ID NO: 1728125 - protein, 10 aa, Staphylococcus epidermidis
QQAIRKEKNY

SEQ ID NO: 1728126 - protein, 12 aa, Staphylococcus epidermidis
QQQFKKQPKNQV

SEQ ID NO: 1728127 - protein, 28 aa, Staphylococcus epidermidis
QQTLSNSNDNIASHTYSNTKPEIENETA

SEQ ID NO: 1728128 - protein, 11 aa, Staphylococcus epidermidis
QQTSRANVAKQ

SEQ ID NO: 1728129 - protein, 8 aa, Staphylococcus epidermidis
QQYGGESA

SEQ ID NO: 1728130 - protein, 4 aa, Staphylococcus epidermidis
QRKM

SEQ ID NO: 1728131 - protein, 4 aa, Staphylococcus epidermidis
QRNN

SEQ ID NO: 1728132 - protein, 11 aa, Staphylococcus epidermidis
QRYESQRPHYN

SEQ ID NO: 1728133 - protein, 14 aa, Staphylococcus epidermidis
QSEYFEDTDDENRQ

SEQ ID NO: 1728134 - protein, 13 aa, Staphylococcus epidermidis
QSFPAIKEGSQVG

SEQ ID NO: 1728135 - protein, 34 aa, Staphylococcus epidermidis
QSIADKDATLNSSNYLNEDSEKKLAYDNAVSQAE

SEQ ID NO: 1728136 - protein, 7 aa, Staphylococcus epidermidis
QSKEEID

SEQ ID NO: 1728137 - protein, 5 aa, Staphylococcus epidermidis
QSNNG

SEQ ID NO: 1728138 - protein, 19 aa, Staphylococcus epidermidis
QSNTNTTLEMTSPDDFNIS

SEQ ID NO: 1728139 - protein, 11 aa, Staphylococcus epidermidis
QSQNNESVSAA

SEQ ID NO: 1728140 - protein, 8 aa, Staphylococcus epidermidis
QSSTDANP

SEQ ID NO: 1728141 - protein, 20 aa, Staphylococcus epidermidis
QSYGKIKGKTYKKSYNMNNR

SEQ ID NO: 1728142 - protein, 10 aa, Staphylococcus epidermidis
QTGLKDSSKH

SEQ ID NO: 1728143 - protein, 17 aa, Staphylococcus epidermidis
QTIEKLNPKLSKDKTNA

SEQ ID NO: 1728144 - protein, 8 aa, Staphylococcus epidermidis
QTKSGQDV

SEQ ID NO: 1728145 - protein, 41 aa, Staphylococcus epidermidis
QTLSQESGNTNYIEKRDKTVEKPKKIKTKYDKKDPTSKSIN

SEQ ID NO: 1728146 - protein, 10 aa, Staphylococcus epidermidis
QTPSLQKEAE

SEQ ID NO: 1728147 - protein, 6 aa, Staphylococcus epidermidis
QTQAYN

SEQ ID NO: 1728148 - protein, 23 aa, Staphylococcus epidermidis
QTRVSTQNITRYSNNELTVNKES

SEQ ID NO: 1728149 - protein, 11 aa, Staphylococcus epidermidis
QYNAENHDSEL

SEQ ID NO: 1728150 - protein, 10 aa, Staphylococcus epidermidis
QYVPDQETAS

SEQ ID NO: 1728151 - protein, 5 aa, Staphylococcus epidermidis
RANKR

SEQ ID NO: 1728152 - protein, 12 aa, Staphylococcus epidermidis
RDDKSQGTVASG

SEQ ID NO: 1728153 - protein, 27 aa, Staphylococcus epidermidis
RDGIQNKEDIKRSSAYINADPTKVTAY

SEQ ID NO: 1728154 - protein, 6 aa, Staphylococcus epidermidis
RDRQFT

SEQ ID NO: 1728155 - protein, 13 aa, Staphylococcus epidermidis
RGQPVEKRFSKEE

SEQ ID NO: 1728156 - protein, 4 aa, Staphylococcus epidermidis
RHKA

SEQ ID NO: 1728157 - protein, 8 aa, Staphylococcus epidermidis
RITDEEMQ

SEQ ID NO: 1728158 - protein, 37 aa, Staphylococcus epidermidis
RKQNSDNKDTKQKKVTSKKKKTPQSTKKVVKTKKRSK

SEQ ID NO: 1728159 - protein, 4 aa, Staphylococcus epidermidis
RLKG

SEQ ID NO: 1728160 - protein, 6 aa, Staphylococcus epidermidis
RLREKD

SEQ ID NO: 1728161 - protein, 9 aa, Staphylococcus epidermidis
RMSAKEKRL

SEQ ID NO: 1728162 - protein, 12 aa, Staphylococcus epidermidis
RNGAEKNIKIKL

SEQ ID NO: 1728163 - protein, 5 aa, Staphylococcus epidermidis
RNHND

SEQ ID NO: 1728164 - protein, 16 aa, Staphylococcus epidermidis
RNPTVEQVKESVANAQ

SEQ ID NO: 1728165 - protein, 13 aa, Staphylococcus epidermidis
RNTHNKTDEENVT

SEQ ID NO: 1728166 - protein, 4 aa, Staphylococcus epidermidis
RNTK

SEQ ID NO: 1728167 - protein, 5 aa, Staphylococcus epidermidis
RPHHL

SEQ ID NO: 1728168 - protein, 17 aa, Staphylococcus epidermidis
RQAIETQYNNAKSEAHQ

SEQ ID NO: 1728169 - protein, 14 aa, Staphylococcus epidermidis
RQVNKNVKNGKEFE

SEQ ID NO: 1728170 - protein, 7 aa, Staphylococcus epidermidis
RQYQSMR

SEQ ID NO: 1728171 - protein, 6 aa, Staphylococcus epidermidis
RRESKA

SEQ ID NO: 1728172 - protein, 6 aa, Staphylococcus epidermidis
RRYSVS

SEQ ID NO: 1728173 - protein, 5 aa, Staphylococcus epidermidis
RSDEV

SEQ ID NO: 1728174 - protein, 13 aa, Staphylococcus epidermidis
RSKEGDCGGCKSN

SEQ ID NO: 1728175 - protein, 8 aa, Staphylococcus epidermidis
RTMGASET

SEQ ID NO: 1728176 - protein, 7 aa, Staphylococcus epidermidis
RTSKLGA

SEQ ID NO: 1728177 - protein, 10 aa, Staphylococcus epidermidis
RTSQEMTNEI

SEQ ID NO: 1728178 - protein, 12 aa, Staphylococcus epidermidis
RTSRSQSNSLKR

SEQ ID NO: 1728179 - protein, 8 aa, Staphylococcus epidermidis
SDAKASSL

SEQ ID NO: 1728180 - protein, 6 aa, Staphylococcus epidermidis
SDDNAI

SEQ ID NO: 1728181 - protein, 8 aa, Staphylococcus epidermidis
SDMGGHAG

SEQ ID NO: 1728182 - protein, 13 aa, Staphylococcus epidermidis
SDTDIDISDEDFD

SEQ ID NO: 1728183 - protein, 6 aa, Staphylococcus epidermidis
SDVNDI

SEQ ID NO: 1728184 - protein, 4 aa, Staphylococcus epidermidis
SECN

SEQ ID NO: 1728185 - protein, 6 aa, Staphylococcus epidermidis
SEGSDQ

SEQ ID NO: 1728186 - protein, 20 aa, Staphylococcus epidermidis
SELNNAKSALRADKQELQQA

SEQ ID NO: 1728187 - protein, 6 aa, Staphylococcus epidermidis
SEMKTS

SEQ ID NO: 1728188 - protein, 23 aa, Staphylococcus epidermidis
SENIKNHKPMGMANNEGNAGNAL

SEQ ID NO: 1728189 - protein, 15 aa, Staphylococcus epidermidis
SESFGSSPRDGSERK

SEQ ID NO: 1728190 - protein, 12 aa, Staphylococcus epidermidis
SESSEVDESGMP

SEQ ID NO: 1728191 - protein, 27 aa, Staphylococcus epidermidis
SETALTAANRTKFQTEAKKGDRKAQGL

SEQ ID NO: 1728192 - protein, 10 aa, Staphylococcus epidermidis
SGNYGEYSQL

SEQ ID NO: 1728193 - protein, 13 aa, Staphylococcus epidermidis
SGQQEGKSESDVC

SEQ ID NO: 1728194 - protein, 7 aa, Staphylococcus epidermidis
SGRTVTG

SEQ ID NO: 1728195 - protein, 6 aa, Staphylococcus epidermidis
SGSFES

SEQ ID NO: 1728196 - protein, 7 aa, Staphylococcus epidermidis
SGSGDGF

SEQ ID NO: 1728197 - protein, 9 aa, Staphylococcus epidermidis
SGSTKSITP

SEQ ID NO: 1728198 - protein, 8 aa, Staphylococcus epidermidis
SHSSQVQQ

SEQ ID NO: 1728199 - protein, 9 aa, Staphylococcus epidermidis
SHTPKTRKL

SEQ ID NO: 1728200 - protein, 15 aa, Staphylococcus epidermidis
SIEDKEHKKNKKIEV

SEQ ID NO: 1728201 - protein, 27 aa, Staphylococcus epidermidis
SIQNQSSVRQESKYINASDAKKEQYNH

SEQ ID NO: 1728202 - protein, 76 aa, Staphylococcus epidermidis
SISSKDGEDFKKPNDVQGSSPDSLSVSGHSDNNTTNRSVHGSSDTSSSSNGGSNSASSGNNSNSSNGTSQGNSGNA

SEQ ID NO: 1728203 - protein, 8 aa, Staphylococcus epidermidis
SKAKAKAI

SEQ ID NO: 1728204 - protein, 4 aa, Staphylococcus epidermidis
SKGQ

SEQ ID NO: 1728205 - protein, 4 aa, Staphylococcus epidermidis
SKHL

SEQ ID NO: 1728206 - protein, 17 aa, Staphylococcus epidermidis
SKIQGRNTDGGLEWSPD

SEQ ID NO: 1728207 - protein, 8 aa, Staphylococcus epidermidis
SKKARYDV

SEQ ID NO: 1728208 - protein, 48 aa, Staphylococcus epidermidis
SKKKVKNQTEAHYKEKEQHLKESHEEALEKERVENKKVVTKQKEDFDV

SEQ ID NO: 1728209 - protein, 8 aa, Staphylococcus epidermidis
SKKPGETV

SEQ ID NO: 1728210 - protein, 6 aa, Staphylococcus epidermidis
SKNGTK

SEQ ID NO: 1728211 - protein, 7 aa, Staphylococcus epidermidis
SKPNQAI

SEQ ID NO: 1728212 - protein, 7 aa, Staphylococcus epidermidis
SKPSQRK

SEQ ID NO: 1728213 - protein, 8 aa, Staphylococcus epidermidis
SKRTKHSQ

SEQ ID NO: 1728214 - protein, 30 aa, Staphylococcus epidermidis
SKTESNKYGPSPKYNRNETNFHGDNANPVD

SEQ ID NO: 1728215 - protein, 10 aa, Staphylococcus epidermidis
SKTQGASPYY

SEQ ID NO: 1728216 - protein, 113 aa, Staphylococcus epidermidis
SKVEQLKYDSKDNIHADELQAQKAAIQRETDLADESPEAQAIQEAKKETKQVDDVRPSATELAAQQNAIQHETDLADESPEAQAIQEAKSEVDSNNKTSTTHIDSEKEPSAEE

SEQ ID NO: 1728217 - protein, 20 aa, Staphylococcus epidermidis
SLDTNDKISKEFHQDSEKAS

SEQ ID NO: 1728218 - protein, 8 aa, Staphylococcus epidermidis
SLEQTNAS

SEQ ID NO: 1728219 - protein, 11 aa, Staphylococcus epidermidis
SLNDKNPTHIH

SEQ ID NO: 1728220 - protein, 13 aa, Staphylococcus epidermidis
SLNSEPNADSYGS

SEQ ID NO: 1728221 - protein, 7 aa, Staphylococcus epidermidis
SLRDELN

SEQ ID NO: 1728222 - protein, 6 aa, Staphylococcus epidermidis
SMSQTV

SEQ ID NO: 1728223 - protein, 35 aa, Staphylococcus epidermidis
SNHTEQDSRSTQPYSSKHSYSQPKDKDNDNTQQAQ

SEQ ID NO: 1728224 - protein, 24 aa, Staphylococcus epidermidis
SNISTKENALHGEQKLTTAKTEAI

SEQ ID NO: 1728225 - protein, 5 aa, Staphylococcus epidermidis
SNKSI

SEQ ID NO: 1728226 - protein, 8 aa, Staphylococcus epidermidis
SNLSEKSY

SEQ ID NO: 1728227 - protein, 14 aa, Staphylococcus epidermidis
SNNGTTNKIGKSAL

SEQ ID NO: 1728228 - protein, 17 aa, Staphylococcus epidermidis
SNPYDSGQVNDEGDTAI

SEQ ID NO: 1728229 - protein, 15 aa, Staphylococcus epidermidis
SPATKIKEDARAAVE

SEQ ID NO: 1728230 - protein, 6 aa, Staphylococcus epidermidis
SPKGKF

SEQ ID NO: 1728231 - protein, 5 aa, Staphylococcus epidermidis
SPQIS

SEQ ID NO: 1728232 - protein, 21 aa, Staphylococcus epidermidis
SPRERKVTSQQGYAITQSKGY

SEQ ID NO: 1728233 - protein, 6 aa, Staphylococcus epidermidis
SQAVTN

SEQ ID NO: 1728234 - protein, 7 aa, Staphylococcus epidermidis
SQYRRKR

SEQ ID NO: 1728235 - protein, 12 aa, Staphylococcus epidermidis
SQYSNQNKSISP

SEQ ID NO: 1728236 - protein, 9 aa, Staphylococcus epidermidis
SRKNPELHK

SEQ ID NO: 1728237 - protein, 8 aa, Staphylococcus epidermidis
SRTLEDSS

SEQ ID NO: 1728238 - protein, 8 aa, Staphylococcus epidermidis
SSDSGEIT

SEQ ID NO: 1728239 - protein, 8 aa, Staphylococcus epidermidis
SSEHASKE

SEQ ID NO: 1728240 - protein, 23 aa, Staphylococcus epidermidis
SSGTRADIQSKNAITQAQVEKTV

SEQ ID NO: 1728241 - protein, 9 aa, Staphylococcus epidermidis
SSKVQTGDS

SEQ ID NO: 1728242 - protein, 8 aa, Staphylococcus epidermidis
SSNYSSNR

SEQ ID NO: 1728243 - protein, 6 aa, Staphylococcus epidermidis
SSVKQM

SEQ ID NO: 1728244 - protein, 8 aa, Staphylococcus epidermidis
STAVKTNA

SEQ ID NO: 1728245 - protein, 4 aa, Staphylococcus epidermidis
STEA

SEQ ID NO: 1728246 - protein, 8 aa, Staphylococcus epidermidis
STHQPKVD

SEQ ID NO: 1728247 - protein, 10 aa, Staphylococcus epidermidis
STKEEEIQNI

SEQ ID NO: 1728248 - protein, 12 aa, Staphylococcus epidermidis
STNLNDKQKQAL

SEQ ID NO: 1728249 - protein, 10 aa, Staphylococcus epidermidis
STTNPKADIP

SEQ ID NO: 1728250 - protein, 14 aa, Staphylococcus epidermidis
SVDQNKSIDTNKPI

SEQ ID NO: 1728251 - protein, 8 aa, Staphylococcus epidermidis
SVGLEPDQ

SEQ ID NO: 1728252 - protein, 6 aa, Staphylococcus epidermidis
SVNPNS

SEQ ID NO: 1728253 - protein, 12 aa, Staphylococcus epidermidis
SYEYKEGDKIGV

SEQ ID NO: 1728254 - protein, 13 aa, Staphylococcus epidermidis
SYNTTKETKLDKR

SEQ ID NO: 1728255 - protein, 15 aa, Staphylococcus epidermidis
TAGESNNPEKSMPKA

SEQ ID NO: 1728256 - protein, 15 aa, Staphylococcus epidermidis
TAGETKNPEKTIPKA

SEQ ID NO: 1728257 - protein, 10 aa, Staphylococcus epidermidis
TAKNRKGGTQ

SEQ ID NO: 1728258 - protein, 29 aa, Staphylococcus epidermidis
TAKNSNLRSNINSNEKQLAERGSNGYSKS

SEQ ID NO: 1728259 - protein, 9 aa, Staphylococcus epidermidis
TANAVATAV

SEQ ID NO: 1728260 - protein, 17 aa, Staphylococcus epidermidis
TAPTKKPIIKPKVETKY

SEQ ID NO: 1728261 - protein, 7 aa, Staphylococcus epidermidis
TAQNNED

SEQ ID NO: 1728262 - protein, 7 aa, Staphylococcus epidermidis
TATTDNK

SEQ ID NO: 1728263 - protein, 10 aa, Staphylococcus epidermidis
TDNTGGSGLR

SEQ ID NO: 1728264 - protein, 12 aa, Staphylococcus epidermidis
TDPSSAGYQAAG

SEQ ID NO: 1728265 - protein, 6 aa, Staphylococcus epidermidis
TDSNID

SEQ ID NO: 1728266 - protein, 16 aa, Staphylococcus epidermidis
TEDKNGFAHNKDKKYP

SEQ ID NO: 1728267 - protein, 8 aa, Staphylococcus epidermidis
TEPALGAT

SEQ ID NO: 1728268 - protein, 8 aa, Staphylococcus epidermidis
TFESQQNE

SEQ ID NO: 1728269 - protein, 4 aa, Staphylococcus epidermidis
TGDV

SEQ ID NO: 1728270 - protein, 13 aa, Staphylococcus epidermidis
TGETNDEHKEILF

SEQ ID NO: 1728271 - protein, 13 aa, Staphylococcus epidermidis
THQTATTEEKEAA

SEQ ID NO: 1728272 - protein, 4 aa, Staphylococcus epidermidis
TIEQ

SEQ ID NO: 1728273 - protein, 13 aa, Staphylococcus epidermidis
TKDGGSKSTIERD

SEQ ID NO: 1728274 - protein, 24 aa, Staphylococcus epidermidis
TKEDLKSKKENDVYQQAKSSLEKK

SEQ ID NO: 1728275 - protein, 10 aa, Staphylococcus epidermidis
TKKEERKESY

SEQ ID NO: 1728276 - protein, 7 aa, Staphylococcus epidermidis
TKKPDDY

SEQ ID NO: 1728277 - protein, 9 aa, Staphylococcus epidermidis
TKRKSKEFL

SEQ ID NO: 1728278 - protein, 7 aa, Staphylococcus epidermidis
TKSNKSV

SEQ ID NO: 1728279 - protein, 17 aa, Staphylococcus epidermidis
TNAKSNLRADKNELQTA

SEQ ID NO: 1728280 - protein, 12 aa, Staphylococcus epidermidis
TNDNTVTGQQTP

SEQ ID NO: 1728281 - protein, 16 aa, Staphylococcus epidermidis
TNEAVNRAKEIANSEI

SEQ ID NO: 1728282 - protein, 9 aa, Staphylococcus epidermidis
TNGEFTKDQ

SEQ ID NO: 1728283 - protein, 22 aa, Staphylococcus epidermidis
TNKVETEQINNELTQAKQGLTV

SEQ ID NO: 1728284 - protein, 7 aa, Staphylococcus epidermidis
TNSNQVT

SEQ ID NO: 1728285 - protein, 8 aa, Staphylococcus epidermidis
TPDSPEVK

SEQ ID NO: 1728286 - protein, 16 aa, Staphylococcus epidermidis
TPKPGETQKSVTQHAE

SEQ ID NO: 1728287 - protein, 6 aa, Staphylococcus epidermidis
TPYDTQ

SEQ ID NO: 1728288 - protein, 10 aa, Staphylococcus epidermidis
TQAKETALND

SEQ ID NO: 1728289 - protein, 6 aa, Staphylococcus epidermidis
TQQTNH

SEQ ID NO: 1728290 - protein, 29 aa, Staphylococcus epidermidis
TQRVNTTKNDLNGNDKLAEAKRDANTTID

SEQ ID NO: 1728291 - protein, 38 aa, Staphylococcus epidermidis
TQTKTQAKADIAQAIGQQRSTIDQNQNATTEEKQEALE

SEQ ID NO: 1728292 - protein, 6 aa, Staphylococcus epidermidis
TQVSRA

SEQ ID NO: 1728293 - protein, 9 aa, Staphylococcus epidermidis
TREESIKAK

SEQ ID NO: 1728294 - protein, 7 aa, Staphylococcus epidermidis
TSEGHSE

SEQ ID NO: 1728295 - protein, 16 aa, Staphylococcus epidermidis
TSGQRIPGYSENITNS

SEQ ID NO: 1728296 - protein, 9 aa, Staphylococcus epidermidis
TSKGTAYHS

SEQ ID NO: 1728297 - protein, 8 aa, Staphylococcus epidermidis
TSKTLSPH

SEQ ID NO: 1728298 - protein, 6 aa, Staphylococcus epidermidis
TSNELL

SEQ ID NO: 1728299 - protein, 15 aa, Staphylococcus epidermidis
TSNNQKLKDVTKKLN

SEQ ID NO: 1728300 - protein, 14 aa, Staphylococcus epidermidis
TSNQIKSLDSEARN

SEQ ID NO: 1728301 - protein, 8 aa, Staphylococcus epidermidis
TSNQQQYN

SEQ ID NO: 1728302 - protein, 5 aa, Staphylococcus epidermidis
TSQRE

SEQ ID NO: 1728303 - protein, 8 aa, Staphylococcus epidermidis
TSRLSKKA

SEQ ID NO: 1728304 - protein, 9 aa, Staphylococcus epidermidis
TSTSDEIAN

SEQ ID NO: 1728305 - protein, 8 aa, Staphylococcus epidermidis
TSYGPATV

SEQ ID NO: 1728306 - protein, 7 aa, Staphylococcus epidermidis
TTKCKEK

SEQ ID NO: 1728307 - protein, 13 aa, Staphylococcus epidermidis
TTKQSLDEVDPNN

SEQ ID NO: 1728308 - protein, 10 aa, Staphylococcus epidermidis
TTKSEKMDGD

SEQ ID NO: 1728309 - protein, 6 aa, Staphylococcus epidermidis
TTLTQA

SEQ ID NO: 1728310 - protein, 26 aa, Staphylococcus epidermidis
TTNQAIEDAPDTNQVNVEKNKGIGTI

SEQ ID NO: 1728311 - protein, 8 aa, Staphylococcus epidermidis
TTQPPELN

SEQ ID NO: 1728312 - protein, 8 aa, Staphylococcus epidermidis
TTREFSDG

SEQ ID NO: 1728313 - protein, 5 aa, Staphylococcus epidermidis
TTRGS

SEQ ID NO: 1728314 - protein, 32 aa, Staphylococcus epidermidis
TVASTSDSAITMTRNNNELVGQAPNVTNSTNK

SEQ ID NO: 1728315 - protein, 6 aa, Staphylococcus epidermidis
TYIPNK

SEQ ID NO: 1728316 - protein, 20 aa, Staphylococcus epidermidis
TYSDTYASNYSQDEGFKERV

SEQ ID NO: 1728317 - protein, 10 aa, Staphylococcus epidermidis
VAKKPSARVE

SEQ ID NO: 1728318 - protein, 8 aa, Staphylococcus epidermidis
VAPKGEVP

SEQ ID NO: 1728319 - protein, 7 aa, Staphylococcus epidermidis
VDANDNN

SEQ ID NO: 1728320 - protein, 29 aa, Staphylococcus epidermidis
VDPTQGMTTDTANNYKSKKREAEDEIQKA

SEQ ID NO: 1728321 - protein, 9 aa, Staphylococcus epidermidis
VDSDTANLN

SEQ ID NO: 1728322 - protein, 14 aa, Staphylococcus epidermidis
VDTNGKKPASIQQY

SEQ ID NO: 1728323 - protein, 25 aa, Staphylococcus epidermidis
VEEATNALNEAKQHLTADTTSLKTE

SEQ ID NO: 1728324 - protein, 5 aa, Staphylococcus epidermidis
VKARS

SEQ ID NO: 1728325 - protein, 12 aa, Staphylococcus epidermidis
VKQPTKGEDGVV

SEQ ID NO: 1728326 - protein, 25 aa, Staphylococcus epidermidis
VKQTKDNLHGDQKLANDKTDAQATL

SEQ ID NO: 1728327 - protein, 17 aa, Staphylococcus epidermidis
VKSAPGKGSIFKVLFND

SEQ ID NO: 1728328 - protein, 20 aa, Staphylococcus epidermidis
VLDEETNNTPFNQRYSQTQI

SEQ ID NO: 1728329 - protein, 7 aa, Staphylococcus epidermidis
VNELDQN

SEQ ID NO: 1728330 - protein, 15 aa, Staphylococcus epidermidis
VNGSGSKDSNAYDTY

SEQ ID NO: 1728331 - protein, 5 aa, Staphylococcus epidermidis
VNSGS

SEQ ID NO: 1728332 - protein, 34 aa, Staphylococcus epidermidis
VNTNGKKPSSIQNYKSARRNIENQYNTAKNEAHN

SEQ ID NO: 1728333 - protein, 5 aa, Staphylococcus epidermidis
VPAGQ

SEQ ID NO: 1728334 - protein, 7 aa, Staphylococcus epidermidis
VPNGSKN

SEQ ID NO: 1728335 - protein, 9 aa, Staphylococcus epidermidis
VPQRQTVKD

SEQ ID NO: 1728336 - protein, 7 aa, Staphylococcus epidermidis
VPRSYES

SEQ ID NO: 1728337 - protein, 14 aa, Staphylococcus epidermidis
VPVSQSGENQPVYG

SEQ ID NO: 1728338 - protein, 6 aa, Staphylococcus epidermidis
VQPESE

SEQ ID NO: 1728339 - protein, 11 aa, Staphylococcus epidermidis
VQQAQQDLDGV

SEQ ID NO: 1728340 - protein, 10 aa, Staphylococcus epidermidis
VQQPKQQYRP

SEQ ID NO: 1728341 - protein, 11 aa, Staphylococcus epidermidis
VRKKQEAKTTI

SEQ ID NO: 1728342 - protein, 16 aa, Staphylococcus epidermidis
VSDSDGNASENKHHKL

SEQ ID NO: 1728343 - protein, 9 aa, Staphylococcus epidermidis
VSEKDKENL

SEQ ID NO: 1728344 - protein, 6 aa, Staphylococcus epidermidis
VSKSKY

SEQ ID NO: 1728345 - protein, 12 aa, Staphylococcus epidermidis
VSNTPGLVSNED

SEQ ID NO: 1728346 - protein, 14 aa, Staphylococcus epidermidis
VSNVPAEKAGTASG

SEQ ID NO: 1728347 - protein, 8 aa, Staphylococcus epidermidis
VSQTSNIT

SEQ ID NO: 1728348 - protein, 37 aa, Staphylococcus epidermidis
VSSDTSTLPHQNKSIKDYDDSGNESKQHTKLTSKESM

SEQ ID NO: 1728349 - protein, 4 aa, Staphylococcus epidermidis
VSSR

SEQ ID NO: 1728350 - protein, 4 aa, Staphylococcus epidermidis
VTER

SEQ ID NO: 1728351 - protein, 15 aa, Staphylococcus epidermidis
VTTTDENGNSETTTF

SEQ ID NO: 1728352 - protein, 13 aa, Staphylococcus epidermidis
VVKTDKKRTAYVG

SEQ ID NO: 1728353 - protein, 9 aa, Staphylococcus epidermidis
WAPRTKRGR

SEQ ID NO: 1728354 - protein, 12 aa, Staphylococcus epidermidis
YDKEKGQNYLNS

SEQ ID NO: 1728355 - protein, 7 aa, Staphylococcus epidermidis
YDQPYYD

SEQ ID NO: 1728356 - protein, 8 aa, Staphylococcus epidermidis
YEDKERDI

SEQ ID NO: 1728357 - protein, 31 aa, Staphylococcus epidermidis
YFNEDSEQQNAYNQAVNKAKNIINDQPTPVM

SEQ ID NO: 1728358 - protein, 5 aa, Staphylococcus epidermidis
YGTEA

SEQ ID NO: 1728359 - protein, 29 aa, Staphylococcus epidermidis
YKKTDELKEKEQDLRSKVENYRQRAEDTV

SEQ ID NO: 1728360 - protein, 13 aa, Staphylococcus epidermidis
YKSRMTSFGTGKD

SEQ ID NO: 1728361 - protein, 6 aa, Staphylococcus epidermidis
YPIDNE

SEQ ID NO: 1728362 - protein, 8 aa, Staphylococcus epidermidis
YQTQTELQ

SEQ ID NO: 1728363 - protein, 5 aa, Staphylococcus epidermidis
YSSIN

SEQ ID NO: 1728364 - protein, 8 aa, Staphylococcus epidermidis
YTASHSTM

SEQ ID NO: 1728365 - protein, 54 aa, Staphylococcus epidermidis
YTQDGDHTHHDERNYNDRHYQDNYDRNDDYRHNNHDHQNDNHDYHDSNFDKTTN

SEQ ID NO: 1728366 - protein, 12 aa, Staphylococcus epidermidis
YVNESNNDVRSQ

SEQ ID NO: 1728367 - protein, 4 aa, Staphylococcus epidermidis
AAKY

SEQ ID NO: 1728368 - protein, 7 aa, Staphylococcus epidermidis
AARNEIH

SEQ ID NO: 1728369 - protein, 17 aa, Staphylococcus epidermidis
ADYEKNALEKAKSYAKD

SEQ ID NO: 1728370 - protein, 12 aa, Staphylococcus epidermidis
AEQAPHVNGPGT

SEQ ID NO: 1728371 - protein, 10 aa, Staphylococcus epidermidis
AGKRQGFAGG

SEQ ID NO: 1728372 - protein, 10 aa, Staphylococcus epidermidis
AGNPTKGNET

SEQ ID NO: 1728373 - protein, 6 aa, Staphylococcus epidermidis
AHEASQ

SEQ ID NO: 1728374 - protein, 5 aa, Staphylococcus epidermidis
AHTRE

SEQ ID NO: 1728375 - protein, 5 aa, Staphylococcus epidermidis
AIHDA

SEQ ID NO: 1728376 - protein, 5 aa, Staphylococcus epidermidis
AKKNA

SEQ ID NO: 1728377 - protein, 52 aa, Staphylococcus epidermidis
AKNVDNRQQGENSASKPSDSTTDEKDDSNNKVHDTNASTRNATTDDSEESVI

SEQ ID NO: 1728378 - protein, 5 aa, Staphylococcus epidermidis
AKRIP

SEQ ID NO: 1728379 - protein, 6 aa, Staphylococcus epidermidis
ALGETA

SEQ ID NO: 1728380 - protein, 6 aa, Staphylococcus epidermidis
ALSSVN

SEQ ID NO: 1728381 - protein, 10 aa, Staphylococcus epidermidis
ANEKANGMIE

SEQ ID NO: 1728382 - protein, 6 aa, Staphylococcus epidermidis
ANGMTG

SEQ ID NO: 1728383 - protein, 7 aa, Staphylococcus epidermidis
ANPTMSH

SEQ ID NO: 1728384 - protein, 4 aa, Staphylococcus epidermidis
ANSE

SEQ ID NO: 1728385 - protein, 5 aa, Staphylococcus epidermidis
APDDG

SEQ ID NO: 1728386 - protein, 6 aa, Staphylococcus epidermidis
APSGMR

SEQ ID NO: 1728387 - protein, 6 aa, Staphylococcus epidermidis
AQQGNS

SEQ ID NO: 1728388 - protein, 12 aa, Staphylococcus epidermidis
AQQKNVKDETYM

SEQ ID NO: 1728389 - protein, 20 aa, Staphylococcus epidermidis
ARDNSGQAVTNKVDGLPDGV

SEQ ID NO: 1728390 - protein, 20 aa, Staphylococcus epidermidis
ARESLHGEQKLQEAKNQAVA

SEQ ID NO: 1728391 - protein, 7 aa, Staphylococcus epidermidis
ARMSQSQ

SEQ ID NO: 1728392 - protein, 12 aa, Staphylococcus epidermidis
ASYTEERNEFAD

SEQ ID NO: 1728393 - protein, 12 aa, Staphylococcus epidermidis
ATDKGSDSVEFT

SEQ ID NO: 1728394 - protein, 6 aa, Staphylococcus epidermidis
ATHKNS

SEQ ID NO: 1728395 - protein, 8 aa, Staphylococcus epidermidis
ATQTYDNG

SEQ ID NO: 1728396 - protein, 16 aa, Staphylococcus epidermidis
DAVEKNISSRDRKNSV

SEQ ID NO: 1728397 - protein, 10 aa, Staphylococcus epidermidis
DDHTPATDKG

SEQ ID NO: 1728398 - protein, 11 aa, Staphylococcus epidermidis
DDKKVPSGAEY

SEQ ID NO: 1728399 - protein, 8 aa, Staphylococcus epidermidis
DDRQSNIK

SEQ ID NO: 1728400 - protein, 5 aa, Staphylococcus epidermidis
DFARG

SEQ ID NO: 1728401 - protein, 8 aa, Staphylococcus epidermidis
DGKTQDIN

SEQ ID NO: 1728402 - protein, 9 aa, Staphylococcus epidermidis
DGVNDAPAL

SEQ ID NO: 1728403 - protein, 16 aa, Staphylococcus epidermidis
DGVQNAQLNGQTNREV

SEQ ID NO: 1728404 - protein, 4 aa, Staphylococcus epidermidis
DHSQ

SEQ ID NO: 1728405 - protein, 19 aa, Staphylococcus epidermidis
DKAQTNEEVKNIKKQSIDE

SEQ ID NO: 1728406 - protein, 17 aa, Staphylococcus epidermidis
DKEGYRDEEFDKDDKGT

SEQ ID NO: 1728407 - protein, 12 aa, Staphylococcus epidermidis
DLNTPQKEAIKT

SEQ ID NO: 1728408 - protein, 10 aa, Staphylococcus epidermidis
DNATTNNQID

SEQ ID NO: 1728409 - protein, 5 aa, Staphylococcus epidermidis
DNATY

SEQ ID NO: 1728410 - protein, 6 aa, Staphylococcus epidermidis
DNEEDY

SEQ ID NO: 1728411 - protein, 8 aa, Staphylococcus epidermidis
DNNDSQKV

SEQ ID NO: 1728412 - protein, 7 aa, Staphylococcus epidermidis
DNQIKYE

SEQ ID NO: 1728413 - protein, 6 aa, Staphylococcus epidermidis
DNSNTI

SEQ ID NO: 1728414 - protein, 14 aa, Staphylococcus epidermidis
DQSITEGYDDSDGI

SEQ ID NO: 1728415 - protein, 18 aa, Staphylococcus epidermidis
DQVPSTDGMTQQSVANYN

SEQ ID NO: 1728416 - protein, 7 aa, Staphylococcus epidermidis
DQVRQPN

SEQ ID NO: 1728417 - protein, 20 aa, Staphylococcus epidermidis
DRIGQKKEELYKKSGKNPII

SEQ ID NO: 1728418 - protein, 6 aa, Staphylococcus epidermidis
DRYDTD

SEQ ID NO: 1728419 - protein, 7 aa, Staphylococcus epidermidis
DSGRILP

SEQ ID NO: 1728420 - protein, 6 aa, Staphylococcus epidermidis
DSKEKF

SEQ ID NO: 1728421 - protein, 6 aa, Staphylococcus epidermidis
DSKLGK

SEQ ID NO: 1728422 - protein, 16 aa, Staphylococcus epidermidis
DSSYISKSDNGEVEMT

SEQ ID NO: 1728423 - protein, 8 aa, Staphylococcus epidermidis
DSTIRSSA

SEQ ID NO: 1728424 - protein, 5 aa, Staphylococcus epidermidis
DSTTV

SEQ ID NO: 1728425 - protein, 9 aa, Staphylococcus epidermidis
DTNGNKRQQ

SEQ ID NO: 1728426 - protein, 17 aa, Staphylococcus epidermidis
DTNKDGIQDDNEKGISG

SEQ ID NO: 1728427 - protein, 12 aa, Staphylococcus epidermidis
DTNPKEAKNEMQ

SEQ ID NO: 1728428 - protein, 17 aa, Staphylococcus epidermidis
DVQDKGMASYNAKISGK

SEQ ID NO: 1728429 - protein, 7 aa, Staphylococcus epidermidis
DVRTVGD

SEQ ID NO: 1728430 - protein, 11 aa, Staphylococcus epidermidis
EAIKPNVHQGD

SEQ ID NO: 1728431 - protein, 7 aa, Staphylococcus epidermidis
EASNSKL

SEQ ID NO: 1728432 - protein, 22 aa, Staphylococcus epidermidis
EATQTSIPQRQPQSSPEKQTVK

SEQ ID NO: 1728433 - protein, 14 aa, Staphylococcus epidermidis
EDDLNSDVTSPHNS

SEQ ID NO: 1728434 - protein, 7 aa, Staphylococcus epidermidis
EDERQRL

SEQ ID NO: 1728435 - protein, 21 aa, Staphylococcus epidermidis
EDTTKPTVEDITDQTQEINTE

SEQ ID NO: 1728436 - protein, 21 aa, Staphylococcus epidermidis
EDTTKPTVESVADQTQEVNTE

SEQ ID NO: 1728437 - protein, 20 aa, Staphylococcus epidermidis
EERSYDRRSEDEKRKNLEKN

SEQ ID NO: 1728438 - protein, 10 aa, Staphylococcus epidermidis
EGSQGSQREL

SEQ ID NO: 1728439 - protein, 19 aa, Staphylococcus epidermidis
EHGQDIQKTNATQNETKQA

SEQ ID NO: 1728440 - protein, 8 aa, Staphylococcus epidermidis
EKAEDRAI

SEQ ID NO: 1728441 - protein, 21 aa, Staphylococcus epidermidis
EKGKDKEELKTSNQALKQAKD

SEQ ID NO: 1728442 - protein, 15 aa, Staphylococcus epidermidis
EKKKNRHKIKRSETL

SEQ ID NO: 1728443 - protein, 20 aa, Staphylococcus epidermidis
EKVNENKENVTEQSKNLFDK

SEQ ID NO: 1728444 - protein, 8 aa, Staphylococcus epidermidis
EKVNQTKD

SEQ ID NO: 1728445 - protein, 7 aa, Staphylococcus epidermidis
ELITDKK

SEQ ID NO: 1728446 - protein, 7 aa, Staphylococcus epidermidis
ELTGGKN

SEQ ID NO: 1728447 - protein, 9 aa, Staphylococcus epidermidis
ENKGDSAVQ

SEQ ID NO: 1728448 - protein, 19 aa, Staphylococcus epidermidis
ENLPEKTISTVNEKGKSID

SEQ ID NO: 1728449 - protein, 8 aa, Staphylococcus epidermidis
ENNGNINA

SEQ ID NO: 1728450 - protein, 4 aa, Staphylococcus epidermidis
ENPH

SEQ ID NO: 1728451 - protein, 17 aa, Staphylococcus epidermidis
ENPNKNSKTTKTEQFKQ

SEQ ID NO: 1728452 - protein, 14 aa, Staphylococcus epidermidis
ENPTIYQSKDGHLK

SEQ ID NO: 1728453 - protein, 16 aa, Staphylococcus epidermidis
ENSNSIDDINNNKEHA

SEQ ID NO: 1728454 - protein, 4 aa, Staphylococcus epidermidis
EQGD

SEQ ID NO: 1728455 - protein, 14 aa, Staphylococcus epidermidis
EQIVGQNGQSYAQG

SEQ ID NO: 1728456 - protein, 4 aa, Staphylococcus epidermidis
EQQK

SEQ ID NO: 1728457 - protein, 9 aa, Staphylococcus epidermidis
ERKRGKVSK

SEQ ID NO: 1728458 - protein, 5 aa, Staphylococcus epidermidis
ERTIN

SEQ ID NO: 1728459 - protein, 11 aa, Staphylococcus epidermidis
ERTNDSELRKA

SEQ ID NO: 1728460 - protein, 5 aa, Staphylococcus epidermidis
ERVSK

SEQ ID NO: 1728461 - protein, 14 aa, Staphylococcus epidermidis
ESHSETVDVAEDYD

SEQ ID NO: 1728462 - protein, 6 aa, Staphylococcus epidermidis
ETARDT

SEQ ID NO: 1728463 - protein, 8 aa, Staphylococcus epidermidis
ETDRFDGK

SEQ ID NO: 1728464 - protein, 18 aa, Staphylococcus epidermidis
ETGNGQSDLSKGIKEGNH

SEQ ID NO: 1728465 - protein, 14 aa, Staphylococcus epidermidis
ETQITSAKDNANAV

SEQ ID NO: 1728466 - protein, 7 aa, Staphylococcus epidermidis
ETVGTAL

SEQ ID NO: 1728467 - protein, 27 aa, Staphylococcus epidermidis
EVKNEALNQVSQAHSNNDVKIAENNGI

SEQ ID NO: 1728468 - protein, 8 aa, Staphylococcus epidermidis
EYETFKDK

SEQ ID NO: 1728469 - protein, 13 aa, Staphylococcus epidermidis
EYGEKFDKEDAQY

SEQ ID NO: 1728470 - protein, 4 aa, Staphylococcus epidermidis
EYSK

SEQ ID NO: 1728471 - protein, 20 aa, Staphylococcus epidermidis
FDNPKTKTEHNFNSQDRQCP

SEQ ID NO: 1728472 - protein, 4 aa, Staphylococcus epidermidis
FGEN

SEQ ID NO: 1728473 - protein, 9 aa, Staphylococcus epidermidis
FKGDKKTRI

SEQ ID NO: 1728474 - protein, 12 aa, Staphylococcus epidermidis
FKNYDTKGHGTV

SEQ ID NO: 1728475 - protein, 17 aa, Staphylococcus epidermidis
FPDGNKVEGKVDSDGNY

SEQ ID NO: 1728476 - protein, 14 aa, Staphylococcus epidermidis
FPSKEKNEETSHIG

SEQ ID NO: 1728477 - protein, 10 aa, Staphylococcus epidermidis
FSKEAGSANG

SEQ ID NO: 1728478 - protein, 7 aa, Staphylococcus epidermidis
FSSNYDR

SEQ ID NO: 1728479 - protein, 5 aa, Staphylococcus epidermidis
GATIG

SEQ ID NO: 1728480 - protein, 62 aa, Staphylococcus epidermidis
GDKPVKSKRRHKNKDINKGNVNDKVDTKLNASNSKDTEADKMKDQQTHIQQDKTDSQENNIY

SEQ ID NO: 1728481 - protein, 11 aa, Staphylococcus epidermidis
GDLDDSERNAI

SEQ ID NO: 1728482 - protein, 17 aa, Staphylococcus epidermidis
GEKFTESEAKYAIEHLD

SEQ ID NO: 1728483 - protein, 5 aa, Staphylococcus epidermidis
GGDGS

SEQ ID NO: 1728484 - protein, 13 aa, Staphylococcus epidermidis
GGKTDPMEKRTRV

SEQ ID NO: 1728485 - protein, 5 aa, Staphylococcus epidermidis
GGQTI

SEQ ID NO: 1728486 - protein, 32 aa, Staphylococcus epidermidis
GHAPKNHEVDYSKNKPPHKHHNDRQDDQHQGN

SEQ ID NO: 1728487 - protein, 4 aa, Staphylococcus epidermidis
GHQK

SEQ ID NO: 1728488 - protein, 8 aa, Staphylococcus epidermidis
GHSSNYGM

SEQ ID NO: 1728489 - protein, 56 aa, Staphylococcus epidermidis
GHTPEEAAIKHDDNNENHYNENTTYEYYEDSKDVDISNEDDTYNINHQSKEEHHTS

SEQ ID NO: 1728490 - protein, 5 aa, Staphylococcus epidermidis
GHTVR

SEQ ID NO: 1728491 - protein, 7 aa, Staphylococcus epidermidis
GKGKSNW

SEQ ID NO: 1728492 - protein, 8 aa, Staphylococcus epidermidis
GKIDKSGK

SEQ ID NO: 1728493 - protein, 8 aa, Staphylococcus epidermidis
GKKDPAVL

SEQ ID NO: 1728494 - protein, 6 aa, Staphylococcus epidermidis
GKKGTY

SEQ ID NO: 1728495 - protein, 15 aa, Staphylococcus epidermidis
GKPGDTVVDDHTDEE

SEQ ID NO: 1728496 - protein, 9 aa, Staphylococcus epidermidis
GKPGESVSI

SEQ ID NO: 1728497 - protein, 4 aa, Staphylococcus epidermidis
GNPD

SEQ ID NO: 1728498 - protein, 7 aa, Staphylococcus epidermidis
GQAEMQG

SEQ ID NO: 1728499 - protein, 8 aa, Staphylococcus epidermidis
GRVDYGAA

SEQ ID NO: 1728500 - protein, 6 aa, Staphylococcus epidermidis
GSAYTS

SEQ ID NO: 1728501 - protein, 46 aa, Staphylococcus epidermidis
GSMPELKKPTDKEDKNHSAFKNHSADEITTNNDGHSKDYDKKKKIH

SEQ ID NO: 1728502 - protein, 7 aa, Staphylococcus epidermidis
GSSQQNI

SEQ ID NO: 1728503 - protein, 14 aa, Staphylococcus epidermidis
GSSQSFTNNYEQLD

SEQ ID NO: 1728504 - protein, 7 aa, Staphylococcus epidermidis
GTEITKK

SEQ ID NO: 1728505 - protein, 14 aa, Staphylococcus epidermidis
GVEEKHNDPNFGSV

SEQ ID NO: 1728506 - protein, 5 aa, Staphylococcus epidermidis
GVSSS

SEQ ID NO: 1728507 - protein, 8 aa, Staphylococcus epidermidis
HAIQDESS

SEQ ID NO: 1728508 - protein, 4 aa, Staphylococcus epidermidis
HAVK

SEQ ID NO: 1728509 - protein, 13 aa, Staphylococcus epidermidis
HDNHESHNHHSGH

SEQ ID NO: 1728510 - protein, 54 aa, Staphylococcus epidermidis
HEIEKKGEKLEKDNRKDIKKLDKKLQKNIEKRHKEEQKQREEAEKARKKEFKKY

SEQ ID NO: 1728511 - protein, 9 aa, Staphylococcus epidermidis
HGSRTSSSK

SEQ ID NO: 1728512 - protein, 8 aa, Staphylococcus epidermidis
HKGKDEVQ

SEQ ID NO: 1728513 - protein, 13 aa, Staphylococcus epidermidis
HKSHNQDKEIKSD

SEQ ID NO: 1728514 - protein, 8 aa, Staphylococcus epidermidis
HQPSSISQ

SEQ ID NO: 1728515 - protein, 4 aa, Staphylococcus epidermidis
HRNL

SEQ ID NO: 1728516 - protein, 12 aa, Staphylococcus epidermidis
HSINNSDSSTII

SEQ ID NO: 1728517 - protein, 17 aa, Staphylococcus epidermidis
HSQAQEKYDYGTEISGQ

SEQ ID NO: 1728518 - protein, 5 aa, Staphylococcus epidermidis
HTGRE

SEQ ID NO: 1728519 - protein, 7 aa, Staphylococcus epidermidis
HTNNEVD

SEQ ID NO: 1728520 - protein, 22 aa, Staphylococcus epidermidis
HTVQSKNNLDFGDPFGGGFGFF

SEQ ID NO: 1728521 - protein, 10 aa, Staphylococcus epidermidis
IADHSEESAR

SEQ ID NO: 1728522 - protein, 25 aa, Staphylococcus epidermidis
IATTSSQVKRHSTQQTQAVDSTREL

SEQ ID NO: 1728523 - protein, 9 aa, Staphylococcus epidermidis
IDENSGKVT

SEQ ID NO: 1728524 - protein, 19 aa, Staphylococcus epidermidis
IDQAQSNKDVDSAKTRSIQ

SEQ ID NO: 1728525 - protein, 5 aa, Staphylococcus epidermidis
IENDS

SEQ ID NO: 1728526 - protein, 44 aa, Staphylococcus epidermidis
IESNTESNKEENTIEQPNKVREDSITSQPSSYKNIDEKISNQDE

SEQ ID NO: 1728527 - protein, 6 aa, Staphylococcus epidermidis
IGGSEA

SEQ ID NO: 1728528 - protein, 9 aa, Staphylococcus epidermidis
IKDNSGEII

SEQ ID NO: 1728529 - protein, 4 aa, Staphylococcus epidermidis
IKGN

SEQ ID NO: 1728530 - protein, 10 aa, Staphylococcus epidermidis
IKKDSSGNYN

SEQ ID NO: 1728531 - protein, 5 aa, Staphylococcus epidermidis
IPEGA

SEQ ID NO: 1728532 - protein, 8 aa, Staphylococcus epidermidis
IPTAGEQI

SEQ ID NO: 1728533 - protein, 20 aa, Staphylococcus epidermidis
IQQRDTYTAEIDAADAEKGV

SEQ ID NO: 1728534 - protein, 8 aa, Staphylococcus epidermidis
IRKETSSW

SEQ ID NO: 1728535 - protein, 14 aa, Staphylococcus epidermidis
IRKYDDEESLRRHH

SEQ ID NO: 1728536 - protein, 5 aa, Staphylococcus epidermidis
ITGDS

SEQ ID NO: 1728537 - protein, 28 aa, Staphylococcus epidermidis
IWNTEDQAVNDLTTQGAEKINQQTSLNP

SEQ ID NO: 1728538 - protein, 18 aa, Staphylococcus epidermidis
KAADIGKANTQSNKYDIR

SEQ ID NO: 1728539 - protein, 8 aa, Staphylococcus epidermidis
KAVGASSR

SEQ ID NO: 1728540 - protein, 8 aa, Staphylococcus epidermidis
KDKEINNT

SEQ ID NO: 1728541 - protein, 5 aa, Staphylococcus epidermidis
KDNPN

SEQ ID NO: 1728542 - protein, 30 aa, Staphylococcus epidermidis
KDYKDGEISYNPNVPSYSAKYQLSNNDYNV

SEQ ID NO: 1728543 - protein, 7 aa, Staphylococcus epidermidis
KEGHEEL

SEQ ID NO: 1728544 - protein, 27 aa, Staphylococcus epidermidis
KEINEEGKLDKDKDTKIKSIGETTEID

SEQ ID NO: 1728545 - protein, 8 aa, Staphylococcus epidermidis
KEKEEQFG

SEQ ID NO: 1728546 - protein, 8 aa, Staphylococcus epidermidis
KELNVTSR

SEQ ID NO: 1728547 - protein, 21 aa, Staphylococcus epidermidis
KEMEPDAPVDKSEMKSEDALY

SEQ ID NO: 1728548 - protein, 14 aa, Staphylococcus epidermidis
KENGLGDKAGLKKG

SEQ ID NO: 1728549 - protein, 5 aa, Staphylococcus epidermidis
KENND

SEQ ID NO: 1728550 - protein, 6 aa, Staphylococcus epidermidis
KENTIT

SEQ ID NO: 1728551 - protein, 4 aa, Staphylococcus epidermidis
KEPV

SEQ ID NO: 1728552 - protein, 5 aa, Staphylococcus epidermidis
KEQKH

SEQ ID NO: 1728553 - protein, 6 aa, Staphylococcus epidermidis
KGHEAK

SEQ ID NO: 1728554 - protein, 5 aa, Staphylococcus epidermidis
KGRYH

SEQ ID NO: 1728555 - protein, 5 aa, Staphylococcus epidermidis
KGTGA

SEQ ID NO: 1728556 - protein, 11 aa, Staphylococcus epidermidis
KGTLTGGVPVS

SEQ ID NO: 1728557 - protein, 4 aa, Staphylococcus epidermidis
KGYN

SEQ ID NO: 1728558 - protein, 9 aa, Staphylococcus epidermidis
KHGRDSEPL

SEQ ID NO: 1728559 - protein, 10 aa, Staphylococcus epidermidis
KKAKASKEIE

SEQ ID NO: 1728560 - protein, 5 aa, Staphylococcus epidermidis
KKEHG

SEQ ID NO: 1728561 - protein, 4 aa, Staphylococcus epidermidis
KKEI

SEQ ID NO: 1728562 - protein, 6 aa, Staphylococcus epidermidis
KKESYY

SEQ ID NO: 1728563 - protein, 7 aa, Staphylococcus epidermidis
KKFEKGM

SEQ ID NO: 1728564 - protein, 11 aa, Staphylococcus epidermidis
KKGVENTTGLK

SEQ ID NO: 1728565 - protein, 5 aa, Staphylococcus epidermidis
KKIPL

SEQ ID NO: 1728566 - protein, 9 aa, Staphylococcus epidermidis
KKITENGTF

SEQ ID NO: 1728567 - protein, 10 aa, Staphylococcus epidermidis
KKKKDGKDIQ

SEQ ID NO: 1728568 - protein, 7 aa, Staphylococcus epidermidis
KKNDGAV

SEQ ID NO: 1728569 - protein, 11 aa, Staphylococcus epidermidis
KLKQQVTQTQK

SEQ ID NO: 1728570 - protein, 8 aa, Staphylococcus epidermidis
KLKRQTVS

SEQ ID NO: 1728571 - protein, 7 aa, Staphylococcus epidermidis
KLSELTN

SEQ ID NO: 1728572 - protein, 6 aa, Staphylococcus epidermidis
KMNNDE

SEQ ID NO: 1728573 - protein, 9 aa, Staphylococcus epidermidis
KMSNQAIKN

SEQ ID NO: 1728574 - protein, 10 aa, Staphylococcus epidermidis
KNAYHKTQQE

SEQ ID NO: 1728575 - protein, 15 aa, Staphylococcus epidermidis
KNDYGSGTAIHPQTG

SEQ ID NO: 1728576 - protein, 5 aa, Staphylococcus epidermidis
KNEVE

SEQ ID NO: 1728577 - protein, 6 aa, Staphylococcus epidermidis
KNMPTY

SEQ ID NO: 1728578 - protein, 16 aa, Staphylococcus epidermidis
KNNNGKSNGKKNRNVK

SEQ ID NO: 1728579 - protein, 11 aa, Staphylococcus epidermidis
KNVSKKDYKAI

SEQ ID NO: 1728580 - protein, 6 aa, Staphylococcus epidermidis
KPSSEF

SEQ ID NO: 1728581 - protein, 7 aa, Staphylococcus epidermidis
KQHNGGV

SEQ ID NO: 1728582 - protein, 22 aa, Staphylococcus epidermidis
KQPTKQKTTSKAEVQRKGQVLE

SEQ ID NO: 1728583 - protein, 8 aa, Staphylococcus epidermidis
KQQPNESY

SEQ ID NO: 1728584 - protein, 13 aa, Staphylococcus epidermidis
KSEMEKTSWPTKE

SEQ ID NO: 1728585 - protein, 7 aa, Staphylococcus epidermidis
KSERGKI

SEQ ID NO: 1728586 - protein, 4 aa, Staphylococcus epidermidis
KSMP

SEQ ID NO: 1728587 - protein, 6 aa, Staphylococcus epidermidis
KSRDYP

SEQ ID NO: 1728588 - protein, 6 aa, Staphylococcus epidermidis
KSYIGQ

SEQ ID NO: 1728589 - protein, 8 aa, Staphylococcus epidermidis
KTHKEDIY

SEQ ID NO: 1728590 - protein, 13 aa, Staphylococcus epidermidis
KTKINSASSLSVT

SEQ ID NO: 1728591 - protein, 11 aa, Staphylococcus epidermidis
KTMDTAKPIED

SEQ ID NO: 1728592 - protein, 15 aa, Staphylococcus epidermidis
KTNPDSGERVEQGDR

SEQ ID NO: 1728593 - protein, 9 aa, Staphylococcus epidermidis
KVNDGSVQK

SEQ ID NO: 1728594 - protein, 17 aa, Staphylococcus epidermidis
KYDDQYQNHRKRSEEDM

SEQ ID NO: 1728595 - protein, 8 aa, Staphylococcus epidermidis
LANTGTAY

SEQ ID NO: 1728596 - protein, 4 aa, Staphylococcus epidermidis
LEAK

SEQ ID NO: 1728597 - protein, 6 aa, Staphylococcus epidermidis
LEDKLS

SEQ ID NO: 1728598 - protein, 4 aa, Staphylococcus epidermidis
LEDP

SEQ ID NO: 1728599 - protein, 4 aa, Staphylococcus epidermidis
LEKL

SEQ ID NO: 1728600 - protein, 17 aa, Staphylococcus epidermidis
LGTPHNGTPAADKIGTR

SEQ ID NO: 1728601 - protein, 9 aa, Staphylococcus epidermidis
LKASGANKM

SEQ ID NO: 1728602 - protein, 17 aa, Staphylococcus epidermidis
LKEAKGVLNKNSGTNVN

SEQ ID NO: 1728603 - protein, 7 aa, Staphylococcus epidermidis
LKKNDSF

SEQ ID NO: 1728604 - protein, 9 aa, Staphylococcus epidermidis
LKQKSGSYA

SEQ ID NO: 1728605 - protein, 7 aa, Staphylococcus epidermidis
LKSRKSV

SEQ ID NO: 1728606 - protein, 5 aa, Staphylococcus epidermidis
LKTSY

SEQ ID NO: 1728607 - protein, 4 aa, Staphylococcus epidermidis
LNDQ

SEQ ID NO: 1728608 - protein, 10 aa, Staphylococcus epidermidis
LNGARNNTIT

SEQ ID NO: 1728609 - protein, 5 aa, Staphylococcus epidermidis
LNNDH

SEQ ID NO: 1728610 - protein, 11 aa, Staphylococcus epidermidis
LNNNYADDETY

SEQ ID NO: 1728611 - protein, 89 aa, Staphylococcus epidermidis
LNQTDDDDSNTHSQEIENNKQNSSGKTESLRSSTSQNQANARLSDQFKDTNETSQQLPTNVSDDSINQSHSEANMNNEPLKVDNSTMQA

SEQ ID NO: 1728612 - protein, 9 aa, Staphylococcus epidermidis
LNSAQKHME

SEQ ID NO: 1728613 - protein, 30 aa, Staphylococcus epidermidis
LPQQSTTEKRGRRSTRSVVENRSSRSDYLD

SEQ ID NO: 1728614 - protein, 4 aa, Staphylococcus epidermidis
LPSI

SEQ ID NO: 1728615 - protein, 6 aa, Staphylococcus epidermidis
LQHEDG

SEQ ID NO: 1728616 - protein, 22 aa, Staphylococcus epidermidis
LSPNREISGSEGFAINGNPKKI

SEQ ID NO: 1728617 - protein, 9 aa, Staphylococcus epidermidis
LSTGPNDGM

SEQ ID NO: 1728618 - protein, 26 aa, Staphylococcus epidermidis
LTKEELGEEEPELSRTNKGNVSNQTK

SEQ ID NO: 1728619 - protein, 7 aa, Staphylococcus epidermidis
LTQSTLE

SEQ ID NO: 1728620 - protein, 12 aa, Staphylococcus epidermidis
LYENGNKKYDID

SEQ ID NO: 1728621 - protein, 8 aa, Staphylococcus epidermidis
MPKPNRNK

SEQ ID NO: 1728622 - protein, 5 aa, Staphylococcus epidermidis
MQTAQ

SEQ ID NO: 1728623 - protein, 44 aa, Staphylococcus epidermidis
NDATDEEIQEANRKIEEAKIEAKDNIQRNSTRDQVNEAKTNGIN

SEQ ID NO: 1728624 - protein, 6 aa, Staphylococcus epidermidis
NDDHIN

SEQ ID NO: 1728625 - protein, 4 aa, Staphylococcus epidermidis
NDKL

SEQ ID NO: 1728626 - protein, 8 aa, Staphylococcus epidermidis
NDSRKITI

SEQ ID NO: 1728627 - protein, 6 aa, Staphylococcus epidermidis
NEDKRT

SEQ ID NO: 1728628 - protein, 15 aa, Staphylococcus epidermidis
NEEYNKLTEDKKEPL

SEQ ID NO: 1728629 - protein, 13 aa, Staphylococcus epidermidis
NELRGNPNHKPEI

SEQ ID NO: 1728630 - protein, 8 aa, Staphylococcus epidermidis
NENNRNNK

SEQ ID NO: 1728631 - protein, 242 aa, Staphylococcus epidermidis
NFKDDFEKNRQSINPDEHQTELKEDDKTNENKKEADSQNSLSNNSNQQFPPRNAQRRKRRRETATNQSKQQDDKHQKNSDAKTTEGSLDDRYDEAQLQQQHDKSQQQNKTEKQSQDNRMKDGKDAAIVNGTSESPEHKSKSTQNRPGPKAQQQKRKSESTQSKPSTNKDKKAATGAGIAGAAGVAGAAETSKRHHNKKDKQDSKHSNHENDEKSVKNDDQKQSKKGKKAAVGAGAAAGVGAA

SEQ ID NO: 1728632 - protein, 14 aa, Staphylococcus epidermidis
NGKASKSKEAGIGS

SEQ ID NO: 1728633 - protein, 4 aa, Staphylococcus epidermidis
NGKE

SEQ ID NO: 1728634 - protein, 9 aa, Staphylococcus epidermidis
NGNQEEIEY

SEQ ID NO: 1728635 - protein, 4 aa, Staphylococcus epidermidis
NGRI

SEQ ID NO: 1728636 - protein, 6 aa, Staphylococcus epidermidis
NHSEYV

SEQ ID NO: 1728637 - protein, 6 aa, Staphylococcus epidermidis
NIGGAI

SEQ ID NO: 1728638 - protein, 9 aa, Staphylococcus epidermidis
NITNTYDGT

SEQ ID NO: 1728639 - protein, 19 aa, Staphylococcus epidermidis
NKAQLEDVTNKVNSANTLT

SEQ ID NO: 1728640 - protein, 6 aa, Staphylococcus epidermidis
NKEGAH

SEQ ID NO: 1728641 - protein, 6 aa, Staphylococcus epidermidis
NKGDLK

SEQ ID NO: 1728642 - protein, 4 aa, Staphylococcus epidermidis
NKGE

SEQ ID NO: 1728643 - protein, 33 aa, Staphylococcus epidermidis
NKNARQRRRRRIDNQSKEKDATSTQSQLETKPM

SEQ ID NO: 1728644 - protein, 5 aa, Staphylococcus epidermidis
NKSPL

SEQ ID NO: 1728645 - protein, 9 aa, Staphylococcus epidermidis
NKTESRFKQ

SEQ ID NO: 1728646 - protein, 26 aa, Staphylococcus epidermidis
NKTLDDKTSYKIDGKGWQKDKSWGGY

SEQ ID NO: 1728647 - protein, 4 aa, Staphylococcus epidermidis
NLDP

SEQ ID NO: 1728648 - protein, 8 aa, Staphylococcus epidermidis
NLPDNAAK

SEQ ID NO: 1728649 - protein, 14 aa, Staphylococcus epidermidis
NNIADAGRKLRKGL

SEQ ID NO: 1728650 - protein, 8 aa, Staphylococcus epidermidis
NQEDKTLT

SEQ ID NO: 1728651 - protein, 12 aa, Staphylococcus epidermidis
NQIRNEESKLDT

SEQ ID NO: 1728652 - protein, 4 aa, Staphylococcus epidermidis
NQPI

SEQ ID NO: 1728653 - protein, 5 aa, Staphylococcus epidermidis
NQTEI

SEQ ID NO: 1728654 - protein, 12 aa, Staphylococcus epidermidis
NRSLSDDKKALK

SEQ ID NO: 1728655 - protein, 8 aa, Staphylococcus epidermidis
NSNGTEMT

SEQ ID NO: 1728656 - protein, 29 aa, Staphylococcus epidermidis
NSVNDVNNVKANSNYINEDNGPKEAYNQA

SEQ ID NO: 1728657 - protein, 18 aa, Staphylococcus epidermidis
NSVPFSSDTTPPTINEPA

SEQ ID NO: 1728658 - protein, 6 aa, Staphylococcus epidermidis
NTKETL

SEQ ID NO: 1728659 - protein, 19 aa, Staphylococcus epidermidis
NTPDATEEEKQEATNRVNA

SEQ ID NO: 1728660 - protein, 7 aa, Staphylococcus epidermidis
NTSTIKT

SEQ ID NO: 1728661 - protein, 8 aa, Staphylococcus epidermidis
NYAPTKAS

SEQ ID NO: 1728662 - protein, 11 aa, Staphylococcus epidermidis
PAATKKQPIPR

SEQ ID NO: 1728663 - protein, 5 aa, Staphylococcus epidermidis
PANRL

SEQ ID NO: 1728664 - protein, 4 aa, Staphylococcus epidermidis
PDSG

SEQ ID NO: 1728665 - protein, 6 aa, Staphylococcus epidermidis
PEDKES

SEQ ID NO: 1728666 - protein, 5 aa, Staphylococcus epidermidis
PESYL

SEQ ID NO: 1728667 - protein, 7 aa, Staphylococcus epidermidis
PGRSTVD

SEQ ID NO: 1728668 - protein, 6 aa, Staphylococcus epidermidis
PIQTTI

SEQ ID NO: 1728669 - protein, 7 aa, Staphylococcus epidermidis
PKNAIRD

SEQ ID NO: 1728670 - protein, 4 aa, Staphylococcus epidermidis
PKQP

SEQ ID NO: 1728671 - protein, 8 aa, Staphylococcus epidermidis
PNKPVIDS

SEQ ID NO: 1728672 - protein, 10 aa, Staphylococcus epidermidis
PTKPIPDDKL

SEQ ID NO: 1728673 - protein, 25 aa, Staphylococcus epidermidis
QAEIQRERINGNSDATREEKEEALK

SEQ ID NO: 1728674 - protein, 10 aa, Staphylococcus epidermidis
QAHAEQAEEF

SEQ ID NO: 1728675 - protein, 7 aa, Staphylococcus epidermidis
QAIESSD

SEQ ID NO: 1728676 - protein, 85 aa, Staphylococcus epidermidis
QDEEPSQEDASSTSNHDVSSKDETKQQDIDNDKHQSKKPNKSDDALTTSNYKEDASSVNKETDTTHNDNIKDHSTYTEDRHSSVV

SEQ ID NO: 1728677 - protein, 5 aa, Staphylococcus epidermidis
QDPSI

SEQ ID NO: 1728678 - protein, 53 aa, Staphylococcus epidermidis
QHQESQQRANSNRATQSENDREYENHPERYYNGRDYRREQQLEEENEKSSKTK

SEQ ID NO: 1728679 - protein, 8 aa, Staphylococcus epidermidis
QIPRTRRS

SEQ ID NO: 1728680 - protein, 5 aa, Staphylococcus epidermidis
QKANY

SEQ ID NO: 1728681 - protein, 15 aa, Staphylococcus epidermidis
QKRQEEEKKKKRKKG

SEQ ID NO: 1728682 - protein, 11 aa, Staphylococcus epidermidis
QLYPGAPKGQF

SEQ ID NO: 1728683 - protein, 13 aa, Staphylococcus epidermidis
QNPNLSNEEKNKL

SEQ ID NO: 1728684 - protein, 13 aa, Staphylococcus epidermidis
QQGKNAVDEILEE

SEQ ID NO: 1728685 - protein, 5 aa, Staphylococcus epidermidis
QRGLK

SEQ ID NO: 1728686 - protein, 5 aa, Staphylococcus epidermidis
QRSEA

SEQ ID NO: 1728687 - protein, 12 aa, Staphylococcus epidermidis
QRYAITQKETSK

SEQ ID NO: 1728688 - protein, 5 aa, Staphylococcus epidermidis
RDGTV

SEQ ID NO: 1728689 - protein, 10 aa, Staphylococcus epidermidis
RDYESTNNKI

SEQ ID NO: 1728690 - protein, 36 aa, Staphylococcus epidermidis
REERIRREKIEKENQAKREQHQTKVNEERVKDNLRK

SEQ ID NO: 1728691 - protein, 105 aa, Staphylococcus epidermidis
REFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDD

SEQ ID NO: 1728692 - protein, 22 aa, Staphylococcus epidermidis
REHNPSSKKKGKNTQVVSKKNK

SEQ ID NO: 1728693 - protein, 6 aa, Staphylococcus epidermidis
RGIQPP

SEQ ID NO: 1728694 - protein, 5 aa, Staphylococcus epidermidis
RIENK

SEQ ID NO: 1728695 - protein, 4 aa, Staphylococcus epidermidis
RKNF

SEQ ID NO: 1728696 - protein, 9 aa, Staphylococcus epidermidis
RLSGGKDVD

SEQ ID NO: 1728697 - protein, 9 aa, Staphylococcus epidermidis
RNLTNEGYN

SEQ ID NO: 1728698 - protein, 7 aa, Staphylococcus epidermidis
RQHGGTI

SEQ ID NO: 1728699 - protein, 7 aa, Staphylococcus epidermidis
RQKKNTF

SEQ ID NO: 1728700 - protein, 5 aa, Staphylococcus epidermidis
RRDGF

SEQ ID NO: 1728701 - protein, 15 aa, Staphylococcus epidermidis
RSEQQPKASRHSKKH

SEQ ID NO: 1728702 - protein, 9 aa, Staphylococcus epidermidis
RTGSRTFDA

SEQ ID NO: 1728703 - protein, 4 aa, Staphylococcus epidermidis
RYGR

SEQ ID NO: 1728704 - protein, 13 aa, Staphylococcus epidermidis
RYPKLGEKRYTEK

SEQ ID NO: 1728705 - protein, 5 aa, Staphylococcus epidermidis
SDDIP

SEQ ID NO: 1728706 - protein, 10 aa, Staphylococcus epidermidis
SDDQSINHSK

SEQ ID NO: 1728707 - protein, 33 aa, Staphylococcus epidermidis
SDGRQSINAITPDTSIKRNAKNDIDIKAADKKI

SEQ ID NO: 1728708 - protein, 4 aa, Staphylococcus epidermidis
SDRY

SEQ ID NO: 1728709 - protein, 5 aa, Staphylococcus epidermidis
SDTQE

SEQ ID NO: 1728710 - protein, 10 aa, Staphylococcus epidermidis
SENSDQVNVT

SEQ ID NO: 1728711 - protein, 5 aa, Staphylococcus epidermidis
SGATG

SEQ ID NO: 1728712 - protein, 6 aa, Staphylococcus epidermidis
SGNSHA

SEQ ID NO: 1728713 - protein, 11 aa, Staphylococcus epidermidis
SIPPSEKEETF

SEQ ID NO: 1728714 - protein, 8 aa, Staphylococcus epidermidis
SKEIKEAD

SEQ ID NO: 1728715 - protein, 11 aa, Staphylococcus epidermidis
SKGIKDNRKND

SEQ ID NO: 1728716 - protein, 34 aa, Staphylococcus epidermidis
SKNVSDQTSSDNLSNDSTVHHQSTIQNEESQDNR

SEQ ID NO: 1728717 - protein, 9 aa, Staphylococcus epidermidis
SKPPTKNYT

SEQ ID NO: 1728718 - protein, 4 aa, Staphylococcus epidermidis
SLGN

SEQ ID NO: 1728719 - protein, 12 aa, Staphylococcus epidermidis
SLPSEKVDDTYK

SEQ ID NO: 1728720 - protein, 4 aa, Staphylococcus epidermidis
SNID

SEQ ID NO: 1728721 - protein, 6 aa, Staphylococcus epidermidis
SNKNLD

SEQ ID NO: 1728722 - protein, 5 aa, Staphylococcus epidermidis
SNPDA

SEQ ID NO: 1728723 - protein, 15 aa, Staphylococcus epidermidis
SNRVGGKIQTYRSDG

SEQ ID NO: 1728724 - protein, 9 aa, Staphylococcus epidermidis
SPTGSSAAV

SEQ ID NO: 1728725 - protein, 9 aa, Staphylococcus epidermidis
SQHPSNQAF

SEQ ID NO: 1728726 - protein, 7 aa, Staphylococcus epidermidis
SQNHSES

SEQ ID NO: 1728727 - protein, 13 aa, Staphylococcus epidermidis
SQQGTLMCYQIPL

SEQ ID NO: 1728728 - protein, 5 aa, Staphylococcus epidermidis
SQSTK

SEQ ID NO: 1728729 - protein, 10 aa, Staphylococcus epidermidis
SRNTHGNSGW

SEQ ID NO: 1728730 - protein, 12 aa, Staphylococcus epidermidis
SSIARGLTYGNA

SEQ ID NO: 1728731 - protein, 5 aa, Staphylococcus epidermidis
SSNDR

SEQ ID NO: 1728732 - protein, 10 aa, Staphylococcus epidermidis
SSNEKPKGNK

SEQ ID NO: 1728733 - protein, 8 aa, Staphylococcus epidermidis
STDAVAAS

SEQ ID NO: 1728734 - protein, 8 aa, Staphylococcus epidermidis
STIKPQAL

SEQ ID NO: 1728735 - protein, 12 aa, Staphylococcus epidermidis
STKNKKVDDVEA

SEQ ID NO: 1728736 - protein, 10 aa, Staphylococcus epidermidis
SYAPKNMTIK

SEQ ID NO: 1728737 - protein, 17 aa, Staphylococcus epidermidis
SYLREQAKHPNDVSGNY

SEQ ID NO: 1728738 - protein, 19 aa, Staphylococcus epidermidis
TAKNPVRDQKGRNLTNGTD

SEQ ID NO: 1728739 - protein, 5 aa, Staphylococcus epidermidis
TAPDK

SEQ ID NO: 1728740 - protein, 9 aa, Staphylococcus epidermidis
TDDVNEDGY

SEQ ID NO: 1728741 - protein, 11 aa, Staphylococcus epidermidis
TDLGRNFSGTV

SEQ ID NO: 1728742 - protein, 8 aa, Staphylococcus epidermidis
TDMRGNDT

SEQ ID NO: 1728743 - protein, 8 aa, Staphylococcus epidermidis
TEEEAKEI

SEQ ID NO: 1728744 - protein, 30 aa, Staphylococcus epidermidis
TEPHSSGLGGGGATLTYNGKENETPKAYEY

SEQ ID NO: 1728745 - protein, 24 aa, Staphylococcus epidermidis
TFQQDNNLKVNGNFDKKTNDKFTE

SEQ ID NO: 1728746 - protein, 6 aa, Staphylococcus epidermidis
TGGKDN

SEQ ID NO: 1728747 - protein, 33 aa, Staphylococcus epidermidis
TGKEDSAHPTPTTTVKKGANPNDTHSDSSQGDS

SEQ ID NO: 1728748 - protein, 4 aa, Staphylococcus epidermidis
TGLQ

SEQ ID NO: 1728749 - protein, 7 aa, Staphylococcus epidermidis
TGRAAEN

SEQ ID NO: 1728750 - protein, 17 aa, Staphylococcus epidermidis
TGRKLERKDFRKGYTAE

SEQ ID NO: 1728751 - protein, 11 aa, Staphylococcus epidermidis
TGTYDNTNKQI

SEQ ID NO: 1728752 - protein, 21 aa, Staphylococcus epidermidis
TLPNYTEASEDKKEKVDQTVS

SEQ ID NO: 1728753 - protein, 6 aa, Staphylococcus epidermidis
TLQRTT

SEQ ID NO: 1728754 - protein, 7 aa, Staphylococcus epidermidis
TNTTGQS

SEQ ID NO: 1728755 - protein, 21 aa, Staphylococcus epidermidis
TPAIAKSNNGNDTSVGTENVF

SEQ ID NO: 1728756 - protein, 8 aa, Staphylococcus epidermidis
TPGNANVS

SEQ ID NO: 1728757 - protein, 6 aa, Staphylococcus epidermidis
TREETE

SEQ ID NO: 1728758 - protein, 7 aa, Staphylococcus epidermidis
TSITTPS

SEQ ID NO: 1728759 - protein, 10 aa, Staphylococcus epidermidis
TSNEPIKDSE

SEQ ID NO: 1728760 - protein, 6 aa, Staphylococcus epidermidis
TSQTDI

SEQ ID NO: 1728761 - protein, 15 aa, Staphylococcus epidermidis
TTNETESRNYPLGKA

SEQ ID NO: 1728762 - protein, 5 aa, Staphylococcus epidermidis
TTRQA

SEQ ID NO: 1728763 - protein, 9 aa, Staphylococcus epidermidis
TTSPGSTQK

SEQ ID NO: 1728764 - protein, 8 aa, Staphylococcus epidermidis
TYKLPGGQ

SEQ ID NO: 1728765 - protein, 21 aa, Staphylococcus epidermidis
VGDQEKQKVTYGNDKSVTGKV

SEQ ID NO: 1728766 - protein, 9 aa, Staphylococcus epidermidis
VGEDIPSDY

SEQ ID NO: 1728767 - protein, 10 aa, Staphylococcus epidermidis
VKDKPIKPAR

SEQ ID NO: 1728768 - protein, 12 aa, Staphylococcus epidermidis
VKNNSKEEIPVG

SEQ ID NO: 1728769 - protein, 7 aa, Staphylococcus epidermidis
VNHDDVP

SEQ ID NO: 1728770 - protein, 15 aa, Staphylococcus epidermidis
VNKDAENPKPKEGIG

SEQ ID NO: 1728771 - protein, 9 aa, Staphylococcus epidermidis
VNKNDKTIT

SEQ ID NO: 1728772 - protein, 6 aa, Staphylococcus epidermidis
VPMSEK

SEQ ID NO: 1728773 - protein, 19 aa, Staphylococcus epidermidis
VRLNGKDMNSINDNDKYQT

SEQ ID NO: 1728774 - protein, 17 aa, Staphylococcus epidermidis
VRPLSTTSAQPSSKRVT

SEQ ID NO: 1728775 - protein, 5 aa, Staphylococcus epidermidis
VSQND

SEQ ID NO: 1728776 - protein, 15 aa, Staphylococcus epidermidis
VYEQRNVNDREKITE

SEQ ID NO: 1728777 - protein, 8 aa, Staphylococcus epidermidis
YADNAEPV

SEQ ID NO: 1728778 - protein, 4 aa, Staphylococcus epidermidis
YANI

SEQ ID NO: 1728779 - protein, 10 aa, Staphylococcus epidermidis
YDIPTKKAPK

SEQ ID NO: 1728780 - protein, 17 aa, Staphylococcus epidermidis
YGENYQTLKKASQQLQP

SEQ ID NO: 1728781 - protein, 19 aa, Staphylococcus epidermidis
YPDGTSKSVRTDEEGKYQF

SEQ ID NO: 1728782 - protein, 5 aa, Staphylococcus epidermidis
YPIPG

SEQ ID NO: 1728783 - protein, 11 aa, Staphylococcus epidermidis
YQKPNENRTAN

SEQ ID NO: 1728784 - protein, 25 aa, Staphylococcus epidermidis
YQNQSNQKNYSKKNKEKECLNVKLD

SEQ ID NO: 1728785 - protein, 7 aa, Staphylococcus epidermidis
YSDGFGS

SEQ ID NO: 1728786 - protein, 9 aa, Staphylococcus epidermidis
YSDNRTVRY

SEQ ID NO: 1728787 - protein, 7 aa, Staphylococcus epidermidis
YSQTYEK

SEQ ID NO: 1728788 - protein, 19 aa, Staphylococcus epidermidis
YTGSATHTGPLGNELPNSS

SEQ ID NO: 1728789 - protein, 12 aa, Staphylococcus epidermidis
AAKNLKESQKGA

SEQ ID NO: 1728790 - protein, 18 aa, Staphylococcus epidermidis
AAPTTTSTTTTSSLTSNS

SEQ ID NO: 1728791 - protein, 42 aa, Staphylococcus epidermidis
ADQSGATLAEETTENQSYKSQAEKRAYEHKKQFQSQRKQSKW

SEQ ID NO: 1728792 - protein, 4 aa, Staphylococcus epidermidis
AEKQ

SEQ ID NO: 1728793 - protein, 11 aa, Staphylococcus epidermidis
AGDTIKQENPS

SEQ ID NO: 1728794 - protein, 7 aa, Staphylococcus epidermidis
AGGSTDL

SEQ ID NO: 1728795 - protein, 38 aa, Staphylococcus epidermidis
AHKKSDAKQSIDNKYNEQSNTINTTPDATDEEKQKALD

SEQ ID NO: 1728796 - protein, 5 aa, Staphylococcus epidermidis
AHNSG

SEQ ID NO: 1728797 - protein, 4 aa, Staphylococcus epidermidis
AHQK

SEQ ID NO: 1728798 - protein, 17 aa, Staphylococcus epidermidis
AIDKVNHSKSIKDIETV

SEQ ID NO: 1728799 - protein, 6 aa, Staphylococcus epidermidis
AIHDAG

SEQ ID NO: 1728800 - protein, 7 aa, Staphylococcus epidermidis
AINGDPR

SEQ ID NO: 1728801 - protein, 12 aa, Staphylococcus epidermidis
AINGDPRVKYKE

SEQ ID NO: 1728802 - protein, 14 aa, Staphylococcus epidermidis
AKENGKNLDEKQIQ

SEQ ID NO: 1728803 - protein, 8 aa, Staphylococcus epidermidis
AKKNDGAV

SEQ ID NO: 1728804 - protein, 11 aa, Staphylococcus epidermidis
AKNLKESQKGA

SEQ ID NO: 1728805 - protein, 9 aa, Staphylococcus epidermidis
AKQPTVQKT

SEQ ID NO: 1728806 - protein, 8 aa, Staphylococcus epidermidis
AKSDYTEG

SEQ ID NO: 1728807 - protein, 7 aa, Staphylococcus epidermidis
ALEEGKA

SEQ ID NO: 1728808 - protein, 8 aa, Staphylococcus epidermidis
ALGGLSGS

SEQ ID NO: 1728809 - protein, 17 aa, Staphylococcus epidermidis
ALQQSLDNQPSTTGMTE

SEQ ID NO: 1728810 - protein, 5 aa, Staphylococcus epidermidis
ANSGV

SEQ ID NO: 1728811 - protein, 4 aa, Staphylococcus epidermidis
AQHT

SEQ ID NO: 1728812 - protein, 10 aa, Staphylococcus epidermidis
AQQNALNEKI

SEQ ID NO: 1728813 - protein, 9 aa, Staphylococcus epidermidis
ARGLTYGNA

SEQ ID NO: 1728814 - protein, 5 aa, Staphylococcus epidermidis
ARVIK

SEQ ID NO: 1728815 - protein, 24 aa, Staphylococcus epidermidis
ASALGDSGSPASDSTLGPTAGLNI

SEQ ID NO: 1728816 - protein, 9 aa, Staphylococcus epidermidis
ASKNESSWT

SEQ ID NO: 1728817 - protein, 9 aa, Staphylococcus epidermidis
ASKNGSSWT

SEQ ID NO: 1728818 - protein, 6 aa, Staphylococcus epidermidis
ASSATR

SEQ ID NO: 1728819 - protein, 5 aa, Staphylococcus epidermidis
ATEDN

SEQ ID NO: 1728820 - protein, 9 aa, Staphylococcus epidermidis
ATEKSLPPW

SEQ ID NO: 1728821 - protein, 16 aa, Staphylococcus epidermidis
ATLLSGKGAYQKSDTE

SEQ ID NO: 1728822 - protein, 6 aa, Staphylococcus epidermidis
ATMPGS

SEQ ID NO: 1728823 - protein, 11 aa, Staphylococcus epidermidis
ATTNGGLDITG

SEQ ID NO: 1728824 - protein, 34 aa, Staphylococcus epidermidis
ATTVKDKAKADVNAEKEQKNLQINSNDEATTEEK

SEQ ID NO: 1728825 - protein, 10 aa, Staphylococcus epidermidis
AVNQANNDLN

SEQ ID NO: 1728826 - protein, 9 aa, Staphylococcus epidermidis
AVQVPNKNR

SEQ ID NO: 1728827 - protein, 5 aa, Staphylococcus epidermidis
AVRAD

SEQ ID NO: 1728828 - protein, 6 aa, Staphylococcus epidermidis
AVRADA

SEQ ID NO: 1728829 - protein, 8 aa, Staphylococcus epidermidis
AYKEDASI

SEQ ID NO: 1728830 - protein, 23 aa, Staphylococcus epidermidis
AYTREGDISSLGTQKEFKEEEMP

SEQ ID NO: 1728831 - protein, 33 aa, Staphylococcus epidermidis
CGTPVRNDGPNYKHSEQRYSHQQPRSNKSNKKT

SEQ ID NO: 1728832 - protein, 7 aa, Staphylococcus epidermidis
DANQTVE

SEQ ID NO: 1728833 - protein, 18 aa, Staphylococcus epidermidis
DAQEKLNAVNSSIPALNE

SEQ ID NO: 1728834 - protein, 17 aa, Staphylococcus epidermidis
DASTNSIVGTPTQIGTN

SEQ ID NO: 1728835 - protein, 5 aa, Staphylococcus epidermidis
DDIND

SEQ ID NO: 1728836 - protein, 4 aa, Staphylococcus epidermidis
DDNE

SEQ ID NO: 1728837 - protein, 21 aa, Staphylococcus epidermidis
DELNSAKEWGTKGKESNGSGI

SEQ ID NO: 1728838 - protein, 28 aa, Staphylococcus epidermidis
DEQSHQTTESQQSNESDQNRDQSTGPSI

SEQ ID NO: 1728839 - protein, 13 aa, Staphylococcus epidermidis
DETQATLSSDTIN

SEQ ID NO: 1728840 - protein, 12 aa, Staphylococcus epidermidis
DGKATSYKQTAM

SEQ ID NO: 1728841 - protein, 13 aa, Staphylococcus epidermidis
DGKATSYKQTTMD

SEQ ID NO: 1728842 - protein, 26 aa, Staphylococcus epidermidis
DGPNYKHSEQRYSHQQPRSNKSNKKT

SEQ ID NO: 1728843 - protein, 11 aa, Staphylococcus epidermidis
DGVNQANNDLN

SEQ ID NO: 1728844 - protein, 5 aa, Staphylococcus epidermidis
DHSQN

SEQ ID NO: 1728845 - protein, 4 aa, Staphylococcus epidermidis
DIDE

SEQ ID NO: 1728846 - protein, 8 aa, Staphylococcus epidermidis
DIPTNQAP

SEQ ID NO: 1728847 - protein, 5 aa, Staphylococcus epidermidis
DISTR

SEQ ID NO: 1728848 - protein, 16 aa, Staphylococcus epidermidis
DKDNKDDSRSNNEEKE

SEQ ID NO: 1728849 - protein, 17 aa, Staphylococcus epidermidis
DKDNKKDDSQSNNEEKE

SEQ ID NO: 1728850 - protein, 9 aa, Staphylococcus epidermidis
DKKSNAIKT

SEQ ID NO: 1728851 - protein, 8 aa, Staphylococcus epidermidis
DLTPKGTF

SEQ ID NO: 1728852 - protein, 6 aa, Staphylococcus epidermidis
DMSENI

SEQ ID NO: 1728853 - protein, 9 aa, Staphylococcus epidermidis
DNDRTQNPN

SEQ ID NO: 1728854 - protein, 18 aa, Staphylococcus epidermidis
DNEKQNRKEFSVSKRAGH

SEQ ID NO: 1728855 - protein, 16 aa, Staphylococcus epidermidis
DNVDTVSKAQLTDNNN

SEQ ID NO: 1728856 - protein, 16 aa, Staphylococcus epidermidis
DPKAHAKKEIRELPNE

SEQ ID NO: 1728857 - protein, 6 aa, Staphylococcus epidermidis
DQKTIT

SEQ ID NO: 1728858 - protein, 54 aa, Staphylococcus epidermidis
DQVPSTEGMTQQTKDDYNSKQQAAQQEISKAQQVIDNGDATTQQISNAKTNVER

SEQ ID NO: 1728859 - protein, 4 aa, Staphylococcus epidermidis
DRKN

SEQ ID NO: 1728860 - protein, 8 aa, Staphylococcus epidermidis
DSAQNDGL

SEQ ID NO: 1728861 - protein, 8 aa, Staphylococcus epidermidis
DSKIQRKI

SEQ ID NO: 1728862 - protein, 5 aa, Staphylococcus epidermidis
DSQAG

SEQ ID NO: 1728863 - protein, 5 aa, Staphylococcus epidermidis
DSRTV

SEQ ID NO: 1728864 - protein, 17 aa, Staphylococcus epidermidis
DTLAQARNNINGANTNA

SEQ ID NO: 1728865 - protein, 18 aa, Staphylococcus epidermidis
DTLAQARNNINGANTNAL

SEQ ID NO: 1728866 - protein, 17 aa, Staphylococcus epidermidis
DTNKDGIQDDSEKGISG

SEQ ID NO: 1728867 - protein, 21 aa, Staphylococcus epidermidis
DTTKPTVESIAGQTQEVNTEI

SEQ ID NO: 1728868 - protein, 9 aa, Staphylococcus epidermidis
DVDSGGTIG

SEQ ID NO: 1728869 - protein, 6 aa, Staphylococcus epidermidis
DVYQPQ

SEQ ID NO: 1728870 - protein, 5 aa, Staphylococcus epidermidis
DYTNA

SEQ ID NO: 1728871 - protein, 9 aa, Staphylococcus epidermidis
EAKNNAITG

SEQ ID NO: 1728872 - protein, 5 aa, Staphylococcus epidermidis
EAKQV

SEQ ID NO: 1728873 - protein, 7 aa, Staphylococcus epidermidis
EANQTVE

SEQ ID NO: 1728874 - protein, 6 aa, Staphylococcus epidermidis
EARVIK

SEQ ID NO: 1728875 - protein, 19 aa, Staphylococcus epidermidis
EATDNSGQAVTNKVEGLPA

SEQ ID NO: 1728876 - protein, 21 aa, Staphylococcus epidermidis
EATDNSGQAVTNKVEGLPDGV

SEQ ID NO: 1728877 - protein, 5 aa, Staphylococcus epidermidis
EAVTS

SEQ ID NO: 1728878 - protein, 6 aa, Staphylococcus epidermidis
EDERQR

SEQ ID NO: 1728879 - protein, 32 aa, Staphylococcus epidermidis
EDQVNQDDQISNSSPFINEDSDKQKTYNDKIQ

SEQ ID NO: 1728880 - protein, 22 aa, Staphylococcus epidermidis
EDTTKPTVEDIADQTQEVNTEI

SEQ ID NO: 1728881 - protein, 22 aa, Staphylococcus epidermidis
EDTTKPTVESVADQTQEVNTEI

SEQ ID NO: 1728882 - protein, 37 aa, Staphylococcus epidermidis
EEIHQQRDDKSYKQKTLNQNNQMNKSKDDDNKIGEES

SEQ ID NO: 1728883 - protein, 44 aa, Staphylococcus epidermidis
EEIKPGHKDEFDPNAPKGSQTTQPGKPGVKNPDTGEVVTPPVDD

SEQ ID NO: 1728884 - protein, 20 aa, Staphylococcus epidermidis
EEQSNVHQQSKYINEDPQVQ

SEQ ID NO: 1728885 - protein, 29 aa, Staphylococcus epidermidis
EESIKDKEQVKQSSNYINEDSDVQETYDN

SEQ ID NO: 1728886 - protein, 20 aa, Staphylococcus epidermidis
EFNTPEELKKRAKLREERRE

SEQ ID NO: 1728887 - protein, 21 aa, Staphylococcus epidermidis
EFNTPEELKKRAKLREERREK

SEQ ID NO: 1728888 - protein, 56 aa, Staphylococcus epidermidis
EGKALEEDNHHDTSSEKGHVNDKNSEYSRQDKDNYVYQNDKRNYNRNYNDEDYNRS

SEQ ID NO: 1728889 - protein, 7 aa, Staphylococcus epidermidis
EGKINLN

SEQ ID NO: 1728890 - protein, 8 aa, Staphylococcus epidermidis
EGNLKKQS

SEQ ID NO: 1728891 - protein, 4 aa, Staphylococcus epidermidis
EIEQ

SEQ ID NO: 1728892 - protein, 7 aa, Staphylococcus epidermidis
EIQENSD

SEQ ID NO: 1728893 - protein, 7 aa, Staphylococcus epidermidis
EKAEDRA

SEQ ID NO: 1728894 - protein, 9 aa, Staphylococcus epidermidis
EKEGKMDEK

SEQ ID NO: 1728895 - protein, 14 aa, Staphylococcus epidermidis
EKESRKRYSPNSTY

SEQ ID NO: 1728896 - protein, 9 aa, Staphylococcus epidermidis
EKNNRQRQY

SEQ ID NO: 1728897 - protein, 9 aa, Staphylococcus epidermidis
EKPLQSEMA

SEQ ID NO: 1728898 - protein, 7 aa, Staphylococcus epidermidis
EKSLPPW

SEQ ID NO: 1728899 - protein, 7 aa, Staphylococcus epidermidis
EKYRSEG

SEQ ID NO: 1728900 - protein, 8 aa, Staphylococcus epidermidis
EKYRSEGV

SEQ ID NO: 1728901 - protein, 8 aa, Staphylococcus epidermidis
ENEFTDDP

SEQ ID NO: 1728902 - protein, 83 aa, Staphylococcus epidermidis
ENKTNQIEHASTMKEKSNINNVKTTKNKNMEKSTQTDKQNSVNLKQNTKDQNNNANDEAASPTSEQNAAIAQAKSYANTLPIS

SEQ ID NO: 1728903 - protein, 14 aa, Staphylococcus epidermidis
ENPTIYQNKDGHLK

SEQ ID NO: 1728904 - protein, 7 aa, Staphylococcus epidermidis
ENTLNNN

SEQ ID NO: 1728905 - protein, 19 aa, Staphylococcus epidermidis
ENYELYGKTGTGIVNGKYN

SEQ ID NO: 1728906 - protein, 45 aa, Staphylococcus epidermidis
EPMHTKKEDRNTRRQFNRNAQQQDSYNGITDNQPDEDTSSDQLYS

SEQ ID NO: 1728907 - protein, 15 aa, Staphylococcus epidermidis
EPQEFQSKKPKKKNQ

SEQ ID NO: 1728908 - protein, 9 aa, Staphylococcus epidermidis
ERATSNVKI

SEQ ID NO: 1728909 - protein, 4 aa, Staphylococcus epidermidis
ESIH

SEQ ID NO: 1728910 - protein, 15 aa, Staphylococcus epidermidis
ESNYTNSLKNTTSIS

SEQ ID NO: 1728911 - protein, 25 aa, Staphylococcus epidermidis
ESYEGHTLDTDTYTYKEPEKTGDGK

SEQ ID NO: 1728912 - protein, 26 aa, Staphylococcus epidermidis
ESYEGHTLDTDTYTYKEPEKTGDGKW

SEQ ID NO: 1728913 - protein, 18 aa, Staphylococcus epidermidis
ETINNYNAKKREAQNEIQ

SEQ ID NO: 1728914 - protein, 28 aa, Staphylococcus epidermidis
ETPSGYTPTKANSGQDITVDSNGITTTG

SEQ ID NO: 1728915 - protein, 6 aa, Staphylococcus epidermidis
ETSLNG

SEQ ID NO: 1728916 - protein, 24 aa, Staphylococcus epidermidis
EYTDRGKNIVAEQTNPNMSPTNIN

SEQ ID NO: 1728917 - protein, 12 aa, Staphylococcus epidermidis
FEQKDPNFTAEE

SEQ ID NO: 1728918 - protein, 5 aa, Staphylococcus epidermidis
FGENE

SEQ ID NO: 1728919 - protein, 16 aa, Staphylococcus epidermidis
FKNNKQIKKANSSYQY

SEQ ID NO: 1728920 - protein, 10 aa, Staphylococcus epidermidis
FKNPAPKNAV

SEQ ID NO: 1728921 - protein, 17 aa, Staphylococcus epidermidis
FKSKDLKGTNGNMKIPS

SEQ ID NO: 1728922 - protein, 4 aa, Staphylococcus epidermidis
FNEL

SEQ ID NO: 1728923 - protein, 12 aa, Staphylococcus epidermidis
FNELAKSDYTEG

SEQ ID NO: 1728924 - protein, 6 aa, Staphylococcus epidermidis
FNEQDL

SEQ ID NO: 1728925 - protein, 7 aa, Staphylococcus epidermidis
FNEQDLE

SEQ ID NO: 1728926 - protein, 10 aa, Staphylococcus epidermidis
FNKNDTPETM

SEQ ID NO: 1728927 - protein, 19 aa, Staphylococcus epidermidis
FPVQASSNYINSDEDLKQQ

SEQ ID NO: 1728928 - protein, 8 aa, Staphylococcus epidermidis
FRKGEPGL

SEQ ID NO: 1728929 - protein, 6 aa, Staphylococcus epidermidis
FSSKGI

SEQ ID NO: 1728930 - protein, 12 aa, Staphylococcus epidermidis
FTTNATNADNIK

SEQ ID NO: 1728931 - protein, 15 aa, Staphylococcus epidermidis
GANKLSDKSEKVQIN

SEQ ID NO: 1728932 - protein, 13 aa, Staphylococcus epidermidis
GDGDLKGASVGRK

SEQ ID NO: 1728933 - protein, 8 aa, Staphylococcus epidermidis
GDPKDKAT

SEQ ID NO: 1728934 - protein, 4 aa, Staphylococcus epidermidis
GDTK

SEQ ID NO: 1728935 - protein, 10 aa, Staphylococcus epidermidis
GEGTQANVDK

SEQ ID NO: 1728936 - protein, 11 aa, Staphylococcus epidermidis
GEGTQANVDKI

SEQ ID NO: 1728937 - protein, 7 aa, Staphylococcus epidermidis
GEKIPVD

SEQ ID NO: 1728938 - protein, 4 aa, Staphylococcus epidermidis
GESI

SEQ ID NO: 1728939 - protein, 6 aa, Staphylococcus epidermidis
GFSQGF

SEQ ID NO: 1728940 - protein, 4 aa, Staphylococcus epidermidis
GFTN

SEQ ID NO: 1728941 - protein, 6 aa, Staphylococcus epidermidis
GGSTDL

SEQ ID NO: 1728942 - protein, 11 aa, Staphylococcus epidermidis
GILENKGSTFI

SEQ ID NO: 1728943 - protein, 13 aa, Staphylococcus epidermidis
GKDANKEIRPNDG

SEQ ID NO: 1728944 - protein, 9 aa, Staphylococcus epidermidis
GKKQSEPYL

SEQ ID NO: 1728945 - protein, 10 aa, Staphylococcus epidermidis
GKQAKSYPID

SEQ ID NO: 1728946 - protein, 4 aa, Staphylococcus epidermidis
GLND

SEQ ID NO: 1728947 - protein, 5 aa, Staphylococcus epidermidis
GLNDP

SEQ ID NO: 1728948 - protein, 4 aa, Staphylococcus epidermidis
GLPQ

SEQ ID NO: 1728949 - protein, 5 aa, Staphylococcus epidermidis
GNIKD

SEQ ID NO: 1728950 - protein, 14 aa, Staphylococcus epidermidis
GNTTSDNFLSKNQK

SEQ ID NO: 1728951 - protein, 9 aa, Staphylococcus epidermidis
GNYSEAKNV

SEQ ID NO: 1728952 - protein, 4 aa, Staphylococcus epidermidis
GQFA

SEQ ID NO: 1728953 - protein, 5 aa, Staphylococcus epidermidis
GQFAT

SEQ ID NO: 1728954 - protein, 13 aa, Staphylococcus epidermidis
GQSSTGKSTAASL

SEQ ID NO: 1728955 - protein, 15 aa, Staphylococcus epidermidis
GRKLIQTSNDNTLAY

SEQ ID NO: 1728956 - protein, 6 aa, Staphylococcus epidermidis
GRSTVD

SEQ ID NO: 1728957 - protein, 4 aa, Staphylococcus epidermidis
GTGA

SEQ ID NO: 1728958 - protein, 6 aa, Staphylococcus epidermidis
GTGTEV

SEQ ID NO: 1728959 - protein, 11 aa, Staphylococcus epidermidis
GTPGDSVEYKN

SEQ ID NO: 1728960 - protein, 5 aa, Staphylococcus epidermidis
GTTSI

SEQ ID NO: 1728961 - protein, 9 aa, Staphylococcus epidermidis
GVDAQKGGI

SEQ ID NO: 1728962 - protein, 4 aa, Staphylococcus epidermidis
GVYD

SEQ ID NO: 1728963 - protein, 46 aa, Staphylococcus epidermidis
HANATSNSKAQAKQMVNEEARKALSNINDATSNDLVNQAKDEGQSA

SEQ ID NO: 1728964 - protein, 34 aa, Staphylococcus epidermidis
HDFQSKIPSLKGWKNTKDVYQPNVQDNGAEYNKE

SEQ ID NO: 1728965 - protein, 12 aa, Staphylococcus epidermidis
HFSKNEKKQLSS

SEQ ID NO: 1728966 - protein, 7 aa, Staphylococcus epidermidis
HGTHANS

SEQ ID NO: 1728967 - protein, 18 aa, Staphylococcus epidermidis
HNEQEDKRPNTANQRQKR

SEQ ID NO: 1728968 - protein, 4 aa, Staphylococcus epidermidis
HNGD

SEQ ID NO: 1728969 - protein, 4 aa, Staphylococcus epidermidis
HNTV

SEQ ID NO: 1728970 - protein, 5 aa, Staphylococcus epidermidis
HPTDI

SEQ ID NO: 1728971 - protein, 6 aa, Staphylococcus epidermidis
HPTFNK

SEQ ID NO: 1728972 - protein, 7 aa, Staphylococcus epidermidis
HSDFSTG

SEQ ID NO: 1728973 - protein, 8 aa, Staphylococcus epidermidis
HSEQDYPQ

SEQ ID NO: 1728974 - protein, 7 aa, Staphylococcus epidermidis
HSEQEYP

SEQ ID NO: 1728975 - protein, 14 aa, Staphylococcus epidermidis
HTRTSGDSAPFKRQ

SEQ ID NO: 1728976 - protein, 8 aa, Staphylococcus epidermidis
HYNKPSDQ

SEQ ID NO: 1728977 - protein, 44 aa, Staphylococcus epidermidis
IADYENQKQQENYLDASNNKRQDYDNAVNAAKGILNQTQSPTMS

SEQ ID NO: 1728978 - protein, 8 aa, Staphylococcus epidermidis
IAHSKNET

SEQ ID NO: 1728979 - protein, 12 aa, Staphylococcus epidermidis
IANYDDELHDGN

SEQ ID NO: 1728980 - protein, 7 aa, Staphylococcus epidermidis
IAQNSGN

SEQ ID NO: 1728981 - protein, 25 aa, Staphylococcus epidermidis
IASDTDQIRDSKDQHVTDEKQDIQA

SEQ ID NO: 1728982 - protein, 4 aa, Staphylococcus epidermidis
IDVP

SEQ ID NO: 1728983 - protein, 69 aa, Staphylococcus epidermidis
IEAQSEDVTNHTNSNHSNSSIPENKATTESSSKPKKRGKRSLDTNSGNDTTSTTQNTDPNLSNTGPNGI

SEQ ID NO: 1728984 - protein, 6 aa, Staphylococcus epidermidis
IEGKAN

SEQ ID NO: 1728985 - protein, 7 aa, Staphylococcus epidermidis
IEGKAND

SEQ ID NO: 1728986 - protein, 4 aa, Staphylococcus epidermidis
IESK

SEQ ID NO: 1728987 - protein, 7 aa, Staphylococcus epidermidis
IFGSNSG

SEQ ID NO: 1728988 - protein, 5 aa, Staphylococcus epidermidis
IHYEK

SEQ ID NO: 1728989 - protein, 4 aa, Staphylococcus epidermidis
IHYK

SEQ ID NO: 1728990 - protein, 19 aa, Staphylococcus epidermidis
IKDKSIDLKSDQNGGYTFE

SEQ ID NO: 1728991 - protein, 5 aa, Staphylococcus epidermidis
IKNSK

SEQ ID NO: 1728992 - protein, 5 aa, Staphylococcus epidermidis
IKSPG

SEQ ID NO: 1728993 - protein, 6 aa, Staphylococcus epidermidis
IKSPGF

SEQ ID NO: 1728994 - protein, 10 aa, Staphylococcus epidermidis
ILENKGSTFI

SEQ ID NO: 1728995 - protein, 9 aa, Staphylococcus epidermidis
ILKSKEKDI

SEQ ID NO: 1728996 - protein, 28 aa, Staphylococcus epidermidis
INDAEQNLHGDNKLRQAQEIAKNEIQNL

SEQ ID NO: 1728997 - protein, 31 aa, Staphylococcus epidermidis
INEDANQQQAYSNAIASAEALKNKSQNPELD

SEQ ID NO: 1728998 - protein, 20 aa, Staphylococcus epidermidis
INNGDATAKQISDEKSKVEQ

SEQ ID NO: 1728999 - protein, 46 aa, Staphylococcus epidermidis
INNGDATSQQINDAKNTVEQAQRDYVEAKSNLRADKSQLQSAYDTL

SEQ ID NO: 1729000 - protein, 9 aa, Staphylococcus epidermidis
INTAKNDLH

SEQ ID NO: 1729001 - protein, 10 aa, Staphylococcus epidermidis
INTTKPIQEF

SEQ ID NO: 1729002 - protein, 10 aa, Staphylococcus epidermidis
INTTKPVQEF

SEQ ID NO: 1729003 - protein, 6 aa, Staphylococcus epidermidis
IQENSD

SEQ ID NO: 1729004 - protein, 7 aa, Staphylococcus epidermidis
IQKASSF

SEQ ID NO: 1729005 - protein, 4 aa, Staphylococcus epidermidis
IQQA

SEQ ID NO: 1729006 - protein, 14 aa, Staphylococcus epidermidis
IQSKDGKISKDNMN

SEQ ID NO: 1729007 - protein, 9 aa, Staphylococcus epidermidis
ISKKQSEVI

SEQ ID NO: 1729008 - protein, 9 aa, Staphylococcus epidermidis
ISNQASYDQ

SEQ ID NO: 1729009 - protein, 4 aa, Staphylococcus epidermidis
ISPQ

SEQ ID NO: 1729010 - protein, 4 aa, Staphylococcus epidermidis
ISTR

SEQ ID NO: 1729011 - protein, 23 aa, Staphylococcus epidermidis
ITPATTVKSEARQAVQNKANEQI

SEQ ID NO: 1729012 - protein, 8 aa, Staphylococcus epidermidis
KAKELNEA

SEQ ID NO: 1729013 - protein, 7 aa, Staphylococcus epidermidis
KATGIKQ

SEQ ID NO: 1729014 - protein, 19 aa, Staphylococcus epidermidis
KDALHGERELNDNKNSKTF

SEQ ID NO: 1729015 - protein, 5 aa, Staphylococcus epidermidis
KDHAP

SEQ ID NO: 1729016 - protein, 11 aa, Staphylococcus epidermidis
KDHPEVKKPLN

SEQ ID NO: 1729017 - protein, 53 aa, Staphylococcus epidermidis
KDKTDVNENATAQLRQNHSKGQSDWNHQQNQQQKDAWDPEQEINKQKKDDPYI

SEQ ID NO: 1729018 - protein, 9 aa, Staphylococcus epidermidis
KDKVTYEQT

SEQ ID NO: 1729019 - protein, 4 aa, Staphylococcus epidermidis
KDLE

SEQ ID NO: 1729020 - protein, 7 aa, Staphylococcus epidermidis
KDMSENI

SEQ ID NO: 1729021 - protein, 7 aa, Staphylococcus epidermidis
KDTIKNK

SEQ ID NO: 1729022 - protein, 8 aa, Staphylococcus epidermidis
KDTIKNKD

SEQ ID NO: 1729023 - protein, 6 aa, Staphylococcus epidermidis
KEGHEE

SEQ ID NO: 1729024 - protein, 8 aa, Staphylococcus epidermidis
KEGKMDEK

SEQ ID NO: 1729025 - protein, 6 aa, Staphylococcus epidermidis
KEQAET

SEQ ID NO: 1729026 - protein, 36 aa, Staphylococcus epidermidis
KEQLQQSIQPAASTDGMTQDSTRNYNNKRQAAEQAI

SEQ ID NO: 1729027 - protein, 12 aa, Staphylococcus epidermidis
KETSKSAVRYSE

SEQ ID NO: 1729028 - protein, 13 aa, Staphylococcus epidermidis
KETSKSAVRYSEV

SEQ ID NO: 1729029 - protein, 12 aa, Staphylococcus epidermidis
KGESFKKIDRKG

SEQ ID NO: 1729030 - protein, 12 aa, Staphylococcus epidermidis
KGKSFKKIDRKG

SEQ ID NO: 1729031 - protein, 6 aa, Staphylococcus epidermidis
KGRYHG

SEQ ID NO: 1729032 - protein, 5 aa, Staphylococcus epidermidis
KGVYD

SEQ ID NO: 1729033 - protein, 5 aa, Staphylococcus epidermidis
KGYNH

SEQ ID NO: 1729034 - protein, 14 aa, Staphylococcus epidermidis
KHKKSKEKQLSEED

SEQ ID NO: 1729035 - protein, 4 aa, Staphylococcus epidermidis
KIAN

SEQ ID NO: 1729036 - protein, 11 aa, Staphylococcus epidermidis
KIKNAGAIGIT

SEQ ID NO: 1729037 - protein, 10 aa, Staphylococcus epidermidis
KIKTSSSDGY

SEQ ID NO: 1729038 - protein, 6 aa, Staphylococcus epidermidis
KKDDYV

SEQ ID NO: 1729039 - protein, 8 aa, Staphylococcus epidermidis
KKDNPYDT

SEQ ID NO: 1729040 - protein, 26 aa, Staphylococcus epidermidis
KKDSNNNYKHQNDHIDRQGLNGYQKT

SEQ ID NO: 1729041 - protein, 27 aa, Staphylococcus epidermidis
KKDSNNNYKHQNDHIDRQGLNGYQKTD

SEQ ID NO: 1729042 - protein, 13 aa, Staphylococcus epidermidis
KKESRKAKIKNEE

SEQ ID NO: 1729043 - protein, 9 aa, Staphylococcus epidermidis
KKGSDAGYT

SEQ ID NO: 1729044 - protein, 10 aa, Staphylococcus epidermidis
KKGSDAGYTI

SEQ ID NO: 1729045 - protein, 6 aa, Staphylococcus epidermidis
KKNDSF

SEQ ID NO: 1729046 - protein, 6 aa, Staphylococcus epidermidis
KKPIDR

SEQ ID NO: 1729047 - protein, 7 aa, Staphylococcus epidermidis
KKPLQND

SEQ ID NO: 1729048 - protein, 7 aa, Staphylococcus epidermidis
KKPLQSD

SEQ ID NO: 1729049 - protein, 9 aa, Staphylococcus epidermidis
KLAQNQADS

SEQ ID NO: 1729050 - protein, 16 aa, Staphylococcus epidermidis
KLAYNSFGKTNKSGVP

SEQ ID NO: 1729051 - protein, 44 aa, Staphylococcus epidermidis
KLDKTLDKASKKQIHNYTSQQVSNKANTAWRDASGTEIKEAMDS

SEQ ID NO: 1729052 - protein, 55 aa, Staphylococcus epidermidis
KLDKTLDKASKKQIHNYTSQQVSNKANTAWRDASGTEIKEAMDSSKFIDDDKQKY

SEQ ID NO: 1729053 - protein, 7 aa, Staphylococcus epidermidis
KLNDQQI

SEQ ID NO: 1729054 - protein, 7 aa, Staphylococcus epidermidis
KLTQASF

SEQ ID NO: 1729055 - protein, 4 aa, Staphylococcus epidermidis
KMNP

SEQ ID NO: 1729056 - protein, 5 aa, Staphylococcus epidermidis
KMNPI

SEQ ID NO: 1729057 - protein, 7 aa, Staphylococcus epidermidis
KNADKVL

SEQ ID NO: 1729058 - protein, 6 aa, Staphylococcus epidermidis
KNEFKS

SEQ ID NO: 1729059 - protein, 7 aa, Staphylococcus epidermidis
KNEVHQN

SEQ ID NO: 1729060 - protein, 11 aa, Staphylococcus epidermidis
KNKEDAITNYA

SEQ ID NO: 1729061 - protein, 7 aa, Staphylococcus epidermidis
KNLGVNP

SEQ ID NO: 1729062 - protein, 7 aa, Staphylococcus epidermidis
KPLQSEM

SEQ ID NO: 1729063 - protein, 6 aa, Staphylococcus epidermidis
KPRFYN

SEQ ID NO: 1729064 - protein, 9 aa, Staphylococcus epidermidis
KQAQQQSIN

SEQ ID NO: 1729065 - protein, 19 aa, Staphylococcus epidermidis
KQTIQNNDDATTEEKEVAN

SEQ ID NO: 1729066 - protein, 9 aa, Staphylococcus epidermidis
KRAKQAKKD

SEQ ID NO: 1729067 - protein, 10 aa, Staphylococcus epidermidis
KRAKQAKKDL

SEQ ID NO: 1729068 - protein, 8 aa, Staphylococcus epidermidis
KRHTKEYH

SEQ ID NO: 1729069 - protein, 10 aa, Staphylococcus epidermidis
KRIKEHPDVQ

SEQ ID NO: 1729070 - protein, 4 aa, Staphylococcus epidermidis
KRIP

SEQ ID NO: 1729071 - protein, 92 aa, Staphylococcus epidermidis
KRKNKDKRVEQRSTIDSKRESNQSKFKASDLEQTTKSNTDPTQSNDIEDEKRKNHFDSEIDNASQSINTDSKEDRNALSHKNQEEDDASNDV

SEQ ID NO: 1729072 - protein, 8 aa, Staphylococcus epidermidis
KRNRQGEN

SEQ ID NO: 1729073 - protein, 9 aa, Staphylococcus epidermidis
KRNRQGENF

SEQ ID NO: 1729074 - protein, 7 aa, Staphylococcus epidermidis
KRSYFNK

SEQ ID NO: 1729075 - protein, 5 aa, Staphylococcus epidermidis
KRTDF

SEQ ID NO: 1729076 - protein, 4 aa, Staphylococcus epidermidis
KSAQ

SEQ ID NO: 1729077 - protein, 10 aa, Staphylococcus epidermidis
KSGANSRLST

SEQ ID NO: 1729078 - protein, 6 aa, Staphylococcus epidermidis
KSGKSW

SEQ ID NO: 1729079 - protein, 7 aa, Staphylococcus epidermidis
KSLEDKT

SEQ ID NO: 1729080 - protein, 8 aa, Staphylococcus epidermidis
KSQNHSES

SEQ ID NO: 1729081 - protein, 19 aa, Staphylococcus epidermidis
KSQNNTEHRLNSSDNTNSL

SEQ ID NO: 1729082 - protein, 5 aa, Staphylococcus epidermidis
KSRDY

SEQ ID NO: 1729083 - protein, 6 aa, Staphylococcus epidermidis
KSSEMI

SEQ ID NO: 1729084 - protein, 5 aa, Staphylococcus epidermidis
KTETV

SEQ ID NO: 1729085 - protein, 6 aa, Staphylococcus epidermidis
KTETVW

SEQ ID NO: 1729086 - protein, 17 aa, Staphylococcus epidermidis
KTKNLPNANPQSNVIPK

SEQ ID NO: 1729087 - protein, 49 aa, Staphylococcus epidermidis
KTNERQSTINTDNEGTIEEKQKAIQSLNDAKNLADEQITQAASNQNVDN

SEQ ID NO: 1729088 - protein, 6 aa, Staphylococcus epidermidis
KTNTIA

SEQ ID NO: 1729089 - protein, 7 aa, Staphylococcus epidermidis
KTPKYSV

SEQ ID NO: 1729090 - protein, 4 aa, Staphylococcus epidermidis
KTYQ

SEQ ID NO: 1729091 - protein, 7 aa, Staphylococcus epidermidis
KVEGPIG

SEQ ID NO: 1729092 - protein, 12 aa, Staphylococcus epidermidis
KVNRSGNNATVN

SEQ ID NO: 1729093 - protein, 12 aa, Staphylococcus epidermidis
KVPNANIDGKVG

SEQ ID NO: 1729094 - protein, 9 aa, Staphylococcus epidermidis
KYDEKKGAQ

SEQ ID NO: 1729095 - protein, 4 aa, Staphylococcus epidermidis
KYSG

SEQ ID NO: 1729096 - protein, 5 aa, Staphylococcus epidermidis
LAQHT

SEQ ID NO: 1729097 - protein, 39 aa, Staphylococcus epidermidis
LASEAKNKNAIIDQTPNATAEEKEEANNKVDRLQEEADA

SEQ ID NO: 1729098 - protein, 6 aa, Staphylococcus epidermidis
LATEDN

SEQ ID NO: 1729099 - protein, 19 aa, Staphylococcus epidermidis
LDAQEKLNAVNSSIPALNE

SEQ ID NO: 1729100 - protein, 6 aa, Staphylococcus epidermidis
LENGSY

SEQ ID NO: 1729101 - protein, 7 aa, Staphylococcus epidermidis
LEQQKTR

SEQ ID NO: 1729102 - protein, 11 aa, Staphylococcus epidermidis
LGKATDKPEFN

SEQ ID NO: 1729103 - protein, 20 aa, Staphylococcus epidermidis
LGQTSLSDYNESFLNFKMSL

SEQ ID NO: 1729104 - protein, 21 aa, Staphylococcus epidermidis
LKDEKGNIISTTTTDENGKYQ

SEQ ID NO: 1729105 - protein, 11 aa, Staphylococcus epidermidis
LKEAAQRSQTM

SEQ ID NO: 1729106 - protein, 4 aa, Staphylococcus epidermidis
LKEG

SEQ ID NO: 1729107 - protein, 7 aa, Staphylococcus epidermidis
LKKPIDR

SEQ ID NO: 1729108 - protein, 22 aa, Staphylococcus epidermidis
LKNKNGDTIGTTTTDSNGKYEF

SEQ ID NO: 1729109 - protein, 12 aa, Staphylococcus epidermidis
LNNSQKIQSNRL

SEQ ID NO: 1729110 - protein, 13 aa, Staphylococcus epidermidis
LNNSQKIQSNRLK

SEQ ID NO: 1729111 - protein, 21 aa, Staphylococcus epidermidis
LNQAQKEQLNQEIQQTQTRSE

SEQ ID NO: 1729112 - protein, 7 aa, Staphylococcus epidermidis
LNQPQKD

SEQ ID NO: 1729113 - protein, 8 aa, Staphylococcus epidermidis
LNQPQKDA

SEQ ID NO: 1729114 - protein, 11 aa, Staphylococcus epidermidis
LNYGNKNLGSY

SEQ ID NO: 1729115 - protein, 4 aa, Staphylococcus epidermidis
LPEQ

SEQ ID NO: 1729116 - protein, 5 aa, Staphylococcus epidermidis
LPEQH

SEQ ID NO: 1729117 - protein, 16 aa, Staphylococcus epidermidis
LPGTKTETSDRTVDIP

SEQ ID NO: 1729118 - protein, 17 aa, Staphylococcus epidermidis
LQQQTAKESVKNATKLE

SEQ ID NO: 1729119 - protein, 13 aa, Staphylococcus epidermidis
LQRDKGTANQEIG

SEQ ID NO: 1729120 - protein, 8 aa, Staphylococcus epidermidis
LSGGRGGI

SEQ ID NO: 1729121 - protein, 13 aa, Staphylococcus epidermidis
LSPNYTTETNRRF

SEQ ID NO: 1729122 - protein, 23 aa, Staphylococcus epidermidis
LSQKKRDAINNNTDLTPSQKAHA

SEQ ID NO: 1729123 - protein, 6 aa, Staphylococcus epidermidis
LSQSTK

SEQ ID NO: 1729124 - protein, 10 aa, Staphylococcus epidermidis
LSRSDLDYKN

SEQ ID NO: 1729125 - protein, 9 aa, Staphylococcus epidermidis
LSSTKRKRM

SEQ ID NO: 1729126 - protein, 6 aa, Staphylococcus epidermidis
LTQASF

SEQ ID NO: 1729127 - protein, 23 aa, Staphylococcus epidermidis
LVRQNSNYINEDVSEKEAYEQAI

SEQ ID NO: 1729128 - protein, 6 aa, Staphylococcus epidermidis
MEKTNN

SEQ ID NO: 1729129 - protein, 11 aa, Staphylococcus epidermidis
MKDEKEQRIKK

SEQ ID NO: 1729130 - protein, 5 aa, Staphylococcus epidermidis
MNYEE

SEQ ID NO: 1729131 - protein, 8 aa, Staphylococcus epidermidis
MTKQPKGK

SEQ ID NO: 1729132 - protein, 6 aa, Staphylococcus epidermidis
NAKKNA

SEQ ID NO: 1729133 - protein, 4 aa, Staphylococcus epidermidis
NAKV

SEQ ID NO: 1729134 - protein, 11 aa, Staphylococcus epidermidis
NAMGQGISKAG

SEQ ID NO: 1729135 - protein, 12 aa, Staphylococcus epidermidis
NAQLNGQTNREV

SEQ ID NO: 1729136 - protein, 4 aa, Staphylococcus epidermidis
NATY

SEQ ID NO: 1729137 - protein, 6 aa, Staphylococcus epidermidis
NAVTRT

SEQ ID NO: 1729138 - protein, 5 aa, Staphylococcus epidermidis
NDIDE

SEQ ID NO: 1729139 - protein, 9 aa, Staphylococcus epidermidis
NDKSYKIEN

SEQ ID NO: 1729140 - protein, 19 aa, Staphylococcus epidermidis
NDLHGDQKLQKAQQDATNE

SEQ ID NO: 1729141 - protein, 24 aa, Staphylococcus epidermidis
NDPQKSGEESLVNGSNTRSEVEEH

SEQ ID NO: 1729142 - protein, 4 aa, Staphylococcus epidermidis
NDQV

SEQ ID NO: 1729143 - protein, 20 aa, Staphylococcus epidermidis
NEAEQESRNYDNNKQIENSV

SEQ ID NO: 1729144 - protein, 20 aa, Staphylococcus epidermidis
NEAEQESRNYDNNNQIENSV

SEQ ID NO: 1729145 - protein, 21 aa, Staphylococcus epidermidis
NEAGMGSAPNAAATSAVPHPV

SEQ ID NO: 1729146 - protein, 12 aa, Staphylococcus epidermidis
NEDQPEKEAYQQ

SEQ ID NO: 1729147 - protein, 13 aa, Staphylococcus epidermidis
NEDQPEKKAYQQA

SEQ ID NO: 1729148 - protein, 14 aa, Staphylococcus epidermidis
NEDQPEQSAYNDSI

SEQ ID NO: 1729149 - protein, 10 aa, Staphylococcus epidermidis
NEKRKQTEYI

SEQ ID NO: 1729150 - protein, 13 aa, Staphylococcus epidermidis
NENKHAKVSFNIP

SEQ ID NO: 1729151 - protein, 13 aa, Staphylococcus epidermidis
NFEQKDPNFTAEE

SEQ ID NO: 1729152 - protein, 11 aa, Staphylococcus epidermidis
NFKNPAPKNAV

SEQ ID NO: 1729153 - protein, 8 aa, Staphylococcus epidermidis
NFTSEGGE

SEQ ID NO: 1729154 - protein, 20 aa, Staphylococcus epidermidis
NGATSRDQVAEKLKEAEALD

SEQ ID NO: 1729155 - protein, 9 aa, Staphylococcus epidermidis
NGEDYHGIK

SEQ ID NO: 1729156 - protein, 10 aa, Staphylococcus epidermidis
NGEDYHGIKN

SEQ ID NO: 1729157 - protein, 8 aa, Staphylococcus epidermidis
NGGQKSHG

SEQ ID NO: 1729158 - protein, 16 aa, Staphylococcus epidermidis
NGVGIENEDASNLKSI

SEQ ID NO: 1729159 - protein, 92 aa, Staphylococcus epidermidis
NGYYDDDSDSDSDSDSDSDDSDSDSDSDSDSDSDSDSDSDSDSDSDSDSDSDSDSDSDSDSDSGLDNSSDKNTKDKLPDTGANEDHDSKGTL

SEQ ID NO: 1729160 - protein, 23 aa, Staphylococcus epidermidis
NIGENTDNGSDFDQIRTDNTSTT

SEQ ID NO: 1729161 - protein, 23 aa, Staphylococcus epidermidis
NIGENTDNGSDFNQIRTDNTSTT

SEQ ID NO: 1729162 - protein, 6 aa, Staphylococcus epidermidis
NIPEGA

SEQ ID NO: 1729163 - protein, 24 aa, Staphylococcus epidermidis
NITPATTVKSEARQAVQNKANEQI

SEQ ID NO: 1729164 - protein, 5 aa, Staphylococcus epidermidis
NKDLE

SEQ ID NO: 1729165 - protein, 10 aa, Staphylococcus epidermidis
NKDQDLNTAI

SEQ ID NO: 1729166 - protein, 8 aa, Staphylococcus epidermidis
NKDTIDKA

SEQ ID NO: 1729167 - protein, 5 aa, Staphylococcus epidermidis
NKGET

SEQ ID NO: 1729168 - protein, 8 aa, Staphylococcus epidermidis
NKLNNEMG

SEQ ID NO: 1729169 - protein, 10 aa, Staphylococcus epidermidis
NKLTSEEYAK

SEQ ID NO: 1729170 - protein, 9 aa, Staphylococcus epidermidis
NKNDTPETM

SEQ ID NO: 1729171 - protein, 5 aa, Staphylococcus epidermidis
NKNRI

SEQ ID NO: 1729172 - protein, 5 aa, Staphylococcus epidermidis
NKQNY

SEQ ID NO: 1729173 - protein, 7 aa, Staphylococcus epidermidis
NLNGKKE

SEQ ID NO: 1729174 - protein, 16 aa, Staphylococcus epidermidis
NLTGGFGSQGASTLTQ

SEQ ID NO: 1729175 - protein, 17 aa, Staphylococcus epidermidis
NLTGGFGSQGASTLTQQ

SEQ ID NO: 1729176 - protein, 18 aa, Staphylococcus epidermidis
NNAHSTQEVNESKTNSIA

SEQ ID NO: 1729177 - protein, 9 aa, Staphylococcus epidermidis
NNDFKSPQY

SEQ ID NO: 1729178 - protein, 25 aa, Staphylococcus epidermidis
NNQEPTVESNSHNLNPNINTTKPVH

SEQ ID NO: 1729179 - protein, 11 aa, Staphylococcus epidermidis
NNSMTPTLQTG

SEQ ID NO: 1729180 - protein, 12 aa, Staphylococcus epidermidis
NNSMTPTLQTGD

SEQ ID NO: 1729181 - protein, 9 aa, Staphylococcus epidermidis
NNTKSNNEA

SEQ ID NO: 1729182 - protein, 34 aa, Staphylococcus epidermidis
NQAQSTQQVSEAKNNGINTINQDQPNAVKKNNTK

SEQ ID NO: 1729183 - protein, 13 aa, Staphylococcus epidermidis
NQDRRDNEVEQHK

SEQ ID NO: 1729184 - protein, 8 aa, Staphylococcus epidermidis
NQIRRDGF

SEQ ID NO: 1729185 - protein, 55 aa, Staphylococcus epidermidis
NQSVKDTELEQITARSKNFSSYAKDHSSLQTSDSDKTLEGDIDKGVQVSDKNLQD

SEQ ID NO: 1729186 - protein, 6 aa, Staphylococcus epidermidis
NQVKPN

SEQ ID NO: 1729187 - protein, 11 aa, Staphylococcus epidermidis
NREVSKDSRSF

SEQ ID NO: 1729188 - protein, 11 aa, Staphylococcus epidermidis
NRSDDFENTVS

SEQ ID NO: 1729189 - protein, 5 aa, Staphylococcus epidermidis
NSAKN

SEQ ID NO: 1729190 - protein, 7 aa, Staphylococcus epidermidis
NSGGTTF

SEQ ID NO: 1729191 - protein, 6 aa, Staphylococcus epidermidis
NSKQVD

SEQ ID NO: 1729192 - protein, 20 aa, Staphylococcus epidermidis
NSKYPTYNSDAGGKNNKIEA

SEQ ID NO: 1729193 - protein, 32 aa, Staphylococcus epidermidis
NTEEAESAQTASYTNINENNDTSDDGLHVNQP

SEQ ID NO: 1729194 - protein, 6 aa, Staphylococcus epidermidis
NTLNNN

SEQ ID NO: 1729195 - protein, 6 aa, Staphylococcus epidermidis
NTRTTK

SEQ ID NO: 1729196 - protein, 9 aa, Staphylococcus epidermidis
NVSDTTSSV

SEQ ID NO: 1729197 - protein, 10 aa, Staphylococcus epidermidis
NYGNENLGSY

SEQ ID NO: 1729198 - protein, 10 aa, Staphylococcus epidermidis
NYGNKNLGSY

SEQ ID NO: 1729199 - protein, 20 aa, Staphylococcus epidermidis
NYINAEPSKKQAYDAAVQNA

SEQ ID NO: 1729200 - protein, 4 aa, Staphylococcus epidermidis
NYKR

SEQ ID NO: 1729201 - protein, 10 aa, Staphylococcus epidermidis
NYSDNRTVRY

SEQ ID NO: 1729202 - protein, 4 aa, Staphylococcus epidermidis
PAGL

SEQ ID NO: 1729203 - protein, 7 aa, Staphylococcus epidermidis
PDNPPVN

SEQ ID NO: 1729204 - protein, 24 aa, Staphylococcus epidermidis
PEGMTQTTANSGNDDEKDADGEDV

SEQ ID NO: 1729205 - protein, 7 aa, Staphylococcus epidermidis
PFTTPEG

SEQ ID NO: 1729206 - protein, 13 aa, Staphylococcus epidermidis
PGKEKKHTRDAPQ

SEQ ID NO: 1729207 - protein, 16 aa, Staphylococcus epidermidis
PGPLGQIGKEGAAVGI

SEQ ID NO: 1729208 - protein, 13 aa, Staphylococcus epidermidis
PHIGQSSTSHHDH

SEQ ID NO: 1729209 - protein, 5 aa, Staphylococcus epidermidis
PNENY

SEQ ID NO: 1729210 - protein, 13 aa, Staphylococcus epidermidis
PNERNVTTRQKEY

SEQ ID NO: 1729211 - protein, 6 aa, Staphylococcus epidermidis
PNTDKV

SEQ ID NO: 1729212 - protein, 14 aa, Staphylococcus epidermidis
PQEFQSKKPKKKNQ

SEQ ID NO: 1729213 - protein, 15 aa, Staphylococcus epidermidis
PSKQGRPTVNDRISD

SEQ ID NO: 1729214 - protein, 15 aa, Staphylococcus epidermidis
PSKQSRPTVNDRISD

SEQ ID NO: 1729215 - protein, 12 aa, Staphylococcus epidermidis
PSNIEEIEPMSA

SEQ ID NO: 1729216 - protein, 8 aa, Staphylococcus epidermidis
PTSDEGRF

SEQ ID NO: 1729217 - protein, 6 aa, Staphylococcus epidermidis
PVDDPK

SEQ ID NO: 1729218 - protein, 6 aa, Staphylococcus epidermidis
PVDNPK

SEQ ID NO: 1729219 - protein, 4 aa, Staphylococcus epidermidis
PYIK

SEQ ID NO: 1729220 - protein, 7 aa, Staphylococcus epidermidis
PYIKSNY

SEQ ID NO: 1729221 - protein, 14 aa, Staphylococcus epidermidis
QETNESRQSTEDDE

SEQ ID NO: 1729222 - protein, 5 aa, Staphylococcus epidermidis
QIEYR

SEQ ID NO: 1729223 - protein, 9 aa, Staphylococcus epidermidis
QIPKNYTAA

SEQ ID NO: 1729224 - protein, 10 aa, Staphylococcus epidermidis
QIPKNYTATQ

SEQ ID NO: 1729225 - protein, 9 aa, Staphylococcus epidermidis
QKAKELNEA

SEQ ID NO: 1729226 - protein, 6 aa, Staphylococcus epidermidis
QKASSF

SEQ ID NO: 1729227 - protein, 28 aa, Staphylococcus epidermidis
QKGNEKKSAIAQTPDATTEEKQEAVSAV

SEQ ID NO: 1729228 - protein, 11 aa, Staphylococcus epidermidis
QKTPQDNTQLK

SEQ ID NO: 1729229 - protein, 5 aa, Staphylococcus epidermidis
QKYSG

SEQ ID NO: 1729230 - protein, 10 aa, Staphylococcus epidermidis
QLSKNYTSDQ

SEQ ID NO: 1729231 - protein, 48 aa, Staphylococcus epidermidis
QNAIHSTSNYFNEDSTQKNTYDNAIDNGSTYITGQHNPELNKSTIDQT

SEQ ID NO: 1729232 - protein, 4 aa, Staphylococcus epidermidis
QNGH

SEQ ID NO: 1729233 - protein, 48 aa, Staphylococcus epidermidis
QNIDTSGKTPASIRKYNEAKSRIQTQIDSAKNEANSILTNDNPQVSQV

SEQ ID NO: 1729234 - protein, 5 aa, Staphylococcus epidermidis
QPGKN

SEQ ID NO: 1729235 - protein, 44 aa, Staphylococcus epidermidis
QPHPQTKATGRHRLNEKANQQQSTIATHPNSTIEERQEASAKLQ

SEQ ID NO: 1729236 - protein, 5 aa, Staphylococcus epidermidis
QQAPP

SEQ ID NO: 1729237 - protein, 6 aa, Staphylococcus epidermidis
QQAPPQ

SEQ ID NO: 1729238 - protein, 6 aa, Staphylococcus epidermidis
QQIEYR

SEQ ID NO: 1729239 - protein, 4 aa, Staphylococcus epidermidis
QRGL

SEQ ID NO: 1729240 - protein, 8 aa, Staphylococcus epidermidis
QSIANSQM

SEQ ID NO: 1729241 - protein, 4 aa, Staphylococcus epidermidis
QTFT

SEQ ID NO: 1729242 - protein, 43 aa, Staphylococcus epidermidis
QTNFTKKQQARDQVNQKFQEKEAELNSTPHATQDEKQDALTRL

SEQ ID NO: 1729243 - protein, 10 aa, Staphylococcus epidermidis
QTQTKRLGVP

SEQ ID NO: 1729244 - protein, 11 aa, Staphylococcus epidermidis
QTQTKRLGVPE

SEQ ID NO: 1729245 - protein, 28 aa, Staphylococcus epidermidis
QTVNTTKDALHGAQKLTQDQQAAETGIR

SEQ ID NO: 1729246 - protein, 6 aa, Staphylococcus epidermidis
QVDDYN

SEQ ID NO: 1729247 - protein, 6 aa, Staphylococcus epidermidis
QVRQPN

SEQ ID NO: 1729248 - protein, 23 aa, Staphylococcus epidermidis
RALREEQKTSKKKSDSKNSQSFG

SEQ ID NO: 1729249 - protein, 4 aa, Staphylococcus epidermidis
RDKW

SEQ ID NO: 1729250 - protein, 5 aa, Staphylococcus epidermidis
RDKWR

SEQ ID NO: 1729251 - protein, 14 aa, Staphylococcus epidermidis
RDTIESNSTSVPNS

SEQ ID NO: 1729252 - protein, 5 aa, Staphylococcus epidermidis
REETE

SEQ ID NO: 1729253 - protein, 4 aa, Staphylococcus epidermidis
RERP

SEQ ID NO: 1729254 - protein, 19 aa, Staphylococcus epidermidis
RGRQTTKRSVKDNSGKKQS

SEQ ID NO: 1729255 - protein, 12 aa, Staphylococcus epidermidis
RINDKQYADAKK

SEQ ID NO: 1729256 - protein, 4 aa, Staphylococcus epidermidis
RIQS

SEQ ID NO: 1729257 - protein, 5 aa, Staphylococcus epidermidis
RIQSY

SEQ ID NO: 1729258 - protein, 7 aa, Staphylococcus epidermidis
RKGEPGL

SEQ ID NO: 1729259 - protein, 6 aa, Staphylococcus epidermidis
RKTGSY

SEQ ID NO: 1729260 - protein, 7 aa, Staphylococcus epidermidis
RQEATTL

SEQ ID NO: 1729261 - protein, 14 aa, Staphylococcus epidermidis
RQNKSIKDNKTHLV

SEQ ID NO: 1729262 - protein, 7 aa, Staphylococcus epidermidis
RQVNEPY

SEQ ID NO: 1729263 - protein, 15 aa, Staphylococcus epidermidis
RRKKEEEEKQSIKNH

SEQ ID NO: 1729264 - protein, 11 aa, Staphylococcus epidermidis
RSIEGQTVGIN

SEQ ID NO: 1729265 - protein, 12 aa, Staphylococcus epidermidis
RSIEGQTVGIND

SEQ ID NO: 1729266 - protein, 7 aa, Staphylococcus epidermidis
RSNLSQE

SEQ ID NO: 1729267 - protein, 8 aa, Staphylococcus epidermidis
RTGSRTFD

SEQ ID NO: 1729268 - protein, 6 aa, Staphylococcus epidermidis
RYNAKN

SEQ ID NO: 1729269 - protein, 7 aa, Staphylococcus epidermidis
RYNAKNK

SEQ ID NO: 1729270 - protein, 14 aa, Staphylococcus epidermidis
SANEGIGPSGVHED

SEQ ID NO: 1729271 - protein, 12 aa, Staphylococcus epidermidis
SATTNGGLDITG

SEQ ID NO: 1729272 - protein, 5 aa, Staphylococcus epidermidis
SAYTS

SEQ ID NO: 1729273 - protein, 11 aa, Staphylococcus epidermidis
SDEKASGENAK

SEQ ID NO: 1729274 - protein, 10 aa, Staphylococcus epidermidis
SDGSLQESIN

SEQ ID NO: 1729275 - protein, 13 aa, Staphylococcus epidermidis
SDRKVHAKIKNIR

SEQ ID NO: 1729276 - protein, 12 aa, Staphylococcus epidermidis
SEAIKPNVHQGD

SEQ ID NO: 1729277 - protein, 4 aa, Staphylococcus epidermidis
SEFK

SEQ ID NO: 1729278 - protein, 12 aa, Staphylococcus epidermidis
SEITQTENRANT

SEQ ID NO: 1729279 - protein, 12 aa, Staphylococcus epidermidis
SEMEKTSWPTKE

SEQ ID NO: 1729280 - protein, 5 aa, Staphylococcus epidermidis
SFSAG

SEQ ID NO: 1729281 - protein, 4 aa, Staphylococcus epidermidis
SFSN

SEQ ID NO: 1729282 - protein, 7 aa, Staphylococcus epidermidis
SGGRGGI

SEQ ID NO: 1729283 - protein, 8 aa, Staphylococcus epidermidis
SGNNQDIS

SEQ ID NO: 1729284 - protein, 8 aa, Staphylococcus epidermidis
SGNNQDMS

SEQ ID NO: 1729285 - protein, 40 aa, Staphylococcus epidermidis
SGQAAQNDSDSDSDSLMPSDNTRSTNSSTHMAQKGQMPSV

SEQ ID NO: 1729286 - protein, 6 aa, Staphylococcus epidermidis
SGRILP

SEQ ID NO: 1729287 - protein, 26 aa, Staphylococcus epidermidis
SGSATYDPKTGIATLTPDAYSQKGAI

SEQ ID NO: 1729288 - protein, 11 aa, Staphylococcus epidermidis
SIDKSDNAYPA

SEQ ID NO: 1729289 - protein, 4 aa, Staphylococcus epidermidis
SIGL

SEQ ID NO: 1729290 - protein, 4 aa, Staphylococcus epidermidis
SIKD

SEQ ID NO: 1729291 - protein, 35 aa, Staphylococcus epidermidis
SIKDKNDTKNSSKYINEDHDQQQAYDNAVNNAQQV

SEQ ID NO: 1729292 - protein, 4 aa, Staphylococcus epidermidis
SIKQ

SEQ ID NO: 1729293 - protein, 7 aa, Staphylococcus epidermidis
SISGYDN

SEQ ID NO: 1729294 - protein, 29 aa, Staphylococcus epidermidis
SITDEHEVKQTSNYINETVGNQTAYNNAV

SEQ ID NO: 1729295 - protein, 9 aa, Staphylococcus epidermidis
SKEAGSANG

SEQ ID NO: 1729296 - protein, 6 aa, Staphylococcus epidermidis
SKENPG

SEQ ID NO: 1729297 - protein, 11 aa, Staphylococcus epidermidis
SKFIDDDKQKY

SEQ ID NO: 1729298 - protein, 11 aa, Staphylococcus epidermidis
SKHFRQDGYSD

SEQ ID NO: 1729299 - protein, 6 aa, Staphylococcus epidermidis
SKKTYQ

SEQ ID NO: 1729300 - protein, 9 aa, Staphylococcus epidermidis
SKRHKRKNT

SEQ ID NO: 1729301 - protein, 6 aa, Staphylococcus epidermidis
SKSISS

SEQ ID NO: 1729302 - protein, 8 aa, Staphylococcus epidermidis
SKSKYVKE

SEQ ID NO: 1729303 - protein, 6 aa, Staphylococcus epidermidis
SLEDKT

SEQ ID NO: 1729304 - protein, 52 aa, Staphylococcus epidermidis
SLSEDTIVTQSKNTNMLNKTGKDYDLQEQRGYTDSEQHNETQSNQADNHSNN

SEQ ID NO: 1729305 - protein, 5 aa, Staphylococcus epidermidis
SPFEA

SEQ ID NO: 1729306 - protein, 6 aa, Staphylococcus epidermidis
SPNENY

SEQ ID NO: 1729307 - protein, 22 aa, Staphylococcus epidermidis
SQKKRDAINNNTDLTPSQKAHA

SEQ ID NO: 1729308 - protein, 7 aa, Staphylococcus epidermidis
SQYQQDN

SEQ ID NO: 1729309 - protein, 8 aa, Staphylococcus epidermidis
SQYQQDNK

SEQ ID NO: 1729310 - protein, 7 aa, Staphylococcus epidermidis
SQYSKNN

SEQ ID NO: 1729311 - protein, 9 aa, Staphylococcus epidermidis
SRKYDRHSI

SEQ ID NO: 1729312 - protein, 11 aa, Staphylococcus epidermidis
SRNQKDNINKN

SEQ ID NO: 1729313 - protein, 4 aa, Staphylococcus epidermidis
SSER

SEQ ID NO: 1729314 - protein, 5 aa, Staphylococcus epidermidis
SSERK

SEQ ID NO: 1729315 - protein, 6 aa, Staphylococcus epidermidis
SSNDRI

SEQ ID NO: 1729316 - protein, 7 aa, Staphylococcus epidermidis
STIRSSA

SEQ ID NO: 1729317 - protein, 5 aa, Staphylococcus epidermidis
STSDL

SEQ ID NO: 1729318 - protein, 43 aa, Staphylococcus epidermidis
SVQNVDQVKQSSNYVNEDQPEQHNYDNAVNEAQATINNNAQPV

SEQ ID NO: 1729319 - protein, 11 aa, Staphylococcus epidermidis
SYKEEERSEKL

SEQ ID NO: 1729320 - protein, 17 aa, Staphylococcus epidermidis
SYSIKGDSMDPTLKDGE

SEQ ID NO: 1729321 - protein, 11 aa, Staphylococcus epidermidis
TASTGGAKNLQ

SEQ ID NO: 1729322 - protein, 10 aa, Staphylococcus epidermidis
TATDNSGKVV

SEQ ID NO: 1729323 - protein, 31 aa, Staphylococcus epidermidis
TDAQRNSEKGLVNSSQTRTEVASQLAKAKEL

SEQ ID NO: 1729324 - protein, 6 aa, Staphylococcus epidermidis
TDDYGR

SEQ ID NO: 1729325 - protein, 4 aa, Staphylococcus epidermidis
TDGL

SEQ ID NO: 1729326 - protein, 7 aa, Staphylococcus epidermidis
TDGLDGL

SEQ ID NO: 1729327 - protein, 10 aa, Staphylococcus epidermidis
TDLGRNFSGT

SEQ ID NO: 1729328 - protein, 23 aa, Staphylococcus epidermidis
TEGQGRQRSNVHGEVKTPKNWGT

SEQ ID NO: 1729329 - protein, 9 aa, Staphylococcus epidermidis
TFSDIPDDA

SEQ ID NO: 1729330 - protein, 6 aa, Staphylococcus epidermidis
TGLPSG

SEQ ID NO: 1729331 - protein, 5 aa, Staphylococcus epidermidis
TGLQD

SEQ ID NO: 1729332 - protein, 6 aa, Staphylococcus epidermidis
TGLTGD

SEQ ID NO: 1729333 - protein, 6 aa, Staphylococcus epidermidis
TGLTGN

SEQ ID NO: 1729334 - protein, 22 aa, Staphylococcus epidermidis
TGNGSNPINSKTVQQDIKGKKI

SEQ ID NO: 1729335 - protein, 7 aa, Staphylococcus epidermidis
TGNTHVR

SEQ ID NO: 1729336 - protein, 8 aa, Staphylococcus epidermidis
TGRAAENG

SEQ ID NO: 1729337 - protein, 4 aa, Staphylococcus epidermidis
TGRG

SEQ ID NO: 1729338 - protein, 20 aa, Staphylococcus epidermidis
TGRGATLLSGKGAYQKSDTE

SEQ ID NO: 1729339 - protein, 16 aa, Staphylococcus epidermidis
TIESTDASGNKTTTKI

SEQ ID NO: 1729340 - protein, 7 aa, Staphylococcus epidermidis
TIRYGTA

SEQ ID NO: 1729341 - protein, 5 aa, Staphylococcus epidermidis
TISGV

SEQ ID NO: 1729342 - protein, 10 aa, Staphylococcus epidermidis
TISKKQSEVI

SEQ ID NO: 1729343 - protein, 10 aa, Staphylococcus epidermidis
TKDKVTYEQT

SEQ ID NO: 1729344 - protein, 25 aa, Staphylococcus epidermidis
TKEELGEEEPELSRTNKGNVSNQTK

SEQ ID NO: 1729345 - protein, 12 aa, Staphylococcus epidermidis
TKINSASSLSVT

SEQ ID NO: 1729346 - protein, 8 aa, Staphylococcus epidermidis
TKRSYFNK

SEQ ID NO: 1729347 - protein, 31 aa, Staphylococcus epidermidis
TKVEDNNTLSDDKKQALKQEIDKTKQSIDRQ

SEQ ID NO: 1729348 - protein, 4 aa, Staphylococcus epidermidis
TLGA

SEQ ID NO: 1729349 - protein, 5 aa, Staphylococcus epidermidis
TLGAS

SEQ ID NO: 1729350 - protein, 12 aa, Staphylococcus epidermidis
TLGKATDKPEFN

SEQ ID NO: 1729351 - protein, 8 aa, Staphylococcus epidermidis
TLRYGTAS

SEQ ID NO: 1729352 - protein, 6 aa, Staphylococcus epidermidis
TNANIN

SEQ ID NO: 1729353 - protein, 10 aa, Staphylococcus epidermidis
TNERPDLDGG

SEQ ID NO: 1729354 - protein, 5 aa, Staphylococcus epidermidis
TNNQE

SEQ ID NO: 1729355 - protein, 5 aa, Staphylococcus epidermidis
TPQSE

SEQ ID NO: 1729356 - protein, 15 aa, Staphylococcus epidermidis
TPTSKAGNAAAVEES

SEQ ID NO: 1729357 - protein, 4 aa, Staphylococcus epidermidis
TQFN

SEQ ID NO: 1729358 - protein, 5 aa, Staphylococcus epidermidis
TQFNG

SEQ ID NO: 1729359 - protein, 14 aa, Staphylococcus epidermidis
TQRAENNQKNHKKD

SEQ ID NO: 1729360 - protein, 7 aa, Staphylococcus epidermidis
TQSEQRT

SEQ ID NO: 1729361 - protein, 4 aa, Staphylococcus epidermidis
TSDL

SEQ ID NO: 1729362 - protein, 20 aa, Staphylococcus epidermidis
TSGIPGDITEENRYSKQYDS

SEQ ID NO: 1729363 - protein, 8 aa, Staphylococcus epidermidis
TTISVGAS

SEQ ID NO: 1729364 - protein, 4 aa, Staphylococcus epidermidis
TTPL

SEQ ID NO: 1729365 - protein, 4 aa, Staphylococcus epidermidis
TTTK

SEQ ID NO: 1729366 - protein, 15 aa, Staphylococcus epidermidis
TVDKLNKSNSSVASY

SEQ ID NO: 1729367 - protein, 11 aa, Staphylococcus epidermidis
TVTSTTGTGNA

SEQ ID NO: 1729368 - protein, 7 aa, Staphylococcus epidermidis
TYEPERK

SEQ ID NO: 1729369 - protein, 7 aa, Staphylococcus epidermidis
VADENIK

SEQ ID NO: 1729370 - protein, 5 aa, Staphylococcus epidermidis
VDDYN

SEQ ID NO: 1729371 - protein, 7 aa, Staphylococcus epidermidis
VDHDDVP

SEQ ID NO: 1729372 - protein, 11 aa, Staphylococcus epidermidis
VDQNKKSKLTI

SEQ ID NO: 1729373 - protein, 7 aa, Staphylococcus epidermidis
VDSGGTI

SEQ ID NO: 1729374 - protein, 6 aa, Staphylococcus epidermidis
VEGPIG

SEQ ID NO: 1729375 - protein, 14 aa, Staphylococcus epidermidis
VEPVKSDTRDKDSI

SEQ ID NO: 1729376 - protein, 8 aa, Staphylococcus epidermidis
VETVGTAL

SEQ ID NO: 1729377 - protein, 10 aa, Staphylococcus epidermidis
VGGPASYSTI

SEQ ID NO: 1729378 - protein, 4 aa, Staphylococcus epidermidis
VIQS

SEQ ID NO: 1729379 - protein, 5 aa, Staphylococcus epidermidis
VIQSG

SEQ ID NO: 1729380 - protein, 45 aa, Staphylococcus epidermidis
VKEPSSVESSNSSMDTAQQPSHTTINSEASIQTSDNEENSRVSDF

SEQ ID NO: 1729381 - protein, 16 aa, Staphylococcus epidermidis
VKNREQKEGLGTVGRA

SEQ ID NO: 1729382 - protein, 14 aa, Staphylococcus epidermidis
VNNQSPTVESRSHD

SEQ ID NO: 1729383 - protein, 12 aa, Staphylococcus epidermidis
VNNSNDEIKEVQ

SEQ ID NO: 1729384 - protein, 12 aa, Staphylococcus epidermidis
VNNSSDEIKEVQ

SEQ ID NO: 1729385 - protein, 11 aa, Staphylococcus epidermidis
VNRSGNNATVN

SEQ ID NO: 1729386 - protein, 18 aa, Staphylococcus epidermidis
VQGPQISVDSQTREVGKT

SEQ ID NO: 1729387 - protein, 4 aa, Staphylococcus epidermidis
VQPN

SEQ ID NO: 1729388 - protein, 9 aa, Staphylococcus epidermidis
VQTESIPNA

SEQ ID NO: 1729389 - protein, 7 aa, Staphylococcus epidermidis
VSDPPIQ

SEQ ID NO: 1729390 - protein, 21 aa, Staphylococcus epidermidis
VSENGEGFTPEEAQYAINHLD

SEQ ID NO: 1729391 - protein, 9 aa, Staphylococcus epidermidis
VSERSLADK

SEQ ID NO: 1729392 - protein, 9 aa, Staphylococcus epidermidis
VSKKRDALN

SEQ ID NO: 1729393 - protein, 8 aa, Staphylococcus epidermidis
VSNNAQAL

SEQ ID NO: 1729394 - protein, 13 aa, Staphylococcus epidermidis
VSTSTEGIPKELT

SEQ ID NO: 1729395 - protein, 15 aa, Staphylococcus epidermidis
VSTSTEGIPKELTEQ

SEQ ID NO: 1729396 - protein, 13 aa, Staphylococcus epidermidis
VTAATTRDEVRNI

SEQ ID NO: 1729397 - protein, 8 aa, Staphylococcus epidermidis
VTPSQASE

SEQ ID NO: 1729398 - protein, 14 aa, Staphylococcus epidermidis
VTRNSASDSTSTSI

SEQ ID NO: 1729399 - protein, 10 aa, Staphylococcus epidermidis
VTSTTGTGNA

SEQ ID NO: 1729400 - protein, 8 aa, Staphylococcus epidermidis
VYGSKTFG

SEQ ID NO: 1729401 - protein, 6 aa, Staphylococcus epidermidis
WKGSHN

SEQ ID NO: 1729402 - protein, 6 aa, Staphylococcus epidermidis
YASGGG

SEQ ID NO: 1729403 - protein, 19 aa, Staphylococcus epidermidis
YINADKDKKDAYNNAVNNA

SEQ ID NO: 1729404 - protein, 6 aa, Staphylococcus epidermidis
YPEEDK

SEQ ID NO: 1729405 - protein, 6 aa, Staphylococcus epidermidis
YRGYDS

SEQ ID NO: 1729406 - protein, 7 aa, Staphylococcus epidermidis
YRGYDSA

SEQ ID NO: 1729407 - protein, 10 aa, Staphylococcus epidermidis
YRNRVQSNVQ

SEQ ID NO: 1729408 - protein, 11 aa, Staphylococcus epidermidis
YRNRVQSNVQV

SEQ ID NO: 1729409 - protein, 5 aa, Staphylococcus epidermidis
YSNSV

SEQ ID NO: 1729410 - protein, 12 aa, Staphylococcus epidermidis
YSSDTDKTIIQK

SEQ ID NO: 1729411 - protein, 6 aa, Staphylococcus epidermidis
AATATT

SEQ ID NO: 1729412 - protein, 48 aa, Staphylococcus epidermidis
ADENTANQNQGTSPKTSQTAPTNNTENTDATAITTDQNNNDEEEYDAS

SEQ ID NO: 1729413 - protein, 9 aa, Staphylococcus epidermidis
ADHSEESAR

SEQ ID NO: 1729414 - protein, 7 aa, Staphylococcus epidermidis
ADNAEPV

SEQ ID NO: 1729415 - protein, 13 aa, Staphylococcus epidermidis
ADNTTNDLDGKFH

SEQ ID NO: 1729416 - protein, 6 aa, Staphylococcus epidermidis
AEDFSG

SEQ ID NO: 1729417 - protein, 5 aa, Staphylococcus epidermidis
AEGLS

SEQ ID NO: 1729418 - protein, 24 aa, Staphylococcus epidermidis
AEIQRERINGNSDATREEKEEALK

SEQ ID NO: 1729419 - protein, 12 aa, Staphylococcus epidermidis
AEPNSGKNVNDK

SEQ ID NO: 1729420 - protein, 12 aa, Staphylococcus epidermidis
AEQAPHVNGPST

SEQ ID NO: 1729421 - protein, 20 aa, Staphylococcus epidermidis
AFPVQASSNYINSDEDLKQQ

SEQ ID NO: 1729422 - protein, 11 aa, Staphylococcus epidermidis
AGETKNPQKNI

SEQ ID NO: 1729423 - protein, 7 aa, Staphylococcus epidermidis
AGRDSGA

SEQ ID NO: 1729424 - protein, 5 aa, Staphylococcus epidermidis
AGRFG

SEQ ID NO: 1729425 - protein, 11 aa, Staphylococcus epidermidis
AGTTGSGKSEI

SEQ ID NO: 1729426 - protein, 7 aa, Staphylococcus epidermidis
AGYGSEA

SEQ ID NO: 1729427 - protein, 5 aa, Staphylococcus epidermidis
AHAEE

SEQ ID NO: 1729428 - protein, 37 aa, Staphylococcus epidermidis
AHKKSDAKQSIDNKYNEQSNTINTTPDATDEEKQKAL

SEQ ID NO: 1729429 - protein, 6 aa, Staphylococcus epidermidis
AHTREG

SEQ ID NO: 1729430 - protein, 17 aa, Staphylococcus epidermidis
AIDKVTHSKSIKDIETV

SEQ ID NO: 1729431 - protein, 20 aa, Staphylococcus epidermidis
AKDNSGQTVTNKVDGLPDGV

SEQ ID NO: 1729432 - protein, 5 aa, Staphylococcus epidermidis
AKEKS

SEQ ID NO: 1729433 - protein, 9 aa, Staphylococcus epidermidis
AKENGKNLD

SEQ ID NO: 1729434 - protein, 10 aa, Staphylococcus epidermidis
AKISGLEAKQ

SEQ ID NO: 1729435 - protein, 18 aa, Staphylococcus epidermidis
AKNPVRDQKGRNLTNGTD

SEQ ID NO: 1729436 - protein, 9 aa, Staphylococcus epidermidis
AKPEVDGIQ

SEQ ID NO: 1729437 - protein, 10 aa, Staphylococcus epidermidis
AKQANTNKTF

SEQ ID NO: 1729438 - protein, 27 aa, Staphylococcus epidermidis
AKQPTVQKTSAYINEDQTEQSAYNDSI

SEQ ID NO: 1729439 - protein, 7 aa, Staphylococcus epidermidis
AKSSEMI

SEQ ID NO: 1729440 - protein, 50 aa, Staphylococcus epidermidis
AKTNEKQSAINSDNEGTIEEKQKAIQSLNDAKNLADEQITQAASNQNVDN

SEQ ID NO: 1729441 - protein, 8 aa, Staphylococcus epidermidis
ALEEGKAI

SEQ ID NO: 1729442 - protein, 5 aa, Staphylococcus epidermidis
ALGET

SEQ ID NO: 1729443 - protein, 7 aa, Staphylococcus epidermidis
ALSSVNK

SEQ ID NO: 1729444 - protein, 9 aa, Staphylococcus epidermidis
ANEKANGMI

SEQ ID NO: 1729445 - protein, 7 aa, Staphylococcus epidermidis
ANLKKQS

SEQ ID NO: 1729446 - protein, 8 aa, Staphylococcus epidermidis
ANLKKQSK

SEQ ID NO: 1729447 - protein, 8 aa, Staphylococcus epidermidis
ANPTMSHD

SEQ ID NO: 1729448 - protein, 7 aa, Staphylococcus epidermidis
ANSEVSV

SEQ ID NO: 1729449 - protein, 40 aa, Staphylococcus epidermidis
ANSKIKESNTESGKEENTIEQPNKVKEDSTTSQPSGYTNI

SEQ ID NO: 1729450 - protein, 8 aa, Staphylococcus epidermidis
APNGEATQ

SEQ ID NO: 1729451 - protein, 8 aa, Staphylococcus epidermidis
APSNINTK

SEQ ID NO: 1729452 - protein, 6 aa, Staphylococcus epidermidis
AQNSSN

SEQ ID NO: 1729453 - protein, 9 aa, Staphylococcus epidermidis
AQQNALNEK

SEQ ID NO: 1729454 - protein, 10 aa, Staphylococcus epidermidis
ARAKTQTTNA

SEQ ID NO: 1729455 - protein, 21 aa, Staphylococcus epidermidis
ARESLHGEQKLQEAKNQAVAE

SEQ ID NO: 1729456 - protein, 4 aa, Staphylococcus epidermidis
ARIG

SEQ ID NO: 1729457 - protein, 25 aa, Staphylococcus epidermidis
ASALGDSGSPASDSTLGPTAGLNID

SEQ ID NO: 1729458 - protein, 6 aa, Staphylococcus epidermidis
ASNSKL

SEQ ID NO: 1729459 - protein, 14 aa, Staphylococcus epidermidis
ASNYEDIKQDTDRL

SEQ ID NO: 1729460 - protein, 4 aa, Staphylococcus epidermidis
ASSA

SEQ ID NO: 1729461 - protein, 7 aa, Staphylococcus epidermidis
ASSGPAF

SEQ ID NO: 1729462 - protein, 6 aa, Staphylococcus epidermidis
ASVYDG

SEQ ID NO: 1729463 - protein, 11 aa, Staphylococcus epidermidis
ATDKGSNSVEF

SEQ ID NO: 1729464 - protein, 9 aa, Staphylococcus epidermidis
ATEQQDETY

SEQ ID NO: 1729465 - protein, 6 aa, Staphylococcus epidermidis
ATFRDT

SEQ ID NO: 1729466 - protein, 13 aa, Staphylococcus epidermidis
ATKGTLTGGVPVS

SEQ ID NO: 1729467 - protein, 7 aa, Staphylococcus epidermidis
ATKQQDL

SEQ ID NO: 1729468 - protein, 10 aa, Staphylococcus epidermidis
ATKVGKDTAL

SEQ ID NO: 1729469 - protein, 6 aa, Staphylococcus epidermidis
ATRNAL

SEQ ID NO: 1729470 - protein, 68 aa, Staphylococcus epidermidis
ATSNSNNETKETTENNVNDKDERNHKTAVEETKTNYDSTKENTKEPGKENESATRLENSALEKAKSYY

SEQ ID NO: 1729471 - protein, 34 aa, Staphylococcus epidermidis
ATTVKDKAKADVNAEKEQKNIQINSNDEATTEEK

SEQ ID NO: 1729472 - protein, 9 aa, Staphylococcus epidermidis
ATYKLPGGQ

SEQ ID NO: 1729473 - protein, 7 aa, Staphylococcus epidermidis
AYKEDAS

SEQ ID NO: 1729474 - protein, 23 aa, Staphylococcus epidermidis
AYKREGDISSLGTQKEFKEEEMP

SEQ ID NO: 1729475 - protein, 8 aa, Staphylococcus epidermidis
AYSQTYEK

SEQ ID NO: 1729476 - protein, 24 aa, Staphylococcus epidermidis
AYTREGDISSLGTQKEFKEEEMPG

SEQ ID NO: 1729477 - protein, 6 aa, Staphylococcus epidermidis
CENVKH

SEQ ID NO: 1729478 - protein, 23 aa, Staphylococcus epidermidis
DANTGKDIIPPKTIAGEVDGTVN

SEQ ID NO: 1729479 - protein, 16 aa, Staphylococcus epidermidis
DAVEKNISSRDKKNSV

SEQ ID NO: 1729480 - protein, 18 aa, Staphylococcus epidermidis
DDATDTYSSKNRESCGQG

SEQ ID NO: 1729481 - protein, 7 aa, Staphylococcus epidermidis
DDQKTIT

SEQ ID NO: 1729482 - protein, 15 aa, Staphylococcus epidermidis
DEATNTISGTPSEVG

SEQ ID NO: 1729483 - protein, 16 aa, Staphylococcus epidermidis
DEATNTISGTPSEVGS

SEQ ID NO: 1729484 - protein, 6 aa, Staphylococcus epidermidis
DEDHKL

SEQ ID NO: 1729485 - protein, 6 aa, Staphylococcus epidermidis
DEDITS

SEQ ID NO: 1729486 - protein, 9 aa, Staphylococcus epidermidis
DEHLKGGDH

SEQ ID NO: 1729487 - protein, 6 aa, Staphylococcus epidermidis
DEIQQA

SEQ ID NO: 1729488 - protein, 7 aa, Staphylococcus epidermidis
DENSRMS

SEQ ID NO: 1729489 - protein, 7 aa, Staphylococcus epidermidis
DEPYNTY

SEQ ID NO: 1729490 - protein, 25 aa, Staphylococcus epidermidis
DEVNANVNPSTEKATIEYNPNVTSL

SEQ ID NO: 1729491 - protein, 32 aa, Staphylococcus epidermidis
DFEGKKIAAQKGTDQEKIAQTEIEDSKISSLN

SEQ ID NO: 1729492 - protein, 13 aa, Staphylococcus epidermidis
DFGDPFGGGFGFF

SEQ ID NO: 1729493 - protein, 5 aa, Staphylococcus epidermidis
DFSSN

SEQ ID NO: 1729494 - protein, 9 aa, Staphylococcus epidermidis
DGNNAKKTV

SEQ ID NO: 1729495 - protein, 15 aa, Staphylococcus epidermidis
DGRTLNGKVDSNGNF

SEQ ID NO: 1729496 - protein, 4 aa, Staphylococcus epidermidis
DGVQ

SEQ ID NO: 1729497 - protein, 5 aa, Staphylococcus epidermidis
DGYTL

SEQ ID NO: 1729498 - protein, 5 aa, Staphylococcus epidermidis
DHRNL

SEQ ID NO: 1729499 - protein, 8 aa, Staphylococcus epidermidis
DIPTEQAP

SEQ ID NO: 1729500 - protein, 10 aa, Staphylococcus epidermidis
DKDGNTATTT

SEQ ID NO: 1729501 - protein, 10 aa, Staphylococcus epidermidis
DKEKTDRYGR

SEQ ID NO: 1729502 - protein, 8 aa, Staphylococcus epidermidis
DKITERDK

SEQ ID NO: 1729503 - protein, 33 aa, Staphylococcus epidermidis
DKKLQKNIEKRHKEEQKQREEAEKARKKEFKKY

SEQ ID NO: 1729504 - protein, 4 aa, Staphylococcus epidermidis
DKRP

SEQ ID NO: 1729505 - protein, 8 aa, Staphylococcus epidermidis
DKSYKIEN

SEQ ID NO: 1729506 - protein, 5 aa, Staphylococcus epidermidis
DKWGR

SEQ ID NO: 1729507 - protein, 10 aa, Staphylococcus epidermidis
DLGPKITPIG

SEQ ID NO: 1729508 - protein, 9 aa, Staphylococcus epidermidis
DNATTNNQI

SEQ ID NO: 1729509 - protein, 9 aa, Staphylococcus epidermidis
DNDRAQNPN

SEQ ID NO: 1729510 - protein, 8 aa, Staphylococcus epidermidis
DNEKCTKI

SEQ ID NO: 1729511 - protein, 18 aa, Staphylococcus epidermidis
DNEKQDRKEFSVSKRAGH

SEQ ID NO: 1729512 - protein, 9 aa, Staphylococcus epidermidis
DNKGDSAVQ

SEQ ID NO: 1729513 - protein, 17 aa, Staphylococcus epidermidis
DNVNDENDNQKNINDKL

SEQ ID NO: 1729514 - protein, 8 aa, Staphylococcus epidermidis
DNVNNKHN

SEQ ID NO: 1729515 - protein, 27 aa, Staphylococcus epidermidis
DNYTPSPANNSTNDAIDSDGERDGTRK

SEQ ID NO: 1729516 - protein, 17 aa, Staphylococcus epidermidis
DPKAHAKKEIRELPNET

SEQ ID NO: 1729517 - protein, 8 aa, Staphylococcus epidermidis
DPKTNTEK

SEQ ID NO: 1729518 - protein, 14 aa, Staphylococcus epidermidis
DQSITEGYDDSEGV

SEQ ID NO: 1729519 - protein, 54 aa, Staphylococcus epidermidis
DQVPSTEGVTQQTKDDYNSKQQAAQQEISKAQQVIDNGDATTQQISNAKTNVER

SEQ ID NO: 1729520 - protein, 28 aa, Staphylococcus epidermidis
DRIGQKKEELYKKSGKNPIINQQTEQLK

SEQ ID NO: 1729521 - protein, 8 aa, Staphylococcus epidermidis
DRQVNEPY

SEQ ID NO: 1729522 - protein, 8 aa, Staphylococcus epidermidis
DRRTASST

SEQ ID NO: 1729523 - protein, 7 aa, Staphylococcus epidermidis
DRYDTDE

SEQ ID NO: 1729524 - protein, 7 aa, Staphylococcus epidermidis
DSGYGQG

SEQ ID NO: 1729525 - protein, 21 aa, Staphylococcus epidermidis
DSIQKGREILNGTTDDVLNNN

SEQ ID NO: 1729526 - protein, 23 aa, Staphylococcus epidermidis
DSIQKGREILNGTTDDVLNNNKI

SEQ ID NO: 1729527 - protein, 8 aa, Staphylococcus epidermidis
DSKLQRKI

SEQ ID NO: 1729528 - protein, 6 aa, Staphylococcus epidermidis
DSNPTK

SEQ ID NO: 1729529 - protein, 10 aa, Staphylococcus epidermidis
DTANAVATAV

SEQ ID NO: 1729530 - protein, 6 aa, Staphylococcus epidermidis
DTKGIK

SEQ ID NO: 1729531 - protein, 6 aa, Staphylococcus epidermidis
DTKNKV

SEQ ID NO: 1729532 - protein, 32 aa, Staphylococcus epidermidis
DTKVEDNNTLSDDKKQALKQEIDKTKQSIDRQ

SEQ ID NO: 1729533 - protein, 10 aa, Staphylococcus epidermidis
DTNGNKRQQL

SEQ ID NO: 1729534 - protein, 24 aa, Staphylococcus epidermidis
DTPETVKPNTPVQPYGKQASNYTK

SEQ ID NO: 1729535 - protein, 20 aa, Staphylococcus epidermidis
EAGMGSAPNAAATSAVPHPV

SEQ ID NO: 1729536 - protein, 7 aa, Staphylococcus epidermidis
EAHKASQ

SEQ ID NO: 1729537 - protein, 9 aa, Staphylococcus epidermidis
EAKNNAITE

SEQ ID NO: 1729538 - protein, 21 aa, Staphylococcus epidermidis
EATDNGGQAVTNKVDGLPDGV

SEQ ID NO: 1729539 - protein, 21 aa, Staphylococcus epidermidis
EATDNSGQAVTNKVDGLPDGV

SEQ ID NO: 1729540 - protein, 21 aa, Staphylococcus epidermidis
EATDNSGQAVTNKVDGLPNGV

SEQ ID NO: 1729541 - protein, 20 aa, Staphylococcus epidermidis
EATDNSGQTVTNKVDGLPDG

SEQ ID NO: 1729542 - protein, 21 aa, Staphylococcus epidermidis
EATDNSGRAVTNKVDGLPDGV

SEQ ID NO: 1729543 - protein, 22 aa, Staphylococcus epidermidis
EATQTSIPQRQPQSNPEKQTVK

SEQ ID NO: 1729544 - protein, 15 aa, Staphylococcus epidermidis
EDQPTKYNGKKIELG

SEQ ID NO: 1729545 - protein, 33 aa, Staphylococcus epidermidis
EDQVNQDDQISNSSPFINEDSDKQKTYNDKIQA

SEQ ID NO: 1729546 - protein, 6 aa, Staphylococcus epidermidis
EDSLKE

SEQ ID NO: 1729547 - protein, 22 aa, Staphylococcus epidermidis
EDTTKPTVKSVSDQTQEVNTEI

SEQ ID NO: 1729548 - protein, 11 aa, Staphylococcus epidermidis
EEAQGSKAPIQ

SEQ ID NO: 1729549 - protein, 9 aa, Staphylococcus epidermidis
EEGNVSEPS

SEQ ID NO: 1729550 - protein, 10 aa, Staphylococcus epidermidis
EEKRSENPKL

SEQ ID NO: 1729551 - protein, 11 aa, Staphylococcus epidermidis
EENNSIEPDGK

SEQ ID NO: 1729552 - protein, 78 aa, Staphylococcus epidermidis
EENTVQDVKDSNMDDELSDSNDQSSNEEKNDVINNSQSINTDDDNQIKKEETNSNDAIENRSKDITQSTTNVDENEAT

SEQ ID NO: 1729553 - protein, 4 aa, Staphylococcus epidermidis
EEQK

SEQ ID NO: 1729554 - protein, 21 aa, Staphylococcus epidermidis
EEQTNVHQQSKYINEDSQVQN

SEQ ID NO: 1729555 - protein, 21 aa, Staphylococcus epidermidis
EERSYDRRSEDEKRKNLEKNL

SEQ ID NO: 1729556 - protein, 29 aa, Staphylococcus epidermidis
EESIKDKEQVKQSSNYINEDPDVQETYNN

SEQ ID NO: 1729557 - protein, 21 aa, Staphylococcus epidermidis
EESPIYENEQRELQKHPTREP

SEQ ID NO: 1729558 - protein, 7 aa, Staphylococcus epidermidis
EGLGPSI

SEQ ID NO: 1729559 - protein, 9 aa, Staphylococcus epidermidis
EGSQGSQRE

SEQ ID NO: 1729560 - protein, 6 aa, Staphylococcus epidermidis
EGSQVG

SEQ ID NO: 1729561 - protein, 6 aa, Staphylococcus epidermidis
EGVQHQ

SEQ ID NO: 1729562 - protein, 6 aa, Staphylococcus epidermidis
EHAGPA

SEQ ID NO: 1729563 - protein, 19 aa, Staphylococcus epidermidis
EHGQDIQKSNATQNEAKQA

SEQ ID NO: 1729564 - protein, 6 aa, Staphylococcus epidermidis
EHIEGT

SEQ ID NO: 1729565 - protein, 9 aa, Staphylococcus epidermidis
EIAHSKNET

SEQ ID NO: 1729566 - protein, 5 aa, Staphylococcus epidermidis
EIDVP

SEQ ID NO: 1729567 - protein, 25 aa, Staphylococcus epidermidis
EIQENVTEKTKGHKLKKSAAKTTAL

SEQ ID NO: 1729568 - protein, 11 aa, Staphylococcus epidermidis
EITQTENRANT

SEQ ID NO: 1729569 - protein, 7 aa, Staphylococcus epidermidis
EKEKDKI

SEQ ID NO: 1729570 - protein, 10 aa, Staphylococcus epidermidis
EKENDKSIEF

SEQ ID NO: 1729571 - protein, 21 aa, Staphylococcus epidermidis
EKGKNKEELKTSNQALKQAKD

SEQ ID NO: 1729572 - protein, 29 aa, Staphylococcus epidermidis
EKIEKENQAKREQHQTKVNEERVKDNLRK

SEQ ID NO: 1729573 - protein, 8 aa, Staphylococcus epidermidis
EKISNQDE

SEQ ID NO: 1729574 - protein, 16 aa, Staphylococcus epidermidis
EKKKNRHKIKRSETLS

SEQ ID NO: 1729575 - protein, 7 aa, Staphylococcus epidermidis
EKNGKPI

SEQ ID NO: 1729576 - protein, 7 aa, Staphylococcus epidermidis
EKYTKDL

SEQ ID NO: 1729577 - protein, 6 aa, Staphylococcus epidermidis
ELITDK

SEQ ID NO: 1729578 - protein, 9 aa, Staphylococcus epidermidis
ELKSEQPDF

SEQ ID NO: 1729579 - protein, 6 aa, Staphylococcus epidermidis
ELTGGK

SEQ ID NO: 1729580 - protein, 5 aa, Staphylococcus epidermidis
EMSAK

SEQ ID NO: 1729581 - protein, 4 aa, Staphylococcus epidermidis
ENFR

SEQ ID NO: 1729582 - protein, 5 aa, Staphylococcus epidermidis
ENGDY

SEQ ID NO: 1729583 - protein, 17 aa, Staphylococcus epidermidis
ENSNSIDDINNNKKHAF

SEQ ID NO: 1729584 - protein, 5 aa, Staphylococcus epidermidis
ENTIT

SEQ ID NO: 1729585 - protein, 17 aa, Staphylococcus epidermidis
ENVNDENDNQKNINDKL

SEQ ID NO: 1729586 - protein, 10 aa, Staphylococcus epidermidis
EPTSIHGKKA

SEQ ID NO: 1729587 - protein, 9 aa, Staphylococcus epidermidis
EQAQQQSIN

SEQ ID NO: 1729588 - protein, 12 aa, Staphylococcus epidermidis
EQIETTKNKLGL

SEQ ID NO: 1729589 - protein, 64 aa, Staphylococcus epidermidis
EQIPQGHKDEFDPNAPVDSKTEVPGKPGVKNPDTGEVVTPPVDDVTKYGPKVGNPITSTEEIPF

SEQ ID NO: 1729590 - protein, 4 aa, Staphylococcus epidermidis
ERTI

SEQ ID NO: 1729591 - protein, 21 aa, Staphylococcus epidermidis
ESEDNSDQAVTNKVDGLPDGV

SEQ ID NO: 1729592 - protein, 21 aa, Staphylococcus epidermidis
ESEDNSGQTVTNKVDGLPDGV

SEQ ID NO: 1729593 - protein, 12 aa, Staphylococcus epidermidis
ESIKDNTNIVSN

SEQ ID NO: 1729594 - protein, 13 aa, Staphylococcus epidermidis
ESRQNTLLLYVIL

SEQ ID NO: 1729595 - protein, 11 aa, Staphylococcus epidermidis
ESSPDRKRNSL

SEQ ID NO: 1729596 - protein, 13 aa, Staphylococcus epidermidis
ETQATLSSDTINQ

SEQ ID NO: 1729597 - protein, 13 aa, Staphylococcus epidermidis
EVDIKGNNNPLKR

SEQ ID NO: 1729598 - protein, 12 aa, Staphylococcus epidermidis
EVKAGNMKKSDI

SEQ ID NO: 1729599 - protein, 12 aa, Staphylococcus epidermidis
EVPGTDTNIDYD

SEQ ID NO: 1729600 - protein, 19 aa, Staphylococcus epidermidis
EYENKARPLSTTSAQPSIK

SEQ ID NO: 1729601 - protein, 7 aa, Staphylococcus epidermidis
EYPEEDK

SEQ ID NO: 1729602 - protein, 8 aa, Staphylococcus epidermidis
EYTDRGKN

SEQ ID NO: 1729603 - protein, 4 aa, Staphylococcus epidermidis
FARG

SEQ ID NO: 1729604 - protein, 31 aa, Staphylococcus epidermidis
FEGKKIAAQKGTDQEKIAQTEIEDSKISSLN

SEQ ID NO: 1729605 - protein, 7 aa, Staphylococcus epidermidis
FEKEGKT

SEQ ID NO: 1729606 - protein, 8 aa, Staphylococcus epidermidis
FKGASTQT

SEQ ID NO: 1729607 - protein, 12 aa, Staphylococcus epidermidis
FKNYDTKSHGTV

SEQ ID NO: 1729608 - protein, 7 aa, Staphylococcus epidermidis
FPSGSIK

SEQ ID NO: 1729609 - protein, 14 aa, Staphylococcus epidermidis
FPSKEKNEETSHVG

SEQ ID NO: 1729610 - protein, 8 aa, Staphylococcus epidermidis
FSTGGEYA

SEQ ID NO: 1729611 - protein, 6 aa, Staphylococcus epidermidis
FTDIPD

SEQ ID NO: 1729612 - protein, 7 aa, Staphylococcus epidermidis
FTPKSTY

SEQ ID NO: 1729613 - protein, 8 aa, Staphylococcus epidermidis
FTPKSTYY

SEQ ID NO: 1729614 - protein, 21 aa, Staphylococcus epidermidis
FTSKKEKETFTSFNSNEKVTQ

SEQ ID NO: 1729615 - protein, 21 aa, Staphylococcus epidermidis
FTSKKEKETSTSFNNNEKVTQ

SEQ ID NO: 1729616 - protein, 21 aa, Staphylococcus epidermidis
FTSKKEKETSTSFNSNEKVTQ

SEQ ID NO: 1729617 - protein, 6 aa, Staphylococcus epidermidis
FTTGTV

SEQ ID NO: 1729618 - protein, 5 aa, Staphylococcus epidermidis
GANKK

SEQ ID NO: 1729619 - protein, 11 aa, Staphylococcus epidermidis
GANSSTPFENP

SEQ ID NO: 1729620 - protein, 15 aa, Staphylococcus epidermidis
GASKLSDKSEKVQIN

SEQ ID NO: 1729621 - protein, 12 aa, Staphylococcus epidermidis
GDGTNDAPALAE

SEQ ID NO: 1729622 - protein, 10 aa, Staphylococcus epidermidis
GDNKRTAQAI

SEQ ID NO: 1729623 - protein, 21 aa, Staphylococcus epidermidis
GEVRLNGKDMNSINDNDKYQT

SEQ ID NO: 1729624 - protein, 4 aa, Staphylococcus epidermidis
GGGM

SEQ ID NO: 1729625 - protein, 12 aa, Staphylococcus epidermidis
GGKTDPMEKRTR

SEQ ID NO: 1729626 - protein, 6 aa, Staphylococcus epidermidis
GGQAGG

SEQ ID NO: 1729627 - protein, 5 aa, Staphylococcus epidermidis
GGTTP

SEQ ID NO: 1729628 - protein, 32 aa, Staphylococcus epidermidis
GHAPKNHEVDYSKNKPPHKHHKGRQDDQHQGN

SEQ ID NO: 1729629 - protein, 5 aa, Staphylococcus epidermidis
GHEAK

SEQ ID NO: 1729630 - protein, 9 aa, Staphylococcus epidermidis
GHSSNYGMT

SEQ ID NO: 1729631 - protein, 12 aa, Staphylococcus epidermidis
GISQSQDNTGSV

SEQ ID NO: 1729632 - protein, 55 aa, Staphylococcus epidermidis
GKALEEDNHHDTSSEKGHVNDKNSEYSRQDKDNYVYQNDKRNYNRNYNDEDYNRS

SEQ ID NO: 1729633 - protein, 13 aa, Staphylococcus epidermidis
GKASKSKEAGIGS

SEQ ID NO: 1729634 - protein, 8 aa, Staphylococcus epidermidis
GKGKSNWS

SEQ ID NO: 1729635 - protein, 6 aa, Staphylococcus epidermidis
GKINLN

SEQ ID NO: 1729636 - protein, 7 aa, Staphylococcus epidermidis
GKKGTYV

SEQ ID NO: 1729637 - protein, 10 aa, Staphylococcus epidermidis
GKPGDQIEYK

SEQ ID NO: 1729638 - protein, 8 aa, Staphylococcus epidermidis
GKPGESVS

SEQ ID NO: 1729639 - protein, 9 aa, Staphylococcus epidermidis
GKRQGFAGG

SEQ ID NO: 1729640 - protein, 8 aa, Staphylococcus epidermidis
GKSGTAEL

SEQ ID NO: 1729641 - protein, 9 aa, Staphylococcus epidermidis
GKSGTAELK

SEQ ID NO: 1729642 - protein, 11 aa, Staphylococcus epidermidis
GKYGLGEKGTV

SEQ ID NO: 1729643 - protein, 6 aa, Staphylococcus epidermidis
GLASGV

SEQ ID NO: 1729644 - protein, 22 aa, Staphylococcus epidermidis
GLNQAQKEQLNQEIQQTQTRSE

SEQ ID NO: 1729645 - protein, 7 aa, Staphylococcus epidermidis
GLSGSKT

SEQ ID NO: 1729646 - protein, 7 aa, Staphylococcus epidermidis
GLSPTDS

SEQ ID NO: 1729647 - protein, 5 aa, Staphylococcus epidermidis
GNTLP

SEQ ID NO: 1729648 - protein, 8 aa, Staphylococcus epidermidis
GNYSEAKN

SEQ ID NO: 1729649 - protein, 4 aa, Staphylococcus epidermidis
GQFE

SEQ ID NO: 1729650 - protein, 9 aa, Staphylococcus epidermidis
GQQSSVTKD

SEQ ID NO: 1729651 - protein, 12 aa, Staphylococcus epidermidis
GRAKSKKDVGTA

SEQ ID NO: 1729652 - protein, 15 aa, Staphylococcus epidermidis
GRKLIQTSNENTLAY

SEQ ID NO: 1729653 - protein, 4 aa, Staphylococcus epidermidis
GSAA

SEQ ID NO: 1729654 - protein, 12 aa, Staphylococcus epidermidis
GSTMNKNGAITV

SEQ ID NO: 1729655 - protein, 9 aa, Staphylococcus epidermidis
GTEITKKER

SEQ ID NO: 1729656 - protein, 14 aa, Staphylococcus epidermidis
GTGDLKGSSTGSKN

SEQ ID NO: 1729657 - protein, 11 aa, Staphylococcus epidermidis
GTINNADNMTV

SEQ ID NO: 1729658 - protein, 6 aa, Staphylococcus epidermidis
GTITYG

SEQ ID NO: 1729659 - protein, 15 aa, Staphylococcus epidermidis
GTLQATAQTRRYQAS

SEQ ID NO: 1729660 - protein, 13 aa, Staphylococcus epidermidis
GVEEKHNDPNFGS

SEQ ID NO: 1729661 - protein, 4 aa, Staphylococcus epidermidis
GVEK

SEQ ID NO: 1729662 - protein, 5 aa, Staphylococcus epidermidis
GVNKA

SEQ ID NO: 1729663 - protein, 5 aa, Staphylococcus epidermidis
GYANI

SEQ ID NO: 1729664 - protein, 22 aa, Staphylococcus epidermidis
GYEAQPKKEASEKSSQKEKQLK

SEQ ID NO: 1729665 - protein, 5 aa, Staphylococcus epidermidis
HAKTT

SEQ ID NO: 1729666 - protein, 24 aa, Staphylococcus epidermidis
HANATSNSKAQAKQMVNEEARKAF

SEQ ID NO: 1729667 - protein, 21 aa, Staphylococcus epidermidis
HEIEKKGEKLEKDNRKDIKKL

SEQ ID NO: 1729668 - protein, 4 aa, Staphylococcus epidermidis
HETE

SEQ ID NO: 1729669 - protein, 10 aa, Staphylococcus epidermidis
HHGSRTSSSE

SEQ ID NO: 1729670 - protein, 5 aa, Staphylococcus epidermidis
HIGKD

SEQ ID NO: 1729671 - protein, 21 aa, Staphylococcus epidermidis
HIQQRDTYTAEIDAADAEKGV

SEQ ID NO: 1729672 - protein, 5 aa, Staphylococcus epidermidis
HISKD

SEQ ID NO: 1729673 - protein, 11 aa, Staphylococcus epidermidis
HKEESITNYAS

SEQ ID NO: 1729674 - protein, 13 aa, Staphylococcus epidermidis
HKSHNQNKEIKSD

SEQ ID NO: 1729675 - protein, 10 aa, Staphylococcus epidermidis
HNLSGGEAQR

SEQ ID NO: 1729676 - protein, 16 aa, Staphylococcus epidermidis
HQSEKQTKDSRHSKKH

SEQ ID NO: 1729677 - protein, 5 aa, Staphylococcus epidermidis
HSDNN

SEQ ID NO: 1729678 - protein, 7 aa, Staphylococcus epidermidis
HSKATSI

SEQ ID NO: 1729679 - protein, 10 aa, Staphylococcus epidermidis
HSMQENNKPI

SEQ ID NO: 1729680 - protein, 11 aa, Staphylococcus epidermidis
HTGKQSEGSSD

SEQ ID NO: 1729681 - protein, 14 aa, Staphylococcus epidermidis
HTRTSGDGAPFKRQ

SEQ ID NO: 1729682 - protein, 9 aa, Staphylococcus epidermidis
HTVQSKNNL

SEQ ID NO: 1729683 - protein, 33 aa, Staphylococcus epidermidis
IADYENQKQQENYLDASNNKRQDYDNAVNAAKG

SEQ ID NO: 1729684 - protein, 7 aa, Staphylococcus epidermidis
IAKEAGV

SEQ ID NO: 1729685 - protein, 31 aa, Staphylococcus epidermidis
IANYDDELHDGNYINADKDKKDAYNNAVNNA

SEQ ID NO: 1729686 - protein, 5 aa, Staphylococcus epidermidis
IATEP

SEQ ID NO: 1729687 - protein, 7 aa, Staphylococcus epidermidis
IDEENNS

SEQ ID NO: 1729688 - protein, 5 aa, Staphylococcus epidermidis
IDGAN

SEQ ID NO: 1729689 - protein, 7 aa, Staphylococcus epidermidis
IDKAKRE

SEQ ID NO: 1729690 - protein, 10 aa, Staphylococcus epidermidis
IDKGDNVSPA

SEQ ID NO: 1729691 - protein, 28 aa, Staphylococcus epidermidis
IDQTPNATAEEKEEANNKVDRLQEEADA

SEQ ID NO: 1729692 - protein, 19 aa, Staphylococcus epidermidis
IDQVPSTDGMTQQSVANYN

SEQ ID NO: 1729693 - protein, 69 aa, Staphylococcus epidermidis
IEAQSEDVTNHTNSNHSNSSIPENKATTESSSKPKKRGKRSLDTNNGNDTTSTTQNTDPNLSNTGPNGI

SEQ ID NO: 1729694 - protein, 13 aa, Staphylococcus epidermidis
IEDSNSKDASFGL

SEQ ID NO: 1729695 - protein, 5 aa, Staphylococcus epidermidis
IENGS

SEQ ID NO: 1729696 - protein, 6 aa, Staphylococcus epidermidis
IERNNG

SEQ ID NO: 1729697 - protein, 14 aa, Staphylococcus epidermidis
IGKANTQSNKYDIR

SEQ ID NO: 1729698 - protein, 10 aa, Staphylococcus epidermidis
IKASKSTIRN

SEQ ID NO: 1729699 - protein, 8 aa, Staphylococcus epidermidis
IKDNSGEI

SEQ ID NO: 1729700 - protein, 15 aa, Staphylococcus epidermidis
IKGKTYKKSYNMNNR

SEQ ID NO: 1729701 - protein, 14 aa, Staphylococcus epidermidis
IKKVSKNKKRVDAQ

SEQ ID NO: 1729702 - protein, 11 aa, Staphylococcus epidermidis
ILNQTQSPTMS

SEQ ID NO: 1729703 - protein, 28 aa, Staphylococcus epidermidis
INDAEQNLHGENKLRQAQEIAKNEIQNL

SEQ ID NO: 1729704 - protein, 15 aa, Staphylococcus epidermidis
INEDANQQQAYSNAI

SEQ ID NO: 1729705 - protein, 7 aa, Staphylococcus epidermidis
INNAVTR

SEQ ID NO: 1729706 - protein, 45 aa, Staphylococcus epidermidis
INNGDATSQQINDAKNTVEQAQRDYVEAKSNLRADKSQLQSAYDT

SEQ ID NO: 1729707 - protein, 5 aa, Staphylococcus epidermidis
INNSD

SEQ ID NO: 1729708 - protein, 23 aa, Staphylococcus epidermidis
INSEELKQKEYKGYKDDAVIGKK

SEQ ID NO: 1729709 - protein, 24 aa, Staphylococcus epidermidis
INSEELKQKEYKGYKDDAVIGKKG

SEQ ID NO: 1729710 - protein, 12 aa, Staphylococcus epidermidis
INSNSGHRNQNN

SEQ ID NO: 1729711 - protein, 26 aa, Staphylococcus epidermidis
INTDSKEDRNALSHKNQEEDDASNDV

SEQ ID NO: 1729712 - protein, 4 aa, Staphylococcus epidermidis
IPAY

SEQ ID NO: 1729713 - protein, 5 aa, Staphylococcus epidermidis
IPETE

SEQ ID NO: 1729714 - protein, 11 aa, Staphylococcus epidermidis
IPGRGINATID

SEQ ID NO: 1729715 - protein, 11 aa, Staphylococcus epidermidis
IQESITDKENK

SEQ ID NO: 1729716 - protein, 13 aa, Staphylococcus epidermidis
IQNHESRMNENSK

SEQ ID NO: 1729717 - protein, 9 aa, Staphylococcus epidermidis
IQNKSKANL

SEQ ID NO: 1729718 - protein, 45 aa, Staphylococcus epidermidis
IQPHPQTKATGRHRLNEKANQQQSTIATHPNSTIEERQEASAKLQ

SEQ ID NO: 1729719 - protein, 58 aa, Staphylococcus epidermidis
IQQDFKSDSNNKLSEQSDQQASPSNKNENNKEESSTTTNQSDSDSKDDKSNDGRRSTL

SEQ ID NO: 1729720 - protein, 59 aa, Staphylococcus epidermidis
IQQDFKSDSNNKLSEQSDQQASPSNKNENNKEESSTTTNQSDSDSKDDKSNDGRRSTLE

SEQ ID NO: 1729721 - protein, 10 aa, Staphylococcus epidermidis
IQQKGEGLKT

SEQ ID NO: 1729722 - protein, 11 aa, Staphylococcus epidermidis
IQQSITDKENK

SEQ ID NO: 1729723 - protein, 5 aa, Staphylococcus epidermidis
IQTTI

SEQ ID NO: 1729724 - protein, 8 aa, Staphylococcus epidermidis
IRSKDFSG

SEQ ID NO: 1729725 - protein, 23 aa, Staphylococcus epidermidis
ISDNESVTNESNYINAEPEKQHA

SEQ ID NO: 1729726 - protein, 8 aa, Staphylococcus epidermidis
ITGTRGAT

SEQ ID NO: 1729727 - protein, 9 aa, Staphylococcus epidermidis
ITRKKQGKA

SEQ ID NO: 1729728 - protein, 8 aa, Staphylococcus epidermidis
KADTDQAL

SEQ ID NO: 1729729 - protein, 13 aa, Staphylococcus epidermidis
KAGNKSEATTTNV

SEQ ID NO: 1729730 - protein, 6 aa, Staphylococcus epidermidis
KAHGPH

SEQ ID NO: 1729731 - protein, 7 aa, Staphylococcus epidermidis
KAKALKE

SEQ ID NO: 1729732 - protein, 7 aa, Staphylococcus epidermidis
KAPKTDA

SEQ ID NO: 1729733 - protein, 7 aa, Staphylococcus epidermidis
KAPSGMK

SEQ ID NO: 1729734 - protein, 19 aa, Staphylococcus epidermidis
KAQRMAKTEIPDEIETQVD

SEQ ID NO: 1729735 - protein, 7 aa, Staphylococcus epidermidis
KAVGASS

SEQ ID NO: 1729736 - protein, 8 aa, Staphylococcus epidermidis
KDETNNTG

SEQ ID NO: 1729737 - protein, 12 aa, Staphylococcus epidermidis
KDFSNPDYGVDT

SEQ ID NO: 1729738 - protein, 7 aa, Staphylococcus epidermidis
KDGDDFL

SEQ ID NO: 1729739 - protein, 12 aa, Staphylococcus epidermidis
KDHPEVKKPLNK

SEQ ID NO: 1729740 - protein, 7 aa, Staphylococcus epidermidis
KDIEQSK

SEQ ID NO: 1729741 - protein, 8 aa, Staphylococcus epidermidis
KDKPIKPA

SEQ ID NO: 1729742 - protein, 14 aa, Staphylococcus epidermidis
KDRHDINEGKDVHD

SEQ ID NO: 1729743 - protein, 19 aa, Staphylococcus epidermidis
KDSNNRELQRVTTDQSGHY

SEQ ID NO: 1729744 - protein, 6 aa, Staphylococcus epidermidis
KDTIDK

SEQ ID NO: 1729745 - protein, 19 aa, Staphylococcus epidermidis
KDYKDGEISYNPNVPSYSA

SEQ ID NO: 1729746 - protein, 30 aa, Staphylococcus epidermidis
KDYKDGEVSYNPNAPNYSAKYQLSNNDYNV

SEQ ID NO: 1729747 - protein, 51 aa, Staphylococcus epidermidis
KEDKNSEKLSTVTGTVTKNNSKSLKHKASEQQSYHNKSEKIKNVNKPTKIV

SEQ ID NO: 1729748 - protein, 16 aa, Staphylococcus epidermidis
KEGFRDEEFDKGDKGT

SEQ ID NO: 1729749 - protein, 4 aa, Staphylococcus epidermidis
KEIT

SEQ ID NO: 1729750 - protein, 17 aa, Staphylococcus epidermidis
KEKSDIGFQTRKKEYPV

SEQ ID NO: 1729751 - protein, 9 aa, Staphylococcus epidermidis
KENKNKAPV

SEQ ID NO: 1729752 - protein, 36 aa, Staphylococcus epidermidis
KEQLQQSIQPAASTDGMTQDSTRNYKNKRQAAEQAI

SEQ ID NO: 1729753 - protein, 9 aa, Staphylococcus epidermidis
KEQNLNTAM

SEQ ID NO: 1729754 - protein, 4 aa, Staphylococcus epidermidis
KFER

SEQ ID NO: 1729755 - protein, 4 aa, Staphylococcus epidermidis
KFIP

SEQ ID NO: 1729756 - protein, 8 aa, Staphylococcus epidermidis
KGDKKTRI

SEQ ID NO: 1729757 - protein, 37 aa, Staphylococcus epidermidis
KGEKSDEEDDEEDKDTTTKNETVKVPYTGKKSKSQKV

SEQ ID NO: 1729758 - protein, 5 aa, Staphylococcus epidermidis
KGENI

SEQ ID NO: 1729759 - protein, 5 aa, Staphylococcus epidermidis
KGLAR

SEQ ID NO: 1729760 - protein, 9 aa, Staphylococcus epidermidis
KGMEQASQS

SEQ ID NO: 1729761 - protein, 6 aa, Staphylococcus epidermidis
KGTPFE

SEQ ID NO: 1729762 - protein, 14 aa, Staphylococcus epidermidis
KHKKSKEKQLSEGD

SEQ ID NO: 1729763 - protein, 6 aa, Staphylococcus epidermidis
KHSDND

SEQ ID NO: 1729764 - protein, 7 aa, Staphylococcus epidermidis
KHSDNDL

SEQ ID NO: 1729765 - protein, 11 aa, Staphylococcus epidermidis
KIGRKQRLSDK

SEQ ID NO: 1729766 - protein, 12 aa, Staphylococcus epidermidis
KIGRKQRLSDKN

SEQ ID NO: 1729767 - protein, 21 aa, Staphylococcus epidermidis
KIKKYKKQINDYSQRKHKYEV

SEQ ID NO: 1729768 - protein, 10 aa, Staphylococcus epidermidis
KIKNAGAIGI

SEQ ID NO: 1729769 - protein, 10 aa, Staphylococcus epidermidis
KIKTNSSDGY

SEQ ID NO: 1729770 - protein, 7 aa, Staphylococcus epidermidis
KIPGVED

SEQ ID NO: 1729771 - protein, 4 aa, Staphylococcus epidermidis
KIPL

SEQ ID NO: 1729772 - protein, 17 aa, Staphylococcus epidermidis
KITNPTLSLNKSNNHAN

SEQ ID NO: 1729773 - protein, 15 aa, Staphylococcus epidermidis
KKARKLKQQVTQTQK

SEQ ID NO: 1729774 - protein, 11 aa, Staphylococcus epidermidis
KKDHDNDLTKE

SEQ ID NO: 1729775 - protein, 5 aa, Staphylococcus epidermidis
KKDHG

SEQ ID NO: 1729776 - protein, 7 aa, Staphylococcus epidermidis
KKDPAVL

SEQ ID NO: 1729777 - protein, 6 aa, Staphylococcus epidermidis
KKDSYY

SEQ ID NO: 1729778 - protein, 17 aa, Staphylococcus epidermidis
KKGVKDIKGRAAINDDN

SEQ ID NO: 1729779 - protein, 11 aa, Staphylococcus epidermidis
KKIGDKGNAAI

SEQ ID NO: 1729780 - protein, 14 aa, Staphylococcus epidermidis
KKLSEPKTKTIYSQ

SEQ ID NO: 1729781 - protein, 12 aa, Staphylococcus epidermidis
KKPIANKSNKYA

SEQ ID NO: 1729782 - protein, 4 aa, Staphylococcus epidermidis
KKPL

SEQ ID NO: 1729783 - protein, 9 aa, Staphylococcus epidermidis
KKRPTGKQN

SEQ ID NO: 1729784 - protein, 13 aa, Staphylococcus epidermidis
KKVSKNKKRVDAQ

SEQ ID NO: 1729785 - protein, 7 aa, Staphylococcus epidermidis
KLANPSM

SEQ ID NO: 1729786 - protein, 10 aa, Staphylococcus epidermidis
KLAQNQADSN

SEQ ID NO: 1729787 - protein, 7 aa, Staphylococcus epidermidis
KMNNDEM

SEQ ID NO: 1729788 - protein, 11 aa, Staphylococcus epidermidis
KNAYHKTQQEL

SEQ ID NO: 1729789 - protein, 19 aa, Staphylococcus epidermidis
KNDSQGNTSKVGSGTPSTD

SEQ ID NO: 1729790 - protein, 4 aa, Staphylococcus epidermidis
KNEV

SEQ ID NO: 1729791 - protein, 13 aa, Staphylococcus epidermidis
KNGDVTVIENVNQ

SEQ ID NO: 1729792 - protein, 12 aa, Staphylococcus epidermidis
KNGFNNEGATVH

SEQ ID NO: 1729793 - protein, 12 aa, Staphylococcus epidermidis
KNGFNNESATVH

SEQ ID NO: 1729794 - protein, 10 aa, Staphylococcus epidermidis
KNKSQNPELD

SEQ ID NO: 1729795 - protein, 17 aa, Staphylococcus epidermidis
KNNNNGKSNGKKNRNVK

SEQ ID NO: 1729796 - protein, 8 aa, Staphylococcus epidermidis
KNNQKRLT

SEQ ID NO: 1729797 - protein, 19 aa, Staphylococcus epidermidis
KNPKLGAVTGNPRIRNKSS

SEQ ID NO: 1729798 - protein, 8 aa, Staphylococcus epidermidis
KNPPEVAS

SEQ ID NO: 1729799 - protein, 37 aa, Staphylococcus epidermidis
KNRLENAVNDTDPTHGMTQETINNYNAKKREAQNEIQ

SEQ ID NO: 1729800 - protein, 5 aa, Staphylococcus epidermidis
KPLHN

SEQ ID NO: 1729801 - protein, 4 aa, Staphylococcus epidermidis
KPTY

SEQ ID NO: 1729802 - protein, 8 aa, Staphylococcus epidermidis
KQGETGRQ

SEQ ID NO: 1729803 - protein, 18 aa, Staphylococcus epidermidis
KQTIQNNDDATTEEKEVA

SEQ ID NO: 1729804 - protein, 9 aa, Staphylococcus epidermidis
KRIKEHPDV

SEQ ID NO: 1729805 - protein, 63 aa, Staphylococcus epidermidis
KRKNKDKRVEQRSTIDSKRESNQSKFKASDLEQTTKSNTDPTQSNDIEDEKRKNHFDSEIDNA

SEQ ID NO: 1729806 - protein, 4 aa, Staphylococcus epidermidis
KSGF

SEQ ID NO: 1729807 - protein, 9 aa, Staphylococcus epidermidis
KSGRSVETC

SEQ ID NO: 1729808 - protein, 6 aa, Staphylococcus epidermidis
KSPGVS

SEQ ID NO: 1729809 - protein, 4 aa, Staphylococcus epidermidis
KSPL

SEQ ID NO: 1729810 - protein, 4 aa, Staphylococcus epidermidis
KSPV

SEQ ID NO: 1729811 - protein, 19 aa, Staphylococcus epidermidis
KSQNNTEHRMNSSDNTNSL

SEQ ID NO: 1729812 - protein, 16 aa, Staphylococcus epidermidis
KSRDLKGTNGNMKIPS

SEQ ID NO: 1729813 - protein, 6 aa, Staphylococcus epidermidis
KSRKSV

SEQ ID NO: 1729814 - protein, 5 aa, Staphylococcus epidermidis
KSYIG

SEQ ID NO: 1729815 - protein, 21 aa, Staphylococcus epidermidis
KTGTITNGTPEVTDFSGDDQT

SEQ ID NO: 1729816 - protein, 7 aa, Staphylococcus epidermidis
KTKKEYR

SEQ ID NO: 1729817 - protein, 8 aa, Staphylococcus epidermidis
KTKKYKSD

SEQ ID NO: 1729818 - protein, 6 aa, Staphylococcus epidermidis
KTLDEA

SEQ ID NO: 1729819 - protein, 15 aa, Staphylococcus epidermidis
KTNPDSGERVEQGNR

SEQ ID NO: 1729820 - protein, 8 aa, Staphylococcus epidermidis
KTNYGNID

SEQ ID NO: 1729821 - protein, 20 aa, Staphylococcus epidermidis
KTPPAVKAISNKTQKVNTEI

SEQ ID NO: 1729822 - protein, 7 aa, Staphylococcus epidermidis
KTSGNPA

SEQ ID NO: 1729823 - protein, 7 aa, Staphylococcus epidermidis
KVEANAN

SEQ ID NO: 1729824 - protein, 7 aa, Staphylococcus epidermidis
KVLPKGS

SEQ ID NO: 1729825 - protein, 8 aa, Staphylococcus epidermidis
KVNDGSVQ

SEQ ID NO: 1729826 - protein, 16 aa, Staphylococcus epidermidis
KVNGNFDKKTNDKFTE

SEQ ID NO: 1729827 - protein, 7 aa, Staphylococcus epidermidis
KVPMSEK

SEQ ID NO: 1729828 - protein, 11 aa, Staphylococcus epidermidis
KVPNANIDGKV

SEQ ID NO: 1729829 - protein, 18 aa, Staphylococcus epidermidis
KYDDQYQNHRKRSEEDMY

SEQ ID NO: 1729830 - protein, 7 aa, Staphylococcus epidermidis
LAKAKEL

SEQ ID NO: 1729831 - protein, 11 aa, Staphylococcus epidermidis
LASEAKNKNAI

SEQ ID NO: 1729832 - protein, 15 aa, Staphylococcus epidermidis
LAYNSFGKTNKSGVP

SEQ ID NO: 1729833 - protein, 156 aa, Staphylococcus epidermidis
LDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVY

SEQ ID NO: 1729834 - protein, 8 aa, Staphylococcus epidermidis
LDSLPNRM

SEQ ID NO: 1729835 - protein, 7 aa, Staphylococcus epidermidis
LEPSGTQ

SEQ ID NO: 1729836 - protein, 8 aa, Staphylococcus epidermidis
LGHRNQNN

SEQ ID NO: 1729837 - protein, 20 aa, Staphylococcus epidermidis
LGQTSLSEYNESFLNFKMSL

SEQ ID NO: 1729838 - protein, 9 aa, Staphylococcus epidermidis
LGTNGGGFL

SEQ ID NO: 1729839 - protein, 13 aa, Staphylococcus epidermidis
LGVDSNETEAITN

SEQ ID NO: 1729840 - protein, 5 aa, Staphylococcus epidermidis
LGVNP

SEQ ID NO: 1729841 - protein, 20 aa, Staphylococcus epidermidis
LKDKNGNAIGTTTTDASGHY

SEQ ID NO: 1729842 - protein, 10 aa, Staphylococcus epidermidis
LKEAAQRSQT

SEQ ID NO: 1729843 - protein, 7 aa, Staphylococcus epidermidis
LKEAKGI

SEQ ID NO: 1729844 - protein, 7 aa, Staphylococcus epidermidis
LKEQAET

SEQ ID NO: 1729845 - protein, 20 aa, Staphylococcus epidermidis
LKRKKGGYATWSSPDRGNIQ

SEQ ID NO: 1729846 - protein, 7 aa, Staphylococcus epidermidis
LKRQTVS

SEQ ID NO: 1729847 - protein, 8 aa, Staphylococcus epidermidis
LKSKEKDI

SEQ ID NO: 1729848 - protein, 10 aa, Staphylococcus epidermidis
LNKNSGPNVN

SEQ ID NO: 1729849 - protein, 7 aa, Staphylococcus epidermidis
LNNTDRE

SEQ ID NO: 1729850 - protein, 6 aa, Staphylococcus epidermidis
LNQRDN

SEQ ID NO: 1729851 - protein, 8 aa, Staphylococcus epidermidis
LNSAQKHM

SEQ ID NO: 1729852 - protein, 5 aa, Staphylococcus epidermidis
LNTAK

SEQ ID NO: 1729853 - protein, 9 aa, Staphylococcus epidermidis
LPTSDEGRF

SEQ ID NO: 1729854 - protein, 27 aa, Staphylococcus epidermidis
LQQQTAKESVKNATKLEEIATASNDAL

SEQ ID NO: 1729855 - protein, 51 aa, Staphylococcus epidermidis
LSEDTIVTQSKNTNMLNKTGKDYDLQEQRGYTDSEQHNETQSNQADNHSNN

SEQ ID NO: 1729856 - protein, 5 aa, Staphylococcus epidermidis
LSEEN

SEQ ID NO: 1729857 - protein, 4 aa, Staphylococcus epidermidis
LSEK

SEQ ID NO: 1729858 - protein, 6 aa, Staphylococcus epidermidis
LSELTN

SEQ ID NO: 1729859 - protein, 13 aa, Staphylococcus epidermidis
LSPNYTSETNRRF

SEQ ID NO: 1729860 - protein, 4 aa, Staphylococcus epidermidis
LSPT

SEQ ID NO: 1729861 - protein, 10 aa, Staphylococcus epidermidis
LSSDNPPASV

SEQ ID NO: 1729862 - protein, 7 aa, Staphylococcus epidermidis
LSSSDPM

SEQ ID NO: 1729863 - protein, 11 aa, Staphylococcus epidermidis
LSSTKRKRTMK

SEQ ID NO: 1729864 - protein, 5 aa, Staphylococcus epidermidis
LTQST

SEQ ID NO: 1729865 - protein, 5 aa, Staphylococcus epidermidis
MANGK

SEQ ID NO: 1729866 - protein, 12 aa, Staphylococcus epidermidis
MDAPKNNPFKQE

SEQ ID NO: 1729867 - protein, 19 aa, Staphylococcus epidermidis
MEPDAPVDKSEMKSEDALY

SEQ ID NO: 1729868 - protein, 9 aa, Staphylococcus epidermidis
MKQGETGRQ

SEQ ID NO: 1729869 - protein, 4 aa, Staphylococcus epidermidis
MQTA

SEQ ID NO: 1729870 - protein, 8 aa, Staphylococcus epidermidis
MSNQAIKN

SEQ ID NO: 1729871 - protein, 67 aa, Staphylococcus epidermidis
MSTYDYSRYSKDISNKNNKSATFEQQNVSDINNNQYSRNKVNQPVKKSRKNEINKDLPQTGEENFNK

SEQ ID NO: 1729872 - protein, 11 aa, Staphylococcus epidermidis
MTKQPKGKIMT

SEQ ID NO: 1729873 - protein, 18 aa, Staphylococcus epidermidis
NAAADYSRFQKKSNSSLS

SEQ ID NO: 1729874 - protein, 9 aa, Staphylococcus epidermidis
NALGGLSGS

SEQ ID NO: 1729875 - protein, 12 aa, Staphylococcus epidermidis
NAMGQGISKAGS

SEQ ID NO: 1729876 - protein, 7 aa, Staphylococcus epidermidis
NAQENVG

SEQ ID NO: 1729877 - protein, 18 aa, Staphylococcus epidermidis
NASNQTFTATYAGKTWTA

SEQ ID NO: 1729878 - protein, 4 aa, Staphylococcus epidermidis
NDED

SEQ ID NO: 1729879 - protein, 8 aa, Staphylococcus epidermidis
NDNLKQDF

SEQ ID NO: 1729880 - protein, 4 aa, Staphylococcus epidermidis
NDNV

SEQ ID NO: 1729881 - protein, 24 aa, Staphylococcus epidermidis
NDPQKSAEESLVNGSNTRSEVEEH

SEQ ID NO: 1729882 - protein, 8 aa, Staphylococcus epidermidis
NDSQSNED

SEQ ID NO: 1729883 - protein, 7 aa, Staphylococcus epidermidis
NDSRKIT

SEQ ID NO: 1729884 - protein, 168 aa, Staphylococcus epidermidis
NDTSRTGISMNSDNDLDTDIVSNSDSENDTYLDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNIN

SEQ ID NO: 1729885 - protein, 192 aa, Staphylococcus epidermidis
NDTSRTGISMNSDNDLDTDIVSNSDSENDTYLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNIN

SEQ ID NO: 1729886 - protein, 19 aa, Staphylococcus epidermidis
NEAYKNNKHIKKANSSYQY

SEQ ID NO: 1729887 - protein, 5 aa, Staphylococcus epidermidis
NEEAY

SEQ ID NO: 1729888 - protein, 5 aa, Staphylococcus epidermidis
NEEGI

SEQ ID NO: 1729889 - protein, 13 aa, Staphylococcus epidermidis
NELRGNSNHKPEI

SEQ ID NO: 1729890 - protein, 17 aa, Staphylococcus epidermidis
NEQEDKRPNTANQRQKR

SEQ ID NO: 1729891 - protein, 9 aa, Staphylococcus epidermidis
NGARNNTIT

SEQ ID NO: 1729892 - protein, 20 aa, Staphylococcus epidermidis
NGARSRDQVAEKLKEAEALD

SEQ ID NO: 1729893 - protein, 6 aa, Staphylococcus epidermidis
NGATIG

SEQ ID NO: 1729894 - protein, 6 aa, Staphylococcus epidermidis
NGGALD

SEQ ID NO: 1729895 - protein, 9 aa, Staphylococcus epidermidis
NGGQKSQGM

SEQ ID NO: 1729896 - protein, 10 aa, Staphylococcus epidermidis
NGSIDNDGLF

SEQ ID NO: 1729897 - protein, 11 aa, Staphylococcus epidermidis
NGTKAVTSKYK

SEQ ID NO: 1729898 - protein, 5 aa, Staphylococcus epidermidis
NGTTT

SEQ ID NO: 1729899 - protein, 19 aa, Staphylococcus epidermidis
NHATSNDLVNQAKDEGQSA

SEQ ID NO: 1729900 - protein, 9 aa, Staphylococcus epidermidis
NHAVQDESS

SEQ ID NO: 1729901 - protein, 6 aa, Staphylococcus epidermidis
NHEQTI

SEQ ID NO: 1729902 - protein, 5 aa, Staphylococcus epidermidis
NHSEY

SEQ ID NO: 1729903 - protein, 14 aa, Staphylococcus epidermidis
NIKGNNNVSTSKIK

SEQ ID NO: 1729904 - protein, 24 aa, Staphylococcus epidermidis
NISDNESVTNESNYINAEPEKQHA

SEQ ID NO: 1729905 - protein, 6 aa, Staphylococcus epidermidis
NKAKRE

SEQ ID NO: 1729906 - protein, 14 aa, Staphylococcus epidermidis
NKDDSKETEIKKSF

SEQ ID NO: 1729907 - protein, 5 aa, Staphylococcus epidermidis
NKEGA

SEQ ID NO: 1729908 - protein, 11 aa, Staphylococcus epidermidis
NKEQDLNTAMQ

SEQ ID NO: 1729909 - protein, 5 aa, Staphylococcus epidermidis
NKGDL

SEQ ID NO: 1729910 - protein, 10 aa, Staphylococcus epidermidis
NKLTSEEYAE

SEQ ID NO: 1729911 - protein, 32 aa, Staphylococcus epidermidis
NKNARQRRRRRIDNQSKEKDATSTQSQLETKP

SEQ ID NO: 1729912 - protein, 14 aa, Staphylococcus epidermidis
NKNGVQDDDEKGLA

SEQ ID NO: 1729913 - protein, 6 aa, Staphylococcus epidermidis
NKNNYL

SEQ ID NO: 1729914 - protein, 6 aa, Staphylococcus epidermidis
NKNRIS

SEQ ID NO: 1729915 - protein, 8 aa, Staphylococcus epidermidis
NKTGSRVK

SEQ ID NO: 1729916 - protein, 27 aa, Staphylococcus epidermidis
NKTIPDAHDTTKLRTNDSGGGNMSGNY

SEQ ID NO: 1729917 - protein, 9 aa, Staphylococcus epidermidis
NKVEKNLNK

SEQ ID NO: 1729918 - protein, 8 aa, Staphylococcus epidermidis
NLDGDEAM

SEQ ID NO: 1729919 - protein, 5 aa, Staphylococcus epidermidis
NLDTD

SEQ ID NO: 1729920 - protein, 19 aa, Staphylococcus epidermidis
NLHGDQKLQKAQQDATNEL

SEQ ID NO: 1729921 - protein, 4 aa, Staphylococcus epidermidis
NLNQ

SEQ ID NO: 1729922 - protein, 7 aa, Staphylococcus epidermidis
NLPDNAA

SEQ ID NO: 1729923 - protein, 18 aa, Staphylococcus epidermidis
NLPEKTISTVNEKGKSID

SEQ ID NO: 1729924 - protein, 7 aa, Staphylococcus epidermidis
NLQESNS

SEQ ID NO: 1729925 - protein, 8 aa, Staphylococcus epidermidis
NLRNGSTN

SEQ ID NO: 1729926 - protein, 20 aa, Staphylococcus epidermidis
NMSNKDDNATHLNDSHRNED

SEQ ID NO: 1729927 - protein, 20 aa, Staphylococcus epidermidis
NMSNKDDNATHLNDSQRNED

SEQ ID NO: 1729928 - protein, 11 aa, Staphylococcus epidermidis
NMSNKDDNTIH

SEQ ID NO: 1729929 - protein, 19 aa, Staphylococcus epidermidis
NNAHSTQEVNESKTNSIAT

SEQ ID NO: 1729930 - protein, 19 aa, Staphylococcus epidermidis
NNGDATAKQISDEKSKVEQ

SEQ ID NO: 1729931 - protein, 7 aa, Staphylococcus epidermidis
NNQKRLT

SEQ ID NO: 1729932 - protein, 12 aa, Staphylococcus epidermidis
NNRQSNTTGADG

SEQ ID NO: 1729933 - protein, 5 aa, Staphylococcus epidermidis
NNRTV

SEQ ID NO: 1729934 - protein, 4 aa, Staphylococcus epidermidis
NPDA

SEQ ID NO: 1729935 - protein, 23 aa, Staphylococcus epidermidis
NPDLKPGEERVKQKGEPGTKTIT

SEQ ID NO: 1729936 - protein, 66 aa, Staphylococcus epidermidis
NQAQSTQQVSEAKNNGINTINQDQPNAVKKNNTKTILEQKGNEKKSAIAQTPDATTEEKQEAVSAV

SEQ ID NO: 1729937 - protein, 12 aa, Staphylococcus epidermidis
NQDRRDNEVEQH

SEQ ID NO: 1729938 - protein, 9 aa, Staphylococcus epidermidis
NQEDKTLTI

SEQ ID NO: 1729939 - protein, 11 aa, Staphylococcus epidermidis
NQEPEMPRESK

SEQ ID NO: 1729940 - protein, 10 aa, Staphylococcus epidermidis
NQEPEMPRQS

SEQ ID NO: 1729941 - protein, 11 aa, Staphylococcus epidermidis
NQEPEMPRQSK

SEQ ID NO: 1729942 - protein, 6 aa, Staphylococcus epidermidis
NQIKYE

SEQ ID NO: 1729943 - protein, 11 aa, Staphylococcus epidermidis
NQIRNEESKLD

SEQ ID NO: 1729944 - protein, 8 aa, Staphylococcus epidermidis
NQKPSYKT

SEQ ID NO: 1729945 - protein, 6 aa, Staphylococcus epidermidis
NQTDIK

SEQ ID NO: 1729946 - protein, 10 aa, Staphylococcus epidermidis
NRGKFSDEGA

SEQ ID NO: 1729947 - protein, 18 aa, Staphylococcus epidermidis
NRLENAVNDTDPTHGMTQ

SEQ ID NO: 1729948 - protein, 14 aa, Staphylococcus epidermidis
NRSDDFKNTVSQSL

SEQ ID NO: 1729949 - protein, 8 aa, Staphylococcus epidermidis
NSDVGTHT

SEQ ID NO: 1729950 - protein, 4 aa, Staphylococcus epidermidis
NSKK

SEQ ID NO: 1729951 - protein, 7 aa, Staphylococcus epidermidis
NSKQVDA

SEQ ID NO: 1729952 - protein, 8 aa, Staphylococcus epidermidis
NSKTNKKI

SEQ ID NO: 1729953 - protein, 15 aa, Staphylococcus epidermidis
NSQTLSSLGYSNNKP

SEQ ID NO: 1729954 - protein, 22 aa, Staphylococcus epidermidis
NTAQINAEKDLVNQAKTRTDVA

SEQ ID NO: 1729955 - protein, 32 aa, Staphylococcus epidermidis
NTEESESAQTASYTNINENNDTSDDGLHVNQP

SEQ ID NO: 1729956 - protein, 9 aa, Staphylococcus epidermidis
NTIQKTGYG

SEQ ID NO: 1729957 - protein, 5 aa, Staphylococcus epidermidis
NTKET

SEQ ID NO: 1729958 - protein, 6 aa, Staphylococcus epidermidis
NTRTAK

SEQ ID NO: 1729959 - protein, 7 aa, Staphylococcus epidermidis
NTRTSKG

SEQ ID NO: 1729960 - protein, 8 aa, Staphylococcus epidermidis
NTSTIKTD

SEQ ID NO: 1729961 - protein, 6 aa, Staphylococcus epidermidis
NTTPGI

SEQ ID NO: 1729962 - protein, 15 aa, Staphylococcus epidermidis
NVDTVSKAQLTDNNN

SEQ ID NO: 1729963 - protein, 17 aa, Staphylococcus epidermidis
NVNVKGNNNVSTSKIKK

SEQ ID NO: 1729964 - protein, 9 aa, Staphylococcus epidermidis
NVSDGGVTG

SEQ ID NO: 1729965 - protein, 40 aa, Staphylococcus epidermidis
NYFNEDSTQKNTYDNAIDNGSTYITGQHNSELNKSTIDQT

SEQ ID NO: 1729966 - protein, 13 aa, Staphylococcus epidermidis
NYGQPPGTTTAGA

SEQ ID NO: 1729967 - protein, 5 aa, Staphylococcus epidermidis
NYTNA

SEQ ID NO: 1729968 - protein, 12 aa, Staphylococcus epidermidis
PAATKKQPIPKR

SEQ ID NO: 1729969 - protein, 4 aa, Staphylococcus epidermidis
PADI

SEQ ID NO: 1729970 - protein, 26 aa, Staphylococcus epidermidis
PADSSSNNTKNTIDIPPTTVKGRDNY

SEQ ID NO: 1729971 - protein, 6 aa, Staphylococcus epidermidis
PANRLT

SEQ ID NO: 1729972 - protein, 9 aa, Staphylococcus epidermidis
PAPGVNPEA

SEQ ID NO: 1729973 - protein, 37 aa, Staphylococcus epidermidis
PAQSGAPEQPNRSMHSTDNKNQLPDTGENRQANEGTL

SEQ ID NO: 1729974 - protein, 7 aa, Staphylococcus epidermidis
PEDKESI

SEQ ID NO: 1729975 - protein, 17 aa, Staphylococcus epidermidis
PEEKASKVAEIQSEGKK

SEQ ID NO: 1729976 - protein, 4 aa, Staphylococcus epidermidis
PESA

SEQ ID NO: 1729977 - protein, 4 aa, Staphylococcus epidermidis
PGAV

SEQ ID NO: 1729978 - protein, 9 aa, Staphylococcus epidermidis
PGKSTKNTL

SEQ ID NO: 1729979 - protein, 12 aa, Staphylococcus epidermidis
PHIGQPSTSHHD

SEQ ID NO: 1729980 - protein, 7 aa, Staphylococcus epidermidis
PKERATA

SEQ ID NO: 1729981 - protein, 5 aa, Staphylococcus epidermidis
PKQPP

SEQ ID NO: 1729982 - protein, 4 aa, Staphylococcus epidermidis
PKTF

SEQ ID NO: 1729983 - protein, 7 aa, Staphylococcus epidermidis
PNGEATQ

SEQ ID NO: 1729984 - protein, 7 aa, Staphylococcus epidermidis
PNKPVID

SEQ ID NO: 1729985 - protein, 8 aa, Staphylococcus epidermidis
PNSNATEM

SEQ ID NO: 1729986 - protein, 7 aa, Staphylococcus epidermidis
PNTDKVA

SEQ ID NO: 1729987 - protein, 25 aa, Staphylococcus epidermidis
PPVAPKANSITTEDTSIKGTAEVDT

SEQ ID NO: 1729988 - protein, 7 aa, Staphylococcus epidermidis
PQSNATK

SEQ ID NO: 1729989 - protein, 12 aa, Staphylococcus epidermidis
PSETTLKGGQPL

SEQ ID NO: 1729990 - protein, 14 aa, Staphylococcus epidermidis
PSKQIKDEKIKKEI

SEQ ID NO: 1729991 - protein, 7 aa, Staphylococcus epidermidis
PTLQRTT

SEQ ID NO: 1729992 - protein, 6 aa, Staphylococcus epidermidis
PTTALD

SEQ ID NO: 1729993 - protein, 4 aa, Staphylococcus epidermidis
QAAT

SEQ ID NO: 1729994 - protein, 6 aa, Staphylococcus epidermidis
QAEMQG

SEQ ID NO: 1729995 - protein, 11 aa, Staphylococcus epidermidis
QDQQAAETGIR

SEQ ID NO: 1729996 - protein, 22 aa, Staphylococcus epidermidis
QDRQDSNEILKTPDAADITLPG

SEQ ID NO: 1729997 - protein, 5 aa, Staphylococcus epidermidis
QEEDV

SEQ ID NO: 1729998 - protein, 38 aa, Staphylococcus epidermidis
QEEIHQQRDDKSYKQKTLNQNNQMNKSKDDDNKIGEES

SEQ ID NO: 1729999 - protein, 11 aa, Staphylococcus epidermidis
QGLKNNHTDVE

SEQ ID NO: 1730000 - protein, 8 aa, Staphylococcus epidermidis
QGTPQTLK

SEQ ID NO: 1730001 - protein, 5 aa, Staphylococcus epidermidis
QIHDG

SEQ ID NO: 1730002 - protein, 6 aa, Staphylococcus epidermidis
QINNSD

SEQ ID NO: 1730003 - protein, 27 aa, Staphylococcus epidermidis
QINTAKNDLHGAEKLQRDKGTANQEIG

SEQ ID NO: 1730004 - protein, 7 aa, Staphylococcus epidermidis
QIPRTRR

SEQ ID NO: 1730005 - protein, 4 aa, Staphylococcus epidermidis
QKAN

SEQ ID NO: 1730006 - protein, 5 aa, Staphylococcus epidermidis
QKFTT

SEQ ID NO: 1730007 - protein, 7 aa, Staphylococcus epidermidis
QKNGEEI

SEQ ID NO: 1730008 - protein, 7 aa, Staphylococcus epidermidis
QKPSGVV

SEQ ID NO: 1730009 - protein, 11 aa, Staphylococcus epidermidis
QLNNNDNNVKQ

SEQ ID NO: 1730010 - protein, 10 aa, Staphylococcus epidermidis
QLRSKDGSIV

SEQ ID NO: 1730011 - protein, 5 aa, Staphylococcus epidermidis
QNGTY

SEQ ID NO: 1730012 - protein, 38 aa, Staphylococcus epidermidis
QNIDTSGKTPASIRKYNEAKSRIQTQIDSAKNEANSIL

SEQ ID NO: 1730013 - protein, 4 aa, Staphylococcus epidermidis
QNIT

SEQ ID NO: 1730014 - protein, 9 aa, Staphylococcus epidermidis
QNNQNPKYA

SEQ ID NO: 1730015 - protein, 13 aa, Staphylococcus epidermidis
QNPNLSHDEKNKL

SEQ ID NO: 1730016 - protein, 7 aa, Staphylococcus epidermidis
QNPTDTR

SEQ ID NO: 1730017 - protein, 7 aa, Staphylococcus epidermidis
QNSQTAS

SEQ ID NO: 1730018 - protein, 54 aa, Staphylococcus epidermidis
QNVKDTELEQITARSKNFSSYAKDHSSMQTSDSDKTLEGDIDKGVQVSDKNLQD

SEQ ID NO: 1730019 - protein, 4 aa, Staphylococcus epidermidis
QPEH

SEQ ID NO: 1730020 - protein, 5 aa, Staphylococcus epidermidis
QQGNS

SEQ ID NO: 1730021 - protein, 30 aa, Staphylococcus epidermidis
QSIANKDQVKADSKYLNEDPQIKQNYDDAV

SEQ ID NO: 1730022 - protein, 30 aa, Staphylococcus epidermidis
QSITDEHEVKQTSNYINETVGNQTAYNNAV

SEQ ID NO: 1730023 - protein, 9 aa, Staphylococcus epidermidis
QSLDEYGDK

SEQ ID NO: 1730024 - protein, 10 aa, Staphylococcus epidermidis
QSRKYDRHSI

SEQ ID NO: 1730025 - protein, 15 aa, Staphylococcus epidermidis
QSYISREERQHHDST

SEQ ID NO: 1730026 - protein, 8 aa, Staphylococcus epidermidis
QTESIPNA

SEQ ID NO: 1730027 - protein, 11 aa, Staphylococcus epidermidis
QTETSNNNHSE

SEQ ID NO: 1730028 - protein, 42 aa, Staphylococcus epidermidis
QTNFTKKQQARDQVNQKFQEKEAELNSTPHATQDEKQDALTR

SEQ ID NO: 1730029 - protein, 21 aa, Staphylococcus epidermidis
QTSGIPGDITEENRYSKQYDS

SEQ ID NO: 1730030 - protein, 6 aa, Staphylococcus epidermidis
QTTVEE

SEQ ID NO: 1730031 - protein, 13 aa, Staphylococcus epidermidis
QTVNTTKDALHGT

SEQ ID NO: 1730032 - protein, 22 aa, Staphylococcus epidermidis
RALREEQKTSKKKSDSKNSQSF

SEQ ID NO: 1730033 - protein, 9 aa, Staphylococcus epidermidis
RDGKTQDIN

SEQ ID NO: 1730034 - protein, 20 aa, Staphylococcus epidermidis
RDGTTNTNDFYRGTKSTTVT

SEQ ID NO: 1730035 - protein, 8 aa, Staphylococcus epidermidis
RDKKGDSK

SEQ ID NO: 1730036 - protein, 7 aa, Staphylococcus epidermidis
RDNNKHL

SEQ ID NO: 1730037 - protein, 4 aa, Staphylococcus epidermidis
RDRQ

SEQ ID NO: 1730038 - protein, 14 aa, Staphylococcus epidermidis
RDTLESNSTSVPNS

SEQ ID NO: 1730039 - protein, 9 aa, Staphylococcus epidermidis
RDYESTNNK

SEQ ID NO: 1730040 - protein, 22 aa, Staphylococcus epidermidis
REHNPYSKKKGKNTQVVSKKNK

SEQ ID NO: 1730041 - protein, 10 aa, Staphylococcus epidermidis
REKGTPSAAG

SEQ ID NO: 1730042 - protein, 7 aa, Staphylococcus epidermidis
RGATSYH

SEQ ID NO: 1730043 - protein, 7 aa, Staphylococcus epidermidis
RGIQPPL

SEQ ID NO: 1730044 - protein, 9 aa, Staphylococcus epidermidis
RGKFSDEGA

SEQ ID NO: 1730045 - protein, 9 aa, Staphylococcus epidermidis
RHYNKPSDQ

SEQ ID NO: 1730046 - protein, 26 aa, Staphylococcus epidermidis
RIASDTDQIRDSKDQHVTDEKQDIQA

SEQ ID NO: 1730047 - protein, 6 aa, Staphylococcus epidermidis
RIENKP

SEQ ID NO: 1730048 - protein, 4 aa, Staphylococcus epidermidis
RIGE

SEQ ID NO: 1730049 - protein, 12 aa, Staphylococcus epidermidis
RINDKQYEDAKK

SEQ ID NO: 1730050 - protein, 7 aa, Staphylococcus epidermidis
RKETSSW

SEQ ID NO: 1730051 - protein, 4 aa, Staphylococcus epidermidis
RKKE

SEQ ID NO: 1730052 - protein, 8 aa, Staphylococcus epidermidis
RKNPELHK

SEQ ID NO: 1730053 - protein, 6 aa, Staphylococcus epidermidis
RNDNPR

SEQ ID NO: 1730054 - protein, 8 aa, Staphylococcus epidermidis
RNESDIPA

SEQ ID NO: 1730055 - protein, 7 aa, Staphylococcus epidermidis
RNGEETM

SEQ ID NO: 1730056 - protein, 7 aa, Staphylococcus epidermidis
RNTRTTK

SEQ ID NO: 1730057 - protein, 4 aa, Staphylococcus epidermidis
RPHH

SEQ ID NO: 1730058 - protein, 7 aa, Staphylococcus epidermidis
RQRKNTF

SEQ ID NO: 1730059 - protein, 7 aa, Staphylococcus epidermidis
RRAAYKE

SEQ ID NO: 1730060 - protein, 13 aa, Staphylococcus epidermidis
RRKKEEEKQSIKN

SEQ ID NO: 1730061 - protein, 4 aa, Staphylococcus epidermidis
RSEA

SEQ ID NO: 1730062 - protein, 7 aa, Staphylococcus epidermidis
RSKDFSG

SEQ ID NO: 1730063 - protein, 7 aa, Staphylococcus epidermidis
RSKEFSG

SEQ ID NO: 1730064 - protein, 11 aa, Staphylococcus epidermidis
RSLSDDKKALK

SEQ ID NO: 1730065 - protein, 4 aa, Staphylococcus epidermidis
RTDF

SEQ ID NO: 1730066 - protein, 7 aa, Staphylococcus epidermidis
RTLEDSS

SEQ ID NO: 1730067 - protein, 10 aa, Staphylococcus epidermidis
RTPDGQETTL

SEQ ID NO: 1730068 - protein, 10 aa, Staphylococcus epidermidis
SAEKGSEHPL

SEQ ID NO: 1730069 - protein, 5 aa, Staphylococcus epidermidis
SAQSQ

SEQ ID NO: 1730070 - protein, 5 aa, Staphylococcus epidermidis
SDERF

SEQ ID NO: 1730071 - protein, 5 aa, Staphylococcus epidermidis
SDFKN

SEQ ID NO: 1730072 - protein, 17 aa, Staphylococcus epidermidis
SDGSLQESINKPRFYND

SEQ ID NO: 1730073 - protein, 12 aa, Staphylococcus epidermidis
SDPDGNPISQDR

SEQ ID NO: 1730074 - protein, 6 aa, Staphylococcus epidermidis
SDSRTV

SEQ ID NO: 1730075 - protein, 6 aa, Staphylococcus epidermidis
SDTQEA

SEQ ID NO: 1730076 - protein, 7 aa, Staphylococcus epidermidis
SDVEENL

SEQ ID NO: 1730077 - protein, 14 aa, Staphylococcus epidermidis
SEKGIQTNEAETNL

SEQ ID NO: 1730078 - protein, 8 aa, Staphylococcus epidermidis
SEKHKGKA

SEQ ID NO: 1730079 - protein, 20 aa, Staphylococcus epidermidis
SENGEGFTPEEAQYAMNHLD

SEQ ID NO: 1730080 - protein, 9 aa, Staphylococcus epidermidis
SENSDQVNV

SEQ ID NO: 1730081 - protein, 10 aa, Staphylococcus epidermidis
SEQVGKSEGF

SEQ ID NO: 1730082 - protein, 6 aa, Staphylococcus epidermidis
SETSRK

SEQ ID NO: 1730083 - protein, 35 aa, Staphylococcus epidermidis
SFDQTTNTIIGTPSEVGTTTVTVNTTDATGNVTSK

SEQ ID NO: 1730084 - protein, 24 aa, Staphylococcus epidermidis
SGLTNEQKTKENQAVNDSQTRDQV

SEQ ID NO: 1730085 - protein, 38 aa, Staphylococcus epidermidis
SGLTNEQKTKENQAVNGAQTRDQVANKLRDAEALDQSM

SEQ ID NO: 1730086 - protein, 6 aa, Staphylococcus epidermidis
SGNIKD

SEQ ID NO: 1730087 - protein, 41 aa, Staphylococcus epidermidis
SGQAAQNDSDSDSDSLMPSDNTRSTNSSTHMAQKGQMPSVP

SEQ ID NO: 1730088 - protein, 5 aa, Staphylococcus epidermidis
SGSFE

SEQ ID NO: 1730089 - protein, 6 aa, Staphylococcus epidermidis
SGYGQG

SEQ ID NO: 1730090 - protein, 5 aa, Staphylococcus epidermidis
SHELR

SEQ ID NO: 1730091 - protein, 29 aa, Staphylococcus epidermidis
SIAKKDQVKADSKYLNEDPQIKQNYDDAV

SEQ ID NO: 1730092 - protein, 32 aa, Staphylococcus epidermidis
SIKDKNDTKNSSKYINEDHDQQQAYDNAVNNA

SEQ ID NO: 1730093 - protein, 12 aa, Staphylococcus epidermidis
SIPPSEKEETFK

SEQ ID NO: 1730094 - protein, 11 aa, Staphylococcus epidermidis
SISEPKDAIRD

SEQ ID NO: 1730095 - protein, 8 aa, Staphylococcus epidermidis
SISGYDNP

SEQ ID NO: 1730096 - protein, 8 aa, Staphylococcus epidermidis
SKALDQSM

SEQ ID NO: 1730097 - protein, 4 aa, Staphylococcus epidermidis
SKEG

SEQ ID NO: 1730098 - protein, 7 aa, Staphylococcus epidermidis
SKEIKEA

SEQ ID NO: 1730099 - protein, 12 aa, Staphylococcus epidermidis
SKLSKEKSHSWD

SEQ ID NO: 1730100 - protein, 8 aa, Staphylococcus epidermidis
SKPPTKNY

SEQ ID NO: 1730101 - protein, 4 aa, Staphylococcus epidermidis
SKSR

SEQ ID NO: 1730102 - protein, 10 aa, Staphylococcus epidermidis
SLKASGANKM

SEQ ID NO: 1730103 - protein, 24 aa, Staphylococcus epidermidis
SLNTAQINAEKDLVNQAKTRTDVA

SEQ ID NO: 1730104 - protein, 5 aa, Staphylococcus epidermidis
SNDIP

SEQ ID NO: 1730105 - protein, 13 aa, Staphylococcus epidermidis
SNEQIETTENKLG

SEQ ID NO: 1730106 - protein, 14 aa, Staphylococcus epidermidis
SNEQIETTENKLGL

SEQ ID NO: 1730107 - protein, 5 aa, Staphylococcus epidermidis
SNGHG

SEQ ID NO: 1730108 - protein, 7 aa, Staphylococcus epidermidis
SNGTEMT

SEQ ID NO: 1730109 - protein, 9 aa, Staphylococcus epidermidis
SNKLNNEMG

SEQ ID NO: 1730110 - protein, 18 aa, Staphylococcus epidermidis
SNYINEDVSEKEAYEQAI

SEQ ID NO: 1730111 - protein, 7 aa, Staphylococcus epidermidis
SPGVGKT

SEQ ID NO: 1730112 - protein, 7 aa, Staphylococcus epidermidis
SPGYGRT

SEQ ID NO: 1730113 - protein, 10 aa, Staphylococcus epidermidis
SPSNFTNLDT

SEQ ID NO: 1730114 - protein, 10 aa, Staphylococcus epidermidis
SPTGSSAAVK

SEQ ID NO: 1730115 - protein, 4 aa, Staphylococcus epidermidis
SQGF

SEQ ID NO: 1730116 - protein, 6 aa, Staphylococcus epidermidis
SQGTSQ

SEQ ID NO: 1730117 - protein, 8 aa, Staphylococcus epidermidis
SQSHRPQF

SEQ ID NO: 1730118 - protein, 6 aa, Staphylococcus epidermidis
SQSLAG

SEQ ID NO: 1730119 - protein, 114 aa, Staphylococcus epidermidis
SRHPQSVRNAESEITKAEKNDEEQNITSNNKENNAATHQNVDSTSHDETRSNENDVADSTLQSKQSHNDTQQSNLSTYHQRPQHREIPQNQHNHDQQQSQIGQQAKQVTNESKG

SEQ ID NO: 1730120 - protein, 53 aa, Staphylococcus epidermidis
SRKESRDKLKQEYNKYKEDPESYKSSAKDLATQIGNKANETIQEVKKNPKDYV

SEQ ID NO: 1730121 - protein, 53 aa, Staphylococcus epidermidis
SRKESRDKLKQEYNKYKENPESYKSSAKDLATQIGNKANETIQEVKKNPKDYV

SEQ ID NO: 1730122 - protein, 6 aa, Staphylococcus epidermidis
SSIGSA

SEQ ID NO: 1730123 - protein, 10 aa, Staphylococcus epidermidis
SSLSEEEVAS

SEQ ID NO: 1730124 - protein, 8 aa, Staphylococcus epidermidis
SSSLESSY

SEQ ID NO: 1730125 - protein, 9 aa, Staphylococcus epidermidis
SSSLESSYL

SEQ ID NO: 1730126 - protein, 170 aa, Staphylococcus epidermidis
STAQSPIVENNQQDNNTNKVVETTNQNKDEVNEKEQNQANTSVTNTQINKNEKDEDTNTPQKDKDEKDTKTPKKDREEKKPVIPKSGKDEKESKDRKTPKKDKKEKITKTPKKDREEKKPVIPKSGKDEKDTKITKKDKEDKITTTSKKDNNNDVQDKLPETGKTNDIQN

SEQ ID NO: 1730127 - protein, 29 aa, Staphylococcus epidermidis
STASKSLKGSYPNVDNEKDREYYEKNPEQ

SEQ ID NO: 1730128 - protein, 4 aa, Staphylococcus epidermidis
STGT

SEQ ID NO: 1730129 - protein, 8 aa, Staphylococcus epidermidis
STISVGAS

SEQ ID NO: 1730130 - protein, 7 aa, Staphylococcus epidermidis
SVAGQNA

SEQ ID NO: 1730131 - protein, 43 aa, Staphylococcus epidermidis
SVQNVDQVKQSNNYVNEDQPEQHNYDNAVNEAQATINNNAQPV

SEQ ID NO: 1730132 - protein, 6 aa, Staphylococcus epidermidis
SYASSS

SEQ ID NO: 1730133 - protein, 17 aa, Staphylococcus epidermidis
SYLREQAKRPDDVSGNY

SEQ ID NO: 1730134 - protein, 18 aa, Staphylococcus epidermidis
TALQQSLDNQPSTTGMTE

SEQ ID NO: 1730135 - protein, 16 aa, Staphylococcus epidermidis
TAQRAENNQKNNKKDN

SEQ ID NO: 1730136 - protein, 4 aa, Staphylococcus epidermidis
TASH

SEQ ID NO: 1730137 - protein, 51 aa, Staphylococcus epidermidis
TAYANENTANQNQETSPKTSQTAPISNKENTDSTAVTTDQNNNDEEEYDAS

SEQ ID NO: 1730138 - protein, 24 aa, Staphylococcus epidermidis
TDAQRNSEKGLVNSSQTRTEVASQ

SEQ ID NO: 1730139 - protein, 7 aa, Staphylococcus epidermidis
TDEDITS

SEQ ID NO: 1730140 - protein, 38 aa, Staphylococcus epidermidis
TDHSRINNTSRNSDEDVTSSNNESNNTKAHSYANSEYK

SEQ ID NO: 1730141 - protein, 36 aa, Staphylococcus epidermidis
TDHSRINNTSRNSNEDVTSSNNESNNTKAHSFANSE

SEQ ID NO: 1730142 - protein, 9 aa, Staphylococcus epidermidis
TDKYNKGAY

SEQ ID NO: 1730143 - protein, 7 aa, Staphylococcus epidermidis
TDRFDGK

SEQ ID NO: 1730144 - protein, 13 aa, Staphylococcus epidermidis
TDRKVHAKIKNIR

SEQ ID NO: 1730145 - protein, 16 aa, Staphylococcus epidermidis
TDRNGMATTEESTAAK

SEQ ID NO: 1730146 - protein, 7 aa, Staphylococcus epidermidis
TEGVQHQ

SEQ ID NO: 1730147 - protein, 31 aa, Staphylococcus epidermidis
TEPHSSGLGGGGATLTYNGKENETPKAYEYK

SEQ ID NO: 1730148 - protein, 5 aa, Staphylococcus epidermidis
TEYSK

SEQ ID NO: 1730149 - protein, 7 aa, Staphylococcus epidermidis
TFQQDNN

SEQ ID NO: 1730150 - protein, 4 aa, Staphylococcus epidermidis
TGDI

SEQ ID NO: 1730151 - protein, 20 aa, Staphylococcus epidermidis
TGEKVGEGKSTEKVTKQPVD

SEQ ID NO: 1730152 - protein, 8 aa, Staphylococcus epidermidis
TGKAAENG

SEQ ID NO: 1730153 - protein, 12 aa, Staphylococcus epidermidis
TGTYDNKNKQIT

SEQ ID NO: 1730154 - protein, 4 aa, Staphylococcus epidermidis
TISG

SEQ ID NO: 1730155 - protein, 7 aa, Staphylococcus epidermidis
TISVGAS

SEQ ID NO: 1730156 - protein, 21 aa, Staphylococcus epidermidis
TKNEKIEKNVELPKDANVSVK

SEQ ID NO: 1730157 - protein, 22 aa, Staphylococcus epidermidis
TKNEKIEKNVELPKDANVSVKK

SEQ ID NO: 1730158 - protein, 5 aa, Staphylococcus epidermidis
TKNKV

SEQ ID NO: 1730159 - protein, 6 aa, Staphylococcus epidermidis
TKSSLA

SEQ ID NO: 1730160 - protein, 19 aa, Staphylococcus epidermidis
TKYGPVDGDSITSTEEIPF

SEQ ID NO: 1730161 - protein, 12 aa, Staphylococcus epidermidis
TLNNNYADDETY

SEQ ID NO: 1730162 - protein, 21 aa, Staphylococcus epidermidis
TLSNYTEASEDKKEKVDQTVS

SEQ ID NO: 1730163 - protein, 13 aa, Staphylococcus epidermidis
TMDESGNATETTF

SEQ ID NO: 1730164 - protein, 10 aa, Staphylococcus epidermidis
TMDTAKPIED

SEQ ID NO: 1730165 - protein, 8 aa, Staphylococcus epidermidis
TNDDNINK

SEQ ID NO: 1730166 - protein, 10 aa, Staphylococcus epidermidis
TNDNPQVSQV

SEQ ID NO: 1730167 - protein, 5 aa, Staphylococcus epidermidis
TNLPK

SEQ ID NO: 1730168 - protein, 6 aa, Staphylococcus epidermidis
TNNEVD

SEQ ID NO: 1730169 - protein, 6 aa, Staphylococcus epidermidis
TNNQEL

SEQ ID NO: 1730170 - protein, 7 aa, Staphylococcus epidermidis
TNYGNID

SEQ ID NO: 1730171 - protein, 12 aa, Staphylococcus epidermidis
TPANDNKAAKEL

SEQ ID NO: 1730172 - protein, 40 aa, Staphylococcus epidermidis
TPEGYTPTKQNSGSDEGKDSNGTKTTVTVKDADNKTIDSG

SEQ ID NO: 1730173 - protein, 15 aa, Staphylococcus epidermidis
TPKRETAIKDNQNYP

SEQ ID NO: 1730174 - protein, 4 aa, Staphylococcus epidermidis
TPNY

SEQ ID NO: 1730175 - protein, 6 aa, Staphylococcus epidermidis
TQAPQQ

SEQ ID NO: 1730176 - protein, 5 aa, Staphylococcus epidermidis
TQQTN

SEQ ID NO: 1730177 - protein, 7 aa, Staphylococcus epidermidis
TQVSRAK

SEQ ID NO: 1730178 - protein, 8 aa, Staphylococcus epidermidis
TRLDSNRS

SEQ ID NO: 1730179 - protein, 5 aa, Staphylococcus epidermidis
TRNAL

SEQ ID NO: 1730180 - protein, 7 aa, Staphylococcus epidermidis
TSAQSQF

SEQ ID NO: 1730181 - protein, 8 aa, Staphylococcus epidermidis
TSASVYDG

SEQ ID NO: 1730182 - protein, 10 aa, Staphylococcus epidermidis
TSEPQLANAE

SEQ ID NO: 1730183 - protein, 6 aa, Staphylococcus epidermidis
TSNEQF

SEQ ID NO: 1730184 - protein, 8 aa, Staphylococcus epidermidis
TSRLSKKT

SEQ ID NO: 1730185 - protein, 8 aa, Staphylococcus epidermidis
TSYQTNEP

SEQ ID NO: 1730186 - protein, 8 aa, Staphylococcus epidermidis
TSYQTSEP

SEQ ID NO: 1730187 - protein, 9 aa, Staphylococcus epidermidis
TSYQTSEPV

SEQ ID NO: 1730188 - protein, 13 aa, Staphylococcus epidermidis
TTDENGNSETTTF

SEQ ID NO: 1730189 - protein, 11 aa, Staphylococcus epidermidis
TTNDGAIAEES

SEQ ID NO: 1730190 - protein, 8 aa, Staphylococcus epidermidis
TTNNPLTP

SEQ ID NO: 1730191 - protein, 11 aa, Staphylococcus epidermidis
TTTDNSKDVLT

SEQ ID NO: 1730192 - protein, 27 aa, Staphylococcus epidermidis
TTTPEQPTINKVTENSTEVNGRGEPGT

SEQ ID NO: 1730193 - protein, 16 aa, Staphylococcus epidermidis
TTTVNGETTVHSAEAA

SEQ ID NO: 1730194 - protein, 9 aa, Staphylococcus epidermidis
TVKDTAQQA

SEQ ID NO: 1730195 - protein, 7 aa, Staphylococcus epidermidis
TVKESPF

SEQ ID NO: 1730196 - protein, 18 aa, Staphylococcus epidermidis
TVNLTTESATVEYNPDMT

SEQ ID NO: 1730197 - protein, 9 aa, Staphylococcus epidermidis
TYEPERKSI

SEQ ID NO: 1730198 - protein, 6 aa, Staphylococcus epidermidis
VADENI

SEQ ID NO: 1730199 - protein, 15 aa, Staphylococcus epidermidis
VAEQTNPNMSPTNIN

SEQ ID NO: 1730200 - protein, 13 aa, Staphylococcus epidermidis
VDKLNKSNSSVAS

SEQ ID NO: 1730201 - protein, 9 aa, Staphylococcus epidermidis
VGGPASYST

SEQ ID NO: 1730202 - protein, 9 aa, Staphylococcus epidermidis
VGNSDASEW

SEQ ID NO: 1730203 - protein, 7 aa, Staphylococcus epidermidis
VGSKKVR

SEQ ID NO: 1730204 - protein, 4 aa, Staphylococcus epidermidis
VKEG

SEQ ID NO: 1730205 - protein, 17 aa, Staphylococcus epidermidis
VKNREQKEGLGTVGRAY

SEQ ID NO: 1730206 - protein, 9 aa, Staphylococcus epidermidis
VKQNNGGVT

SEQ ID NO: 1730207 - protein, 5 aa, Staphylococcus epidermidis
VKTPA

SEQ ID NO: 1730208 - protein, 5 aa, Staphylococcus epidermidis
VNFGA

SEQ ID NO: 1730209 - protein, 4 aa, Staphylococcus epidermidis
VNGG

SEQ ID NO: 1730210 - protein, 10 aa, Staphylococcus epidermidis
VNNTKSNNEA

SEQ ID NO: 1730211 - protein, 5 aa, Staphylococcus epidermidis
VPDSG

SEQ ID NO: 1730212 - protein, 4 aa, Staphylococcus epidermidis
VPGI

SEQ ID NO: 1730213 - protein, 39 aa, Staphylococcus epidermidis
VQKGEPGTKTITTPTTKNPLTGEKVGEGEPTEKVTKQPV

SEQ ID NO: 1730214 - protein, 5 aa, Staphylococcus epidermidis
VQPNV

SEQ ID NO: 1730215 - protein, 14 aa, Staphylococcus epidermidis
VQTATTDDITSNIA

SEQ ID NO: 1730216 - protein, 13 aa, Staphylococcus epidermidis
VQTATTDNITSNI

SEQ ID NO: 1730217 - protein, 14 aa, Staphylococcus epidermidis
VQTATTDNITSNIA

SEQ ID NO: 1730218 - protein, 8 aa, Staphylococcus epidermidis
VQVPNKNR

SEQ ID NO: 1730219 - protein, 9 aa, Staphylococcus epidermidis
VRPTGTGNV

SEQ ID NO: 1730220 - protein, 7 aa, Staphylococcus epidermidis
VSGNSHA

SEQ ID NO: 1730221 - protein, 7 aa, Staphylococcus epidermidis
VSKKRDV

SEQ ID NO: 1730222 - protein, 4 aa, Staphylococcus epidermidis
VSPA

SEQ ID NO: 1730223 - protein, 6 aa, Staphylococcus epidermidis
VSQNDF

SEQ ID NO: 1730224 - protein, 20 aa, Staphylococcus epidermidis
VTAATTRDEVRNIRQEATTL

SEQ ID NO: 1730225 - protein, 5 aa, Staphylococcus epidermidis
VTDTN

SEQ ID NO: 1730226 - protein, 4 aa, Staphylococcus epidermidis
VTTP

SEQ ID NO: 1730227 - protein, 14 aa, Staphylococcus epidermidis
VTTTDENGNATETT

SEQ ID NO: 1730228 - protein, 12 aa, Staphylococcus epidermidis
VTTTDESGNVTE

SEQ ID NO: 1730229 - protein, 15 aa, Staphylococcus epidermidis
VYEQRNVNDRETISE

SEQ ID NO: 1730230 - protein, 10 aa, Staphylococcus epidermidis
VYGSKTFGKG

SEQ ID NO: 1730231 - protein, 13 aa, Staphylococcus epidermidis
WTPSNDNKAAKEL

SEQ ID NO: 1730232 - protein, 9 aa, Staphylococcus epidermidis
YAPKNMTIK

SEQ ID NO: 1730233 - protein, 13 aa, Staphylococcus epidermidis
YDATTVKENSDLR

SEQ ID NO: 1730234 - protein, 18 aa, Staphylococcus epidermidis
YDKEGYRDEEFNKNDKGT

SEQ ID NO: 1730235 - protein, 4 aa, Staphylococcus epidermidis
YEKK

SEQ ID NO: 1730236 - protein, 13 aa, Staphylococcus epidermidis
YELDDSIKEGDTF

SEQ ID NO: 1730237 - protein, 18 aa, Staphylococcus epidermidis
YGENYQTLKKASQQLQPV

SEQ ID NO: 1730238 - protein, 19 aa, Staphylococcus epidermidis
YINAEPSKKQAYDAAVQNA

SEQ ID NO: 1730239 - protein, 14 aa, Staphylococcus epidermidis
YKKESRKAKIKNEE

SEQ ID NO: 1730240 - protein, 8 aa, Staphylococcus epidermidis
YKNTDKVL

SEQ ID NO: 1730241 - protein, 19 aa, Staphylococcus epidermidis
YPDGTSKSVRTDEDGKYQF

SEQ ID NO: 1730242 - protein, 5 aa, Staphylococcus epidermidis
YRPDQ

SEQ ID NO: 1730243 - protein, 8 aa, Staphylococcus epidermidis
YSDGFGSK

SEQ ID NO: 1730244 - protein, 4 aa, Staphylococcus epidermidis
YTNA

SEQ ID NO: 1730245 - protein, 5 aa, Staphylococcus epidermidis
YWGGT

SEQ ID NO: 1730246 - protein, 6 aa, Staphylococcus epidermidis
YWGGTK

SEQ ID NO: 1730247 - protein, 21 aa, Staphylococcus epidermidis
YYNNDPLDKIQKQAGQGYRGY

SEQ ID NO: 1730248 - protein, 10 aa, Staphylococcus epidermidis
AAAATTAWTT

SEQ ID NO: 1730249 - protein, 8 aa, Staphylococcus epidermidis
AAAGGYGS

SEQ ID NO: 1730250 - protein, 14 aa, Staphylococcus epidermidis
AADGSLYGSEAGAG

SEQ ID NO: 1730251 - protein, 15 aa, Staphylococcus epidermidis
AADGSLYGSTAGAGF

SEQ ID NO: 1730252 - protein, 9 aa, Staphylococcus epidermidis
AAEDMQDDG

SEQ ID NO: 1730253 - protein, 4 aa, Staphylococcus epidermidis
AAEG

SEQ ID NO: 1730254 - protein, 8 aa, Staphylococcus epidermidis
AAEKGSNV

SEQ ID NO: 1730255 - protein, 7 aa, Staphylococcus epidermidis
AAEKSGY

SEQ ID NO: 1730256 - protein, 10 aa, Staphylococcus epidermidis
AAESKRNIAA

SEQ ID NO: 1730257 - protein, 8 aa, Staphylococcus epidermidis
AAGASSVS

SEQ ID NO: 1730258 - protein, 8 aa, Staphylococcus epidermidis
AAIASKGS

SEQ ID NO: 1730259 - protein, 8 aa, Staphylococcus epidermidis
AAKISGKS

SEQ ID NO: 1730260 - protein, 7 aa, Staphylococcus epidermidis
AAKSHKN

SEQ ID NO: 1730261 - protein, 5 aa, Staphylococcus epidermidis
AAKVR

SEQ ID NO: 1730262 - protein, 12 aa, Staphylococcus epidermidis
AAKYGHNRYGRT

SEQ ID NO: 1730263 - protein, 9 aa, Staphylococcus epidermidis
AANKARDSI

SEQ ID NO: 1730264 - protein, 17 aa, Staphylococcus epidermidis
AAPPTADPKTTQAYTEA

SEQ ID NO: 1730265 - protein, 10 aa, Staphylococcus epidermidis
AAQKGDKITL

SEQ ID NO: 1730266 - protein, 23 aa, Staphylococcus epidermidis
AAQPESEVTASEIKGNSDASALS

SEQ ID NO: 1730267 - protein, 9 aa, Staphylococcus epidermidis
AAQTEIDDA

SEQ ID NO: 1730268 - protein, 39 aa, Staphylococcus epidermidis
AAQTKNDKINNDSQVAKNTKDLTTEQDIPKSSNKEVPNL

SEQ ID NO: 1730269 - protein, 7 aa, Staphylococcus epidermidis
AARGSKE

SEQ ID NO: 1730270 - protein, 172 aa, Staphylococcus epidermidis
AASETPITSEISSNSETVANQNSTTIKNSQKETVNSTSLESNHSNSTNKQMSSEVTNTAQSSEKAGISQQSSETSNQSSKLNTYASTDHVESTTINNDNTAQQDQNKSSNVTSKSTQSNTSSSEKNISSNLTQSIETKATDSLATSEARTSTNQISNLTSTSTSNQSSPTSF

SEQ ID NO: 1730271 - protein, 172 aa, Staphylococcus epidermidis
AASETPITSEISSNSETVANQNSTTIKNSQKETVNSTSLESNHSNSTNKQMSSEVTNTAQSSEKAGISQQSSETSNQSSKLNTYASTDHVESTTTNNDNTAQQDQNKSSNVTSKSTQSNTSSSEKNISSNLTQSIETKATDSLATSEARTSTNQISNLTSTSTSNQSSPTSF

SEQ ID NO: 1730272 - protein, 9 aa, Staphylococcus epidermidis
AASGEDLAS

SEQ ID NO: 1730273 - protein, 27 aa, Staphylococcus epidermidis
AASNVKTSKDALHGERELNDNKNSKTF

SEQ ID NO: 1730274 - protein, 7 aa, Staphylococcus epidermidis
AASREQI

SEQ ID NO: 1730275 - protein, 44 aa, Staphylococcus epidermidis
AAVEETKTNYDSTKENTKEPAKENESATRLENSALEKAKSYSDD

SEQ ID NO: 1730276 - protein, 37 aa, Staphylococcus epidermidis
ADDEATKEEEAEAQENESNAVGATAGSTDSDQSDEPY

SEQ ID NO: 1730277 - protein, 7 aa, Staphylococcus epidermidis
ADDQENV

SEQ ID NO: 1730278 - protein, 7 aa, Staphylococcus epidermidis
ADDVLSG

SEQ ID NO: 1730279 - protein, 7 aa, Staphylococcus epidermidis
ADEDHKL

SEQ ID NO: 1730280 - protein, 46 aa, Staphylococcus epidermidis
ADENTANQGTSPKTSQTAPTNNNENTDATAVTTDQNNNDEEEYDAS

SEQ ID NO: 1730281 - protein, 48 aa, Staphylococcus epidermidis
ADENTANQNQGTSPKISQTAPTNNTENTDATAITTDQNNNDEEEYDAS

SEQ ID NO: 1730282 - protein, 44 aa, Staphylococcus epidermidis
ADESGAPLGKDTANSENKSYKTQAEERARENKQNFQSHRKQSKW

SEQ ID NO: 1730283 - protein, 9 aa, Staphylococcus epidermidis
ADGGGATRI

SEQ ID NO: 1730284 - protein, 8 aa, Staphylococcus epidermidis
ADGHEVGD

SEQ ID NO: 1730285 - protein, 6 aa, Staphylococcus epidermidis
ADGMAS

SEQ ID NO: 1730286 - protein, 8 aa, Staphylococcus epidermidis
ADISGDYE

SEQ ID NO: 1730287 - protein, 12 aa, Staphylococcus epidermidis
ADKDDENKKANV

SEQ ID NO: 1730288 - protein, 18 aa, Staphylococcus epidermidis
ADKKDNANNDTNEEPDRV

SEQ ID NO: 1730289 - protein, 11 aa, Staphylococcus epidermidis
ADKQNAHQSIP

SEQ ID NO: 1730290 - protein, 10 aa, Staphylococcus epidermidis
ADLQTSDNQV

SEQ ID NO: 1730291 - protein, 5 aa, Staphylococcus epidermidis
ADMKG

SEQ ID NO: 1730292 - protein, 35 aa, Staphylococcus epidermidis
ADNEAKAAEDNQLESASKEEQKGSRDNESSKLNQV

SEQ ID NO: 1730293 - protein, 5 aa, Staphylococcus epidermidis
ADNLT

SEQ ID NO: 1730294 - protein, 14 aa, Staphylococcus epidermidis
ADQNVADAKNNSLT

SEQ ID NO: 1730295 - protein, 5 aa, Staphylococcus epidermidis
ADSLS

SEQ ID NO: 1730296 - protein, 8 aa, Staphylococcus epidermidis
ADSPRGSL

SEQ ID NO: 1730297 - protein, 34 aa, Staphylococcus epidermidis
ADVSDSKETNDQIQTQSNLNQTNDLTKESTPITK

SEQ ID NO: 1730298 - protein, 8 aa, Staphylococcus epidermidis
AEDASMSE

SEQ ID NO: 1730299 - protein, 27 aa, Staphylococcus epidermidis
AEDNQLESASKEEQKGSRDNENSKLNQ

SEQ ID NO: 1730300 - protein, 9 aa, Staphylococcus epidermidis
AEDNVKTDL

SEQ ID NO: 1730301 - protein, 650 aa, Staphylococcus epidermidis
AEENPQGTTGTGFQRETVGTVETTGQPAAGNPGTATPAQGAQNDQNNQAGGAQTGTPNNAQDTGAPAQAKPEAGTTPAGNQAEQNAGTPQNNQADASVTPAQSAGQQGQGTPGADQNATTGQQTGTAAQGADTKPGENGAGTAVTPAPTTGNNNQQDQAGATGGTPAKPDTTAGQDTAKPGNTDASQTPGNNQQGQDTTQAGASKPDASTPNTNAEAKPTPGTQGQQTDQNNQAGAGTTVTPAPENNTQAGQGATGTPAQGTEAKPGNDQNAGTGQQTGTPAQGTETKPGNDQQGQGATGTGTPENTKPGENGAGTTVTPTPGENAGQTKPNGQENQEKPGAPETDQNAGTGQQTGTPDQNNAGDTTVKPPTAPDQGTEAKPDTQTKPDATTPDQNGTGAPGQDAGTKPGTTPDQTPGNTEQQGQGGTQTGTTTPQPGTTPDQNNQAGAGTTVTPAPENNTQPGQGTETKPGTDQQGQGAPDNTKPGENGTDNTVTPTPGENAGQTKPDGQEKPGTPGTDQNAGTGQQTGKPDENNAGDTTVKPPTNPDQGTEAKPDTQTKPGTTTPDQHDQLGAGVKPGTGTDQNTQVKPDDEHKPDTTKPGTGQQEGPTPDKNNGGDTTVKSPTKPDTQTKPSTTTTPDKNDTDDQDV

SEQ ID NO: 1730302 - protein, 4 aa, Staphylococcus epidermidis
AEKI

SEQ ID NO: 1730303 - protein, 4 aa, Staphylococcus epidermidis
AELR

SEQ ID NO: 1730304 - protein, 11 aa, Staphylococcus epidermidis
AENNPTISSTD

SEQ ID NO: 1730305 - protein, 11 aa, Staphylococcus epidermidis
AENNQKNYEKD

SEQ ID NO: 1730306 - protein, 18 aa, Staphylococcus epidermidis
AENVDRNYDDNNNIETSV

SEQ ID NO: 1730307 - protein, 18 aa, Staphylococcus epidermidis
AEQQISSQQHVEKAAPNM

SEQ ID NO: 1730308 - protein, 8 aa, Staphylococcus epidermidis
AEREATRS

SEQ ID NO: 1730309 - protein, 12 aa, Staphylococcus epidermidis
AESKKDNNGYKN

SEQ ID NO: 1730310 - protein, 13 aa, Staphylococcus epidermidis
AESNTSVSSYQTT

SEQ ID NO: 1730311 - protein, 6 aa, Staphylococcus epidermidis
AESPEK

SEQ ID NO: 1730312 - protein, 30 aa, Staphylococcus epidermidis
AESRASKNDKEKENLQEKDKPQQVQPPLDK

SEQ ID NO: 1730313 - protein, 9 aa, Staphylococcus epidermidis
AESSKPLKD

SEQ ID NO: 1730314 - protein, 16 aa, Staphylococcus epidermidis
AESSPDKRRNSLGSGL

SEQ ID NO: 1730315 - protein, 6 aa, Staphylococcus epidermidis
AETYRV

SEQ ID NO: 1730316 - protein, 10 aa, Staphylococcus epidermidis
AEVDDDISDL

SEQ ID NO: 1730317 - protein, 35 aa, Staphylococcus epidermidis
AFADSESTSSNVENTSNSNSIADKIQQAKNDIKDL

SEQ ID NO: 1730318 - protein, 7 aa, Staphylococcus epidermidis
AFGGPDS

SEQ ID NO: 1730319 - protein, 8 aa, Staphylococcus epidermidis
AFSSNYDR

SEQ ID NO: 1730320 - protein, 4 aa, Staphylococcus epidermidis
AGAD

SEQ ID NO: 1730321 - protein, 6 aa, Staphylococcus epidermidis
AGAPPL

SEQ ID NO: 1730322 - protein, 6 aa, Staphylococcus epidermidis
AGASRW

SEQ ID NO: 1730323 - protein, 10 aa, Staphylococcus epidermidis
AGAVGGGGIG

SEQ ID NO: 1730324 - protein, 7 aa, Staphylococcus epidermidis
AGDPYYS

SEQ ID NO: 1730325 - protein, 10 aa, Staphylococcus epidermidis
AGDRQGFAGG

SEQ ID NO: 1730326 - protein, 14 aa, Staphylococcus epidermidis
AGESNNPEKSMPKA

SEQ ID NO: 1730327 - protein, 14 aa, Staphylococcus epidermidis
AGESNNPQKSMPKA

SEQ ID NO: 1730328 - protein, 13 aa, Staphylococcus epidermidis
AGETKDPEQTIPK

SEQ ID NO: 1730329 - protein, 12 aa, Staphylococcus epidermidis
AGETKDPHTTIP

SEQ ID NO: 1730330 - protein, 14 aa, Staphylococcus epidermidis
AGETKNPEKTIPKA

SEQ ID NO: 1730331 - protein, 13 aa, Staphylococcus epidermidis
AGGEGAKNYGDPK

SEQ ID NO: 1730332 - protein, 4 aa, Staphylococcus epidermidis
AGGG

SEQ ID NO: 1730333 - protein, 6 aa, Staphylococcus epidermidis
AGGRAK

SEQ ID NO: 1730334 - protein, 8 aa, Staphylococcus epidermidis
AGHTTDNS

SEQ ID NO: 1730335 - protein, 12 aa, Staphylococcus epidermidis
AGIKGEKAGTAL

SEQ ID NO: 1730336 - protein, 9 aa, Staphylococcus epidermidis
AGITTPTQR

SEQ ID NO: 1730337 - protein, 43 aa, Staphylococcus epidermidis
AGKAGGKVAHATSSGVKGIQNTFSSNKRAENARSSAKSVADEI

SEQ ID NO: 1730338 - protein, 11 aa, Staphylococcus epidermidis
AGKLRKKETVS

SEQ ID NO: 1730339 - protein, 48 aa, Staphylococcus epidermidis
AGKLRNKTTMDSNDLTNNDNQRTQNKETIHTPPRTRINTNSQPKHLPH

SEQ ID NO: 1730340 - protein, 6 aa, Staphylococcus epidermidis
AGLGEA

SEQ ID NO: 1730341 - protein, 6 aa, Staphylococcus epidermidis
AGMSIE

SEQ ID NO: 1730342 - protein, 5 aa, Staphylococcus epidermidis
AGNLG

SEQ ID NO: 1730343 - protein, 24 aa, Staphylococcus epidermidis
AGPHSPTIPDASQSKTNAEDGSVT

SEQ ID NO: 1730344 - protein, 5 aa, Staphylococcus epidermidis
AGPST

SEQ ID NO: 1730345 - protein, 6 aa, Staphylococcus epidermidis
AGQDHI

SEQ ID NO: 1730346 - protein, 9 aa, Staphylococcus epidermidis
AGQKTSDTA

SEQ ID NO: 1730347 - protein, 7 aa, Staphylococcus epidermidis
AGQNAEE

SEQ ID NO: 1730348 - protein, 6 aa, Staphylococcus epidermidis
AGQRIT

SEQ ID NO: 1730349 - protein, 5 aa, Staphylococcus epidermidis
AGSGF

SEQ ID NO: 1730350 - protein, 37 aa, Staphylococcus epidermidis
AGSKSIKDLSKSTKDASKYQDDLSKKMGESASRNVAK

SEQ ID NO: 1730351 - protein, 5 aa, Staphylococcus epidermidis
AGSLG

SEQ ID NO: 1730352 - protein, 7 aa, Staphylococcus epidermidis
AGTDVAV

SEQ ID NO: 1730353 - protein, 11 aa, Staphylococcus epidermidis
AGTNEKTGALE

SEQ ID NO: 1730354 - protein, 5 aa, Staphylococcus epidermidis
AGYTA

SEQ ID NO: 1730355 - protein, 8 aa, Staphylococcus epidermidis
AHAEGSHP

SEQ ID NO: 1730356 - protein, 16 aa, Staphylococcus epidermidis
AHANPSSENETQTPSR

SEQ ID NO: 1730357 - protein, 5 aa, Staphylococcus epidermidis
AHATL

SEQ ID NO: 1730358 - protein, 6 aa, Staphylococcus epidermidis
AHEGTG

SEQ ID NO: 1730359 - protein, 12 aa, Staphylococcus epidermidis
AHETSGGSTITQ

SEQ ID NO: 1730360 - protein, 7 aa, Staphylococcus epidermidis
AHGGGGN

SEQ ID NO: 1730361 - protein, 6 aa, Staphylococcus epidermidis
AHQGTG

SEQ ID NO: 1730362 - protein, 30 aa, Staphylococcus epidermidis
AHRYNDDKRYDYRHSDNHTDFHNESEDYPR

SEQ ID NO: 1730363 - protein, 5 aa, Staphylococcus epidermidis
AHTPV

SEQ ID NO: 1730364 - protein, 34 aa, Staphylococcus epidermidis
AIAQNQQINSNNMATTEEKQDALNQVEAHKQATI

SEQ ID NO: 1730365 - protein, 22 aa, Staphylococcus epidermidis
AIDKVNHSKSIKDIETVKRTDF

SEQ ID NO: 1730366 - protein, 11 aa, Staphylococcus epidermidis
AIESSKGSSLP

SEQ ID NO: 1730367 - protein, 6 aa, Staphylococcus epidermidis
AIGPTL

SEQ ID NO: 1730368 - protein, 5 aa, Staphylococcus epidermidis
AIPDS

SEQ ID NO: 1730369 - protein, 5 aa, Staphylococcus epidermidis
AIPHS

SEQ ID NO: 1730370 - protein, 7 aa, Staphylococcus epidermidis
AIQDESS

SEQ ID NO: 1730371 - protein, 11 aa, Staphylococcus epidermidis
AIRAVPGSVRE

SEQ ID NO: 1730372 - protein, 8 aa, Staphylococcus epidermidis
AIRKEKSY

SEQ ID NO: 1730373 - protein, 17 aa, Staphylococcus epidermidis
AISGINNNDLNKTDEAL

SEQ ID NO: 1730374 - protein, 4 aa, Staphylococcus epidermidis
AISS

SEQ ID NO: 1730375 - protein, 4 aa, Staphylococcus epidermidis
AITK

SEQ ID NO: 1730376 - protein, 10 aa, Staphylococcus epidermidis
AITNKSVQKA

SEQ ID NO: 1730377 - protein, 25 aa, Staphylococcus epidermidis
AITPDTSIKRNAKNDIEGKAADRKI

SEQ ID NO: 1730378 - protein, 149 aa, Staphylococcus epidermidis
AIVNGKSESSEHKSKSTQNRPGPKAQQQKDKSESTQSKSSTNKDKKVATGAGIAGAAGVAETSKHHHNKKNKQDSKQSNHENDEKSVKNDDKKQSKKGKKAAVGAGAAAGVGAAGAAHHNKQNKHHNEEKNSSQNNQYNNHSDDKKKGG

SEQ ID NO: 1730379 - protein, 8 aa, Staphylococcus epidermidis
AKAPPLNK

SEQ ID NO: 1730380 - protein, 4 aa, Staphylococcus epidermidis
AKAQ

SEQ ID NO: 1730381 - protein, 8 aa, Staphylococcus epidermidis
AKASNQLN

SEQ ID NO: 1730382 - protein, 9 aa, Staphylococcus epidermidis
AKDPSNEDV

SEQ ID NO: 1730383 - protein, 7 aa, Staphylococcus epidermidis
AKDSTHF

SEQ ID NO: 1730384 - protein, 13 aa, Staphylococcus epidermidis
AKDYSKGKHVGSF

SEQ ID NO: 1730385 - protein, 12 aa, Staphylococcus epidermidis
AKEIVNEQQATL

SEQ ID NO: 1730386 - protein, 12 aa, Staphylococcus epidermidis
AKENKDYSADKL

SEQ ID NO: 1730387 - protein, 14 aa, Staphylococcus epidermidis
AKEQINSQELTSNS

SEQ ID NO: 1730388 - protein, 9 aa, Staphylococcus epidermidis
AKESYRFEN

SEQ ID NO: 1730389 - protein, 9 aa, Staphylococcus epidermidis
AKETGKNLD

SEQ ID NO: 1730390 - protein, 7 aa, Staphylococcus epidermidis
AKGAQKR

SEQ ID NO: 1730391 - protein, 6 aa, Staphylococcus epidermidis
AKGNSA

SEQ ID NO: 1730392 - protein, 6 aa, Staphylococcus epidermidis
AKGQEI

SEQ ID NO: 1730393 - protein, 7 aa, Staphylococcus epidermidis
AKGQQQN

SEQ ID NO: 1730394 - protein, 4 aa, Staphylococcus epidermidis
AKHV

SEQ ID NO: 1730395 - protein, 21 aa, Staphylococcus epidermidis
AKIGEAETDTTVNEARDNGTR

SEQ ID NO: 1730396 - protein, 5 aa, Staphylococcus epidermidis
AKKAR

SEQ ID NO: 1730397 - protein, 18 aa, Staphylococcus epidermidis
AKKDNKANVQKATEEGVK

SEQ ID NO: 1730398 - protein, 8 aa, Staphylococcus epidermidis
AKKDQLRV

SEQ ID NO: 1730399 - protein, 22 aa, Staphylococcus epidermidis
AKKEEIKNQISQDTKNNQVEQH

SEQ ID NO: 1730400 - protein, 10 aa, Staphylococcus epidermidis
AKKGNSDASI

SEQ ID NO: 1730401 - protein, 7 aa, Staphylococcus epidermidis
AKLDKRY

SEQ ID NO: 1730402 - protein, 154 aa, Staphylococcus epidermidis
AKLEATKDDFDQEQGPSASELTAQQNAIQEETELADQSPEAQNIQDAKAETQQQSGPTASELAAQQNAIQEETKLADQSPEAQDIQEAKAETQQQNGPSTSELTAQQNAIQEETELADQSPEAQNIQEAKNDAKAKDSQENSHIDSDKKPSAEE

SEQ ID NO: 1730403 - protein, 12 aa, Staphylococcus epidermidis
AKLSKNADVSQI

SEQ ID NO: 1730404 - protein, 11 aa, Staphylococcus epidermidis
AKNEVEETKDV

SEQ ID NO: 1730405 - protein, 4 aa, Staphylococcus epidermidis
AKNG

SEQ ID NO: 1730406 - protein, 11 aa, Staphylococcus epidermidis
AKNQGQKSTRY

SEQ ID NO: 1730407 - protein, 10 aa, Staphylococcus epidermidis
AKNSTLSKSD

SEQ ID NO: 1730408 - protein, 52 aa, Staphylococcus epidermidis
AKNVDNRQQDEGSVSKPSDSTTDEEDDSNNKVHDTSASTRNATTDDSEESVI

SEQ ID NO: 1730409 - protein, 52 aa, Staphylococcus epidermidis
AKNVDNRQQGEERASKPSDSTTDEKDDSNNKVHDTNASTRNATTDDSEESVI

SEQ ID NO: 1730410 - protein, 7 aa, Staphylococcus epidermidis
AKPENKK

SEQ ID NO: 1730411 - protein, 4 aa, Staphylococcus epidermidis
AKPQ

SEQ ID NO: 1730412 - protein, 25 aa, Staphylococcus epidermidis
AKQPEVQRTSNYNNEDQPEQSAYND

SEQ ID NO: 1730413 - protein, 10 aa, Staphylococcus epidermidis
AKQVKGEEQI

SEQ ID NO: 1730414 - protein, 19 aa, Staphylococcus epidermidis
AKRTKSSSLSSAAKDNLSD

SEQ ID NO: 1730415 - protein, 22 aa, Staphylococcus epidermidis
AKSETKSKKDVKNTSQPITPDA

SEQ ID NO: 1730416 - protein, 7 aa, Staphylococcus epidermidis
AKSSELI

SEQ ID NO: 1730417 - protein, 8 aa, Staphylococcus epidermidis
AKSSEMIE

SEQ ID NO: 1730418 - protein, 8 aa, Staphylococcus epidermidis
AKSSQKKQ

SEQ ID NO: 1730419 - protein, 10 aa, Staphylococcus epidermidis
AKSYANTLPI

SEQ ID NO: 1730420 - protein, 7 aa, Staphylococcus epidermidis
AKTEYAN

SEQ ID NO: 1730421 - protein, 7 aa, Staphylococcus epidermidis
AKTGSLL

SEQ ID NO: 1730422 - protein, 5 aa, Staphylococcus epidermidis
AKTGT

SEQ ID NO: 1730423 - protein, 10 aa, Staphylococcus epidermidis
AKTRTEVAQA

SEQ ID NO: 1730424 - protein, 7 aa, Staphylococcus epidermidis
AKVNYDE

SEQ ID NO: 1730425 - protein, 82 aa, Staphylococcus epidermidis
AKVVKNENSDYSDGKYGKSYNDIRKEQLEDDDKEDDDNHEKDEVNQDNTDREADNTSHTNEPGHQQSPNIDKPYNPNDPNHR

SEQ ID NO: 1730426 - protein, 6 aa, Staphylococcus epidermidis
ALAQGG

SEQ ID NO: 1730427 - protein, 10 aa, Staphylococcus epidermidis
ALATSPREVR

SEQ ID NO: 1730428 - protein, 9 aa, Staphylococcus epidermidis
ALDENQNVD

SEQ ID NO: 1730429 - protein, 27 aa, Staphylococcus epidermidis
ALEEQEATFGRKRQSGAPLTGKKEFDE

SEQ ID NO: 1730430 - protein, 4 aa, Staphylococcus epidermidis
ALGA

SEQ ID NO: 1730431 - protein, 5 aa, Staphylococcus epidermidis
ALGGK

SEQ ID NO: 1730432 - protein, 17 aa, Staphylococcus epidermidis
ALKKAQEQANFILHFIL

SEQ ID NO: 1730433 - protein, 15 aa, Staphylococcus epidermidis
ALKQQKKYAQNTGGV

SEQ ID NO: 1730434 - protein, 13 aa, Staphylococcus epidermidis
ALMGGGDSISTSP

SEQ ID NO: 1730435 - protein, 7 aa, Staphylococcus epidermidis
ALNDSMN

SEQ ID NO: 1730436 - protein, 8 aa, Staphylococcus epidermidis
ALNSSNAA

SEQ ID NO: 1730437 - protein, 15 aa, Staphylococcus epidermidis
ALPQTGEQSNSNNAT

SEQ ID NO: 1730438 - protein, 20 aa, Staphylococcus epidermidis
ALQDSSKKTIDKELDDVKAD

SEQ ID NO: 1730439 - protein, 6 aa, Staphylococcus epidermidis
ALQGDS

SEQ ID NO: 1730440 - protein, 22 aa, Staphylococcus epidermidis
ALREEQKTSKKKSDSKNSQSFG

SEQ ID NO: 1730441 - protein, 10 aa, Staphylococcus epidermidis
ALRNDESWAK

SEQ ID NO: 1730442 - protein, 19 aa, Staphylococcus epidermidis
ALSTAVSNVPAEKAGTASG

SEQ ID NO: 1730443 - protein, 8 aa, Staphylococcus epidermidis
ALTPNKDT

SEQ ID NO: 1730444 - protein, 4 aa, Staphylococcus epidermidis
ALTQ

SEQ ID NO: 1730445 - protein, 6 aa, Staphylococcus epidermidis
AMDASP

SEQ ID NO: 1730446 - protein, 8 aa, Staphylococcus epidermidis
AMGGGQYS

SEQ ID NO: 1730447 - protein, 4 aa, Staphylococcus epidermidis
ANAG

SEQ ID NO: 1730448 - protein, 7 aa, Staphylococcus epidermidis
ANASKEY

SEQ ID NO: 1730449 - protein, 8 aa, Staphylococcus epidermidis
ANATTTQL

SEQ ID NO: 1730450 - protein, 10 aa, Staphylococcus epidermidis
ANDKSVNQSG

SEQ ID NO: 1730451 - protein, 11 aa, Staphylococcus epidermidis
ANDLKSPLDRE

SEQ ID NO: 1730452 - protein, 7 aa, Staphylococcus epidermidis
ANDQGTP

SEQ ID NO: 1730453 - protein, 7 aa, Staphylococcus epidermidis
ANDSTQF

SEQ ID NO: 1730454 - protein, 32 aa, Staphylococcus epidermidis
ANEADPTQGMTTDTANSYKSKKLEAEDEIQKA

SEQ ID NO: 1730455 - protein, 20 aa, Staphylococcus epidermidis
ANEAIQNAQTNAEVDKAKEL

SEQ ID NO: 1730456 - protein, 7 aa, Staphylococcus epidermidis
ANEAQAN

SEQ ID NO: 1730457 - protein, 21 aa, Staphylococcus epidermidis
ANEDNQYKYDNDNIDDSNHED

SEQ ID NO: 1730458 - protein, 14 aa, Staphylococcus epidermidis
ANEDSLPNKHLDQT

SEQ ID NO: 1730459 - protein, 5 aa, Staphylococcus epidermidis
ANEER

SEQ ID NO: 1730460 - protein, 25 aa, Staphylococcus epidermidis
ANEGLDKYEQDELKTGEQQYLSKGA

SEQ ID NO: 1730461 - protein, 8 aa, Staphylococcus epidermidis
ANEQFNKT

SEQ ID NO: 1730462 - protein, 17 aa, Staphylococcus epidermidis
ANERTIDANTSAGNTKV

SEQ ID NO: 1730463 - protein, 13 aa, Staphylococcus epidermidis
ANEYSNHNKSISP

SEQ ID NO: 1730464 - protein, 7 aa, Staphylococcus epidermidis
ANGQAPK

SEQ ID NO: 1730465 - protein, 7 aa, Staphylococcus epidermidis
ANHDTRL

SEQ ID NO: 1730466 - protein, 24 aa, Staphylococcus epidermidis
ANHKQSGNQKKYGVASNNAIATKV

SEQ ID NO: 1730467 - protein, 49 aa, Staphylococcus epidermidis
ANHQTTDEVNHSDSDNMTNSTPNDTENELDTTQLTSHDESPSPQSDNFT

SEQ ID NO: 1730468 - protein, 9 aa, Staphylococcus epidermidis
ANIETDKAL

SEQ ID NO: 1730469 - protein, 22 aa, Staphylococcus epidermidis
ANIKNHKPMGMANNEGNAGNAL

SEQ ID NO: 1730470 - protein, 6 aa, Staphylococcus epidermidis
ANITGR

SEQ ID NO: 1730471 - protein, 8 aa, Staphylococcus epidermidis
ANKDGKEI

SEQ ID NO: 1730472 - protein, 31 aa, Staphylococcus epidermidis
ANKDQVKSDSKYLNEDPQIKQNYDDAVQRAE

SEQ ID NO: 1730473 - protein, 8 aa, Staphylococcus epidermidis
ANKEGTAW

SEQ ID NO: 1730474 - protein, 48 aa, Staphylococcus epidermidis
ANKESLKESRNRLESKINETVQTEGMTQQSVENYNQTKIKAQNESSIA

SEQ ID NO: 1730475 - protein, 4 aa, Staphylococcus epidermidis
ANLN

SEQ ID NO: 1730476 - protein, 11 aa, Staphylococcus epidermidis
ANNGDKDTFSP

SEQ ID NO: 1730477 - protein, 11 aa, Staphylococcus epidermidis
ANNGDKDTMSP

SEQ ID NO: 1730478 - protein, 6 aa, Staphylococcus epidermidis
ANNGYR

SEQ ID NO: 1730479 - protein, 15 aa, Staphylococcus epidermidis
ANNKTGTISGIPTKI

SEQ ID NO: 1730480 - protein, 38 aa, Staphylococcus epidermidis
ANNPDVNAIRTNKAEAERISNDLTQAKNNLQVDTQPLE

SEQ ID NO: 1730481 - protein, 32 aa, Staphylococcus epidermidis
ANNPDVSAIRTNKVEAEQINNELTQAKQGLTV

SEQ ID NO: 1730482 - protein, 8 aa, Staphylococcus epidermidis
ANPDPNQY

SEQ ID NO: 1730483 - protein, 9 aa, Staphylococcus epidermidis
ANPEDEGTF

SEQ ID NO: 1730484 - protein, 7 aa, Staphylococcus epidermidis
ANPPRAL

SEQ ID NO: 1730485 - protein, 12 aa, Staphylococcus epidermidis
ANPTRKSDALQE

SEQ ID NO: 1730486 - protein, 37 aa, Staphylococcus epidermidis
ANREQYEETDDKYSQFPKRAVESEYASSQNTEEEPEV

SEQ ID NO: 1730487 - protein, 6 aa, Staphylococcus epidermidis
ANRESK

SEQ ID NO: 1730488 - protein, 11 aa, Staphylococcus epidermidis
ANSSKVQTGDS

SEQ ID NO: 1730489 - protein, 9 aa, Staphylococcus epidermidis
ANSVKSEGF

SEQ ID NO: 1730490 - protein, 6 aa, Staphylococcus epidermidis
ANTDIK

SEQ ID NO: 1730491 - protein, 5 aa, Staphylococcus epidermidis
ANVDD

SEQ ID NO: 1730492 - protein, 11 aa, Staphylococcus epidermidis
ANYDRPSVAGT

SEQ ID NO: 1730493 - protein, 9 aa, Staphylococcus epidermidis
APEDTAQGA

SEQ ID NO: 1730494 - protein, 19 aa, Staphylococcus epidermidis
APEKPRRQAPQEVKKDKNI

SEQ ID NO: 1730495 - protein, 9 aa, Staphylococcus epidermidis
APGESGTFG

SEQ ID NO: 1730496 - protein, 5 aa, Staphylococcus epidermidis
APGGM

SEQ ID NO: 1730497 - protein, 4 aa, Staphylococcus epidermidis
APIT

SEQ ID NO: 1730498 - protein, 5 aa, Staphylococcus epidermidis
APKAF

SEQ ID NO: 1730499 - protein, 6 aa, Staphylococcus epidermidis
APLVRQ

SEQ ID NO: 1730500 - protein, 8 aa, Staphylococcus epidermidis
APNGETTQ

SEQ ID NO: 1730501 - protein, 7 aa, Staphylococcus epidermidis
APPIQTT

SEQ ID NO: 1730502 - protein, 15 aa, Staphylococcus epidermidis
APQAKAESNINGSNA

SEQ ID NO: 1730503 - protein, 5 aa, Staphylococcus epidermidis
APQNS

SEQ ID NO: 1730504 - protein, 8 aa, Staphylococcus epidermidis
APSEATVL

SEQ ID NO: 1730505 - protein, 12 aa, Staphylococcus epidermidis
APSETKKQPIPK

SEQ ID NO: 1730506 - protein, 4 aa, Staphylococcus epidermidis
APSG

SEQ ID NO: 1730507 - protein, 8 aa, Staphylococcus epidermidis
APSKPKDL

SEQ ID NO: 1730508 - protein, 9 aa, Staphylococcus epidermidis
APSKPKGLK

SEQ ID NO: 1730509 - protein, 8 aa, Staphylococcus epidermidis
APSNVSED

SEQ ID NO: 1730510 - protein, 15 aa, Staphylococcus epidermidis
APYGTTINATNDGNV

SEQ ID NO: 1730511 - protein, 6 aa, Staphylococcus epidermidis
AQADSF

SEQ ID NO: 1730512 - protein, 10 aa, Staphylococcus epidermidis
AQAHKRQDAI

SEQ ID NO: 1730513 - protein, 4 aa, Staphylococcus epidermidis
AQAQ

SEQ ID NO: 1730514 - protein, 7 aa, Staphylococcus epidermidis
AQAQHND

SEQ ID NO: 1730515 - protein, 19 aa, Staphylococcus epidermidis
AQATDVHQSPIQNVNEQGL

SEQ ID NO: 1730516 - protein, 13 aa, Staphylococcus epidermidis
AQDEAKKRKLNIW

SEQ ID NO: 1730517 - protein, 13 aa, Staphylococcus epidermidis
AQDKSEIYNILKG

SEQ ID NO: 1730518 - protein, 5 aa, Staphylococcus epidermidis
AQDTT

SEQ ID NO: 1730519 - protein, 13 aa, Staphylococcus epidermidis
AQEEAKKRKLNIW

SEQ ID NO: 1730520 - protein, 19 aa, Staphylococcus epidermidis
AQGEINEDEYEKLKKVLKK

SEQ ID NO: 1730521 - protein, 10 aa, Staphylococcus epidermidis
AQGERAPSQA

SEQ ID NO: 1730522 - protein, 10 aa, Staphylococcus epidermidis
AQKDAHGKHS

SEQ ID NO: 1730523 - protein, 9 aa, Staphylococcus epidermidis
AQKGTPSKG

SEQ ID NO: 1730524 - protein, 12 aa, Staphylococcus epidermidis
AQLDEGLNPRGA

SEQ ID NO: 1730525 - protein, 51 aa, Staphylococcus epidermidis
AQPIEKQAARDAINQKANEQTTSINANNNATDEEKAEANTRVNDAKQTALN

SEQ ID NO: 1730526 - protein, 5 aa, Staphylococcus epidermidis
AQPNQ

SEQ ID NO: 1730527 - protein, 8 aa, Staphylococcus epidermidis
AQPPSPEW

SEQ ID NO: 1730528 - protein, 5 aa, Staphylococcus epidermidis
AQQNV

SEQ ID NO: 1730529 - protein, 13 aa, Staphylococcus epidermidis
AQSEINSQKERAL

SEQ ID NO: 1730530 - protein, 9 aa, Staphylococcus epidermidis
AQSLPKPLI

SEQ ID NO: 1730531 - protein, 6 aa, Staphylococcus epidermidis
AQSTTT

SEQ ID NO: 1730532 - protein, 7 aa, Staphylococcus epidermidis
AQTEIDD

SEQ ID NO: 1730533 - protein, 14 aa, Staphylococcus epidermidis
AQTSSKANTDVRGL

SEQ ID NO: 1730534 - protein, 13 aa, Staphylococcus epidermidis
AQVSQKEYKGFGG

SEQ ID NO: 1730535 - protein, 20 aa, Staphylococcus epidermidis
ARDNSGQTVTNKVDGLPDGV

SEQ ID NO: 1730536 - protein, 16 aa, Staphylococcus epidermidis
ARESINISSSRDRAKF

SEQ ID NO: 1730537 - protein, 13 aa, Staphylococcus epidermidis
ARESKGNSDSSNV

SEQ ID NO: 1730538 - protein, 7 aa, Staphylococcus epidermidis
ARGIQPP

SEQ ID NO: 1730539 - protein, 6 aa, Staphylococcus epidermidis
ARGLGQ

SEQ ID NO: 1730540 - protein, 9 aa, Staphylococcus epidermidis
ARGYDTTQK

SEQ ID NO: 1730541 - protein, 7 aa, Staphylococcus epidermidis
ARLREKD

SEQ ID NO: 1730542 - protein, 5 aa, Staphylococcus epidermidis
ARMPI

SEQ ID NO: 1730543 - protein, 9 aa, Staphylococcus epidermidis
ARNYKGGTN

SEQ ID NO: 1730544 - protein, 7 aa, Staphylococcus epidermidis
ARQEAAN

SEQ ID NO: 1730545 - protein, 12 aa, Staphylococcus epidermidis
ARSQAKTGNSGI

SEQ ID NO: 1730546 - protein, 4 aa, Staphylococcus epidermidis
ASAK

SEQ ID NO: 1730547 - protein, 24 aa, Staphylococcus epidermidis
ASALGDSGSPASDSTLGPTAGLNM

SEQ ID NO: 1730548 - protein, 25 aa, Staphylococcus epidermidis
ASALGDSGSPASDSTLGPTAGLNMD

SEQ ID NO: 1730549 - protein, 4 aa, Staphylococcus epidermidis
ASAT

SEQ ID NO: 1730550 - protein, 9 aa, Staphylococcus epidermidis
ASDALTNPQ

SEQ ID NO: 1730551 - protein, 34 aa, Staphylococcus epidermidis
ASDEDYKKLTKSIDGSKGASKRMAKEMEGGIGGA

SEQ ID NO: 1730552 - protein, 7 aa, Staphylococcus epidermidis
ASDKARR

SEQ ID NO: 1730553 - protein, 4 aa, Staphylococcus epidermidis
ASDN

SEQ ID NO: 1730554 - protein, 7 aa, Staphylococcus epidermidis
ASEGHSE

SEQ ID NO: 1730555 - protein, 7 aa, Staphylococcus epidermidis
ASEIQNS

SEQ ID NO: 1730556 - protein, 14 aa, Staphylococcus epidermidis
ASEKPKGVRSDDSL

SEQ ID NO: 1730557 - protein, 26 aa, Staphylococcus epidermidis
ASEKPVRQATQEINQEKEDEKEEKVP

SEQ ID NO: 1730558 - protein, 16 aa, Staphylococcus epidermidis
ASERTIDANTTAGNTK

SEQ ID NO: 1730559 - protein, 5 aa, Staphylococcus epidermidis
ASETI

SEQ ID NO: 1730560 - protein, 5 aa, Staphylococcus epidermidis
ASGDG

SEQ ID NO: 1730561 - protein, 6 aa, Staphylococcus epidermidis
ASGDGV

SEQ ID NO: 1730562 - protein, 5 aa, Staphylococcus epidermidis
ASGGG

SEQ ID NO: 1730563 - protein, 8 aa, Staphylococcus epidermidis
ASGISPNE

SEQ ID NO: 1730564 - protein, 7 aa, Staphylococcus epidermidis
ASGMGRA

SEQ ID NO: 1730565 - protein, 8 aa, Staphylococcus epidermidis
ASHDEAAL

SEQ ID NO: 1730566 - protein, 7 aa, Staphylococcus epidermidis
ASHHHSG

SEQ ID NO: 1730567 - protein, 20 aa, Staphylococcus epidermidis
ASINNYEAKRNEAQSAIRNA

SEQ ID NO: 1730568 - protein, 6 aa, Staphylococcus epidermidis
ASITNA

SEQ ID NO: 1730569 - protein, 4 aa, Staphylococcus epidermidis
ASKD

SEQ ID NO: 1730570 - protein, 13 aa, Staphylococcus epidermidis
ASKIKASEGFMTF

SEQ ID NO: 1730571 - protein, 10 aa, Staphylococcus epidermidis
ASKVSARETF

SEQ ID NO: 1730572 - protein, 4 aa, Staphylococcus epidermidis
ASLA

SEQ ID NO: 1730573 - protein, 7 aa, Staphylococcus epidermidis
ASNEPPG

SEQ ID NO: 1730574 - protein, 5 aa, Staphylococcus epidermidis
ASNGG

SEQ ID NO: 1730575 - protein, 8 aa, Staphylococcus epidermidis
ASNQQQYN

SEQ ID NO: 1730576 - protein, 6 aa, Staphylococcus epidermidis
ASNSNL

SEQ ID NO: 1730577 - protein, 5 aa, Staphylococcus epidermidis
ASPEF

SEQ ID NO: 1730578 - protein, 4 aa, Staphylococcus epidermidis
ASPF

SEQ ID NO: 1730579 - protein, 11 aa, Staphylococcus epidermidis
ASRKRGKQGTG

SEQ ID NO: 1730580 - protein, 20 aa, Staphylococcus epidermidis
ASRYTQPGDTIAVTTAKDNR

SEQ ID NO: 1730581 - protein, 9 aa, Staphylococcus epidermidis
ASSDKNEQS

SEQ ID NO: 1730582 - protein, 4 aa, Staphylococcus epidermidis
ASSI

SEQ ID NO: 1730583 - protein, 6 aa, Staphylococcus epidermidis
ASSSEF

SEQ ID NO: 1730584 - protein, 14 aa, Staphylococcus epidermidis
ASTAEQSESKSISR

SEQ ID NO: 1730585 - protein, 18 aa, Staphylococcus epidermidis
ASTGRKDVDNQLKELGAT

SEQ ID NO: 1730586 - protein, 7 aa, Staphylococcus epidermidis
ASTRNHD

SEQ ID NO: 1730587 - protein, 17 aa, Staphylococcus epidermidis
ASVQEASVTVTPNENAT

SEQ ID NO: 1730588 - protein, 51 aa, Staphylococcus epidermidis
ATAAKDKNNLIDQTANATAEEMEEANNKVDRLQEEADANVTKANTTDEVNN

SEQ ID NO: 1730589 - protein, 21 aa, Staphylococcus epidermidis
ATAAKTKKSKLTKGSKEAQLT

SEQ ID NO: 1730590 - protein, 5 aa, Staphylococcus epidermidis
ATAEM

SEQ ID NO: 1730591 - protein, 9 aa, Staphylococcus epidermidis
ATARGIANG

SEQ ID NO: 1730592 - protein, 12 aa, Staphylococcus epidermidis
ATDNGSDSVEFT

SEQ ID NO: 1730593 - protein, 18 aa, Staphylococcus epidermidis
ATEDTKPKTYIKPNNSEY

SEQ ID NO: 1730594 - protein, 18 aa, Staphylococcus epidermidis
ATEDTKPKTYKKPNNSEY

SEQ ID NO: 1730595 - protein, 7 aa, Staphylococcus epidermidis
ATEEPEV

SEQ ID NO: 1730596 - protein, 6 aa, Staphylococcus epidermidis
ATEQGK

SEQ ID NO: 1730597 - protein, 10 aa, Staphylococcus epidermidis
ATESSQSEAI

SEQ ID NO: 1730598 - protein, 15 aa, Staphylococcus epidermidis
ATETKGNSDASAESR

SEQ ID NO: 1730599 - protein, 16 aa, Staphylococcus epidermidis
ATETKGNSDASAESRI

SEQ ID NO: 1730600 - protein, 18 aa, Staphylococcus epidermidis
ATETKGNSDASAESRITM

SEQ ID NO: 1730601 - protein, 31 aa, Staphylococcus epidermidis
ATETKGNSDASAESRITMPRKEATPIPPTLE

SEQ ID NO: 1730602 - protein, 29 aa, Staphylococcus epidermidis
ATETKGNSDASAESRVTMPRKEATPHSPI

SEQ ID NO: 1730603 - protein, 29 aa, Staphylococcus epidermidis
ATETKGNSDESAESRVTMPRKEATPHSPI

SEQ ID NO: 1730604 - protein, 37 aa, Staphylococcus epidermidis
ATETKGNSDESGESKTVMPRKEDIPEPPTVSANVEQA

SEQ ID NO: 1730605 - protein, 6 aa, Staphylococcus epidermidis
ATEVTG

SEQ ID NO: 1730606 - protein, 5 aa, Staphylococcus epidermidis
ATFPD

SEQ ID NO: 1730607 - protein, 14 aa, Staphylococcus epidermidis
ATFRGNDGQRTGDN

SEQ ID NO: 1730608 - protein, 7 aa, Staphylococcus epidermidis
ATGDNVK

SEQ ID NO: 1730609 - protein, 5 aa, Staphylococcus epidermidis
ATGIQ

SEQ ID NO: 1730610 - protein, 8 aa, Staphylococcus epidermidis
ATGKGIGP

SEQ ID NO: 1730611 - protein, 9 aa, Staphylococcus epidermidis
ATGKGIGPN

SEQ ID NO: 1730612 - protein, 6 aa, Staphylococcus epidermidis
ATGKTN

SEQ ID NO: 1730613 - protein, 15 aa, Staphylococcus epidermidis
ATGNASPFTDTAQGK

SEQ ID NO: 1730614 - protein, 8 aa, Staphylococcus epidermidis
ATGQGRGA

SEQ ID NO: 1730615 - protein, 6 aa, Staphylococcus epidermidis
ATHNAH

SEQ ID NO: 1730616 - protein, 4 aa, Staphylococcus epidermidis
ATIE

SEQ ID NO: 1730617 - protein, 10 aa, Staphylococcus epidermidis
ATKNMDGKKF

SEQ ID NO: 1730618 - protein, 7 aa, Staphylococcus epidermidis
ATKNNES

SEQ ID NO: 1730619 - protein, 9 aa, Staphylococcus epidermidis
ATLQNQGKT

SEQ ID NO: 1730620 - protein, 16 aa, Staphylococcus epidermidis
ATLTYTPKAVDGDPII

SEQ ID NO: 1730621 - protein, 23 aa, Staphylococcus epidermidis
ATLTYTPKAVDGDPITSTKEIPF

SEQ ID NO: 1730622 - protein, 9 aa, Staphylococcus epidermidis
ATNASKPVY

SEQ ID NO: 1730623 - protein, 9 aa, Staphylococcus epidermidis
ATNSNGGIK

SEQ ID NO: 1730624 - protein, 14 aa, Staphylococcus epidermidis
ATPDATNEEKQAAI

SEQ ID NO: 1730625 - protein, 17 aa, Staphylococcus epidermidis
ATPNKAARSKLPKEVRN

SEQ ID NO: 1730626 - protein, 19 aa, Staphylococcus epidermidis
ATPSTDTAISNSPEEKVGV

SEQ ID NO: 1730627 - protein, 20 aa, Staphylococcus epidermidis
ATPSTDTAVAQAPDDKVGVA

SEQ ID NO: 1730628 - protein, 8 aa, Staphylococcus epidermidis
ATQAYNEK

SEQ ID NO: 1730629 - protein, 27 aa, Staphylococcus epidermidis
ATQEYDDKVKKDKVISQSPKNKSIDEG

SEQ ID NO: 1730630 - protein, 5 aa, Staphylococcus epidermidis
ATQGR

SEQ ID NO: 1730631 - protein, 7 aa, Staphylococcus epidermidis
ATQNPEL

SEQ ID NO: 1730632 - protein, 7 aa, Staphylococcus epidermidis
ATQYERR

SEQ ID NO: 1730633 - protein, 9 aa, Staphylococcus epidermidis
ATRKKTPNE

SEQ ID NO: 1730634 - protein, 4 aa, Staphylococcus epidermidis
ATSD

SEQ ID NO: 1730635 - protein, 8 aa, Staphylococcus epidermidis
ATSENSTL

SEQ ID NO: 1730636 - protein, 5 aa, Staphylococcus epidermidis
ATSLS

SEQ ID NO: 1730637 - protein, 13 aa, Staphylococcus epidermidis
ATSNLDNESKSEI

SEQ ID NO: 1730638 - protein, 16 aa, Staphylococcus epidermidis
ATSNLDSESEHKIQES

SEQ ID NO: 1730639 - protein, 70 aa, Staphylococcus epidermidis
ATSNSNNETKETTENNVNDKDERNHKAAVEETKTNYDSTKENTKEPGKENESATRLENSALEKAKSYSDD

SEQ ID NO: 1730640 - protein, 11 aa, Staphylococcus epidermidis
ATSSLDPENET

SEQ ID NO: 1730641 - protein, 8 aa, Staphylococcus epidermidis
ATSTANKT

SEQ ID NO: 1730642 - protein, 7 aa, Staphylococcus epidermidis
ATTATGT

SEQ ID NO: 1730643 - protein, 10 aa, Staphylococcus epidermidis
ATTDPKKEKA

SEQ ID NO: 1730644 - protein, 11 aa, Staphylococcus epidermidis
ATTEEEDKTGL

SEQ ID NO: 1730645 - protein, 47 aa, Staphylococcus epidermidis
ATTNATDEEKEAAKVKVTEAGQLGDSKVDQAQTNQQVTNAKTETVDN

SEQ ID NO: 1730646 - protein, 10 aa, Staphylococcus epidermidis
ATTNGGLDIT

SEQ ID NO: 1730647 - protein, 10 aa, Staphylococcus epidermidis
ATTRSAGLQT

SEQ ID NO: 1730648 - protein, 65 aa, Staphylococcus epidermidis
ATTTRENPQVNKKVRDDSETPQSHQDDTKTSISAPHEKAKYEYKEESKTEKQDQNLPQAGKTTKS

SEQ ID NO: 1730649 - protein, 34 aa, Staphylococcus epidermidis
ATTVKDKAKADVNAEKEEKNLQINSNDEATTEEK

SEQ ID NO: 1730650 - protein, 14 aa, Staphylococcus epidermidis
AVDIGKANTKTNRF

SEQ ID NO: 1730651 - protein, 19 aa, Staphylococcus epidermidis
AVEDSKTTANNRNPGQIDG

SEQ ID NO: 1730652 - protein, 11 aa, Staphylococcus epidermidis
AVEKSAYDTIT

SEQ ID NO: 1730653 - protein, 8 aa, Staphylococcus epidermidis
AVKEEVRS

SEQ ID NO: 1730654 - protein, 32 aa, Staphylococcus epidermidis
AVKKESSDNNLADPTTKEGKNEDTASHTQAEK

SEQ ID NO: 1730655 - protein, 13 aa, Staphylococcus epidermidis
AVKRGRGHIGEKG

SEQ ID NO: 1730656 - protein, 13 aa, Staphylococcus epidermidis
AVKSDPSNTNYKN

SEQ ID NO: 1730657 - protein, 24 aa, Staphylococcus epidermidis
AVQPESEITASETKANSDESEVSK

SEQ ID NO: 1730658 - protein, 29 aa, Staphylococcus epidermidis
AVQVPNKNRVTIKQGNALPTNLAGGSTSH

SEQ ID NO: 1730659 - protein, 7 aa, Staphylococcus epidermidis
AVSNEQL

SEQ ID NO: 1730660 - protein, 25 aa, Staphylococcus epidermidis
AVTNGNNHINQANSNDDVDQALSNA

SEQ ID NO: 1730661 - protein, 18 aa, Staphylococcus epidermidis
AVYDKNKKTVDVGSDVGN

SEQ ID NO: 1730662 - protein, 9 aa, Staphylococcus epidermidis
AYDENGKTI

SEQ ID NO: 1730663 - protein, 13 aa, Staphylococcus epidermidis
AYDNTSISQKGGD

SEQ ID NO: 1730664 - protein, 10 aa, Staphylococcus epidermidis
AYEIDGTKIT

SEQ ID NO: 1730665 - protein, 5 aa, Staphylococcus epidermidis
AYEPE

SEQ ID NO: 1730666 - protein, 17 aa, Staphylococcus epidermidis
AYKEDASIAYQSKEEID

SEQ ID NO: 1730667 - protein, 17 aa, Staphylococcus epidermidis
AYKENETIAYQTKEEID

SEQ ID NO: 1730668 - protein, 9 aa, Staphylococcus epidermidis
AYPHPDKPV

SEQ ID NO: 1730669 - protein, 5 aa, Staphylococcus epidermidis
AYPNT

SEQ ID NO: 1730670 - protein, 5 aa, Staphylococcus epidermidis
AYRNG

SEQ ID NO: 1730671 - protein, 8 aa, Staphylococcus epidermidis
AYSPKEYK

SEQ ID NO: 1730672 - protein, 4 aa, Staphylococcus epidermidis
AYVP

SEQ ID NO: 1730673 - protein, 9 aa, Staphylococcus epidermidis
CEEQEPQFE

SEQ ID NO: 1730674 - protein, 14 aa, Staphylococcus epidermidis
CGKDKEFKIETCVS

SEQ ID NO: 1730675 - protein, 7 aa, Staphylococcus epidermidis
CGTPVNQ

SEQ ID NO: 1730676 - protein, 28 aa, Staphylococcus epidermidis
CKESDDQLSTSIDNEEKVNGMAKSIDEN

SEQ ID NO: 1730677 - protein, 6 aa, Staphylococcus epidermidis
CKPEDK

SEQ ID NO: 1730678 - protein, 6 aa, Staphylococcus epidermidis
CNEYNQ

SEQ ID NO: 1730679 - protein, 7 aa, Staphylococcus epidermidis
CSQLNSR

SEQ ID NO: 1730680 - protein, 6 aa, Staphylococcus epidermidis
CVSGGG

SEQ ID NO: 1730681 - protein, 17 aa, Staphylococcus epidermidis
DADNEQKLAQYERQGQT

SEQ ID NO: 1730682 - protein, 8 aa, Staphylococcus epidermidis
DAEGDFGR

SEQ ID NO: 1730683 - protein, 5 aa, Staphylococcus epidermidis
DAGIR

SEQ ID NO: 1730684 - protein, 37 aa, Staphylococcus epidermidis
DAKDKNNHLESTDSSATSSKTEDDDTSEKDNDDITKD

SEQ ID NO: 1730685 - protein, 15 aa, Staphylococcus epidermidis
DAKDSVKREKGQRGL

SEQ ID NO: 1730686 - protein, 30 aa, Staphylococcus epidermidis
DAKQRNNQLESSNPSATDDKNTDSETTKEL

SEQ ID NO: 1730687 - protein, 22 aa, Staphylococcus epidermidis
DAKSTINDDSKKDSDKQKAIRN

SEQ ID NO: 1730688 - protein, 25 aa, Staphylococcus epidermidis
DALKAPNYTETSGTPTLKLTNSSQT

SEQ ID NO: 1730689 - protein, 6 aa, Staphylococcus epidermidis
DALKET

SEQ ID NO: 1730690 - protein, 25 aa, Staphylococcus epidermidis
DALQNSNYSETSGTPTLKLTNSSQT

SEQ ID NO: 1730691 - protein, 15 aa, Staphylococcus epidermidis
DANDSVKREKGQRGL

SEQ ID NO: 1730692 - protein, 8 aa, Staphylococcus epidermidis
DANGKMRS

SEQ ID NO: 1730693 - protein, 20 aa, Staphylococcus epidermidis
DANISDDLADTYENKSYTKS

SEQ ID NO: 1730694 - protein, 7 aa, Staphylococcus epidermidis
DANQERK

SEQ ID NO: 1730695 - protein, 7 aa, Staphylococcus epidermidis
DANQTVQ

SEQ ID NO: 1730696 - protein, 8 aa, Staphylococcus epidermidis
DANSGDVT

SEQ ID NO: 1730697 - protein, 19 aa, Staphylococcus epidermidis
DANTGKDIIPPKTIAGEVD

SEQ ID NO: 1730698 - protein, 4 aa, Staphylococcus epidermidis
DANY

SEQ ID NO: 1730699 - protein, 19 aa, Staphylococcus epidermidis
DAPDTNQVNVEKNKGVNSI

SEQ ID NO: 1730700 - protein, 61 aa, Staphylococcus epidermidis
DAPNNTQSTDNNQAATNNNTTTATTDNDVSTQENNTQSTQTKEAQTTKALPETGEQSNSGL

SEQ ID NO: 1730701 - protein, 9 aa, Staphylococcus epidermidis
DAPNTYEGR

SEQ ID NO: 1730702 - protein, 8 aa, Staphylococcus epidermidis
DAQEGDVL

SEQ ID NO: 1730703 - protein, 12 aa, Staphylococcus epidermidis
DAQYQTYKDEFE

SEQ ID NO: 1730704 - protein, 23 aa, Staphylococcus epidermidis
DARDNGNNTITQIEPETAVKTNA

SEQ ID NO: 1730705 - protein, 6 aa, Staphylococcus epidermidis
DASQLK

SEQ ID NO: 1730706 - protein, 7 aa, Staphylococcus epidermidis
DATPTSE

SEQ ID NO: 1730707 - protein, 5 aa, Staphylococcus epidermidis
DAVSV

SEQ ID NO: 1730708 - protein, 8 aa, Staphylococcus epidermidis
DAYNQTSG

SEQ ID NO: 1730709 - protein, 21 aa, Staphylococcus epidermidis
DDASGNGDTVAPGLAPSSMNT

SEQ ID NO: 1730710 - protein, 19 aa, Staphylococcus epidermidis
DDATDTHSSKNKESRGQGI

SEQ ID NO: 1730711 - protein, 19 aa, Staphylococcus epidermidis
DDATDTYSSKNRESRGQGI

SEQ ID NO: 1730712 - protein, 10 aa, Staphylococcus epidermidis
DDDPDKRKLT

SEQ ID NO: 1730713 - protein, 6 aa, Staphylococcus epidermidis
DDEDYE

SEQ ID NO: 1730714 - protein, 12 aa, Staphylococcus epidermidis
DDEGNELPPNRM

SEQ ID NO: 1730715 - protein, 8 aa, Staphylococcus epidermidis
DDGDITDS

SEQ ID NO: 1730716 - protein, 38 aa, Staphylococcus epidermidis
DDGSVSAGKLKEQVSELGKTSQDMAKQYGVAGESIRNG

SEQ ID NO: 1730717 - protein, 6 aa, Staphylococcus epidermidis
DDGSYE

SEQ ID NO: 1730718 - protein, 16 aa, Staphylococcus epidermidis
DDKDEKQVKQNTIQTK

SEQ ID NO: 1730719 - protein, 16 aa, Staphylococcus epidermidis
DDKKGKQEKYINDTSM

SEQ ID NO: 1730720 - protein, 9 aa, Staphylococcus epidermidis
DDKQDQSLV

SEQ ID NO: 1730721 - protein, 46 aa, Staphylococcus epidermidis
DDNNQNHYNEDTTYEYNNDTPQNKDENYNIDQNADNEKPEDQETLK

SEQ ID NO: 1730722 - protein, 11 aa, Staphylococcus epidermidis
DDNTEKDTKTV

SEQ ID NO: 1730723 - protein, 4 aa, Staphylococcus epidermidis
DDRD

SEQ ID NO: 1730724 - protein, 7 aa, Staphylococcus epidermidis
DDRQSNI

SEQ ID NO: 1730725 - protein, 7 aa, Staphylococcus epidermidis
DDRYSKS

SEQ ID NO: 1730726 - protein, 8 aa, Staphylococcus epidermidis
DDSEIEKE

SEQ ID NO: 1730727 - protein, 15 aa, Staphylococcus epidermidis
DDSKVDKDALSENPL

SEQ ID NO: 1730728 - protein, 6 aa, Staphylococcus epidermidis
DDTNQM

SEQ ID NO: 1730729 - protein, 7 aa, Staphylococcus epidermidis
DDVSTSK

SEQ ID NO: 1730730 - protein, 9 aa, Staphylococcus epidermidis
DDYGQPYYD

SEQ ID NO: 1730731 - protein, 5 aa, Staphylococcus epidermidis
DDYGR

SEQ ID NO: 1730732 - protein, 9 aa, Staphylococcus epidermidis
DEADEAMEG

SEQ ID NO: 1730733 - protein, 8 aa, Staphylococcus epidermidis
DEAKRYQN

SEQ ID NO: 1730734 - protein, 5 aa, Staphylococcus epidermidis
DEDEI

SEQ ID NO: 1730735 - protein, 7 aa, Staphylococcus epidermidis
DEDMKTQ

SEQ ID NO: 1730736 - protein, 15 aa, Staphylococcus epidermidis
DEDPSDYKDEGLSNA

SEQ ID NO: 1730737 - protein, 9 aa, Staphylococcus epidermidis
DEDQKEIVE

SEQ ID NO: 1730738 - protein, 6 aa, Staphylococcus epidermidis
DEDQSE

SEQ ID NO: 1730739 - protein, 16 aa, Staphylococcus epidermidis
DEDSERKQQNSGQRTD

SEQ ID NO: 1730740 - protein, 5 aa, Staphylococcus epidermidis
DEEIT

SEQ ID NO: 1730741 - protein, 10 aa, Staphylococcus epidermidis
DEENDPDTKR

SEQ ID NO: 1730742 - protein, 8 aa, Staphylococcus epidermidis
DEIHNNTS

SEQ ID NO: 1730743 - protein, 9 aa, Staphylococcus epidermidis
DEIPSNQHQ

SEQ ID NO: 1730744 - protein, 4 aa, Staphylococcus epidermidis
DEIS

SEQ ID NO: 1730745 - protein, 15 aa, Staphylococcus epidermidis
DEKDISDVEKGNDVD

SEQ ID NO: 1730746 - protein, 6 aa, Staphylococcus epidermidis
DEKDTF

SEQ ID NO: 1730747 - protein, 11 aa, Staphylococcus epidermidis
DEKHDDRYTET

SEQ ID NO: 1730748 - protein, 7 aa, Staphylococcus epidermidis
DEKKDIT

SEQ ID NO: 1730749 - protein, 9 aa, Staphylococcus epidermidis
DEKPLQSEM

SEQ ID NO: 1730750 - protein, 5 aa, Staphylococcus epidermidis
DEKQL

SEQ ID NO: 1730751 - protein, 9 aa, Staphylococcus epidermidis
DEKTPSKMS

SEQ ID NO: 1730752 - protein, 9 aa, Staphylococcus epidermidis
DELDKTNPV

SEQ ID NO: 1730753 - protein, 4 aa, Staphylococcus epidermidis
DENE

SEQ ID NO: 1730754 - protein, 9 aa, Staphylococcus epidermidis
DENEYTSDL

SEQ ID NO: 1730755 - protein, 7 aa, Staphylococcus epidermidis
DENMAQY

SEQ ID NO: 1730756 - protein, 4 aa, Staphylococcus epidermidis
DENT

SEQ ID NO: 1730757 - protein, 6 aa, Staphylococcus epidermidis
DEPEAT

SEQ ID NO: 1730758 - protein, 8 aa, Staphylococcus epidermidis
DEPTTALD

SEQ ID NO: 1730759 - protein, 12 aa, Staphylococcus epidermidis
DEQARNNLSGPI

SEQ ID NO: 1730760 - protein, 15 aa, Staphylococcus epidermidis
DEQGKEVARTKNTID

SEQ ID NO: 1730761 - protein, 28 aa, Staphylococcus epidermidis
DEQSHQTTQSQQSNESGQNKDQSTGPSI

SEQ ID NO: 1730762 - protein, 28 aa, Staphylococcus epidermidis
DEQSHQTTQSQQSNESGQNRDQSTGPSI

SEQ ID NO: 1730763 - protein, 28 aa, Staphylococcus epidermidis
DEQSHQTTQSQQSNESNQNRNQSTGPSI

SEQ ID NO: 1730764 - protein, 8 aa, Staphylococcus epidermidis
DEQSSNSV

SEQ ID NO: 1730765 - protein, 5 aa, Staphylococcus epidermidis
DERDT

SEQ ID NO: 1730766 - protein, 21 aa, Staphylococcus epidermidis
DESAITGESAPVIKESGGDFD

SEQ ID NO: 1730767 - protein, 9 aa, Staphylococcus epidermidis
DESETKNQS

SEQ ID NO: 1730768 - protein, 13 aa, Staphylococcus epidermidis
DESKSGKGSSSSL

SEQ ID NO: 1730769 - protein, 6 aa, Staphylococcus epidermidis
DESVPN

SEQ ID NO: 1730770 - protein, 7 aa, Staphylococcus epidermidis
DETEDEI

SEQ ID NO: 1730771 - protein, 17 aa, Staphylococcus epidermidis
DETTNTISGTPSEVGSY

SEQ ID NO: 1730772 - protein, 5 aa, Staphylococcus epidermidis
DETTT

SEQ ID NO: 1730773 - protein, 6 aa, Staphylococcus epidermidis
DETTVH

SEQ ID NO: 1730774 - protein, 7 aa, Staphylococcus epidermidis
DEVRSQT

SEQ ID NO: 1730775 - protein, 15 aa, Staphylococcus epidermidis
DEYDKDFDSKKKYKE

SEQ ID NO: 1730776 - protein, 9 aa, Staphylococcus epidermidis
DEYETFKDK

SEQ ID NO: 1730777 - protein, 13 aa, Staphylococcus epidermidis
DFDKKGNATSDDI

SEQ ID NO: 1730778 - protein, 9 aa, Staphylococcus epidermidis
DFGTSTSEI

SEQ ID NO: 1730779 - protein, 21 aa, Staphylococcus epidermidis
DFKKVNPSKYEYKAGPKGNEK

SEQ ID NO: 1730780 - protein, 21 aa, Staphylococcus epidermidis
DFKKVNPSKYEYKSGPKGNEK

SEQ ID NO: 1730781 - protein, 12 aa, Staphylococcus epidermidis
DFPEISQSNDIP

SEQ ID NO: 1730782 - protein, 20 aa, Staphylococcus epidermidis
DFRNRKRKRFGDKVNEEELA

SEQ ID NO: 1730783 - protein, 5 aa, Staphylococcus epidermidis
DFSNN

SEQ ID NO: 1730784 - protein, 15 aa, Staphylococcus epidermidis
DGATQKIKDYKLKLI

SEQ ID NO: 1730785 - protein, 11 aa, Staphylococcus epidermidis
DGDSNEISEDS

SEQ ID NO: 1730786 - protein, 4 aa, Staphylococcus epidermidis
DGED

SEQ ID NO: 1730787 - protein, 5 aa, Staphylococcus epidermidis
DGFPN

SEQ ID NO: 1730788 - protein, 5 aa, Staphylococcus epidermidis
DGGKK

SEQ ID NO: 1730789 - protein, 6 aa, Staphylococcus epidermidis
DGHEVS

SEQ ID NO: 1730790 - protein, 9 aa, Staphylococcus epidermidis
DGIKTVTGK

SEQ ID NO: 1730791 - protein, 31 aa, Staphylococcus epidermidis
DGKDSGATGSPNIVQDKSNVENPQTSGGIPT

SEQ ID NO: 1730792 - protein, 10 aa, Staphylococcus epidermidis
DGKEAKKTVV

SEQ ID NO: 1730793 - protein, 13 aa, Staphylococcus epidermidis
DGKLETAITTKEG

SEQ ID NO: 1730794 - protein, 11 aa, Staphylococcus epidermidis
DGKNVKDDTDL

SEQ ID NO: 1730795 - protein, 10 aa, Staphylococcus epidermidis
DGKQAKSYPI

SEQ ID NO: 1730796 - protein, 11 aa, Staphylococcus epidermidis
DGKQIKDDTDL

SEQ ID NO: 1730797 - protein, 8 aa, Staphylococcus epidermidis
DGKTKDID

SEQ ID NO: 1730798 - protein, 13 aa, Staphylococcus epidermidis
DGLKTGTSKEGYN

SEQ ID NO: 1730799 - protein, 11 aa, Staphylococcus epidermidis
DGNISLPATGK

SEQ ID NO: 1730800 - protein, 24 aa, Staphylococcus epidermidis
DGQKVSVTYANDNPTQAGELTGAN

SEQ ID NO: 1730801 - protein, 15 aa, Staphylococcus epidermidis
DGQTAEGKADSDGNY

SEQ ID NO: 1730802 - protein, 15 aa, Staphylococcus epidermidis
DGQTAEGKADTDGNY

SEQ ID NO: 1730803 - protein, 39 aa, Staphylococcus epidermidis
DGRRSYREDHFPENDSQYRRSEYGDSNINNQSRNHRNQV

SEQ ID NO: 1730804 - protein, 10 aa, Staphylococcus epidermidis
DGSKDDTEEI

SEQ ID NO: 1730805 - protein, 9 aa, Staphylococcus epidermidis
DGSKDNTID

SEQ ID NO: 1730806 - protein, 12 aa, Staphylococcus epidermidis
DGSKDNTKEIAQ

SEQ ID NO: 1730807 - protein, 4 aa, Staphylococcus epidermidis
DGSL

SEQ ID NO: 1730808 - protein, 13 aa, Staphylococcus epidermidis
DGSNTIKSYQSEV

SEQ ID NO: 1730809 - protein, 9 aa, Staphylococcus epidermidis
DGSSDNTAD

SEQ ID NO: 1730810 - protein, 9 aa, Staphylococcus epidermidis
DGSSDNTAE

SEQ ID NO: 1730811 - protein, 16 aa, Staphylococcus epidermidis
DGSTTLKGTKNTELPK

SEQ ID NO: 1730812 - protein, 9 aa, Staphylococcus epidermidis
DGTIAEEDA

SEQ ID NO: 1730813 - protein, 5 aa, Staphylococcus epidermidis
DGTNL

SEQ ID NO: 1730814 - protein, 10 aa, Staphylococcus epidermidis
DGTSAGLSDS

SEQ ID NO: 1730815 - protein, 7 aa, Staphylococcus epidermidis
DGTVQSL

SEQ ID NO: 1730816 - protein, 11 aa, Staphylococcus epidermidis
DGVNDAPALAQ

SEQ ID NO: 1730817 - protein, 7 aa, Staphylococcus epidermidis
DGVTGVK

SEQ ID NO: 1730818 - protein, 32 aa, Staphylococcus epidermidis
DGYQHPEKYPNYLSKEEQRRQNFRKERARQKD

SEQ ID NO: 1730819 - protein, 10 aa, Staphylococcus epidermidis
DHATGTRNVK

SEQ ID NO: 1730820 - protein, 11 aa, Staphylococcus epidermidis
DHGRGISKKDL

SEQ ID NO: 1730821 - protein, 12 aa, Staphylococcus epidermidis
DHHPNNKDVKSL

SEQ ID NO: 1730822 - protein, 5 aa, Staphylococcus epidermidis
DHKAE

SEQ ID NO: 1730823 - protein, 15 aa, Staphylococcus epidermidis
DHKLTTSKGLGDLES

SEQ ID NO: 1730824 - protein, 9 aa, Staphylococcus epidermidis
DHSSASKKL

SEQ ID NO: 1730825 - protein, 84 aa, Staphylococcus epidermidis
DHTEEDDFEGVNNRSKEADSEKENVEKPKDESHSAVDSEQTHTDNSDLKDSASYTEDRHSSVVSDAKDEINEAEEQTTEDSTKK

SEQ ID NO: 1730826 - protein, 23 aa, Staphylococcus epidermidis
DIDGQKASIKGKVEQVGKATAAS

SEQ ID NO: 1730827 - protein, 7 aa, Staphylococcus epidermidis
DIDKPHN

SEQ ID NO: 1730828 - protein, 8 aa, Staphylococcus epidermidis
DIDNEEKY

SEQ ID NO: 1730829 - protein, 4 aa, Staphylococcus epidermidis
DIET

SEQ ID NO: 1730830 - protein, 6 aa, Staphylococcus epidermidis
DIGQTV

SEQ ID NO: 1730831 - protein, 4 aa, Staphylococcus epidermidis
DIGS

SEQ ID NO: 1730832 - protein, 7 aa, Staphylococcus epidermidis
DIIQQTS

SEQ ID NO: 1730833 - protein, 11 aa, Staphylococcus epidermidis
DIKDYNSQETL

SEQ ID NO: 1730834 - protein, 12 aa, Staphylococcus epidermidis
DIKGSKHKMTIP

SEQ ID NO: 1730835 - protein, 8 aa, Staphylococcus epidermidis
DIKKRESR

SEQ ID NO: 1730836 - protein, 17 aa, Staphylococcus epidermidis
DIKNGIGAQPIKISEGQ

SEQ ID NO: 1730837 - protein, 24 aa, Staphylococcus epidermidis
DIKNNSNLSNDKRSEQTKKYNDKL

SEQ ID NO: 1730838 - protein, 4 aa, Staphylococcus epidermidis
DINH

SEQ ID NO: 1730839 - protein, 13 aa, Staphylococcus epidermidis
DINKSADAGLQKT

SEQ ID NO: 1730840 - protein, 39 aa, Staphylococcus epidermidis
DIPNPTKKAEAREAVTNSANSKIKNINNNTQATLDERND

SEQ ID NO: 1730841 - protein, 5 aa, Staphylococcus epidermidis
DIQNA

SEQ ID NO: 1730842 - protein, 5 aa, Staphylococcus epidermidis
DIQTN

SEQ ID NO: 1730843 - protein, 7 aa, Staphylococcus epidermidis
DISRKEN

SEQ ID NO: 1730844 - protein, 7 aa, Staphylococcus epidermidis
DISTRTQ

SEQ ID NO: 1730845 - protein, 9 aa, Staphylococcus epidermidis
DKAGKLSDV

SEQ ID NO: 1730846 - protein, 15 aa, Staphylococcus epidermidis
DKAKTSISNLSPTEY

SEQ ID NO: 1730847 - protein, 20 aa, Staphylococcus epidermidis
DKAQTNEDVKNIKKQSIDEV

SEQ ID NO: 1730848 - protein, 4 aa, Staphylococcus epidermidis
DKDA

SEQ ID NO: 1730849 - protein, 8 aa, Staphylococcus epidermidis
DKDDAQAK

SEQ ID NO: 1730850 - protein, 10 aa, Staphylococcus epidermidis
DKDDSKIYPS

SEQ ID NO: 1730851 - protein, 13 aa, Staphylococcus epidermidis
DKDSDKSDSRRYG

SEQ ID NO: 1730852 - protein, 24 aa, Staphylococcus epidermidis
DKDSKKVNDALKKQREKKDNKIKN

SEQ ID NO: 1730853 - protein, 9 aa, Staphylococcus epidermidis
DKDTRDVQV

SEQ ID NO: 1730854 - protein, 9 aa, Staphylococcus epidermidis
DKEDNSALV

SEQ ID NO: 1730855 - protein, 17 aa, Staphylococcus epidermidis
DKEEQLRKDKKEEDPFK

SEQ ID NO: 1730856 - protein, 6 aa, Staphylococcus epidermidis
DKEEVL

SEQ ID NO: 1730857 - protein, 7 aa, Staphylococcus epidermidis
DKEGRFN

SEQ ID NO: 1730858 - protein, 18 aa, Staphylococcus epidermidis
DKEGYRDEEFDKDDKGTW

SEQ ID NO: 1730859 - protein, 17 aa, Staphylococcus epidermidis
DKEGYRDEEFDKGDKGT

SEQ ID NO: 1730860 - protein, 17 aa, Staphylococcus epidermidis
DKEGYRDENFDKNDKGT

SEQ ID NO: 1730861 - protein, 23 aa, Staphylococcus epidermidis
DKEHALESELDDKIQEKISENEN

SEQ ID NO: 1730862 - protein, 10 aa, Staphylococcus epidermidis
DKEKNDRYGR

SEQ ID NO: 1730863 - protein, 42 aa, Staphylococcus epidermidis
DKELDDPSEEESKLTQEEENSIELKNQQEEQERAKYKQIEDE

SEQ ID NO: 1730864 - protein, 9 aa, Staphylococcus epidermidis
DKENGTNKD

SEQ ID NO: 1730865 - protein, 15 aa, Staphylococcus epidermidis
DKESDLQKGFDNEKY

SEQ ID NO: 1730866 - protein, 17 aa, Staphylococcus epidermidis
DKEVTFKRSNRDIPEYE

SEQ ID NO: 1730867 - protein, 6 aa, Staphylococcus epidermidis
DKGDDE

SEQ ID NO: 1730868 - protein, 6 aa, Staphylococcus epidermidis
DKGDLK

SEQ ID NO: 1730869 - protein, 9 aa, Staphylococcus epidermidis
DKGKKIKDL

SEQ ID NO: 1730870 - protein, 6 aa, Staphylococcus epidermidis
DKGNTN

SEQ ID NO: 1730871 - protein, 10 aa, Staphylococcus epidermidis
DKGQKTDKYG

SEQ ID NO: 1730872 - protein, 5 aa, Staphylococcus epidermidis
DKGQT

SEQ ID NO: 1730873 - protein, 7 aa, Staphylococcus epidermidis
DKIGDTS

SEQ ID NO: 1730874 - protein, 15 aa, Staphylococcus epidermidis
DKIGQQNNVHQQSNY

SEQ ID NO: 1730875 - protein, 7 aa, Staphylococcus epidermidis
DKISETA

SEQ ID NO: 1730876 - protein, 8 aa, Staphylococcus epidermidis
DKISTTQA

SEQ ID NO: 1730877 - protein, 9 aa, Staphylococcus epidermidis
DKKGSTYIG

SEQ ID NO: 1730878 - protein, 37 aa, Staphylococcus epidermidis
DKKNKKATNINQIQQTSSKSKDIQNSNNKVSNSNNKI

SEQ ID NO: 1730879 - protein, 29 aa, Staphylococcus epidermidis
DKKSGEKYDDDADDESDNDSSSGEVTREN

SEQ ID NO: 1730880 - protein, 9 aa, Staphylococcus epidermidis
DKKTIRNSA

SEQ ID NO: 1730881 - protein, 9 aa, Staphylococcus epidermidis
DKKTPSKMS

SEQ ID NO: 1730882 - protein, 11 aa, Staphylococcus epidermidis
DKKVDPASTTK

SEQ ID NO: 1730883 - protein, 10 aa, Staphylococcus epidermidis
DKKVPTGGEY

SEQ ID NO: 1730884 - protein, 5 aa, Staphylococcus epidermidis
DKKYP

SEQ ID NO: 1730885 - protein, 8 aa, Staphylococcus epidermidis
DKLPDDVT

SEQ ID NO: 1730886 - protein, 14 aa, Staphylococcus epidermidis
DKLPTDKSNAKSKL

SEQ ID NO: 1730887 - protein, 7 aa, Staphylococcus epidermidis
DKNEPKV

SEQ ID NO: 1730888 - protein, 6 aa, Staphylococcus epidermidis
DKNGDL

SEQ ID NO: 1730889 - protein, 32 aa, Staphylococcus epidermidis
DKNGDLAGSYTVDSEDGLVTKYDKDGEEVGSG

SEQ ID NO: 1730890 - protein, 7 aa, Staphylococcus epidermidis
DKNGSYD

SEQ ID NO: 1730891 - protein, 8 aa, Staphylococcus epidermidis
DKNNKSLK

SEQ ID NO: 1730892 - protein, 8 aa, Staphylococcus epidermidis
DKNNQSLK

SEQ ID NO: 1730893 - protein, 12 aa, Staphylococcus epidermidis
DKNPYSKSAFKT

SEQ ID NO: 1730894 - protein, 8 aa, Staphylococcus epidermidis
DKNSNGEL

SEQ ID NO: 1730895 - protein, 6 aa, Staphylococcus epidermidis
DKNTGK

SEQ ID NO: 1730896 - protein, 4 aa, Staphylococcus epidermidis
DKPH

SEQ ID NO: 1730897 - protein, 7 aa, Staphylococcus epidermidis
DKPKPTQ

SEQ ID NO: 1730898 - protein, 6 aa, Staphylococcus epidermidis
DKPLTH

SEQ ID NO: 1730899 - protein, 8 aa, Staphylococcus epidermidis
DKPQKSTK

SEQ ID NO: 1730900 - protein, 12 aa, Staphylococcus epidermidis
DKPSSRKKKGGN

SEQ ID NO: 1730901 - protein, 5 aa, Staphylococcus epidermidis
DKPTF

SEQ ID NO: 1730902 - protein, 16 aa, Staphylococcus epidermidis
DKPTNTPKQAQKSSRL

SEQ ID NO: 1730903 - protein, 12 aa, Staphylococcus epidermidis
DKQDYDKSKLKY

SEQ ID NO: 1730904 - protein, 17 aa, Staphylococcus epidermidis
DKQESGITLDTNTGEVT

SEQ ID NO: 1730905 - protein, 9 aa, Staphylococcus epidermidis
DKQSNTYAP

SEQ ID NO: 1730906 - protein, 14 aa, Staphylococcus epidermidis
DKRGSQDSSEKRYP

SEQ ID NO: 1730907 - protein, 11 aa, Staphylococcus epidermidis
DKSDLTNNIEE

SEQ ID NO: 1730908 - protein, 7 aa, Staphylococcus epidermidis
DKSESSA

SEQ ID NO: 1730909 - protein, 17 aa, Staphylococcus epidermidis
DKSINLKSDNSGGYTFE

SEQ ID NO: 1730910 - protein, 7 aa, Staphylococcus epidermidis
DKSYKIE

SEQ ID NO: 1730911 - protein, 7 aa, Staphylococcus epidermidis
DKTPTRY

SEQ ID NO: 1730912 - protein, 7 aa, Staphylococcus epidermidis
DKTQRPI

SEQ ID NO: 1730913 - protein, 8 aa, Staphylococcus epidermidis
DKTVNSNT

SEQ ID NO: 1730914 - protein, 52 aa, Staphylococcus epidermidis
DKTYVNENDTDQLRQNHSKDQSDLNHQQNQQQKDVWDPEQEINKQKKDDPYI

SEQ ID NO: 1730915 - protein, 24 aa, Staphylococcus epidermidis
DKVAEKTNVKQSSDYINDSTEHQR

SEQ ID NO: 1730916 - protein, 26 aa, Staphylococcus epidermidis
DKVAKTKKEEINQIPNATTDETHQSL

SEQ ID NO: 1730917 - protein, 7 aa, Staphylococcus epidermidis
DKVETNF

SEQ ID NO: 1730918 - protein, 5 aa, Staphylococcus epidermidis
DKVGE

SEQ ID NO: 1730919 - protein, 14 aa, Staphylococcus epidermidis
DKWVTKGGAPYHVS

SEQ ID NO: 1730920 - protein, 22 aa, Staphylococcus epidermidis
DKWVTKGGAPYHVSNREESLEK

SEQ ID NO: 1730921 - protein, 27 aa, Staphylococcus epidermidis
DKYKNGNVSYNPEVPSYSAEYQLNNND

SEQ ID NO: 1730922 - protein, 7 aa, Staphylococcus epidermidis
DKYKNRN

SEQ ID NO: 1730923 - protein, 4 aa, Staphylococcus epidermidis
DKYN

SEQ ID NO: 1730924 - protein, 4 aa, Staphylococcus epidermidis
DKYS

SEQ ID NO: 1730925 - protein, 9 aa, Staphylococcus epidermidis
DLAKSSAPF

SEQ ID NO: 1730926 - protein, 18 aa, Staphylococcus epidermidis
DLETENELYDTKKPYSFK

SEQ ID NO: 1730927 - protein, 19 aa, Staphylococcus epidermidis
DLGLSQKEISDAENRYKNY

SEQ ID NO: 1730928 - protein, 8 aa, Staphylococcus epidermidis
DLGQKPAG

SEQ ID NO: 1730929 - protein, 20 aa, Staphylococcus epidermidis
DLHGSNKLLEDKKEASEQLQ

SEQ ID NO: 1730930 - protein, 4 aa, Staphylococcus epidermidis
DLKK

SEQ ID NO: 1730931 - protein, 9 aa, Staphylococcus epidermidis
DLKNGQIKS

SEQ ID NO: 1730932 - protein, 7 aa, Staphylococcus epidermidis
DLKQNLS

SEQ ID NO: 1730933 - protein, 5 aa, Staphylococcus epidermidis
DLKTL

SEQ ID NO: 1730934 - protein, 7 aa, Staphylococcus epidermidis
DLKTSYE

SEQ ID NO: 1730935 - protein, 11 aa, Staphylococcus epidermidis
DLNTPQKEAIK

SEQ ID NO: 1730936 - protein, 13 aa, Staphylococcus epidermidis
DLNTPQKESIKTA

SEQ ID NO: 1730937 - protein, 13 aa, Staphylococcus epidermidis
DLQSELNTKYTPT

SEQ ID NO: 1730938 - protein, 4 aa, Staphylococcus epidermidis
DLSD

SEQ ID NO: 1730939 - protein, 11 aa, Staphylococcus epidermidis
DLSDSRKLSDE

SEQ ID NO: 1730940 - protein, 4 aa, Staphylococcus epidermidis
DLSG

SEQ ID NO: 1730941 - protein, 25 aa, Staphylococcus epidermidis
DLSRAEDNKLSDKIKSEFGDTPQIN

SEQ ID NO: 1730942 - protein, 7 aa, Staphylococcus epidermidis
DLSTNED

SEQ ID NO: 1730943 - protein, 36 aa, Staphylococcus epidermidis
DLTDAQREKLREQINSSNSRDDIKQKIEQAKALNDA

SEQ ID NO: 1730944 - protein, 8 aa, Staphylococcus epidermidis
DLTEEQKN

SEQ ID NO: 1730945 - protein, 8 aa, Staphylococcus epidermidis
DLTKGPSL

SEQ ID NO: 1730946 - protein, 10 aa, Staphylococcus epidermidis
DLTPDEQAKF

SEQ ID NO: 1730947 - protein, 12 aa, Staphylococcus epidermidis
DLVNEAKSNGIN

SEQ ID NO: 1730948 - protein, 17 aa, Staphylococcus epidermidis
DMDESERNSSNLPSNVN

SEQ ID NO: 1730949 - protein, 7 aa, Staphylococcus epidermidis
DMGGHAG

SEQ ID NO: 1730950 - protein, 7 aa, Staphylococcus epidermidis
DMYSGND

SEQ ID NO: 1730951 - protein, 8 aa, Staphylococcus epidermidis
DNALTAAT

SEQ ID NO: 1730952 - protein, 6 aa, Staphylococcus epidermidis
DNANEI

SEQ ID NO: 1730953 - protein, 21 aa, Staphylococcus epidermidis
DNATTSHDVSTAKSNGTTSIG

SEQ ID NO: 1730954 - protein, 5 aa, Staphylococcus epidermidis
DNDAY

SEQ ID NO: 1730955 - protein, 13 aa, Staphylococcus epidermidis
DNDNATDEEKEVA

SEQ ID NO: 1730956 - protein, 11 aa, Staphylococcus epidermidis
DNEGKPFSRND

SEQ ID NO: 1730957 - protein, 7 aa, Staphylococcus epidermidis
DNEHPSI

SEQ ID NO: 1730958 - protein, 13 aa, Staphylococcus epidermidis
DNEKQDRKEFSVS

SEQ ID NO: 1730959 - protein, 27 aa, Staphylococcus epidermidis
DNELHDGNYINADKDKQDAYNNAVTNA

SEQ ID NO: 1730960 - protein, 7 aa, Staphylococcus epidermidis
DNEVREV

SEQ ID NO: 1730961 - protein, 5 aa, Staphylococcus epidermidis
DNFGE

SEQ ID NO: 1730962 - protein, 5 aa, Staphylococcus epidermidis
DNFTK

SEQ ID NO: 1730963 - protein, 14 aa, Staphylococcus epidermidis
DNGDASDQEVSTEI

SEQ ID NO: 1730964 - protein, 15 aa, Staphylococcus epidermidis
DNGGGGAPDENTISN

SEQ ID NO: 1730965 - protein, 8 aa, Staphylococcus epidermidis
DNHESKSS

SEQ ID NO: 1730966 - protein, 11 aa, Staphylococcus epidermidis
DNHPQPPRHRR

SEQ ID NO: 1730967 - protein, 6 aa, Staphylococcus epidermidis
DNHRGD

SEQ ID NO: 1730968 - protein, 6 aa, Staphylococcus epidermidis
DNIELK

SEQ ID NO: 1730969 - protein, 13 aa, Staphylococcus epidermidis
DNIKDAGKGMGMT

SEQ ID NO: 1730970 - protein, 8 aa, Staphylococcus epidermidis
DNKQKPSF

SEQ ID NO: 1730971 - protein, 6 aa, Staphylococcus epidermidis
DNKSKK

SEQ ID NO: 1730972 - protein, 8 aa, Staphylococcus epidermidis
DNNDAQKV

SEQ ID NO: 1730973 - protein, 8 aa, Staphylococcus epidermidis
DNNDTQKV

SEQ ID NO: 1730974 - protein, 5 aa, Staphylococcus epidermidis
DNNGS

SEQ ID NO: 1730975 - protein, 15 aa, Staphylococcus epidermidis
DNNKYSSIDINQYRK

SEQ ID NO: 1730976 - protein, 6 aa, Staphylococcus epidermidis
DNNQYN

SEQ ID NO: 1730977 - protein, 5 aa, Staphylococcus epidermidis
DNNSR

SEQ ID NO: 1730978 - protein, 4 aa, Staphylococcus epidermidis
DNNY

SEQ ID NO: 1730979 - protein, 7 aa, Staphylococcus epidermidis
DNPQINA

SEQ ID NO: 1730980 - protein, 26 aa, Staphylococcus epidermidis
DNQLDKQADAKDQSKEEYKKTFKDRL

SEQ ID NO: 1730981 - protein, 12 aa, Staphylococcus epidermidis
DNQLTGEAIGKE

SEQ ID NO: 1730982 - protein, 10 aa, Staphylococcus epidermidis
DNQSIANSQM

SEQ ID NO: 1730983 - protein, 13 aa, Staphylococcus epidermidis
DNQTSQLSLQTQN

SEQ ID NO: 1730984 - protein, 5 aa, Staphylococcus epidermidis
DNRHK

SEQ ID NO: 1730985 - protein, 12 aa, Staphylococcus epidermidis
DNRQNSIDSRRD

SEQ ID NO: 1730986 - protein, 15 aa, Staphylococcus epidermidis
DNRTNSIDSRSSEVG

SEQ ID NO: 1730987 - protein, 12 aa, Staphylococcus epidermidis
DNRTNSIDSRYS

SEQ ID NO: 1730988 - protein, 7 aa, Staphylococcus epidermidis
DNSAMGS

SEQ ID NO: 1730989 - protein, 4 aa, Staphylococcus epidermidis
DNSY

SEQ ID NO: 1730990 - protein, 6 aa, Staphylococcus epidermidis
DNTDPY

SEQ ID NO: 1730991 - protein, 7 aa, Staphylococcus epidermidis
DNTNGVT

SEQ ID NO: 1730992 - protein, 11 aa, Staphylococcus epidermidis
DNVEAEDEQKL

SEQ ID NO: 1730993 - protein, 37 aa, Staphylococcus epidermidis
DNVNDEDDNQKYNNDKLNDRSVQQTSETRQSNEDEEE

SEQ ID NO: 1730994 - protein, 38 aa, Staphylococcus epidermidis
DNVNDEDDNQKYNNDKLNDRSVQQTSETRQSNEDEEEF

SEQ ID NO: 1730995 - protein, 5 aa, Staphylococcus epidermidis
DNWPE

SEQ ID NO: 1730996 - protein, 10 aa, Staphylococcus epidermidis
DNYASEKEDI

SEQ ID NO: 1730997 - protein, 10 aa, Staphylococcus epidermidis
DNYEEEKTNH

SEQ ID NO: 1730998 - protein, 5 aa, Staphylococcus epidermidis
DNYGE

SEQ ID NO: 1730999 - protein, 13 aa, Staphylococcus epidermidis
DPDKNGSSKFTQY

SEQ ID NO: 1731000 - protein, 6 aa, Staphylococcus epidermidis
DPDNSP

SEQ ID NO: 1731001 - protein, 6 aa, Staphylococcus epidermidis
DPGLDK

SEQ ID NO: 1731002 - protein, 4 aa, Staphylococcus epidermidis
DPIE

SEQ ID NO: 1731003 - protein, 17 aa, Staphylococcus epidermidis
DPKAHAKKEIRALPNET

SEQ ID NO: 1731004 - protein, 17 aa, Staphylococcus epidermidis
DPKAHAKKELKSLPNET

SEQ ID NO: 1731005 - protein, 50 aa, Staphylococcus epidermidis
DPKEVPSKPAKPAKATPSTTQTKPANQTTASTQSSVADHEVEANKVPNAY

SEQ ID NO: 1731006 - protein, 5 aa, Staphylococcus epidermidis
DPLRT

SEQ ID NO: 1731007 - protein, 6 aa, Staphylococcus epidermidis
DPNFDG

SEQ ID NO: 1731008 - protein, 11 aa, Staphylococcus epidermidis
DPNFTSEEDLY

SEQ ID NO: 1731009 - protein, 5 aa, Staphylococcus epidermidis
DPRSL

SEQ ID NO: 1731010 - protein, 8 aa, Staphylococcus epidermidis
DPSGEFSN

SEQ ID NO: 1731011 - protein, 6 aa, Staphylococcus epidermidis
DPSTGV

SEQ ID NO: 1731012 - protein, 8 aa, Staphylococcus epidermidis
DPTRIYSD

SEQ ID NO: 1731013 - protein, 7 aa, Staphylococcus epidermidis
DPVGGKN

SEQ ID NO: 1731014 - protein, 20 aa, Staphylococcus epidermidis
DPYDKAANNAKALKDKIEND

SEQ ID NO: 1731015 - protein, 19 aa, Staphylococcus epidermidis
DPYQQAANNAKALKDQIEK

SEQ ID NO: 1731016 - protein, 12 aa, Staphylococcus epidermidis
DQANDKLESIND

SEQ ID NO: 1731017 - protein, 14 aa, Staphylococcus epidermidis
DQDVQSHIGQTETY

SEQ ID NO: 1731018 - protein, 7 aa, Staphylococcus epidermidis
DQGKYGT

SEQ ID NO: 1731019 - protein, 5 aa, Staphylococcus epidermidis
DQISP

SEQ ID NO: 1731020 - protein, 6 aa, Staphylococcus epidermidis
DQKHTS

SEQ ID NO: 1731021 - protein, 6 aa, Staphylococcus epidermidis
DQLESN

SEQ ID NO: 1731022 - protein, 6 aa, Staphylococcus epidermidis
DQLGNI

SEQ ID NO: 1731023 - protein, 18 aa, Staphylococcus epidermidis
DQLPSPTPKVNNNQEPQI

SEQ ID NO: 1731024 - protein, 13 aa, Staphylococcus epidermidis
DQNKAADNGISAS

SEQ ID NO: 1731025 - protein, 9 aa, Staphylococcus epidermidis
DQNSSSTFT

SEQ ID NO: 1731026 - protein, 4 aa, Staphylococcus epidermidis
DQPL

SEQ ID NO: 1731027 - protein, 4 aa, Staphylococcus epidermidis
DQQL

SEQ ID NO: 1731028 - protein, 9 aa, Staphylococcus epidermidis
DQSKDKEKL

SEQ ID NO: 1731029 - protein, 12 aa, Staphylococcus epidermidis
DQSMSPTLNKDD

SEQ ID NO: 1731030 - protein, 7 aa, Staphylococcus epidermidis
DQSSPQT

SEQ ID NO: 1731031 - protein, 10 aa, Staphylococcus epidermidis
DQTQEVNTEI

SEQ ID NO: 1731032 - protein, 7 aa, Staphylococcus epidermidis
DQTQEWK

SEQ ID NO: 1731033 - protein, 7 aa, Staphylococcus epidermidis
DQTTAER

SEQ ID NO: 1731034 - protein, 6 aa, Staphylococcus epidermidis
DQTYYD

SEQ ID NO: 1731035 - protein, 4 aa, Staphylococcus epidermidis
DQVI

SEQ ID NO: 1731036 - protein, 4 aa, Staphylococcus epidermidis
DQVP

SEQ ID NO: 1731037 - protein, 31 aa, Staphylococcus epidermidis
DQVPSTEGMTRQTKDDYNSKQQAAQQEITKA

SEQ ID NO: 1731038 - protein, 8 aa, Staphylococcus epidermidis
DQYQEGAD

SEQ ID NO: 1731039 - protein, 10 aa, Staphylococcus epidermidis
DRADTTEYQK

SEQ ID NO: 1731040 - protein, 4 aa, Staphylococcus epidermidis
DRAI

SEQ ID NO: 1731041 - protein, 7 aa, Staphylococcus epidermidis
DREQIGP

SEQ ID NO: 1731042 - protein, 5 aa, Staphylococcus epidermidis
DRFGR

SEQ ID NO: 1731043 - protein, 8 aa, Staphylococcus epidermidis
DRFTERHN

SEQ ID NO: 1731044 - protein, 9 aa, Staphylococcus epidermidis
DRKKKTKLG

SEQ ID NO: 1731045 - protein, 6 aa, Staphylococcus epidermidis
DRLEDG

SEQ ID NO: 1731046 - protein, 8 aa, Staphylococcus epidermidis
DRLENSEA

SEQ ID NO: 1731047 - protein, 4 aa, Staphylococcus epidermidis
DRLQ

SEQ ID NO: 1731048 - protein, 10 aa, Staphylococcus epidermidis
DRLTQQVGTT

SEQ ID NO: 1731049 - protein, 7 aa, Staphylococcus epidermidis
DRPDGFK

SEQ ID NO: 1731050 - protein, 15 aa, Staphylococcus epidermidis
DRPDLAKQFKETLLN

SEQ ID NO: 1731051 - protein, 12 aa, Staphylococcus epidermidis
DRPKENAKEAIQ

SEQ ID NO: 1731052 - protein, 8 aa, Staphylococcus epidermidis
DRRSASST

SEQ ID NO: 1731053 - protein, 13 aa, Staphylococcus epidermidis
DRRVNDKYAKHRQ

SEQ ID NO: 1731054 - protein, 6 aa, Staphylococcus epidermidis
DRSPYE

SEQ ID NO: 1731055 - protein, 4 aa, Staphylococcus epidermidis
DSAF

SEQ ID NO: 1731056 - protein, 8 aa, Staphylococcus epidermidis
DSDGEEVK

SEQ ID NO: 1731057 - protein, 36 aa, Staphylococcus epidermidis
DSDHSRINNTSRNSDEDVSSTSSSSDSSHSHSFTNT

SEQ ID NO: 1731058 - protein, 11 aa, Staphylococcus epidermidis
DSDKSKLDSNI

SEQ ID NO: 1731059 - protein, 13 aa, Staphylococcus epidermidis
DSDLDPKKPKIDN

SEQ ID NO: 1731060 - protein, 9 aa, Staphylococcus epidermidis
DSDNAIKKG

SEQ ID NO: 1731061 - protein, 14 aa, Staphylococcus epidermidis
DSDRPYDTEGAVTL

SEQ ID NO: 1731062 - protein, 8 aa, Staphylococcus epidermidis
DSDTANLN

SEQ ID NO: 1731063 - protein, 14 aa, Staphylococcus epidermidis
DSDTCKNGDKCESK

SEQ ID NO: 1731064 - protein, 14 aa, Staphylococcus epidermidis
DSDYTNMSYDPHNK

SEQ ID NO: 1731065 - protein, 31 aa, Staphylococcus epidermidis
DSEEGANKYGPYPKNNDEYNSNVKETNNDRI

SEQ ID NO: 1731066 - protein, 8 aa, Staphylococcus epidermidis
DSEGSHTY

SEQ ID NO: 1731067 - protein, 10 aa, Staphylococcus epidermidis
DSEKEPSAEE

SEQ ID NO: 1731068 - protein, 4 aa, Staphylococcus epidermidis
DSET

SEQ ID NO: 1731069 - protein, 7 aa, Staphylococcus epidermidis
DSFKTKV

SEQ ID NO: 1731070 - protein, 5 aa, Staphylococcus epidermidis
DSGTV

SEQ ID NO: 1731071 - protein, 13 aa, Staphylococcus epidermidis
DSHPQYNRPLNTK

SEQ ID NO: 1731072 - protein, 4 aa, Staphylococcus epidermidis
DSIA

SEQ ID NO: 1731073 - protein, 4 aa, Staphylococcus epidermidis
DSIE

SEQ ID NO: 1731074 - protein, 22 aa, Staphylococcus epidermidis
DSIQKGQEILNGTTDDVLNNNK

SEQ ID NO: 1731075 - protein, 22 aa, Staphylococcus epidermidis
DSIQKGREILNGTTDDVLNNNK

SEQ ID NO: 1731076 - protein, 10 aa, Staphylococcus epidermidis
DSISNQTNAL

SEQ ID NO: 1731077 - protein, 10 aa, Staphylococcus epidermidis
DSKLIDTAGK

SEQ ID NO: 1731078 - protein, 6 aa, Staphylococcus epidermidis
DSKSEW

SEQ ID NO: 1731079 - protein, 7 aa, Staphylococcus epidermidis
DSKSGWR

SEQ ID NO: 1731080 - protein, 6 aa, Staphylococcus epidermidis
DSKTGG

SEQ ID NO: 1731081 - protein, 19 aa, Staphylococcus epidermidis
DSKYKNTEKEIKKLNERNS

SEQ ID NO: 1731082 - protein, 5 aa, Staphylococcus epidermidis
DSMTG

SEQ ID NO: 1731083 - protein, 6 aa, Staphylococcus epidermidis
DSNEIE

SEQ ID NO: 1731084 - protein, 21 aa, Staphylococcus epidermidis
DSNKSQTNNHTQKNANSSYQV

SEQ ID NO: 1731085 - protein, 7 aa, Staphylococcus epidermidis
DSNNEEQ

SEQ ID NO: 1731086 - protein, 6 aa, Staphylococcus epidermidis
DSNSNY

SEQ ID NO: 1731087 - protein, 37 aa, Staphylococcus epidermidis
DSPKSYKEVEYTGKKAQHSQLHENKDVANKIIQFLWN

SEQ ID NO: 1731088 - protein, 6 aa, Staphylococcus epidermidis
DSRSRG

SEQ ID NO: 1731089 - protein, 35 aa, Staphylococcus epidermidis
DSSKKGNERLSDKTTQQEKKKDDKDKKEKKIKNRW

SEQ ID NO: 1731090 - protein, 10 aa, Staphylococcus epidermidis
DSSQTEATKA

SEQ ID NO: 1731091 - protein, 11 aa, Staphylococcus epidermidis
DSSSSSEGASM

SEQ ID NO: 1731092 - protein, 6 aa, Staphylococcus epidermidis
DSTYQI

SEQ ID NO: 1731093 - protein, 10 aa, Staphylococcus epidermidis
DTDKESAKKE

SEQ ID NO: 1731094 - protein, 12 aa, Staphylococcus epidermidis
DTDYKRDGKELG

SEQ ID NO: 1731095 - protein, 9 aa, Staphylococcus epidermidis
DTFAESKND

SEQ ID NO: 1731096 - protein, 6 aa, Staphylococcus epidermidis
DTFPKG

SEQ ID NO: 1731097 - protein, 8 aa, Staphylococcus epidermidis
DTGTGIAP

SEQ ID NO: 1731098 - protein, 5 aa, Staphylococcus epidermidis
DTKSI

SEQ ID NO: 1731099 - protein, 10 aa, Staphylococcus epidermidis
DTLKNSDFST

SEQ ID NO: 1731100 - protein, 63 aa, Staphylococcus epidermidis
DTNASKREQLANKVNQAQSQVNDDYQKINQSPNNSQLQSKLTQDQSSLNEAQQSLAQHDRQVN

SEQ ID NO: 1731101 - protein, 17 aa, Staphylococcus epidermidis
DTNKDGIQDDNEKGISN

SEQ ID NO: 1731102 - protein, 17 aa, Staphylococcus epidermidis
DTNKDSIQDDNEKGISG

SEQ ID NO: 1731103 - protein, 12 aa, Staphylococcus epidermidis
DTNPEEAKNEMQ

SEQ ID NO: 1731104 - protein, 9 aa, Staphylococcus epidermidis
DTNQTKKEF

SEQ ID NO: 1731105 - protein, 14 aa, Staphylococcus epidermidis
DTNTENEKTIDESL

SEQ ID NO: 1731106 - protein, 8 aa, Staphylococcus epidermidis
DTNTGEVS

SEQ ID NO: 1731107 - protein, 11 aa, Staphylococcus epidermidis
DTPEDEEKDAY

SEQ ID NO: 1731108 - protein, 5 aa, Staphylococcus epidermidis
DTQKH

SEQ ID NO: 1731109 - protein, 6 aa, Staphylococcus epidermidis
DTRGMT

SEQ ID NO: 1731110 - protein, 9 aa, Staphylococcus epidermidis
DTSMDNQEA

SEQ ID NO: 1731111 - protein, 25 aa, Staphylococcus epidermidis
DTSTLPHQSKSKQLNDNQSKENQYH

SEQ ID NO: 1731112 - protein, 28 aa, Staphylococcus epidermidis
DTTAPEQPKINKVTENSTEVSGRGEPGT

SEQ ID NO: 1731113 - protein, 28 aa, Staphylococcus epidermidis
DTTAPEQPTINKVTENSTEVSGRGEPGT

SEQ ID NO: 1731114 - protein, 18 aa, Staphylococcus epidermidis
DTTFKTTSKKGKNEASGY

SEQ ID NO: 1731115 - protein, 21 aa, Staphylococcus epidermidis
DTTKPTVESVADQTQEVNTEI

SEQ ID NO: 1731116 - protein, 6 aa, Staphylococcus epidermidis
DTTTGE

SEQ ID NO: 1731117 - protein, 13 aa, Staphylococcus epidermidis
DTVISQSNGQMNS

SEQ ID NO: 1731118 - protein, 10 aa, Staphylococcus epidermidis
DTVPKNKDKW

SEQ ID NO: 1731119 - protein, 10 aa, Staphylococcus epidermidis
DTYAKQDRNI

SEQ ID NO: 1731120 - protein, 5 aa, Staphylococcus epidermidis
DVAQA

SEQ ID NO: 1731121 - protein, 10 aa, Staphylococcus epidermidis
DVATTPQRDN

SEQ ID NO: 1731122 - protein, 9 aa, Staphylococcus epidermidis
DVDSGGEIG

SEQ ID NO: 1731123 - protein, 8 aa, Staphylococcus epidermidis
DVDSGGTI

SEQ ID NO: 1731124 - protein, 12 aa, Staphylococcus epidermidis
DVEPEPVQHHKG

SEQ ID NO: 1731125 - protein, 16 aa, Staphylococcus epidermidis
DVETSQMKSDKQSFNI

SEQ ID NO: 1731126 - protein, 6 aa, Staphylococcus epidermidis
DVKGTN

SEQ ID NO: 1731127 - protein, 7 aa, Staphylococcus epidermidis
DVKPGKY

SEQ ID NO: 1731128 - protein, 29 aa, Staphylococcus epidermidis
DVKQGDKLDKGDKVAEVSAQGEGGQSKDM

SEQ ID NO: 1731129 - protein, 13 aa, Staphylococcus epidermidis
DVNDTYSHQSGDA

SEQ ID NO: 1731130 - protein, 7 aa, Staphylococcus epidermidis
DVNEAER

SEQ ID NO: 1731131 - protein, 10 aa, Staphylococcus epidermidis
DVPEDQYQGP

SEQ ID NO: 1731132 - protein, 10 aa, Staphylococcus epidermidis
DVPEEQYQGP

SEQ ID NO: 1731133 - protein, 5 aa, Staphylococcus epidermidis
DVPKN

SEQ ID NO: 1731134 - protein, 13 aa, Staphylococcus epidermidis
DVPQPQQKAQARA

SEQ ID NO: 1731135 - protein, 27 aa, Staphylococcus epidermidis
DVQKTLQDRIDNGGSNYYKNDDQQVGA

SEQ ID NO: 1731136 - protein, 22 aa, Staphylococcus epidermidis
DVQNSKSNADQISGELNQLDDN

SEQ ID NO: 1731137 - protein, 8 aa, Staphylococcus epidermidis
DVRINSGS

SEQ ID NO: 1731138 - protein, 9 aa, Staphylococcus epidermidis
DVRTEKQEL

SEQ ID NO: 1731139 - protein, 4 aa, Staphylococcus epidermidis
DVVP

SEQ ID NO: 1731140 - protein, 56 aa, Staphylococcus epidermidis
DVVTSDSNTIAQIQPATKIKDDAKADVNAENAKKQQEIANNNEATTEEKDVAQQQL

SEQ ID NO: 1731141 - protein, 5 aa, Staphylococcus epidermidis
DWEPG

SEQ ID NO: 1731142 - protein, 5 aa, Staphylococcus epidermidis
DYERG

SEQ ID NO: 1731143 - protein, 5 aa, Staphylococcus epidermidis
DYETY

SEQ ID NO: 1731144 - protein, 6 aa, Staphylococcus epidermidis
DYGSNI

SEQ ID NO: 1731145 - protein, 8 aa, Staphylococcus epidermidis
DYKSQEFK

SEQ ID NO: 1731146 - protein, 12 aa, Staphylococcus epidermidis
DYNASSIVQDQG

SEQ ID NO: 1731147 - protein, 7 aa, Staphylococcus epidermidis
DYNSEKQ

SEQ ID NO: 1731148 - protein, 26 aa, Staphylococcus epidermidis
DYPEDNKKVSEEELDEIRSTEDSLNV

SEQ ID NO: 1731149 - protein, 8 aa, Staphylococcus epidermidis
DYQSDGNK

SEQ ID NO: 1731150 - protein, 6 aa, Staphylococcus epidermidis
DYSSIN

SEQ ID NO: 1731151 - protein, 11 aa, Staphylococcus epidermidis
DYTNGNNAGNG

SEQ ID NO: 1731152 - protein, 48 aa, Staphylococcus epidermidis
DYVNDSNVRDYAKNAIGSKYTEAGSVSIGGHGGGVTDKDNGVKDNGDY

SEQ ID NO: 1731153 - protein, 9 aa, Staphylococcus epidermidis
EAAKDKKNV

SEQ ID NO: 1731154 - protein, 27 aa, Staphylococcus epidermidis
EAAKTEAKGNITSQHTTSEVNDAKVAG

SEQ ID NO: 1731155 - protein, 6 aa, Staphylococcus epidermidis
EAATKI

SEQ ID NO: 1731156 - protein, 31 aa, Staphylococcus epidermidis
EADDEATKEEEEANENATVSTDNSNQDNNEP

SEQ ID NO: 1731157 - protein, 12 aa, Staphylococcus epidermidis
EAETNEDVDNSV

SEQ ID NO: 1731158 - protein, 17 aa, Staphylococcus epidermidis
EAGEEVSSETLKSVSNA

SEQ ID NO: 1731159 - protein, 7 aa, Staphylococcus epidermidis
EAGGTRI

SEQ ID NO: 1731160 - protein, 20 aa, Staphylococcus epidermidis
EAGMGSAPNAAATAAVPHPV

SEQ ID NO: 1731161 - protein, 6 aa, Staphylococcus epidermidis
EAGQLS

SEQ ID NO: 1731162 - protein, 19 aa, Staphylococcus epidermidis
EAKADSDKHEIKSHQQSMT

SEQ ID NO: 1731163 - protein, 17 aa, Staphylococcus epidermidis
EAKAQSIESHPTYLKKY

SEQ ID NO: 1731164 - protein, 40 aa, Staphylococcus epidermidis
EAKDNSGQKVTNKVSGLPEGVSFDSETNTISGTPTKVGSY

SEQ ID NO: 1731165 - protein, 25 aa, Staphylococcus epidermidis
EAKNQVDQAQTNAQVDQAQQDGVNK

SEQ ID NO: 1731166 - protein, 15 aa, Staphylococcus epidermidis
EAKQQLTADTSQLQT

SEQ ID NO: 1731167 - protein, 9 aa, Staphylococcus epidermidis
EAKTSIKRR

SEQ ID NO: 1731168 - protein, 7 aa, Staphylococcus epidermidis
EAPPNLK

SEQ ID NO: 1731169 - protein, 6 aa, Staphylococcus epidermidis
EAQQYN

SEQ ID NO: 1731170 - protein, 23 aa, Staphylococcus epidermidis
EAQRNKAKENVGKASTKTNIASQ

SEQ ID NO: 1731171 - protein, 10 aa, Staphylococcus epidermidis
EAQSSKAPIQ

SEQ ID NO: 1731172 - protein, 21 aa, Staphylococcus epidermidis
EARDNSGQAVTNKVSGLPEGV

SEQ ID NO: 1731173 - protein, 19 aa, Staphylococcus epidermidis
EASDNSGQAVTNKVSGLPD

SEQ ID NO: 1731174 - protein, 7 aa, Staphylococcus epidermidis
EASHASQ

SEQ ID NO: 1731175 - protein, 21 aa, Staphylococcus epidermidis
EATDNNGQAVTNKVSGLPTGV

SEQ ID NO: 1731176 - protein, 21 aa, Staphylococcus epidermidis
EATDNSGQAVANKVDGLPNGV

SEQ ID NO: 1731177 - protein, 20 aa, Staphylococcus epidermidis
EATDNSGQAVTNKVEGLPAG

SEQ ID NO: 1731178 - protein, 40 aa, Staphylococcus epidermidis
EATDNSGQKVTNKVSGLPEGVSFDSETNTISGTPTKVGNY

SEQ ID NO: 1731179 - protein, 40 aa, Staphylococcus epidermidis
EATDNSGQSVTNKISGLPDGVSFDSATNTITGTPTKVGSY

SEQ ID NO: 1731180 - protein, 6 aa, Staphylococcus epidermidis
EATEYV

SEQ ID NO: 1731181 - protein, 13 aa, Staphylococcus epidermidis
EATNTISGTPSEV

SEQ ID NO: 1731182 - protein, 8 aa, Staphylococcus epidermidis
EATPHSPI

SEQ ID NO: 1731183 - protein, 22 aa, Staphylococcus epidermidis
EATQTSIPQRQPQSRPEKQTVK

SEQ ID NO: 1731184 - protein, 21 aa, Staphylococcus epidermidis
EDAIKTGKSFAKQKKWTTPEK

SEQ ID NO: 1731185 - protein, 26 aa, Staphylococcus epidermidis
EDALTGNDAVKQTSNYINEDTSQQVN

SEQ ID NO: 1731186 - protein, 23 aa, Staphylococcus epidermidis
EDANEKIREANTDSEVLGTKSNA

SEQ ID NO: 1731187 - protein, 5 aa, Staphylococcus epidermidis
EDARN

SEQ ID NO: 1731188 - protein, 24 aa, Staphylococcus epidermidis
EDDDFEKGKKEKVKIDGETKNLKP

SEQ ID NO: 1731189 - protein, 14 aa, Staphylococcus epidermidis
EDDLSSDVTSPHNS

SEQ ID NO: 1731190 - protein, 6 aa, Staphylococcus epidermidis
EDDLTH

SEQ ID NO: 1731191 - protein, 6 aa, Staphylococcus epidermidis
EDDMPG

SEQ ID NO: 1731192 - protein, 5 aa, Staphylococcus epidermidis
EDDTI

SEQ ID NO: 1731193 - protein, 7 aa, Staphylococcus epidermidis
EDEESYY

SEQ ID NO: 1731194 - protein, 27 aa, Staphylococcus epidermidis
EDELSHPNQTLRSASIESQTGSSVIRP

SEQ ID NO: 1731195 - protein, 12 aa, Staphylococcus epidermidis
EDENKEYEENIS

SEQ ID NO: 1731196 - protein, 18 aa, Staphylococcus epidermidis
EDFRNRSKDGLTSEELQA

SEQ ID NO: 1731197 - protein, 12 aa, Staphylococcus epidermidis
EDFTTKNESPSY

SEQ ID NO: 1731198 - protein, 5 aa, Staphylococcus epidermidis
EDGYP

SEQ ID NO: 1731199 - protein, 19 aa, Staphylococcus epidermidis
EDIINNSSNPNLNAQDITN

SEQ ID NO: 1731200 - protein, 6 aa, Staphylococcus epidermidis
EDIKQI

SEQ ID NO: 1731201 - protein, 22 aa, Staphylococcus epidermidis
EDIKSDSESDSNDDSEEVTRDN

SEQ ID NO: 1731202 - protein, 11 aa, Staphylococcus epidermidis
EDKASAKRYAE

SEQ ID NO: 1731203 - protein, 8 aa, Staphylococcus epidermidis
EDKKNTMD

SEQ ID NO: 1731204 - protein, 5 aa, Staphylococcus epidermidis
EDKRA

SEQ ID NO: 1731205 - protein, 11 aa, Staphylococcus epidermidis
EDNEAKNFDHR

SEQ ID NO: 1731206 - protein, 4 aa, Staphylococcus epidermidis
EDNL

SEQ ID NO: 1731207 - protein, 15 aa, Staphylococcus epidermidis
EDNLETDAKNNLQKQ

SEQ ID NO: 1731208 - protein, 9 aa, Staphylococcus epidermidis
EDNSSMNDK

SEQ ID NO: 1731209 - protein, 9 aa, Staphylococcus epidermidis
EDPTRRPFS

SEQ ID NO: 1731210 - protein, 5 aa, Staphylococcus epidermidis
EDQDT

SEQ ID NO: 1731211 - protein, 31 aa, Staphylococcus epidermidis
EDQVNQDDQISNSSPFINEDSDKQKIYNDKI

SEQ ID NO: 1731212 - protein, 14 aa, Staphylococcus epidermidis
EDSQSSKDASGQIK

SEQ ID NO: 1731213 - protein, 13 aa, Staphylococcus epidermidis
EDSRNTKTGGSGL

SEQ ID NO: 1731214 - protein, 6 aa, Staphylococcus epidermidis
EDSSMK

SEQ ID NO: 1731215 - protein, 5 aa, Staphylococcus epidermidis
EDSTR

SEQ ID NO: 1731216 - protein, 4 aa, Staphylococcus epidermidis
EDTL

SEQ ID NO: 1731217 - protein, 21 aa, Staphylococcus epidermidis
EDTTKPTVEDIADQTQEINTE

SEQ ID NO: 1731218 - protein, 22 aa, Staphylococcus epidermidis
EDTTKPTVEDIANQTQEVNTEI

SEQ ID NO: 1731219 - protein, 22 aa, Staphylococcus epidermidis
EDTTKPTVEDITDQTQEVNTEI

SEQ ID NO: 1731220 - protein, 21 aa, Staphylococcus epidermidis
EDTTKPTVENVADQTQEVNTE

SEQ ID NO: 1731221 - protein, 21 aa, Staphylococcus epidermidis
EDTTKPTVENVAGQTQEINTE

SEQ ID NO: 1731222 - protein, 10 aa, Staphylococcus epidermidis
EDTTKPTVES

SEQ ID NO: 1731223 - protein, 22 aa, Staphylococcus epidermidis
EDTTKPTVESIANQTQEVNTEI

SEQ ID NO: 1731224 - protein, 21 aa, Staphylococcus epidermidis
EDTTKPTVESVADQTQEINTE

SEQ ID NO: 1731225 - protein, 21 aa, Staphylococcus epidermidis
EDTTKPTVESVADQTQEINTK

SEQ ID NO: 1731226 - protein, 7 aa, Staphylococcus epidermidis
EDVETET

SEQ ID NO: 1731227 - protein, 17 aa, Staphylococcus epidermidis
EDVHESVDKAAKLKEQH

SEQ ID NO: 1731228 - protein, 16 aa, Staphylococcus epidermidis
EDVHESVEKAAQIKEA

SEQ ID NO: 1731229 - protein, 9 aa, Staphylococcus epidermidis
EDVKSQTQN

SEQ ID NO: 1731230 - protein, 40 aa, Staphylococcus epidermidis
EDVSAAEQHSQTEGVHATTSSGNDETQVSDKESEINSING

SEQ ID NO: 1731231 - protein, 5 aa, Staphylococcus epidermidis
EDVTQ

SEQ ID NO: 1731232 - protein, 5 aa, Staphylococcus epidermidis
EDYDQ

SEQ ID NO: 1731233 - protein, 8 aa, Staphylococcus epidermidis
EDYEKITE

SEQ ID NO: 1731234 - protein, 15 aa, Staphylococcus epidermidis
EDYQSLRAHAKGKNI

SEQ ID NO: 1731235 - protein, 21 aa, Staphylococcus epidermidis
EEDIEEVKGSVKERQKNNTNI

SEQ ID NO: 1731236 - protein, 13 aa, Staphylococcus epidermidis
EEDKETKASIDKK

SEQ ID NO: 1731237 - protein, 54 aa, Staphylococcus epidermidis
EEDKKNEQQDIKEHYSNDSHNDTQNVNENRDNHANHQDNNHQDLNANTHKDNDF

SEQ ID NO: 1731238 - protein, 14 aa, Staphylococcus epidermidis
EEDLKNNKNALEDK

SEQ ID NO: 1731239 - protein, 10 aa, Staphylococcus epidermidis
EEFDKDTFSQ

SEQ ID NO: 1731240 - protein, 8 aa, Staphylococcus epidermidis
EEGNRSAK

SEQ ID NO: 1731241 - protein, 4 aa, Staphylococcus epidermidis
EEIQ

SEQ ID NO: 1731242 - protein, 12 aa, Staphylococcus epidermidis
EEISESFKQHMN

SEQ ID NO: 1731243 - protein, 8 aa, Staphylococcus epidermidis
EEITEGTA

SEQ ID NO: 1731244 - protein, 14 aa, Staphylococcus epidermidis
EEITNQGKLTIDKD

SEQ ID NO: 1731245 - protein, 10 aa, Staphylococcus epidermidis
EEKATEINKA

SEQ ID NO: 1731246 - protein, 4 aa, Staphylococcus epidermidis
EEKN

SEQ ID NO: 1731247 - protein, 7 aa, Staphylococcus epidermidis
EEKPLTK

SEQ ID NO: 1731248 - protein, 17 aa, Staphylococcus epidermidis
EEKPNSNSKDEEHLPEQ

SEQ ID NO: 1731249 - protein, 13 aa, Staphylococcus epidermidis
EELEDVKADTHKA

SEQ ID NO: 1731250 - protein, 12 aa, Staphylococcus epidermidis
EELGKNDKSTAV

SEQ ID NO: 1731251 - protein, 9 aa, Staphylococcus epidermidis
EENNRGKQM

SEQ ID NO: 1731252 - protein, 11 aa, Staphylococcus epidermidis
EENNRIEPDGK

SEQ ID NO: 1731253 - protein, 4 aa, Staphylococcus epidermidis
EENQ

SEQ ID NO: 1731254 - protein, 8 aa, Staphylococcus epidermidis
EENSGKVT

SEQ ID NO: 1731255 - protein, 9 aa, Staphylococcus epidermidis
EENSGKVTI

SEQ ID NO: 1731256 - protein, 77 aa, Staphylococcus epidermidis
EENTVQDVKDSNMDDELSDSNDQSSNEEKNDVINNSQSINTDDDNQIKKEETNSNDAIENRSKDITQSTTNVDENEA

SEQ ID NO: 1731257 - protein, 9 aa, Staphylococcus epidermidis
EENVNKTNF

SEQ ID NO: 1731258 - protein, 5 aa, Staphylococcus epidermidis
EEPEN

SEQ ID NO: 1731259 - protein, 6 aa, Staphylococcus epidermidis
EEQAKG

SEQ ID NO: 1731260 - protein, 12 aa, Staphylococcus epidermidis
EEQESARSNEQK

SEQ ID NO: 1731261 - protein, 9 aa, Staphylococcus epidermidis
EEQGGSKEI

SEQ ID NO: 1731262 - protein, 8 aa, Staphylococcus epidermidis
EEQNSSNV

SEQ ID NO: 1731263 - protein, 11 aa, Staphylococcus epidermidis
EEQVEKGYQSY

SEQ ID NO: 1731264 - protein, 21 aa, Staphylococcus epidermidis
EERAYDKRSKAEKRKNTEKNL

SEQ ID NO: 1731265 - protein, 38 aa, Staphylococcus epidermidis
EEREERIRREREAREKKVEKAQQQSKMNEERVKDNLRK

SEQ ID NO: 1731266 - protein, 15 aa, Staphylococcus epidermidis
EERQENMNEYNYQSF

SEQ ID NO: 1731267 - protein, 6 aa, Staphylococcus epidermidis
EESDMT

SEQ ID NO: 1731268 - protein, 30 aa, Staphylococcus epidermidis
EESIKDKEQVKQSSNYINEDPDVKETYDNA

SEQ ID NO: 1731269 - protein, 6 aa, Staphylococcus epidermidis
EESPVY

SEQ ID NO: 1731270 - protein, 4 aa, Staphylococcus epidermidis
EETD

SEQ ID NO: 1731271 - protein, 15 aa, Staphylococcus epidermidis
EETDDTVDVKDGMGK

SEQ ID NO: 1731272 - protein, 4 aa, Staphylococcus epidermidis
EETG

SEQ ID NO: 1731273 - protein, 7 aa, Staphylococcus epidermidis
EETGDVS

SEQ ID NO: 1731274 - protein, 4 aa, Staphylococcus epidermidis
EETT

SEQ ID NO: 1731275 - protein, 14 aa, Staphylococcus epidermidis
EEVPSNEERMTSDP

SEQ ID NO: 1731276 - protein, 8 aa, Staphylococcus epidermidis
EEVQNDDI

SEQ ID NO: 1731277 - protein, 6 aa, Staphylococcus epidermidis
EFDQNQ

SEQ ID NO: 1731278 - protein, 7 aa, Staphylococcus epidermidis
EFKPSKD

SEQ ID NO: 1731279 - protein, 11 aa, Staphylococcus epidermidis
EFKSKSPKKKD

SEQ ID NO: 1731280 - protein, 7 aa, Staphylococcus epidermidis
EFNQRRD

SEQ ID NO: 1731281 - protein, 20 aa, Staphylococcus epidermidis
EFNSPEELKSRAKLREQQRE

SEQ ID NO: 1731282 - protein, 13 aa, Staphylococcus epidermidis
EFPGDQIAKGTNT

SEQ ID NO: 1731283 - protein, 15 aa, Staphylococcus epidermidis
EFRNYDTKSHGNVSA

SEQ ID NO: 1731284 - protein, 12 aa, Staphylococcus epidermidis
EFSEEKISENDP

SEQ ID NO: 1731285 - protein, 4 aa, Staphylococcus epidermidis
EGAD

SEQ ID NO: 1731286 - protein, 8 aa, Staphylococcus epidermidis
EGADNGRT

SEQ ID NO: 1731287 - protein, 30 aa, Staphylococcus epidermidis
EGDEYEATTSKSVDDLEKANTDPKVKIEKI

SEQ ID NO: 1731288 - protein, 22 aa, Staphylococcus epidermidis
EGEVRLKGKDMNSINDNEKYQT

SEQ ID NO: 1731289 - protein, 10 aa, Staphylococcus epidermidis
EGFKGIKNGH

SEQ ID NO: 1731290 - protein, 4 aa, Staphylococcus epidermidis
EGGI

SEQ ID NO: 1731291 - protein, 5 aa, Staphylococcus epidermidis
EGGND

SEQ ID NO: 1731292 - protein, 10 aa, Staphylococcus epidermidis
EGGRGSQREL

SEQ ID NO: 1731293 - protein, 6 aa, Staphylococcus epidermidis
EGIGGV

SEQ ID NO: 1731294 - protein, 5 aa, Staphylococcus epidermidis
EGISK

SEQ ID NO: 1731295 - protein, 7 aa, Staphylococcus epidermidis
EGKIKKD

SEQ ID NO: 1731296 - protein, 8 aa, Staphylococcus epidermidis
EGKLNLND

SEQ ID NO: 1731297 - protein, 7 aa, Staphylococcus epidermidis
EGKMDEK

SEQ ID NO: 1731298 - protein, 25 aa, Staphylococcus epidermidis
EGKSSKDSKTESNIGCTTHQGETLE

SEQ ID NO: 1731299 - protein, 18 aa, Staphylococcus epidermidis
EGLKEGSTVKFKNSDQSY

SEQ ID NO: 1731300 - protein, 4 aa, Staphylococcus epidermidis
EGLQ

SEQ ID NO: 1731301 - protein, 6 aa, Staphylococcus epidermidis
EGQEAT

SEQ ID NO: 1731302 - protein, 22 aa, Staphylococcus epidermidis
EGQGRQRSNVHGEVKTPKNWGT

SEQ ID NO: 1731303 - protein, 14 aa, Staphylococcus epidermidis
EGQRGSGGGELDTH

SEQ ID NO: 1731304 - protein, 7 aa, Staphylococcus epidermidis
EGRDGRL

SEQ ID NO: 1731305 - protein, 4 aa, Staphylococcus epidermidis
EGRK

SEQ ID NO: 1731306 - protein, 7 aa, Staphylococcus epidermidis
EGRSRRR

SEQ ID NO: 1731307 - protein, 17 aa, Staphylococcus epidermidis
EGSDESDKYVDTVSTPI

SEQ ID NO: 1731308 - protein, 19 aa, Staphylococcus epidermidis
EGSDESDKYVDTVSTRSSL

SEQ ID NO: 1731309 - protein, 15 aa, Staphylococcus epidermidis
EGSNSSKKQVISPRK

SEQ ID NO: 1731310 - protein, 5 aa, Staphylococcus epidermidis
EGSNV

SEQ ID NO: 1731311 - protein, 28 aa, Staphylococcus epidermidis
EGSYEGKTFKSNSVNVAGASEKDGGVTD

SEQ ID NO: 1731312 - protein, 28 aa, Staphylococcus epidermidis
EGSYEGKTFKSNSVNVASASEDDGGVTD

SEQ ID NO: 1731313 - protein, 9 aa, Staphylococcus epidermidis
EGTISNQDK

SEQ ID NO: 1731314 - protein, 18 aa, Staphylococcus epidermidis
EGTRATTIAKDKEHDTRT

SEQ ID NO: 1731315 - protein, 11 aa, Staphylococcus epidermidis
EGYDTEVGERG

SEQ ID NO: 1731316 - protein, 8 aa, Staphylococcus epidermidis
EHAEGGHI

SEQ ID NO: 1731317 - protein, 9 aa, Staphylococcus epidermidis
EHEKSRKGS

SEQ ID NO: 1731318 - protein, 8 aa, Staphylococcus epidermidis
EHMEGNQL

SEQ ID NO: 1731319 - protein, 12 aa, Staphylococcus epidermidis
EHPEIKKPLNQL

SEQ ID NO: 1731320 - protein, 6 aa, Staphylococcus epidermidis
EHQQVE

SEQ ID NO: 1731321 - protein, 5 aa, Staphylococcus epidermidis
EHSNY

SEQ ID NO: 1731322 - protein, 9 aa, Staphylococcus epidermidis
EHVRDESER

SEQ ID NO: 1731323 - protein, 12 aa, Staphylococcus epidermidis
EIAVGASQAEVA

SEQ ID NO: 1731324 - protein, 19 aa, Staphylococcus epidermidis
EIAVNTDNSLLSKTNKIEI

SEQ ID NO: 1731325 - protein, 22 aa, Staphylococcus epidermidis
EIDKEIKDDSHSKINSKGTRDY

SEQ ID NO: 1731326 - protein, 4 aa, Staphylococcus epidermidis
EIDN

SEQ ID NO: 1731327 - protein, 5 aa, Staphylococcus epidermidis
EIEEI

SEQ ID NO: 1731328 - protein, 8 aa, Staphylococcus epidermidis
EIEQSQAN

SEQ ID NO: 1731329 - protein, 5 aa, Staphylococcus epidermidis
EIGQT

SEQ ID NO: 1731330 - protein, 5 aa, Staphylococcus epidermidis
EIGTF

SEQ ID NO: 1731331 - protein, 5 aa, Staphylococcus epidermidis
EIKEA

SEQ ID NO: 1731332 - protein, 24 aa, Staphylococcus epidermidis
EIKNNSDLSNDKRSEQTKKYNDKL

SEQ ID NO: 1731333 - protein, 9 aa, Staphylococcus epidermidis
EIKNTKDLG

SEQ ID NO: 1731334 - protein, 12 aa, Staphylococcus epidermidis
EIPKTSIKKEQS

SEQ ID NO: 1731335 - protein, 25 aa, Staphylococcus epidermidis
EIQENVTEKTEGHKFKKSAAKTTAL

SEQ ID NO: 1731336 - protein, 13 aa, Staphylococcus epidermidis
EIQESKNLSGGIY

SEQ ID NO: 1731337 - protein, 8 aa, Staphylococcus epidermidis
EISEQDQK

SEQ ID NO: 1731338 - protein, 12 aa, Staphylococcus epidermidis
EISGKIGKIKSK

SEQ ID NO: 1731339 - protein, 7 aa, Staphylococcus epidermidis
EISGSKG

SEQ ID NO: 1731340 - protein, 7 aa, Staphylococcus epidermidis
EISKKER

SEQ ID NO: 1731341 - protein, 17 aa, Staphylococcus epidermidis
EISVDQNGKPSKMNEDY

SEQ ID NO: 1731342 - protein, 9 aa, Staphylococcus epidermidis
EITHSKNET

SEQ ID NO: 1731343 - protein, 19 aa, Staphylococcus epidermidis
EITKPSETTIDEEVSDEPV

SEQ ID NO: 1731344 - protein, 19 aa, Staphylococcus epidermidis
EITKPSETTVTEDVSDEPI

SEQ ID NO: 1731345 - protein, 6 aa, Staphylococcus epidermidis
EITQDK

SEQ ID NO: 1731346 - protein, 5 aa, Staphylococcus epidermidis
EKAKL

SEQ ID NO: 1731347 - protein, 29 aa, Staphylococcus epidermidis
EKAKTEVKSNITNSDTEREVNSAKTNGLE

SEQ ID NO: 1731348 - protein, 7 aa, Staphylococcus epidermidis
EKANSVD

SEQ ID NO: 1731349 - protein, 15 aa, Staphylococcus epidermidis
EKATSGMSDEQKNAA

SEQ ID NO: 1731350 - protein, 18 aa, Staphylococcus epidermidis
EKDASIDKPNTGDATVDG

SEQ ID NO: 1731351 - protein, 10 aa, Staphylococcus epidermidis
EKDDFSKGNH

SEQ ID NO: 1731352 - protein, 9 aa, Staphylococcus epidermidis
EKDGTGYAS

SEQ ID NO: 1731353 - protein, 9 aa, Staphylococcus epidermidis
EKDKDSQRR

SEQ ID NO: 1731354 - protein, 9 aa, Staphylococcus epidermidis
EKDKKGNIT

SEQ ID NO: 1731355 - protein, 9 aa, Staphylococcus epidermidis
EKDKSSRRL

SEQ ID NO: 1731356 - protein, 6 aa, Staphylococcus epidermidis
EKDLND

SEQ ID NO: 1731357 - protein, 9 aa, Staphylococcus epidermidis
EKDQKDIQV

SEQ ID NO: 1731358 - protein, 14 aa, Staphylococcus epidermidis
EKDRQSIDSKTQLE

SEQ ID NO: 1731359 - protein, 5 aa, Staphylococcus epidermidis
EKEGY

SEQ ID NO: 1731360 - protein, 19 aa, Staphylococcus epidermidis
EKEHNPSKKKGKNTQVVSK

SEQ ID NO: 1731361 - protein, 4 aa, Staphylococcus epidermidis
EKEI

SEQ ID NO: 1731362 - protein, 8 aa, Staphylococcus epidermidis
EKEKSVKS

SEQ ID NO: 1731363 - protein, 15 aa, Staphylococcus epidermidis
EKELNKSTDNLIKEN

SEQ ID NO: 1731364 - protein, 19 aa, Staphylococcus epidermidis
EKESARNAIEQKSTQQTQF

SEQ ID NO: 1731365 - protein, 35 aa, Staphylococcus epidermidis
EKGADKKEIGKKVEKELNKKGTGTSEGQYSYQDNE

SEQ ID NO: 1731366 - protein, 35 aa, Staphylococcus epidermidis
EKGSDKKDVGKKVEKALNKKGTGVSEGQYSYEDNE

SEQ ID NO: 1731367 - protein, 5 aa, Staphylococcus epidermidis
EKGYK

SEQ ID NO: 1731368 - protein, 9 aa, Staphylococcus epidermidis
EKHKADRKL

SEQ ID NO: 1731369 - protein, 100 aa, Staphylococcus epidermidis
EKIDKPDKKARKDKKKNKNTLADTKDDVNHQTSDAKEKAQDKVNNHQSTDDNFKDKAESQINDKKDSISDQGQDLKDNASHKANDVKDNISDKAKDTFDN

SEQ ID NO: 1731370 - protein, 54 aa, Staphylococcus epidermidis
EKINEINGNAQATRDEKDAAIGNVNQAKDQALQNINNADTNGNVTSAKNTGVNA

SEQ ID NO: 1731371 - protein, 8 aa, Staphylococcus epidermidis
EKIQNAEE

SEQ ID NO: 1731372 - protein, 9 aa, Staphylococcus epidermidis
EKISKTSNY

SEQ ID NO: 1731373 - protein, 8 aa, Staphylococcus epidermidis
EKKAEEGI

SEQ ID NO: 1731374 - protein, 6 aa, Staphylococcus epidermidis
EKKDKE

SEQ ID NO: 1731375 - protein, 31 aa, Staphylococcus epidermidis
EKKKYKEEVEKREKDYKKYLSDKSSDINNAI

SEQ ID NO: 1731376 - protein, 10 aa, Staphylococcus epidermidis
EKKTAKNVKS

SEQ ID NO: 1731377 - protein, 7 aa, Staphylococcus epidermidis
EKLDTYD

SEQ ID NO: 1731378 - protein, 10 aa, Staphylococcus epidermidis
EKLNTSRQTI

SEQ ID NO: 1731379 - protein, 18 aa, Staphylococcus epidermidis
EKMKSIGNNIDNTGTKAV

SEQ ID NO: 1731380 - protein, 7 aa, Staphylococcus epidermidis
EKMRNTM

SEQ ID NO: 1731381 - protein, 9 aa, Staphylococcus epidermidis
EKMTEGGNI

SEQ ID NO: 1731382 - protein, 12 aa, Staphylococcus epidermidis
EKMTTKNNYEIE

SEQ ID NO: 1731383 - protein, 8 aa, Staphylococcus epidermidis
EKNESQLT

SEQ ID NO: 1731384 - protein, 14 aa, Staphylococcus epidermidis
EKNGLGEKSGLKKD

SEQ ID NO: 1731385 - protein, 7 aa, Staphylococcus epidermidis
EKNKDNY

SEQ ID NO: 1731386 - protein, 7 aa, Staphylococcus epidermidis
EKNKDTE

SEQ ID NO: 1731387 - protein, 9 aa, Staphylococcus epidermidis
EKNPEKTTE

SEQ ID NO: 1731388 - protein, 6 aa, Staphylococcus epidermidis
EKNPMG

SEQ ID NO: 1731389 - protein, 17 aa, Staphylococcus epidermidis
EKNQNKNLKFDDPNKEE

SEQ ID NO: 1731390 - protein, 7 aa, Staphylococcus epidermidis
EKNTDEV

SEQ ID NO: 1731391 - protein, 15 aa, Staphylococcus epidermidis
EKPETLSSGKKGISP

SEQ ID NO: 1731392 - protein, 7 aa, Staphylococcus epidermidis
EKPKGNK

SEQ ID NO: 1731393 - protein, 11 aa, Staphylococcus epidermidis
EKPKSKNAPHP

SEQ ID NO: 1731394 - protein, 5 aa, Staphylococcus epidermidis
EKPNE

SEQ ID NO: 1731395 - protein, 12 aa, Staphylococcus epidermidis
EKPPQPIQKNNT

SEQ ID NO: 1731396 - protein, 6 aa, Staphylococcus epidermidis
EKQANN

SEQ ID NO: 1731397 - protein, 4 aa, Staphylococcus epidermidis
EKQF

SEQ ID NO: 1731398 - protein, 23 aa, Staphylococcus epidermidis
EKQLEEDPETPKIEKDKGKEFTT

SEQ ID NO: 1731399 - protein, 13 aa, Staphylococcus epidermidis
EKRADKLKEVERR

SEQ ID NO: 1731400 - protein, 12 aa, Staphylococcus epidermidis
EKREARRNKEKE

SEQ ID NO: 1731401 - protein, 10 aa, Staphylococcus epidermidis
EKSEQEYSQN

SEQ ID NO: 1731402 - protein, 8 aa, Staphylococcus epidermidis
EKSGKITK

SEQ ID NO: 1731403 - protein, 9 aa, Staphylococcus epidermidis
EKSIPQQQG

SEQ ID NO: 1731404 - protein, 12 aa, Staphylococcus epidermidis
EKSKNKSLAIQN

SEQ ID NO: 1731405 - protein, 17 aa, Staphylococcus epidermidis
EKSNKHDTVLDKLLDKL

SEQ ID NO: 1731406 - protein, 8 aa, Staphylococcus epidermidis
EKTPAPPI

SEQ ID NO: 1731407 - protein, 8 aa, Staphylococcus epidermidis
EKTRNTMN

SEQ ID NO: 1731408 - protein, 7 aa, Staphylococcus epidermidis
EKTTSSG

SEQ ID NO: 1731409 - protein, 11 aa, Staphylococcus epidermidis
EKTVETEDASE

SEQ ID NO: 1731410 - protein, 15 aa, Staphylococcus epidermidis
EKVKDDVKEQESPFT

SEQ ID NO: 1731411 - protein, 8 aa, Staphylococcus epidermidis
EKVNQTKN

SEQ ID NO: 1731412 - protein, 58 aa, Staphylococcus epidermidis
EKVNSQNGLITNNNDATDEEKASAKQLVEAAKNKAVTNINESQTNAQVDNAKDSGMNE

SEQ ID NO: 1731413 - protein, 9 aa, Staphylococcus epidermidis
EKVRGDSER

SEQ ID NO: 1731414 - protein, 13 aa, Staphylococcus epidermidis
EKYHDKKSKKNYK

SEQ ID NO: 1731415 - protein, 6 aa, Staphylococcus epidermidis
EKYKKT

SEQ ID NO: 1731416 - protein, 10 aa, Staphylococcus epidermidis
EKYKSKAKKL

SEQ ID NO: 1731417 - protein, 7 aa, Staphylococcus epidermidis
EKYPHAN

SEQ ID NO: 1731418 - protein, 7 aa, Staphylococcus epidermidis
ELGGTDT

SEQ ID NO: 1731419 - protein, 26 aa, Staphylococcus epidermidis
ELGNKEANNELKEKVSANFDTKKADA

SEQ ID NO: 1731420 - protein, 6 aa, Staphylococcus epidermidis
ELGPKR

SEQ ID NO: 1731421 - protein, 7 aa, Staphylococcus epidermidis
ELGTDNV

SEQ ID NO: 1731422 - protein, 18 aa, Staphylococcus epidermidis
ELKDGSYEVGKDLEPGHY

SEQ ID NO: 1731423 - protein, 18 aa, Staphylococcus epidermidis
ELNNAKSALRADKEELQH

SEQ ID NO: 1731424 - protein, 5 aa, Staphylococcus epidermidis
ELPAD

SEQ ID NO: 1731425 - protein, 9 aa, Staphylococcus epidermidis
ELPADTEFN

SEQ ID NO: 1731426 - protein, 15 aa, Staphylococcus epidermidis
ELPAKKTTQNGTFNG

SEQ ID NO: 1731427 - protein, 11 aa, Staphylococcus epidermidis
ELQGNDPNITY

SEQ ID NO: 1731428 - protein, 18 aa, Staphylococcus epidermidis
ELQTKVNDKIKNAKDLDE

SEQ ID NO: 1731429 - protein, 4 aa, Staphylococcus epidermidis
ELRQ

SEQ ID NO: 1731430 - protein, 13 aa, Staphylococcus epidermidis
ELRSKESLNNAEL

SEQ ID NO: 1731431 - protein, 14 aa, Staphylococcus epidermidis
ELSKENLNEEKPTK

SEQ ID NO: 1731432 - protein, 7 aa, Staphylococcus epidermidis
ELTRDKK

SEQ ID NO: 1731433 - protein, 8 aa, Staphylococcus epidermidis
EMDEASDQ

SEQ ID NO: 1731434 - protein, 21 aa, Staphylococcus epidermidis
EMDQEEEEKLKNQKFPQSVER

SEQ ID NO: 1731435 - protein, 5 aa, Staphylococcus epidermidis
EMNPG

SEQ ID NO: 1731436 - protein, 5 aa, Staphylococcus epidermidis
EMSPE

SEQ ID NO: 1731437 - protein, 16 aa, Staphylococcus epidermidis
ENANPTLNKSKIEQKL

SEQ ID NO: 1731438 - protein, 6 aa, Staphylococcus epidermidis
ENAPSI

SEQ ID NO: 1731439 - protein, 6 aa, Staphylococcus epidermidis
ENAQRS

SEQ ID NO: 1731440 - protein, 6 aa, Staphylococcus epidermidis
ENATNL

SEQ ID NO: 1731441 - protein, 47 aa, Staphylococcus epidermidis
ENAVNTSLTSAKNIKTAKHTATTKKSITHYSSKKSKKSSRAKAKKEY

SEQ ID NO: 1731442 - protein, 4 aa, Staphylococcus epidermidis
ENDL

SEQ ID NO: 1731443 - protein, 4 aa, Staphylococcus epidermidis
ENDT

SEQ ID NO: 1731444 - protein, 9 aa, Staphylococcus epidermidis
ENEAGKSTV

SEQ ID NO: 1731445 - protein, 6 aa, Staphylococcus epidermidis
ENEEND

SEQ ID NO: 1731446 - protein, 6 aa, Staphylococcus epidermidis
ENEGLY

SEQ ID NO: 1731447 - protein, 9 aa, Staphylococcus epidermidis
ENELTDNEI

SEQ ID NO: 1731448 - protein, 7 aa, Staphylococcus epidermidis
ENENQEI

SEQ ID NO: 1731449 - protein, 9 aa, Staphylococcus epidermidis
ENENQEIRY

SEQ ID NO: 1731450 - protein, 4 aa, Staphylococcus epidermidis
ENES

SEQ ID NO: 1731451 - protein, 4 aa, Staphylococcus epidermidis
ENEY

SEQ ID NO: 1731452 - protein, 5 aa, Staphylococcus epidermidis
ENFGK

SEQ ID NO: 1731453 - protein, 7 aa, Staphylococcus epidermidis
ENGEGLP

SEQ ID NO: 1731454 - protein, 5 aa, Staphylococcus epidermidis
ENGKM

SEQ ID NO: 1731455 - protein, 12 aa, Staphylococcus epidermidis
ENGKSNKETKSK

SEQ ID NO: 1731456 - protein, 10 aa, Staphylococcus epidermidis
ENGNPSVNEV

SEQ ID NO: 1731457 - protein, 10 aa, Staphylococcus epidermidis
ENKENNDELV

SEQ ID NO: 1731458 - protein, 12 aa, Staphylococcus epidermidis
ENKGHNQSKDTY

SEQ ID NO: 1731459 - protein, 13 aa, Staphylococcus epidermidis
ENKGHTQSKETTY

SEQ ID NO: 1731460 - protein, 85 aa, Staphylococcus epidermidis
ENKPNQTEHASTMKEKSDINNVKTTRNKNIEKSIHKDKQNSVNLKQNTKDQNNNANDEVASPTSEQNAAIAQAKSYANSLPISKK

SEQ ID NO: 1731461 - protein, 68 aa, Staphylococcus epidermidis
ENKTNQIEHASTMKEKSNINNVKTTKNKNIEKSTQTDKQNSVNLKQNTKDQNNNANDEETSTTSEQNV

SEQ ID NO: 1731462 - protein, 82 aa, Staphylococcus epidermidis
ENKTNQIEHASTMKEKSNINNVKTTKNKNMEKSTQTDKQNSVNLKQNTKDQNNNANDEAASPTSEQNAAIAQAKSYANTLPI

SEQ ID NO: 1731463 - protein, 7 aa, Staphylococcus epidermidis
ENLDQVE

SEQ ID NO: 1731464 - protein, 5 aa, Staphylococcus epidermidis
ENLKN

SEQ ID NO: 1731465 - protein, 4 aa, Staphylococcus epidermidis
ENNL

SEQ ID NO: 1731466 - protein, 11 aa, Staphylococcus epidermidis
ENNQNGDFNEN

SEQ ID NO: 1731467 - protein, 7 aa, Staphylococcus epidermidis
ENPGEYD

SEQ ID NO: 1731468 - protein, 5 aa, Staphylococcus epidermidis
ENPHL

SEQ ID NO: 1731469 - protein, 33 aa, Staphylococcus epidermidis
ENPNKGNKSNHTEQFEKSNNHTENPKPKQGVGT

SEQ ID NO: 1731470 - protein, 32 aa, Staphylococcus epidermidis
ENPNKNSKTTKTEQFKQANKDAENPKPKEGIG

SEQ ID NO: 1731471 - protein, 32 aa, Staphylococcus epidermidis
ENPNKNSKTTKTEQFKQVNKDAENPKPKEGIG

SEQ ID NO: 1731472 - protein, 16 aa, Staphylococcus epidermidis
ENQLKGAKGNTSQLSS

SEQ ID NO: 1731473 - protein, 11 aa, Staphylococcus epidermidis
ENQPRAKEGLA

SEQ ID NO: 1731474 - protein, 37 aa, Staphylococcus epidermidis
ENRVNESKYELDKTKTVPLTRDELNKKMKSSEREHDL

SEQ ID NO: 1731475 - protein, 4 aa, Staphylococcus epidermidis
ENSS

SEQ ID NO: 1731476 - protein, 7 aa, Staphylococcus epidermidis
ENSTEAS

SEQ ID NO: 1731477 - protein, 4 aa, Staphylococcus epidermidis
ENTG

SEQ ID NO: 1731478 - protein, 10 aa, Staphylococcus epidermidis
ENTGEIQQNE

SEQ ID NO: 1731479 - protein, 15 aa, Staphylococcus epidermidis
ENTPDVTHEERNDAI

SEQ ID NO: 1731480 - protein, 5 aa, Staphylococcus epidermidis
ENVLS

SEQ ID NO: 1731481 - protein, 26 aa, Staphylococcus epidermidis
EPARQQEFQSPEERYYPSHNKKKRSK

SEQ ID NO: 1731482 - protein, 14 aa, Staphylococcus epidermidis
EPASEAVSQTSNIT

SEQ ID NO: 1731483 - protein, 12 aa, Staphylococcus epidermidis
EPENGYGGRQVS

SEQ ID NO: 1731484 - protein, 14 aa, Staphylococcus epidermidis
EPHSRPRDDYYEED

SEQ ID NO: 1731485 - protein, 45 aa, Staphylococcus epidermidis
EPIHTKKEDRNTRRQFNRNAQQQDSYNGITDNQPDEDTSSDQLYS

SEQ ID NO: 1731486 - protein, 9 aa, Staphylococcus epidermidis
EPKGEEMEA

SEQ ID NO: 1731487 - protein, 10 aa, Staphylococcus epidermidis
EPKGKNMESR

SEQ ID NO: 1731488 - protein, 17 aa, Staphylococcus epidermidis
EPLDRQTNDEKHERRDM

SEQ ID NO: 1731489 - protein, 5 aa, Staphylococcus epidermidis
EPLNP

SEQ ID NO: 1731490 - protein, 44 aa, Staphylococcus epidermidis
EPMHTKKEDRNTRRQFNRNAQQQDSYNGITDNQPDEDISSNQLY

SEQ ID NO: 1731491 - protein, 5 aa, Staphylococcus epidermidis
EPMPA

SEQ ID NO: 1731492 - protein, 7 aa, Staphylococcus epidermidis
EPQDKEA

SEQ ID NO: 1731493 - protein, 17 aa, Staphylococcus epidermidis
EPQIEKSALSEDQQRQI

SEQ ID NO: 1731494 - protein, 11 aa, Staphylococcus epidermidis
EPSDKTRSIVE

SEQ ID NO: 1731495 - protein, 16 aa, Staphylococcus epidermidis
EPTAKASIKKGYKRLP

SEQ ID NO: 1731496 - protein, 15 aa, Staphylococcus epidermidis
EPTIKKGKKKTNVPN

SEQ ID NO: 1731497 - protein, 11 aa, Staphylococcus epidermidis
EPTSGHGKKAL

SEQ ID NO: 1731498 - protein, 8 aa, Staphylococcus epidermidis
EPVNTKYS

SEQ ID NO: 1731499 - protein, 4 aa, Staphylococcus epidermidis
EQAK

SEQ ID NO: 1731500 - protein, 9 aa, Staphylococcus epidermidis
EQDLDNAGL

SEQ ID NO: 1731501 - protein, 10 aa, Staphylococcus epidermidis
EQEPDTRNKI

SEQ ID NO: 1731502 - protein, 46 aa, Staphylococcus epidermidis
EQFQQSLPSTKNQSINNNQPSTTAENNQQQSKAEGSISEAGEEANI

SEQ ID NO: 1731503 - protein, 8 aa, Staphylococcus epidermidis
EQGDSAQG

SEQ ID NO: 1731504 - protein, 44 aa, Staphylococcus epidermidis
EQIPQGHKDEFDPNAPVDSKTEVPGKPGVKNPDTGEVVTPPVDD

SEQ ID NO: 1731505 - protein, 5 aa, Staphylococcus epidermidis
EQISG

SEQ ID NO: 1731506 - protein, 5 aa, Staphylococcus epidermidis
EQKVY

SEQ ID NO: 1731507 - protein, 9 aa, Staphylococcus epidermidis
EQKYNPDNG

SEQ ID NO: 1731508 - protein, 11 aa, Staphylococcus epidermidis
EQLGDPSKGYA

SEQ ID NO: 1731509 - protein, 32 aa, Staphylococcus epidermidis
EQLQQTIQPAASTDGMTQDSTRNYNNKRQAVE

SEQ ID NO: 1731510 - protein, 6 aa, Staphylococcus epidermidis
EQNDHT

SEQ ID NO: 1731511 - protein, 7 aa, Staphylococcus epidermidis
EQNGRFD

SEQ ID NO: 1731512 - protein, 7 aa, Staphylococcus epidermidis
EQNKIKT

SEQ ID NO: 1731513 - protein, 4 aa, Staphylococcus epidermidis
EQNN

SEQ ID NO: 1731514 - protein, 8 aa, Staphylococcus epidermidis
EQQNEIET

SEQ ID NO: 1731515 - protein, 6 aa, Staphylococcus epidermidis
EQQYNK

SEQ ID NO: 1731516 - protein, 17 aa, Staphylococcus epidermidis
EQTQGGSMNSEVGGTSE

SEQ ID NO: 1731517 - protein, 12 aa, Staphylococcus epidermidis
EQTYKNLNNGGL

SEQ ID NO: 1731518 - protein, 8 aa, Staphylococcus epidermidis
EQYNNKKE

SEQ ID NO: 1731519 - protein, 28 aa, Staphylococcus epidermidis
EQYQKETQSITEEYDKRVNSIKSNQNKI

SEQ ID NO: 1731520 - protein, 29 aa, Staphylococcus epidermidis
ERATSNVKTSKDALHGERELNDNKNSKTF

SEQ ID NO: 1731521 - protein, 29 aa, Staphylococcus epidermidis
ERATSNVKTSKDALHGKRELNDNKNSKTF

SEQ ID NO: 1731522 - protein, 24 aa, Staphylococcus epidermidis
ERFDNDKKYREYRKRHRFEEKYDL

SEQ ID NO: 1731523 - protein, 24 aa, Staphylococcus epidermidis
ERFDNDKKYREYRKRKPFEEKYNL

SEQ ID NO: 1731524 - protein, 6 aa, Staphylococcus epidermidis
ERHKGN

SEQ ID NO: 1731525 - protein, 6 aa, Staphylococcus epidermidis
ERIDGD

SEQ ID NO: 1731526 - protein, 11 aa, Staphylococcus epidermidis
ERKETIKSKDI

SEQ ID NO: 1731527 - protein, 53 aa, Staphylococcus epidermidis
ERLDQAINSQPSLNGMTQESINNYTAKRRDAQNIASSAETIINNGDASIEQIT

SEQ ID NO: 1731528 - protein, 8 aa, Staphylococcus epidermidis
ERLSSERI

SEQ ID NO: 1731529 - protein, 13 aa, Staphylococcus epidermidis
ERNKKEMYPPKTV

SEQ ID NO: 1731530 - protein, 16 aa, Staphylococcus epidermidis
ERNNRGEDKHDTFTDR

SEQ ID NO: 1731531 - protein, 15 aa, Staphylococcus epidermidis
ERNQATDAHPTGSSL

SEQ ID NO: 1731532 - protein, 7 aa, Staphylococcus epidermidis
ERNVDQN

SEQ ID NO: 1731533 - protein, 10 aa, Staphylococcus epidermidis
ERPPQPVQKN

SEQ ID NO: 1731534 - protein, 5 aa, Staphylococcus epidermidis
ERPQN

SEQ ID NO: 1731535 - protein, 8 aa, Staphylococcus epidermidis
ERQHHDST

SEQ ID NO: 1731536 - protein, 12 aa, Staphylococcus epidermidis
ERSIEGETVGIN

SEQ ID NO: 1731537 - protein, 18 aa, Staphylococcus epidermidis
ERTDIGQKNSKKFNKVNL

SEQ ID NO: 1731538 - protein, 17 aa, Staphylococcus epidermidis
ERTEALSESENDLVEDG

SEQ ID NO: 1731539 - protein, 7 aa, Staphylococcus epidermidis
ERTKGTL

SEQ ID NO: 1731540 - protein, 7 aa, Staphylococcus epidermidis
ERTSGTL

SEQ ID NO: 1731541 - protein, 7 aa, Staphylococcus epidermidis
ERTTGTL

SEQ ID NO: 1731542 - protein, 22 aa, Staphylococcus epidermidis
ERYPDEHQNQSTEIASKEKVEY

SEQ ID NO: 1731543 - protein, 8 aa, Staphylococcus epidermidis
ESAKYNAS

SEQ ID NO: 1731544 - protein, 4 aa, Staphylococcus epidermidis
ESAL

SEQ ID NO: 1731545 - protein, 9 aa, Staphylococcus epidermidis
ESDAQSVRQ

SEQ ID NO: 1731546 - protein, 8 aa, Staphylococcus epidermidis
ESDTANLD

SEQ ID NO: 1731547 - protein, 12 aa, Staphylococcus epidermidis
ESEDEETPPKRA

SEQ ID NO: 1731548 - protein, 19 aa, Staphylococcus epidermidis
ESEDNSGQAVTNKVEGLPA

SEQ ID NO: 1731549 - protein, 9 aa, Staphylococcus epidermidis
ESESVSQSP

SEQ ID NO: 1731550 - protein, 9 aa, Staphylococcus epidermidis
ESETVQDTL

SEQ ID NO: 1731551 - protein, 8 aa, Staphylococcus epidermidis
ESETVRDT

SEQ ID NO: 1731552 - protein, 8 aa, Staphylococcus epidermidis
ESEVGQGT

SEQ ID NO: 1731553 - protein, 4 aa, Staphylococcus epidermidis
ESFA

SEQ ID NO: 1731554 - protein, 14 aa, Staphylococcus epidermidis
ESFEEEQVRKNQRQ

SEQ ID NO: 1731555 - protein, 10 aa, Staphylococcus epidermidis
ESFKDDKSAL

SEQ ID NO: 1731556 - protein, 13 aa, Staphylococcus epidermidis
ESGWGKSQNAIQH

SEQ ID NO: 1731557 - protein, 17 aa, Staphylococcus epidermidis
ESHANPLSLSEGPAEIE

SEQ ID NO: 1731558 - protein, 7 aa, Staphylococcus epidermidis
ESHDTVS

SEQ ID NO: 1731559 - protein, 25 aa, Staphylococcus epidermidis
ESHLNNVQKDNFKAQVNSAPNHNAL

SEQ ID NO: 1731560 - protein, 5 aa, Staphylococcus epidermidis
ESIDK

SEQ ID NO: 1731561 - protein, 6 aa, Staphylococcus epidermidis
ESIGNK

SEQ ID NO: 1731562 - protein, 13 aa, Staphylococcus epidermidis
ESIKNNANIVSNG

SEQ ID NO: 1731563 - protein, 8 aa, Staphylococcus epidermidis
ESIKTSHD

SEQ ID NO: 1731564 - protein, 9 aa, Staphylococcus epidermidis
ESINPKTIE

SEQ ID NO: 1731565 - protein, 12 aa, Staphylococcus epidermidis
ESKELVEKKDTP

SEQ ID NO: 1731566 - protein, 7 aa, Staphylococcus epidermidis
ESKGDEL

SEQ ID NO: 1731567 - protein, 60 aa, Staphylococcus epidermidis
ESKQNSNNSHIQKNANQTKNITATKEDSEGKQQHTPNQNKRNKQQKVEKTSSKIEKRTFN

SEQ ID NO: 1731568 - protein, 5 aa, Staphylococcus epidermidis
ESKSF

SEQ ID NO: 1731569 - protein, 4 aa, Staphylococcus epidermidis
ESKV

SEQ ID NO: 1731570 - protein, 4 aa, Staphylococcus epidermidis
ESLE

SEQ ID NO: 1731571 - protein, 13 aa, Staphylococcus epidermidis
ESLENEHRANSNI

SEQ ID NO: 1731572 - protein, 15 aa, Staphylococcus epidermidis
ESLSRYQSTNGRQNI

SEQ ID NO: 1731573 - protein, 5 aa, Staphylococcus epidermidis
ESNAS

SEQ ID NO: 1731574 - protein, 10 aa, Staphylococcus epidermidis
ESNPTDLNAT

SEQ ID NO: 1731575 - protein, 5 aa, Staphylococcus epidermidis
ESNQT

SEQ ID NO: 1731576 - protein, 15 aa, Staphylococcus epidermidis
ESNYTKPLKNTTSIS

SEQ ID NO: 1731577 - protein, 5 aa, Staphylococcus epidermidis
ESPDF

SEQ ID NO: 1731578 - protein, 7 aa, Staphylococcus epidermidis
ESPFNKR

SEQ ID NO: 1731579 - protein, 5 aa, Staphylococcus epidermidis
ESQAG

SEQ ID NO: 1731580 - protein, 12 aa, Staphylococcus epidermidis
ESQGNSDLSEES

SEQ ID NO: 1731581 - protein, 6 aa, Staphylococcus epidermidis
ESQNRD

SEQ ID NO: 1731582 - protein, 8 aa, Staphylococcus epidermidis
ESQRPHYN

SEQ ID NO: 1731583 - protein, 13 aa, Staphylococcus epidermidis
ESRAGRLTDTFPG

SEQ ID NO: 1731584 - protein, 7 aa, Staphylococcus epidermidis
ESSSPKL

SEQ ID NO: 1731585 - protein, 21 aa, Staphylococcus epidermidis
ESTEAAMEETGDLKVPQDEGV

SEQ ID NO: 1731586 - protein, 9 aa, Staphylococcus epidermidis
ESTLPTTSN

SEQ ID NO: 1731587 - protein, 4 aa, Staphylococcus epidermidis
ESTN

SEQ ID NO: 1731588 - protein, 9 aa, Staphylococcus epidermidis
ESTNDQVEK

SEQ ID NO: 1731589 - protein, 12 aa, Staphylococcus epidermidis
ESTNKDELGPLK

SEQ ID NO: 1731590 - protein, 7 aa, Staphylococcus epidermidis
ESTYGYR

SEQ ID NO: 1731591 - protein, 16 aa, Staphylococcus epidermidis
ESTYGYRQRIRYEEQR

SEQ ID NO: 1731592 - protein, 7 aa, Staphylococcus epidermidis
ESVSQSP

SEQ ID NO: 1731593 - protein, 26 aa, Staphylococcus epidermidis
ESYEGHNLDTSKYTYKEPEKTDDGDW

SEQ ID NO: 1731594 - protein, 24 aa, Staphylococcus epidermidis
ETAQNNLHGDQKLTHAQQDAANAI

SEQ ID NO: 1731595 - protein, 5 aa, Staphylococcus epidermidis
ETARD

SEQ ID NO: 1731596 - protein, 4 aa, Staphylococcus epidermidis
ETDT

SEQ ID NO: 1731597 - protein, 6 aa, Staphylococcus epidermidis
ETDTEE

SEQ ID NO: 1731598 - protein, 4 aa, Staphylococcus epidermidis
ETEL

SEQ ID NO: 1731599 - protein, 5 aa, Staphylococcus epidermidis
ETEQN

SEQ ID NO: 1731600 - protein, 13 aa, Staphylococcus epidermidis
ETERTNELYEDSK

SEQ ID NO: 1731601 - protein, 13 aa, Staphylococcus epidermidis
ETGESEKQTESKK

SEQ ID NO: 1731602 - protein, 7 aa, Staphylococcus epidermidis
ETGKKHP

SEQ ID NO: 1731603 - protein, 7 aa, Staphylococcus epidermidis
ETGKKHS

SEQ ID NO: 1731604 - protein, 8 aa, Staphylococcus epidermidis
ETGKQTAK

SEQ ID NO: 1731605 - protein, 18 aa, Staphylococcus epidermidis
ETGNGKSELAKGVKDGHH

SEQ ID NO: 1731606 - protein, 18 aa, Staphylococcus epidermidis
ETGNGQSDLSKGIKEGDH

SEQ ID NO: 1731607 - protein, 18 aa, Staphylococcus epidermidis
ETGNGQSDLSNGIKEGDH

SEQ ID NO: 1731608 - protein, 23 aa, Staphylococcus epidermidis
ETGVEASSKDDAKNAAAQKGNPL

SEQ ID NO: 1731609 - protein, 13 aa, Staphylococcus epidermidis
ETIPGEGASGARI

SEQ ID NO: 1731610 - protein, 14 aa, Staphylococcus epidermidis
ETIPPKKDGDSEKV

SEQ ID NO: 1731611 - protein, 8 aa, Staphylococcus epidermidis
ETKSINAD

SEQ ID NO: 1731612 - protein, 19 aa, Staphylococcus epidermidis
ETLDNKQDVKKHDREDMRE

SEQ ID NO: 1731613 - protein, 8 aa, Staphylococcus epidermidis
ETNEKYGL

SEQ ID NO: 1731614 - protein, 12 aa, Staphylococcus epidermidis
ETQATLSSDTIN

SEQ ID NO: 1731615 - protein, 4 aa, Staphylococcus epidermidis
ETQE

SEQ ID NO: 1731616 - protein, 9 aa, Staphylococcus epidermidis
ETQGGVGAE

SEQ ID NO: 1731617 - protein, 9 aa, Staphylococcus epidermidis
ETRSESRLQ

SEQ ID NO: 1731618 - protein, 6 aa, Staphylococcus epidermidis
ETRTRT

SEQ ID NO: 1731619 - protein, 21 aa, Staphylococcus epidermidis
ETTPIRKDTTYKLSQSIPKQV

SEQ ID NO: 1731620 - protein, 15 aa, Staphylococcus epidermidis
ETVENTKLKGKFTPN

SEQ ID NO: 1731621 - protein, 8 aa, Staphylococcus epidermidis
ETVTQGQP

SEQ ID NO: 1731622 - protein, 23 aa, Staphylococcus epidermidis
EVAETEKRLREARIKEREAVSHE

SEQ ID NO: 1731623 - protein, 5 aa, Staphylococcus epidermidis
EVGGP

SEQ ID NO: 1731624 - protein, 6 aa, Staphylococcus epidermidis
EVKARS

SEQ ID NO: 1731625 - protein, 18 aa, Staphylococcus epidermidis
EVKNEALNQVSQAHSNND

SEQ ID NO: 1731626 - protein, 19 aa, Staphylococcus epidermidis
EVKNEALNQVSQAHSNNDV

SEQ ID NO: 1731627 - protein, 9 aa, Staphylococcus epidermidis
EVRESSKEV

SEQ ID NO: 1731628 - protein, 12 aa, Staphylococcus epidermidis
EVSSQAEEKNQS

SEQ ID NO: 1731629 - protein, 5 aa, Staphylococcus epidermidis
EVTDE

SEQ ID NO: 1731630 - protein, 17 aa, Staphylococcus epidermidis
EVVTPQPKNSNTTPTPN

SEQ ID NO: 1731631 - protein, 12 aa, Staphylococcus epidermidis
EYAGKAARESKL

SEQ ID NO: 1731632 - protein, 13 aa, Staphylococcus epidermidis
EYDNNTNKEQTKG

SEQ ID NO: 1731633 - protein, 9 aa, Staphylococcus epidermidis
EYEKKDNVG

SEQ ID NO: 1731634 - protein, 38 aa, Staphylococcus epidermidis
EYEQPRDEKENRNTRRQLRKERRQKEAFEAQQYEQPYD

SEQ ID NO: 1731635 - protein, 6 aa, Staphylococcus epidermidis
EYLGKD

SEQ ID NO: 1731636 - protein, 6 aa, Staphylococcus epidermidis
EYLGKS

SEQ ID NO: 1731637 - protein, 10 aa, Staphylococcus epidermidis
EYLGKSKKFG

SEQ ID NO: 1731638 - protein, 6 aa, Staphylococcus epidermidis
EYPEED

SEQ ID NO: 1731639 - protein, 7 aa, Staphylococcus epidermidis
EYPEEEK

SEQ ID NO: 1731640 - protein, 9 aa, Staphylococcus epidermidis
EYQLNNEDV

SEQ ID NO: 1731641 - protein, 6 aa, Staphylococcus epidermidis
EYSNKN

SEQ ID NO: 1731642 - protein, 24 aa, Staphylococcus epidermidis
EYTDRGKNIVAEQTDPNLSPANIN

SEQ ID NO: 1731643 - protein, 9 aa, Staphylococcus epidermidis
EYTQNRNAL

SEQ ID NO: 1731644 - protein, 4 aa, Staphylococcus epidermidis
EYTY

SEQ ID NO: 1731645 - protein, 10 aa, Staphylococcus epidermidis
FAKKNNIKTI

SEQ ID NO: 1731646 - protein, 13 aa, Staphylococcus epidermidis
FANTQKEVAPKEE

SEQ ID NO: 1731647 - protein, 484 aa, Staphylococcus epidermidis
FDDDSDSDSDADSDSDSDSDSDADSDSDADSDSDSDSDSDSDSDSDSDSDSDSDSDSDSDADSDSDADSDSDSDSDSDSDSDSDSDSDSDSDSDSDSDADSDSDADSDSDADSDSDADSDSDSDSDSDADSDSDSDSDSDADSDSDSDSDSDADSDSDSDSDSDADSDSDSDSDSDADSDSDSDSDSDSDSDSDSDSDSDSDSDSDSDSDSDSDSDSDSDADSDSDSDSDSDADSDSDADSDSDSDSDSDSDSDSDADSDSDSDSDSDSDSDSDADSDSDSDSDSDAESDSDSDSDSDSDSDSDSDSDSDSDSDSDSDSDSDADSDSDSDSDSDSDSDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTL

SEQ ID NO: 1731648 - protein, 488 aa, Staphylococcus epidermidis
FDDDSDSDSDADSDSDSDSDSDADSDSDSDSDSDSDSDSDSDSDSDSDSDSDSDADSDSDSDSDSDADSDSDSDSDSDSDSDSDADSDSDSDSDSDADSDSDSDSDSDADSDSDSDSDSDSDSDSDSDSDSDSDSDSDSDSDSDSDADSDSDSDSDSDADSDSDSDSDSDADSDSDADSDSDSDSDSDADSDSDADSDSDSDSDSDADSDSDSDSDSDSDSDSDSDSDSDSDSDSDADSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDKNAKDKLPDTGANEDHDSKGTL

SEQ ID NO: 1731649 - protein, 190 aa, Staphylococcus epidermidis
FDDDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTL

SEQ ID NO: 1731650 - protein, 17 aa, Staphylococcus epidermidis
FDETTNTISGTPSEVGS

SEQ ID NO: 1731651 - protein, 18 aa, Staphylococcus epidermidis
FDETTNTISGTPSEVGSY

SEQ ID NO: 1731652 - protein, 18 aa, Staphylococcus epidermidis
FDETTNTISGTPSKVGSY

SEQ ID NO: 1731653 - protein, 47 aa, Staphylococcus epidermidis
FDNEAKSSETTSNSQENNHKKDVSTNSEQEINNNNDGESSISEAGEV

SEQ ID NO: 1731654 - protein, 10 aa, Staphylococcus epidermidis
FDNPKTKTEH

SEQ ID NO: 1731655 - protein, 16 aa, Staphylococcus epidermidis
FDSATNTISGTPTKVG

SEQ ID NO: 1731656 - protein, 11 aa, Staphylococcus epidermidis
FDTGEAKNYQA

SEQ ID NO: 1731657 - protein, 10 aa, Staphylococcus epidermidis
FEDTENNKEI

SEQ ID NO: 1731658 - protein, 31 aa, Staphylococcus epidermidis
FEGKNIAAQKGTDQEKIAQTEIEDSKISSLN

SEQ ID NO: 1731659 - protein, 31 aa, Staphylococcus epidermidis
FEGKTIAAQKGTDQEKIAQTEIEDSKISSLN

SEQ ID NO: 1731660 - protein, 10 aa, Staphylococcus epidermidis
FENISKSTSE

SEQ ID NO: 1731661 - protein, 32 aa, Staphylococcus epidermidis
FGEAAEPLENEIENYEPKLNEYESLKSEGNYV

SEQ ID NO: 1731662 - protein, 7 aa, Staphylococcus epidermidis
FGEPELK

SEQ ID NO: 1731663 - protein, 10 aa, Staphylococcus epidermidis
FGKTNKSGVP

SEQ ID NO: 1731664 - protein, 53 aa, Staphylococcus epidermidis
FGNTHTKSKPSHPTQLNPFQSKKDKPNPNFNRDADKKPQPKKEFKEMKPSHHT

SEQ ID NO: 1731665 - protein, 9 aa, Staphylococcus epidermidis
FIDNDKQKY

SEQ ID NO: 1731666 - protein, 12 aa, Staphylococcus epidermidis
FKDEYNKAHPQD

SEQ ID NO: 1731667 - protein, 10 aa, Staphylococcus epidermidis
FKDNKKDSLG

SEQ ID NO: 1731668 - protein, 6 aa, Staphylococcus epidermidis
FKKDDG

SEQ ID NO: 1731669 - protein, 10 aa, Staphylococcus epidermidis
FKPDMQELPS

SEQ ID NO: 1731670 - protein, 18 aa, Staphylococcus epidermidis
FKPEEGKIKKRSKKLYTE

SEQ ID NO: 1731671 - protein, 4 aa, Staphylococcus epidermidis
FKPN

SEQ ID NO: 1731672 - protein, 6 aa, Staphylococcus epidermidis
FKPNSY

SEQ ID NO: 1731673 - protein, 11 aa, Staphylococcus epidermidis
FKPSDNKNIFE

SEQ ID NO: 1731674 - protein, 5 aa, Staphylococcus epidermidis
FKPSS

SEQ ID NO: 1731675 - protein, 4 aa, Staphylococcus epidermidis
FKRT

SEQ ID NO: 1731676 - protein, 8 aa, Staphylococcus epidermidis
FKSVPGHG

SEQ ID NO: 1731677 - protein, 7 aa, Staphylococcus epidermidis
FKTTRSG

SEQ ID NO: 1731678 - protein, 10 aa, Staphylococcus epidermidis
FNAEPEKQHA

SEQ ID NO: 1731679 - protein, 20 aa, Staphylococcus epidermidis
FNEDEQPKHNYDNAVQAGQR

SEQ ID NO: 1731680 - protein, 9 aa, Staphylococcus epidermidis
FNEEKKPTC

SEQ ID NO: 1731681 - protein, 6 aa, Staphylococcus epidermidis
FNGKES

SEQ ID NO: 1731682 - protein, 6 aa, Staphylococcus epidermidis
FNKESK

SEQ ID NO: 1731683 - protein, 10 aa, Staphylococcus epidermidis
FNKNDTPATM

SEQ ID NO: 1731684 - protein, 11 aa, Staphylococcus epidermidis
FNKQQKDYSQN

SEQ ID NO: 1731685 - protein, 11 aa, Staphylococcus epidermidis
FNKSEREMGKA

SEQ ID NO: 1731686 - protein, 4 aa, Staphylococcus epidermidis
FNKY

SEQ ID NO: 1731687 - protein, 20 aa, Staphylococcus epidermidis
FNNPKTKTEHNFNSQDRQCP

SEQ ID NO: 1731688 - protein, 8 aa, Staphylococcus epidermidis
FNPKPKDL

SEQ ID NO: 1731689 - protein, 17 aa, Staphylococcus epidermidis
FNSGRPSVDEEQEDDER

SEQ ID NO: 1731690 - protein, 17 aa, Staphylococcus epidermidis
FNSKDLKGTNGNMKIPN

SEQ ID NO: 1731691 - protein, 18 aa, Staphylococcus epidermidis
FNSTTKSIGKLAGNDESL

SEQ ID NO: 1731692 - protein, 22 aa, Staphylococcus epidermidis
FPKKTGEKGDKALQIASSGPAF

SEQ ID NO: 1731693 - protein, 4 aa, Staphylococcus epidermidis
FPPN

SEQ ID NO: 1731694 - protein, 4 aa, Staphylococcus epidermidis
FPPY

SEQ ID NO: 1731695 - protein, 14 aa, Staphylococcus epidermidis
FPSREKNKETSQIG

SEQ ID NO: 1731696 - protein, 4 aa, Staphylococcus epidermidis
FPSS

SEQ ID NO: 1731697 - protein, 42 aa, Staphylococcus epidermidis
FRNADQSNLSTDPLKANEINPEIQNGNFSQVSGGPLPTSSKR

SEQ ID NO: 1731698 - protein, 5 aa, Staphylococcus epidermidis
FSAPQ

SEQ ID NO: 1731699 - protein, 13 aa, Staphylococcus epidermidis
FSATDEEKETAKQ

SEQ ID NO: 1731700 - protein, 6 aa, Staphylococcus epidermidis
FSDESK

SEQ ID NO: 1731701 - protein, 10 aa, Staphylococcus epidermidis
FSEGKTETPL

SEQ ID NO: 1731702 - protein, 6 aa, Staphylococcus epidermidis
FSKNEK

SEQ ID NO: 1731703 - protein, 5 aa, Staphylococcus epidermidis
FSKNN

SEQ ID NO: 1731704 - protein, 5 aa, Staphylococcus epidermidis
FSQGF

SEQ ID NO: 1731705 - protein, 4 aa, Staphylococcus epidermidis
FSSE

SEQ ID NO: 1731706 - protein, 11 aa, Staphylococcus epidermidis
FSSEKSNKQLT

SEQ ID NO: 1731707 - protein, 33 aa, Staphylococcus epidermidis
FSSGTRADIQSKNAITQAQVEKTVKSAGLEPDQ

SEQ ID NO: 1731708 - protein, 9 aa, Staphylococcus epidermidis
FSTGGEYAG

SEQ ID NO: 1731709 - protein, 7 aa, Staphylococcus epidermidis
FSTNEPV

SEQ ID NO: 1731710 - protein, 14 aa, Staphylococcus epidermidis
FSTTAEKMGGVTST

SEQ ID NO: 1731711 - protein, 7 aa, Staphylococcus epidermidis
FTDIPDD

SEQ ID NO: 1731712 - protein, 4 aa, Staphylococcus epidermidis
FTGD

SEQ ID NO: 1731713 - protein, 12 aa, Staphylococcus epidermidis
FTHAAKKGQEKI

SEQ ID NO: 1731714 - protein, 12 aa, Staphylococcus epidermidis
FTKNDNRKRKPV

SEQ ID NO: 1731715 - protein, 5 aa, Staphylococcus epidermidis
FTNGY

SEQ ID NO: 1731716 - protein, 10 aa, Staphylococcus epidermidis
FTNPSGANNK

SEQ ID NO: 1731717 - protein, 6 aa, Staphylococcus epidermidis
FTPQAD

SEQ ID NO: 1731718 - protein, 15 aa, Staphylococcus epidermidis
FTSTTDRNDTASSGM

SEQ ID NO: 1731719 - protein, 5 aa, Staphylococcus epidermidis
FTTGQ

SEQ ID NO: 1731720 - protein, 29 aa, Staphylococcus epidermidis
FTVKESPNRIDAKSSDNIANKNESNSGVQ

SEQ ID NO: 1731721 - protein, 15 aa, Staphylococcus epidermidis
FYEPESRNEHGYNDD

SEQ ID NO: 1731722 - protein, 7 aa, Staphylococcus epidermidis
GAETFTD

SEQ ID NO: 1731723 - protein, 5 aa, Staphylococcus epidermidis
GAGGL

SEQ ID NO: 1731724 - protein, 9 aa, Staphylococcus epidermidis
GAGGSIGSE

SEQ ID NO: 1731725 - protein, 20 aa, Staphylococcus epidermidis
GAGVEPGKKKHKEDGPKHVN

SEQ ID NO: 1731726 - protein, 10 aa, Staphylococcus epidermidis
GAGVSSPIAI

SEQ ID NO: 1731727 - protein, 5 aa, Staphylococcus epidermidis
GAGYN

SEQ ID NO: 1731728 - protein, 5 aa, Staphylococcus epidermidis
GAISG

SEQ ID NO: 1731729 - protein, 29 aa, Staphylococcus epidermidis
GANDKTGNSDASAESRITMPRKEATPLSP

SEQ ID NO: 1731730 - protein, 8 aa, Staphylococcus epidermidis
GANKTQPQ

SEQ ID NO: 1731731 - protein, 13 aa, Staphylococcus epidermidis
GARNEFDYTQEQI

SEQ ID NO: 1731732 - protein, 8 aa, Staphylococcus epidermidis
GASEAEVA

SEQ ID NO: 1731733 - protein, 12 aa, Staphylococcus epidermidis
GASGQSMPNMNT

SEQ ID NO: 1731734 - protein, 67 aa, Staphylococcus epidermidis
GASKLSDSSEKVKINDREMSYSNSKEYGPYPKTKDITISATGKAKGRTFKSETKTISADDLKDNTKV

SEQ ID NO: 1731735 - protein, 8 aa, Staphylococcus epidermidis
GASMHPTF

SEQ ID NO: 1731736 - protein, 13 aa, Staphylococcus epidermidis
GASNRAKGVKWST

SEQ ID NO: 1731737 - protein, 15 aa, Staphylococcus epidermidis
GASPAMSEAPEEAEE

SEQ ID NO: 1731738 - protein, 9 aa, Staphylococcus epidermidis
GATADNISN

SEQ ID NO: 1731739 - protein, 7 aa, Staphylococcus epidermidis
GATGGVG

SEQ ID NO: 1731740 - protein, 10 aa, Staphylococcus epidermidis
GATRKKTPNE

SEQ ID NO: 1731741 - protein, 15 aa, Staphylococcus epidermidis
GATSLGTSYISSGDD

SEQ ID NO: 1731742 - protein, 8 aa, Staphylococcus epidermidis
GAVKNDGK

SEQ ID NO: 1731743 - protein, 14 aa, Staphylococcus epidermidis
GAWGSLKKGTHNTM

SEQ ID NO: 1731744 - protein, 15 aa, Staphylococcus epidermidis
GDAETHKIARRGAAY

SEQ ID NO: 1731745 - protein, 8 aa, Staphylococcus epidermidis
GDEDDKAL

SEQ ID NO: 1731746 - protein, 19 aa, Staphylococcus epidermidis
GDFHKDKKVKKDMTKTEDY

SEQ ID NO: 1731747 - protein, 22 aa, Staphylococcus epidermidis
GDFSKDKLSPNHGEPHKAPRSF

SEQ ID NO: 1731748 - protein, 22 aa, Staphylococcus epidermidis
GDFSKDSSSPNYGEPHKAPRSF

SEQ ID NO: 1731749 - protein, 13 aa, Staphylococcus epidermidis
GDGDLKGSSVGHR

SEQ ID NO: 1731750 - protein, 13 aa, Staphylococcus epidermidis
GDGDLKGSSVGRK

SEQ ID NO: 1731751 - protein, 14 aa, Staphylococcus epidermidis
GDGDLKGSSVGSKN

SEQ ID NO: 1731752 - protein, 8 aa, Staphylococcus epidermidis
GDGKAVEN

SEQ ID NO: 1731753 - protein, 9 aa, Staphylococcus epidermidis
GDGQPIKNE

SEQ ID NO: 1731754 - protein, 5 aa, Staphylococcus epidermidis
GDGYT

SEQ ID NO: 1731755 - protein, 9 aa, Staphylococcus epidermidis
GDHNQTPGE

SEQ ID NO: 1731756 - protein, 8 aa, Staphylococcus epidermidis
GDIKYNDR

SEQ ID NO: 1731757 - protein, 18 aa, Staphylococcus epidermidis
GDISNGTMSHTSNDISNT

SEQ ID NO: 1731758 - protein, 9 aa, Staphylococcus epidermidis
GDKHTGETL

SEQ ID NO: 1731759 - protein, 10 aa, Staphylococcus epidermidis
GDKIKNPYGS

SEQ ID NO: 1731760 - protein, 12 aa, Staphylococcus epidermidis
GDKPVKSKRRHK

SEQ ID NO: 1731761 - protein, 12 aa, Staphylococcus epidermidis
GDLDDSERNAIN

SEQ ID NO: 1731762 - protein, 8 aa, Staphylococcus epidermidis
GDNELTAA

SEQ ID NO: 1731763 - protein, 5 aa, Staphylococcus epidermidis
GDNET

SEQ ID NO: 1731764 - protein, 12 aa, Staphylococcus epidermidis
GDNKGTANAIGS

SEQ ID NO: 1731765 - protein, 10 aa, Staphylococcus epidermidis
GDNKQTAQAI

SEQ ID NO: 1731766 - protein, 15 aa, Staphylococcus epidermidis
GDNKSSKSKSSDDDD

SEQ ID NO: 1731767 - protein, 4 aa, Staphylococcus epidermidis
GDPI

SEQ ID NO: 1731768 - protein, 12 aa, Staphylococcus epidermidis
GDPITSTEEIPF

SEQ ID NO: 1731769 - protein, 86 aa, Staphylococcus epidermidis
GDQPVKSKRRHKNKDVNKDTVNDKVDTTLNTSDSKDTEIDKMKDQQTHVQQEKTDIQKNNIDDSIKEKVNENKENITEQSKNLFDK

SEQ ID NO: 1731770 - protein, 10 aa, Staphylococcus epidermidis
GDSAYKDEDG

SEQ ID NO: 1731771 - protein, 14 aa, Staphylococcus epidermidis
GDSEMTGKAVGEQL

SEQ ID NO: 1731772 - protein, 18 aa, Staphylococcus epidermidis
GDSIKKLQEQATFIFHFI

SEQ ID NO: 1731773 - protein, 4 aa, Staphylococcus epidermidis
GDSR

SEQ ID NO: 1731774 - protein, 5 aa, Staphylococcus epidermidis
GDSVN

SEQ ID NO: 1731775 - protein, 12 aa, Staphylococcus epidermidis
GDTNNKKDKTII

SEQ ID NO: 1731776 - protein, 7 aa, Staphylococcus epidermidis
GDTSHNL

SEQ ID NO: 1731777 - protein, 4 aa, Staphylococcus epidermidis
GDTV

SEQ ID NO: 1731778 - protein, 6 aa, Staphylococcus epidermidis
GDYGMD

SEQ ID NO: 1731779 - protein, 9 aa, Staphylococcus epidermidis
GEAAQPLEK

SEQ ID NO: 1731780 - protein, 6 aa, Staphylococcus epidermidis
GEAGPE

SEQ ID NO: 1731781 - protein, 9 aa, Staphylococcus epidermidis
GEDEDEGNI

SEQ ID NO: 1731782 - protein, 10 aa, Staphylococcus epidermidis
GEDKASTHQK

SEQ ID NO: 1731783 - protein, 10 aa, Staphylococcus epidermidis
GEDNATMDPQ

SEQ ID NO: 1731784 - protein, 45 aa, Staphylococcus epidermidis
GEEIKTGHKDEFDPNAPKGSQTTQPGKPGVKNPDTGEVVTPPVDD

SEQ ID NO: 1731785 - protein, 16 aa, Staphylococcus epidermidis
GEESDGGSAGCGTVGG

SEQ ID NO: 1731786 - protein, 7 aa, Staphylococcus epidermidis
GEFETQN

SEQ ID NO: 1731787 - protein, 14 aa, Staphylococcus epidermidis
GEGKINKDYYSKPE

SEQ ID NO: 1731788 - protein, 9 aa, Staphylococcus epidermidis
GEGLDKKEH

SEQ ID NO: 1731789 - protein, 5 aa, Staphylococcus epidermidis
GEHDM

SEQ ID NO: 1731790 - protein, 10 aa, Staphylococcus epidermidis
GEKDNGVGAA

SEQ ID NO: 1731791 - protein, 5 aa, Staphylococcus epidermidis
GEKIP

SEQ ID NO: 1731792 - protein, 6 aa, Staphylococcus epidermidis
GEKPIL

SEQ ID NO: 1731793 - protein, 5 aa, Staphylococcus epidermidis
GELSS

SEQ ID NO: 1731794 - protein, 9 aa, Staphylococcus epidermidis
GENAPQGVA

SEQ ID NO: 1731795 - protein, 14 aa, Staphylococcus epidermidis
GENGQTLSGGERQR

SEQ ID NO: 1731796 - protein, 5 aa, Staphylococcus epidermidis
GENLA

SEQ ID NO: 1731797 - protein, 5 aa, Staphylococcus epidermidis
GENYK

SEQ ID NO: 1731798 - protein, 9 aa, Staphylococcus epidermidis
GEQIPNDGK

SEQ ID NO: 1731799 - protein, 5 aa, Staphylococcus epidermidis
GEQRT

SEQ ID NO: 1731800 - protein, 4 aa, Staphylococcus epidermidis
GERQ

SEQ ID NO: 1731801 - protein, 10 aa, Staphylococcus epidermidis
GESGSGKSIT

SEQ ID NO: 1731802 - protein, 11 aa, Staphylococcus epidermidis
GESGSGKSTIG

SEQ ID NO: 1731803 - protein, 7 aa, Staphylococcus epidermidis
GETKDHS

SEQ ID NO: 1731804 - protein, 10 aa, Staphylococcus epidermidis
GETSSDPASI

SEQ ID NO: 1731805 - protein, 4 aa, Staphylococcus epidermidis
GEVR

SEQ ID NO: 1731806 - protein, 4 aa, Staphylococcus epidermidis
GEYK

SEQ ID NO: 1731807 - protein, 25 aa, Staphylococcus epidermidis
GFDSETKKSIKKAKHSDFDKNYKPS

SEQ ID NO: 1731808 - protein, 21 aa, Staphylococcus epidermidis
GFKKSTNEQFDEAGAGKDQAS

SEQ ID NO: 1731809 - protein, 22 aa, Staphylococcus epidermidis
GFKKSTTEQFNNAGAGKNQASI

SEQ ID NO: 1731810 - protein, 11 aa, Staphylococcus epidermidis
GFNEKDLEEYR

SEQ ID NO: 1731811 - protein, 7 aa, Staphylococcus epidermidis
GGAAYEA

SEQ ID NO: 1731812 - protein, 7 aa, Staphylococcus epidermidis
GGAGGYG

SEQ ID NO: 1731813 - protein, 11 aa, Staphylococcus epidermidis
GGAGTDTALET

SEQ ID NO: 1731814 - protein, 9 aa, Staphylococcus epidermidis
GGAWQDESL

SEQ ID NO: 1731815 - protein, 6 aa, Staphylococcus epidermidis
GGDPIV

SEQ ID NO: 1731816 - protein, 5 aa, Staphylococcus epidermidis
GGDYA

SEQ ID NO: 1731817 - protein, 9 aa, Staphylococcus epidermidis
GGETSPKGL

SEQ ID NO: 1731818 - protein, 9 aa, Staphylococcus epidermidis
GGETTRAGN

SEQ ID NO: 1731819 - protein, 13 aa, Staphylococcus epidermidis
GGETTSLIKATLG

SEQ ID NO: 1731820 - protein, 7 aa, Staphylococcus epidermidis
GGEYGST

SEQ ID NO: 1731821 - protein, 13 aa, Staphylococcus epidermidis
GGGDGSKALNSIQ

SEQ ID NO: 1731822 - protein, 14 aa, Staphylococcus epidermidis
GGGGHLTNAATQIK

SEQ ID NO: 1731823 - protein, 8 aa, Staphylococcus epidermidis
GGGGTFPI

SEQ ID NO: 1731824 - protein, 11 aa, Staphylococcus epidermidis
GGGIEPGTTEL

SEQ ID NO: 1731825 - protein, 4 aa, Staphylococcus epidermidis
GGHA

SEQ ID NO: 1731826 - protein, 6 aa, Staphylococcus epidermidis
GGHTTP

SEQ ID NO: 1731827 - protein, 5 aa, Staphylococcus epidermidis
GGKAK

SEQ ID NO: 1731828 - protein, 6 aa, Staphylococcus epidermidis
GGKENI

SEQ ID NO: 1731829 - protein, 14 aa, Staphylococcus epidermidis
GGKIEVESELGKGT

SEQ ID NO: 1731830 - protein, 261 aa, Staphylococcus epidermidis
GGLQGNKNEGGKADQTNAHQGNGVLNGGAQGNKSEGGDATQKNDNQGNGVANGGSQGNKNEGGKADQTNAHQGNGVANGGSQGNKNEGGDATQKNDNQGNGVANGGSQGNKNEGGKADQSNTNKGNGILNGGSQSNVNKGDHQDASKPSDNDHKDHSDDPKDDGKDNHHKGDKDDHHQGKDDGQDNHKKDKDHNDKDHHKGSKDDDTKKPDQSDKDDHHQGKDDGQDDSKSEPSKDTDNKGNHNTTSKDGKHNGKSPVAPI

SEQ ID NO: 1731831 - protein, 11 aa, Staphylococcus epidermidis
GGNMEGKETRF

SEQ ID NO: 1731832 - protein, 13 aa, Staphylococcus epidermidis
GGNMEGKETRFGI

SEQ ID NO: 1731833 - protein, 11 aa, Staphylococcus epidermidis
GGQTPDAGNTK

SEQ ID NO: 1731834 - protein, 7 aa, Staphylococcus epidermidis
GGSALQQ

SEQ ID NO: 1731835 - protein, 8 aa, Staphylococcus epidermidis
GGSENSEK

SEQ ID NO: 1731836 - protein, 8 aa, Staphylococcus epidermidis
GGSKDQIV

SEQ ID NO: 1731837 - protein, 7 aa, Staphylococcus epidermidis
GGSLAGS

SEQ ID NO: 1731838 - protein, 6 aa, Staphylococcus epidermidis
GGTEFE

SEQ ID NO: 1731839 - protein, 6 aa, Staphylococcus epidermidis
GGTGAT

SEQ ID NO: 1731840 - protein, 8 aa, Staphylococcus epidermidis
GGTHMSNK

SEQ ID NO: 1731841 - protein, 9 aa, Staphylococcus epidermidis
GGTIEVSSE

SEQ ID NO: 1731842 - protein, 8 aa, Staphylococcus epidermidis
GGTKESAG

SEQ ID NO: 1731843 - protein, 4 aa, Staphylococcus epidermidis
GGTL

SEQ ID NO: 1731844 - protein, 6 aa, Staphylococcus epidermidis
GGTSVA

SEQ ID NO: 1731845 - protein, 7 aa, Staphylococcus epidermidis
GGTVKGI

SEQ ID NO: 1731846 - protein, 12 aa, Staphylococcus epidermidis
GGVGDRVAHGGP

SEQ ID NO: 1731847 - protein, 12 aa, Staphylococcus epidermidis
GGYAQHTSDGLS

SEQ ID NO: 1731848 - protein, 7 aa, Staphylococcus epidermidis
GHEKPTN

SEQ ID NO: 1731849 - protein, 21 aa, Staphylococcus epidermidis
GHGGGGKVGGSGSANARRAIQ

SEQ ID NO: 1731850 - protein, 6 aa, Staphylococcus epidermidis
GHHRLN

SEQ ID NO: 1731851 - protein, 7 aa, Staphylococcus epidermidis
GHRNQNN

SEQ ID NO: 1731852 - protein, 4 aa, Staphylococcus epidermidis
GHSP

SEQ ID NO: 1731853 - protein, 56 aa, Staphylococcus epidermidis
GHTPEEAAIKHDDNNENHYNENTTYEYYEDSKDVDISNKDDTYNINHQSKEEHHTS

SEQ ID NO: 1731854 - protein, 56 aa, Staphylococcus epidermidis
GHTPEEAAIKHEDNNENHYNENTTYEYYKDNKDVDISNEDDTYNINHQSKEEHHTT

SEQ ID NO: 1731855 - protein, 4 aa, Staphylococcus epidermidis
GIAK

SEQ ID NO: 1731856 - protein, 16 aa, Staphylococcus epidermidis
GIEDNKIERNSNTNEL

SEQ ID NO: 1731857 - protein, 4 aa, Staphylococcus epidermidis
GIEV

SEQ ID NO: 1731858 - protein, 7 aa, Staphylococcus epidermidis
GIGGSEA

SEQ ID NO: 1731859 - protein, 4 aa, Staphylococcus epidermidis
GIGI

SEQ ID NO: 1731860 - protein, 5 aa, Staphylococcus epidermidis
GIKGK

SEQ ID NO: 1731861 - protein, 5 aa, Staphylococcus epidermidis
GIKTG

SEQ ID NO: 1731862 - protein, 5 aa, Staphylococcus epidermidis
GIPPL

SEQ ID NO: 1731863 - protein, 13 aa, Staphylococcus epidermidis
GIQPDVKIPTPKY

SEQ ID NO: 1731864 - protein, 7 aa, Staphylococcus epidermidis
GIRDGYR

SEQ ID NO: 1731865 - protein, 29 aa, Staphylococcus epidermidis
GKALDQDHSNTKGTAEDTQYGDHHGESYR

SEQ ID NO: 1731866 - protein, 4 aa, Staphylococcus epidermidis
GKDK

SEQ ID NO: 1731867 - protein, 7 aa, Staphylococcus epidermidis
GKDKGIN

SEQ ID NO: 1731868 - protein, 8 aa, Staphylococcus epidermidis
GKDPNEIK

SEQ ID NO: 1731869 - protein, 18 aa, Staphylococcus epidermidis
GKDTISNKAQTINTDEAD

SEQ ID NO: 1731870 - protein, 15 aa, Staphylococcus epidermidis
GKDYGTLDNATTPTI

SEQ ID NO: 1731871 - protein, 7 aa, Staphylococcus epidermidis
GKEAPLL

SEQ ID NO: 1731872 - protein, 16 aa, Staphylococcus epidermidis
GKELKDYSDDVSHDGP

SEQ ID NO: 1731873 - protein, 7 aa, Staphylococcus epidermidis
GKGHSNW

SEQ ID NO: 1731874 - protein, 21 aa, Staphylococcus epidermidis
GKGNNLGKNAALKTYNENQAQ

SEQ ID NO: 1731875 - protein, 7 aa, Staphylococcus epidermidis
GKHNIDK

SEQ ID NO: 1731876 - protein, 18 aa, Staphylococcus epidermidis
GKHQKKNSVIKYKKKKNS

SEQ ID NO: 1731877 - protein, 8 aa, Staphylococcus epidermidis
GKIDATNL

SEQ ID NO: 1731878 - protein, 14 aa, Staphylococcus epidermidis
GKISKQQYKNAEKY

SEQ ID NO: 1731879 - protein, 8 aa, Staphylococcus epidermidis
GKKDPEVL

SEQ ID NO: 1731880 - protein, 7 aa, Staphylococcus epidermidis
GKKDTYY

SEQ ID NO: 1731881 - protein, 34 aa, Staphylococcus epidermidis
GKKETNKYGPSPKFTEYATNYEGKNHNPVDKAKT

SEQ ID NO: 1731882 - protein, 8 aa, Staphylococcus epidermidis
GKKGTTVT

SEQ ID NO: 1731883 - protein, 10 aa, Staphylococcus epidermidis
GKLASTTNTL

SEQ ID NO: 1731884 - protein, 9 aa, Staphylococcus epidermidis
GKLGSEPSI

SEQ ID NO: 1731885 - protein, 9 aa, Staphylococcus epidermidis
GKLGSEPSV

SEQ ID NO: 1731886 - protein, 8 aa, Staphylococcus epidermidis
GKLKGSLG

SEQ ID NO: 1731887 - protein, 18 aa, Staphylococcus epidermidis
GKMGGLSKDQQAAAASTI

SEQ ID NO: 1731888 - protein, 10 aa, Staphylococcus epidermidis
GKPGDTVEYK

SEQ ID NO: 1731889 - protein, 8 aa, Staphylococcus epidermidis
GKPGESIE

SEQ ID NO: 1731890 - protein, 7 aa, Staphylococcus epidermidis
GKPLTDG

SEQ ID NO: 1731891 - protein, 8 aa, Staphylococcus epidermidis
GKPLTDGE

SEQ ID NO: 1731892 - protein, 7 aa, Staphylococcus epidermidis
GKPLTNG

SEQ ID NO: 1731893 - protein, 12 aa, Staphylococcus epidermidis
GKPVEKRFNKEE

SEQ ID NO: 1731894 - protein, 9 aa, Staphylococcus epidermidis
GKSKEGMDY

SEQ ID NO: 1731895 - protein, 14 aa, Staphylococcus epidermidis
GKSTADQSSITGES

SEQ ID NO: 1731896 - protein, 16 aa, Staphylococcus epidermidis
GKSVSKQLKNELTEKD

SEQ ID NO: 1731897 - protein, 11 aa, Staphylococcus epidermidis
GKTDPMEKRTR

SEQ ID NO: 1731898 - protein, 11 aa, Staphylococcus epidermidis
GKTKSGDDYSS

SEQ ID NO: 1731899 - protein, 7 aa, Staphylococcus epidermidis
GKTNHEY

SEQ ID NO: 1731900 - protein, 14 aa, Staphylococcus epidermidis
GKTSVASKEELDST

SEQ ID NO: 1731901 - protein, 4 aa, Staphylococcus epidermidis
GKTV

SEQ ID NO: 1731902 - protein, 7 aa, Staphylococcus epidermidis
GKTVEDN

SEQ ID NO: 1731903 - protein, 14 aa, Staphylococcus epidermidis
GKTYTISNDKEADI

SEQ ID NO: 1731904 - protein, 19 aa, Staphylococcus epidermidis
GKVDGGPSQVIKPGKEKTI

SEQ ID NO: 1731905 - protein, 19 aa, Staphylococcus epidermidis
GKVGMKPTNPLSPDEKKKY

SEQ ID NO: 1731906 - protein, 11 aa, Staphylococcus epidermidis
GKVYKKERLDT

SEQ ID NO: 1731907 - protein, 11 aa, Staphylococcus epidermidis
GKVYKKERLET

SEQ ID NO: 1731908 - protein, 9 aa, Staphylococcus epidermidis
GLDDHNSVG

SEQ ID NO: 1731909 - protein, 6 aa, Staphylococcus epidermidis
GLDDKQ

SEQ ID NO: 1731910 - protein, 9 aa, Staphylococcus epidermidis
GLDNSSDKM

SEQ ID NO: 1731911 - protein, 7 aa, Staphylococcus epidermidis
GLDSYNA

SEQ ID NO: 1731912 - protein, 7 aa, Staphylococcus epidermidis
GLEGKLS

SEQ ID NO: 1731913 - protein, 7 aa, Staphylococcus epidermidis
GLENGDY

SEQ ID NO: 1731914 - protein, 9 aa, Staphylococcus epidermidis
GLENSPENG

SEQ ID NO: 1731915 - protein, 11 aa, Staphylococcus epidermidis
GLGGSENISSL

SEQ ID NO: 1731916 - protein, 4 aa, Staphylococcus epidermidis
GLGR

SEQ ID NO: 1731917 - protein, 25 aa, Staphylococcus epidermidis
GLKSGDKVIKKPKGNLNDGEKVEVS

SEQ ID NO: 1731918 - protein, 25 aa, Staphylococcus epidermidis
GLKSGDKVIKNPKGNLNDGEKVEVS

SEQ ID NO: 1731919 - protein, 6 aa, Staphylococcus epidermidis
GLPENG

SEQ ID NO: 1731920 - protein, 23 aa, Staphylococcus epidermidis
GLPIDNSGGGGAPPKSESHNPSV

SEQ ID NO: 1731921 - protein, 22 aa, Staphylococcus epidermidis
GLPIDNSGGGGAPPKSESYNPS

SEQ ID NO: 1731922 - protein, 22 aa, Staphylococcus epidermidis
GLPKDDNESQTPRRPRRKSNAT

SEQ ID NO: 1731923 - protein, 8 aa, Staphylococcus epidermidis
GLRTDTTN

SEQ ID NO: 1731924 - protein, 9 aa, Staphylococcus epidermidis
GLTEPQKQA

SEQ ID NO: 1731925 - protein, 14 aa, Staphylococcus epidermidis
GLTGLDTTQGTEGM

SEQ ID NO: 1731926 - protein, 12 aa, Staphylococcus epidermidis
GLTSKEKTQFDK

SEQ ID NO: 1731927 - protein, 5 aa, Staphylococcus epidermidis
GMGNS

SEQ ID NO: 1731928 - protein, 9 aa, Staphylococcus epidermidis
GMGPYPTGK

SEQ ID NO: 1731929 - protein, 7 aa, Staphylococcus epidermidis
GMGSSAM

SEQ ID NO: 1731930 - protein, 9 aa, Staphylococcus epidermidis
GMKAKNDGI

SEQ ID NO: 1731931 - protein, 5 aa, Staphylococcus epidermidis
GMSPN

SEQ ID NO: 1731932 - protein, 7 aa, Staphylococcus epidermidis
GNAAKKG

SEQ ID NO: 1731933 - protein, 6 aa, Staphylococcus epidermidis
GNAFKE

SEQ ID NO: 1731934 - protein, 4 aa, Staphylococcus epidermidis
GNAS

SEQ ID NO: 1731935 - protein, 6 aa, Staphylococcus epidermidis
GNENSI

SEQ ID NO: 1731936 - protein, 6 aa, Staphylococcus epidermidis
GNGDGF

SEQ ID NO: 1731937 - protein, 5 aa, Staphylococcus epidermidis
GNGMR

SEQ ID NO: 1731938 - protein, 21 aa, Staphylococcus epidermidis
GNGSNPINSKTVQQEIKGKKI

SEQ ID NO: 1731939 - protein, 16 aa, Staphylococcus epidermidis
GNGTLQESIDKPRFYN

SEQ ID NO: 1731940 - protein, 7 aa, Staphylococcus epidermidis
GNHPKGL

SEQ ID NO: 1731941 - protein, 5 aa, Staphylococcus epidermidis
GNHRR

SEQ ID NO: 1731942 - protein, 11 aa, Staphylococcus epidermidis
GNKKDNTTTAA

SEQ ID NO: 1731943 - protein, 5 aa, Staphylococcus epidermidis
GNLPG

SEQ ID NO: 1731944 - protein, 6 aa, Staphylococcus epidermidis
GNNETI

SEQ ID NO: 1731945 - protein, 6 aa, Staphylococcus epidermidis
GNPGKA

SEQ ID NO: 1731946 - protein, 4 aa, Staphylococcus epidermidis
GNPI

SEQ ID NO: 1731947 - protein, 12 aa, Staphylococcus epidermidis
GNPIAQSLAEKT

SEQ ID NO: 1731948 - protein, 7 aa, Staphylococcus epidermidis
GNPSYSA

SEQ ID NO: 1731949 - protein, 17 aa, Staphylococcus epidermidis
GNQTEDNTQKEVKNSEN

SEQ ID NO: 1731950 - protein, 4 aa, Staphylococcus epidermidis
GNRE

SEQ ID NO: 1731951 - protein, 18 aa, Staphylococcus epidermidis
GNRYEGYSPDGVAGGDGI

SEQ ID NO: 1731952 - protein, 19 aa, Staphylococcus epidermidis
GNRYRKDHHSVDKSLNEAE

SEQ ID NO: 1731953 - protein, 5 aa, Staphylococcus epidermidis
GNSET

SEQ ID NO: 1731954 - protein, 5 aa, Staphylococcus epidermidis
GNSKY

SEQ ID NO: 1731955 - protein, 14 aa, Staphylococcus epidermidis
GNTTSDDFLSKNQK

SEQ ID NO: 1731956 - protein, 9 aa, Staphylococcus epidermidis
GNVPENKLT

SEQ ID NO: 1731957 - protein, 7 aa, Staphylococcus epidermidis
GNYSEAK

SEQ ID NO: 1731958 - protein, 13 aa, Staphylococcus epidermidis
GNYSEAKSVVTQT

SEQ ID NO: 1731959 - protein, 6 aa, Staphylococcus epidermidis
GPENSN

SEQ ID NO: 1731960 - protein, 12 aa, Staphylococcus epidermidis
GPFGEVQNYNTT

SEQ ID NO: 1731961 - protein, 8 aa, Staphylococcus epidermidis
GPGQTYSN

SEQ ID NO: 1731962 - protein, 8 aa, Staphylococcus epidermidis
GPHQEQSQ

SEQ ID NO: 1731963 - protein, 7 aa, Staphylococcus epidermidis
GPKAYAA

SEQ ID NO: 1731964 - protein, 8 aa, Staphylococcus epidermidis
GPKSDQIK

SEQ ID NO: 1731965 - protein, 13 aa, Staphylococcus epidermidis
GPLQFSSSSGGQV

SEQ ID NO: 1731966 - protein, 6 aa, Staphylococcus epidermidis
GPNDYD

SEQ ID NO: 1731967 - protein, 10 aa, Staphylococcus epidermidis
GPSGCGKSTL

SEQ ID NO: 1731968 - protein, 9 aa, Staphylococcus epidermidis
GPSGSGKTT

SEQ ID NO: 1731969 - protein, 11 aa, Staphylococcus epidermidis
GQADRSYPYKN

SEQ ID NO: 1731970 - protein, 11 aa, Staphylococcus epidermidis
GQADRTYPFKN

SEQ ID NO: 1731971 - protein, 4 aa, Staphylococcus epidermidis
GQEN

SEQ ID NO: 1731972 - protein, 13 aa, Staphylococcus epidermidis
GQFDKKTNDKFTQ

SEQ ID NO: 1731973 - protein, 6 aa, Staphylococcus epidermidis
GQFSPR

SEQ ID NO: 1731974 - protein, 8 aa, Staphylococcus epidermidis
GQGLDEPI

SEQ ID NO: 1731975 - protein, 4 aa, Staphylococcus epidermidis
GQKI

SEQ ID NO: 1731976 - protein, 5 aa, Staphylococcus epidermidis
GQKPN

SEQ ID NO: 1731977 - protein, 10 aa, Staphylococcus epidermidis
GQLDKDTQGA

SEQ ID NO: 1731978 - protein, 13 aa, Staphylococcus epidermidis
GQNIDLPHETGEY

SEQ ID NO: 1731979 - protein, 9 aa, Staphylococcus epidermidis
GQPKDHGDY

SEQ ID NO: 1731980 - protein, 5 aa, Staphylococcus epidermidis
GQPTT

SEQ ID NO: 1731981 - protein, 8 aa, Staphylococcus epidermidis
GQQSSVTK

SEQ ID NO: 1731982 - protein, 7 aa, Staphylococcus epidermidis
GQSRSYT

SEQ ID NO: 1731983 - protein, 12 aa, Staphylococcus epidermidis
GQSSTGKSTAAA

SEQ ID NO: 1731984 - protein, 6 aa, Staphylococcus epidermidis
GQTDKF

SEQ ID NO: 1731985 - protein, 12 aa, Staphylococcus epidermidis
GQVPEANGASAF

SEQ ID NO: 1731986 - protein, 10 aa, Staphylococcus epidermidis
GRAKNKKDVG

SEQ ID NO: 1731987 - protein, 9 aa, Staphylococcus epidermidis
GREGAFNEV

SEQ ID NO: 1731988 - protein, 6 aa, Staphylococcus epidermidis
GRFSPE

SEQ ID NO: 1731989 - protein, 4 aa, Staphylococcus epidermidis
GRID

SEQ ID NO: 1731990 - protein, 21 aa, Staphylococcus epidermidis
GRISVSSKPGEGSTFKVTFID

SEQ ID NO: 1731991 - protein, 8 aa, Staphylococcus epidermidis
GRKETHFP

SEQ ID NO: 1731992 - protein, 4 aa, Staphylococcus epidermidis
GRKP

SEQ ID NO: 1731993 - protein, 4 aa, Staphylococcus epidermidis
GRNA

SEQ ID NO: 1731994 - protein, 7 aa, Staphylococcus epidermidis
GRRQPSL

SEQ ID NO: 1731995 - protein, 7 aa, Staphylococcus epidermidis
GRSRRSE

SEQ ID NO: 1731996 - protein, 6 aa, Staphylococcus epidermidis
GRTRRQ

SEQ ID NO: 1731997 - protein, 8 aa, Staphylococcus epidermidis
GSEQNVTP

SEQ ID NO: 1731998 - protein, 4 aa, Staphylococcus epidermidis
GSFA

SEQ ID NO: 1731999 - protein, 16 aa, Staphylococcus epidermidis
GSFKRQKKSASTLKTS

SEQ ID NO: 1732000 - protein, 5 aa, Staphylococcus epidermidis
GSFST

SEQ ID NO: 1732001 - protein, 14 aa, Staphylococcus epidermidis
GSFTRQKESIATLK

SEQ ID NO: 1732002 - protein, 8 aa, Staphylococcus epidermidis
GSGSTFNQ

SEQ ID NO: 1732003 - protein, 10 aa, Staphylococcus epidermidis
GSGTQENVDK

SEQ ID NO: 1732004 - protein, 5 aa, Staphylococcus epidermidis
GSHVS

SEQ ID NO: 1732005 - protein, 5 aa, Staphylococcus epidermidis
GSIKE

SEQ ID NO: 1732006 - protein, 10 aa, Staphylococcus epidermidis
GSIKYGTNSI

SEQ ID NO: 1732007 - protein, 8 aa, Staphylococcus epidermidis
GSIPEQKL

SEQ ID NO: 1732008 - protein, 10 aa, Staphylococcus epidermidis
GSISQEQFDT

SEQ ID NO: 1732009 - protein, 8 aa, Staphylococcus epidermidis
GSKLGEYT

SEQ ID NO: 1732010 - protein, 12 aa, Staphylococcus epidermidis
GSLNARKQPAFS

SEQ ID NO: 1732011 - protein, 4 aa, Staphylococcus epidermidis
GSMA

SEQ ID NO: 1732012 - protein, 46 aa, Staphylococcus epidermidis
GSMPDLKKPTDKEDSNHSAFKNHSEDQITTNDEEQTDDYKNKKKFN

SEQ ID NO: 1732013 - protein, 18 aa, Staphylococcus epidermidis
GSMPELKKPTDKEDKNHS

SEQ ID NO: 1732014 - protein, 46 aa, Staphylococcus epidermidis
GSMPELKKPTDKEDKNHSAFKNHSADEITTNNDEHSKDYDKKKKMH

SEQ ID NO: 1732015 - protein, 7 aa, Staphylococcus epidermidis
GSNARDL

SEQ ID NO: 1732016 - protein, 10 aa, Staphylococcus epidermidis
GSPATLPGPS

SEQ ID NO: 1732017 - protein, 8 aa, Staphylococcus epidermidis
GSPKNKIT

SEQ ID NO: 1732018 - protein, 10 aa, Staphylococcus epidermidis
GSPQKSPNTE

SEQ ID NO: 1732019 - protein, 9 aa, Staphylococcus epidermidis
GSRDLRKKD

SEQ ID NO: 1732020 - protein, 4 aa, Staphylococcus epidermidis
GSRG

SEQ ID NO: 1732021 - protein, 7 aa, Staphylococcus epidermidis
GSRTLRK

SEQ ID NO: 1732022 - protein, 7 aa, Staphylococcus epidermidis
GSSDSTY

SEQ ID NO: 1732023 - protein, 5 aa, Staphylococcus epidermidis
GSSLG

SEQ ID NO: 1732024 - protein, 6 aa, Staphylococcus epidermidis
GSSLPI

SEQ ID NO: 1732025 - protein, 7 aa, Staphylococcus epidermidis
GSSRQNI

SEQ ID NO: 1732026 - protein, 4 aa, Staphylococcus epidermidis
GSTF

SEQ ID NO: 1732027 - protein, 5 aa, Staphylococcus epidermidis
GSTFP

SEQ ID NO: 1732028 - protein, 4 aa, Staphylococcus epidermidis
GSTP

SEQ ID NO: 1732029 - protein, 7 aa, Staphylococcus epidermidis
GSTQPQL

SEQ ID NO: 1732030 - protein, 7 aa, Staphylococcus epidermidis
GSVSKGI

SEQ ID NO: 1732031 - protein, 9 aa, Staphylococcus epidermidis
GTAKATSYG

SEQ ID NO: 1732032 - protein, 5 aa, Staphylococcus epidermidis
GTAVP

SEQ ID NO: 1732033 - protein, 10 aa, Staphylococcus epidermidis
GTDAGGRDNF

SEQ ID NO: 1732034 - protein, 6 aa, Staphylococcus epidermidis
GTDVAL

SEQ ID NO: 1732035 - protein, 17 aa, Staphylococcus epidermidis
GTFRGRNSNFNGDGFAR

SEQ ID NO: 1732036 - protein, 11 aa, Staphylococcus epidermidis
GTGDLKGSSVG

SEQ ID NO: 1732037 - protein, 25 aa, Staphylococcus epidermidis
GTGVEPGKNNKETQQPKLHKNDNDS

SEQ ID NO: 1732038 - protein, 4 aa, Staphylococcus epidermidis
GTIN

SEQ ID NO: 1732039 - protein, 9 aa, Staphylococcus epidermidis
GTLAAGQTG

SEQ ID NO: 1732040 - protein, 9 aa, Staphylococcus epidermidis
GTNGREQAY

SEQ ID NO: 1732041 - protein, 13 aa, Staphylococcus epidermidis
GTPESKNHNTSAR

SEQ ID NO: 1732042 - protein, 7 aa, Staphylococcus epidermidis
GTPLSAG

SEQ ID NO: 1732043 - protein, 6 aa, Staphylococcus epidermidis
GTPNNI

SEQ ID NO: 1732044 - protein, 7 aa, Staphylococcus epidermidis
GTPSDVD

SEQ ID NO: 1732045 - protein, 11 aa, Staphylococcus epidermidis
GTSGSYLSGGE

SEQ ID NO: 1732046 - protein, 4 aa, Staphylococcus epidermidis
GTSI

SEQ ID NO: 1732047 - protein, 5 aa, Staphylococcus epidermidis
GTSKG

SEQ ID NO: 1732048 - protein, 5 aa, Staphylococcus epidermidis
GTTEG

SEQ ID NO: 1732049 - protein, 12 aa, Staphylococcus epidermidis
GTTKKDADYKKY

SEQ ID NO: 1732050 - protein, 4 aa, Staphylococcus epidermidis
GTTL

SEQ ID NO: 1732051 - protein, 26 aa, Staphylococcus epidermidis
GTTSIDESSINGESIPKEKSKGDEVF

SEQ ID NO: 1732052 - protein, 5 aa, Staphylococcus epidermidis
GTTSM

SEQ ID NO: 1732053 - protein, 4 aa, Staphylococcus epidermidis
GTVD

SEQ ID NO: 1732054 - protein, 16 aa, Staphylococcus epidermidis
GTVIPNTSTTIDSNGI

SEQ ID NO: 1732055 - protein, 14 aa, Staphylococcus epidermidis
GTVKHSTDSSGQDF

SEQ ID NO: 1732056 - protein, 11 aa, Staphylococcus epidermidis
GTVNPRHTDEY

SEQ ID NO: 1732057 - protein, 6 aa, Staphylococcus epidermidis
GTVRDE

SEQ ID NO: 1732058 - protein, 7 aa, Staphylococcus epidermidis
GTYEGKQ

SEQ ID NO: 1732059 - protein, 11 aa, Staphylococcus epidermidis
GVAKSLNPAKQ

SEQ ID NO: 1732060 - protein, 13 aa, Staphylococcus epidermidis
GVEEKRNDPNFGS

SEQ ID NO: 1732061 - protein, 5 aa, Staphylococcus epidermidis
GVEKG

SEQ ID NO: 1732062 - protein, 7 aa, Staphylococcus epidermidis
GVGIKDK

SEQ ID NO: 1732063 - protein, 6 aa, Staphylococcus epidermidis
GVGISK

SEQ ID NO: 1732064 - protein, 32 aa, Staphylococcus epidermidis
GVKSAKVKDSEDSTYSAKITNTHGSGDTSLKK

SEQ ID NO: 1732065 - protein, 11 aa, Staphylococcus epidermidis
GVNDAPALAAS

SEQ ID NO: 1732066 - protein, 8 aa, Staphylococcus epidermidis
GVNDAQGA

SEQ ID NO: 1732067 - protein, 14 aa, Staphylococcus epidermidis
GVNTVTRPTGTPIK

SEQ ID NO: 1732068 - protein, 4 aa, Staphylococcus epidermidis
GVPL

SEQ ID NO: 1732069 - protein, 7 aa, Staphylococcus epidermidis
GVPSSPL

SEQ ID NO: 1732070 - protein, 7 aa, Staphylococcus epidermidis
GVRPGEK

SEQ ID NO: 1732071 - protein, 4 aa, Staphylococcus epidermidis
GVSE

SEQ ID NO: 1732072 - protein, 7 aa, Staphylococcus epidermidis
GVSGTTW

SEQ ID NO: 1732073 - protein, 7 aa, Staphylococcus epidermidis
GVSQTST

SEQ ID NO: 1732074 - protein, 5 aa, Staphylococcus epidermidis
GVSST

SEQ ID NO: 1732075 - protein, 17 aa, Staphylococcus epidermidis
GVTNPNTIAKETFKSGT

SEQ ID NO: 1732076 - protein, 9 aa, Staphylococcus epidermidis
GVTSPTEIS

SEQ ID NO: 1732077 - protein, 10 aa, Staphylococcus epidermidis
GWEDKVKEEK

SEQ ID NO: 1732078 - protein, 5 aa, Staphylococcus epidermidis
GWVTG

SEQ ID NO: 1732079 - protein, 15 aa, Staphylococcus epidermidis
GYANVSQKTKVTPRT

SEQ ID NO: 1732080 - protein, 10 aa, Staphylococcus epidermidis
GYEPTEELKE

SEQ ID NO: 1732081 - protein, 60 aa, Staphylococcus epidermidis
GYGQGYGQGSASESTETPKTITTSTTETTPDKKEVTHGEKTEHSANELPETGEENQENKG

SEQ ID NO: 1732082 - protein, 9 aa, Staphylococcus epidermidis
GYLKGSSVG

SEQ ID NO: 1732083 - protein, 5 aa, Staphylococcus epidermidis
GYPKP

SEQ ID NO: 1732084 - protein, 15 aa, Staphylococcus epidermidis
GYSGYNGRLNEESSG

SEQ ID NO: 1732085 - protein, 14 aa, Staphylococcus epidermidis
GYYPNGGAPGYSFN

SEQ ID NO: 1732086 - protein, 7 aa, Staphylococcus epidermidis
HAESHSE

SEQ ID NO: 1732087 - protein, 9 aa, Staphylococcus epidermidis
HAIRKEKNY

SEQ ID NO: 1732088 - protein, 4 aa, Staphylococcus epidermidis
HAKP

SEQ ID NO: 1732089 - protein, 9 aa, Staphylococcus epidermidis
HAKSNAVKQ

SEQ ID NO: 1732090 - protein, 46 aa, Staphylococcus epidermidis
HANATSNSKDQTKQMVNEEARKALSNINDATSNDLVNQAKDEGQSA

SEQ ID NO: 1732091 - protein, 11 aa, Staphylococcus epidermidis
HAPVSPQYKDG

SEQ ID NO: 1732092 - protein, 8 aa, Staphylococcus epidermidis
HASESVGG

SEQ ID NO: 1732093 - protein, 27 aa, Staphylococcus epidermidis
HASGRALGTRANDLNKQMANNDKDNQL

SEQ ID NO: 1732094 - protein, 8 aa, Staphylococcus epidermidis
HATEVKGE

SEQ ID NO: 1732095 - protein, 20 aa, Staphylococcus epidermidis
HDDDEGTKENTTEQEDNSEN

SEQ ID NO: 1732096 - protein, 6 aa, Staphylococcus epidermidis
HDDTRD

SEQ ID NO: 1732097 - protein, 9 aa, Staphylococcus epidermidis
HDEIEGGKE

SEQ ID NO: 1732098 - protein, 17 aa, Staphylococcus epidermidis
HDGDTIEYDHSSHKAMK

SEQ ID NO: 1732099 - protein, 15 aa, Staphylococcus epidermidis
HDKVTETLRPDKDKQ

SEQ ID NO: 1732100 - protein, 9 aa, Staphylococcus epidermidis
HDNKVKNKI

SEQ ID NO: 1732101 - protein, 8 aa, Staphylococcus epidermidis
HEAKQKEV

SEQ ID NO: 1732102 - protein, 19 aa, Staphylococcus epidermidis
HEDDNNHKAAVDQTKGKYQ

SEQ ID NO: 1732103 - protein, 10 aa, Staphylococcus epidermidis
HEEHEENKLN

SEQ ID NO: 1732104 - protein, 15 aa, Staphylococcus epidermidis
HEEITNQGKLTIDKE

SEQ ID NO: 1732105 - protein, 19 aa, Staphylococcus epidermidis
HEEITNQGKLTMDEDKNTV

SEQ ID NO: 1732106 - protein, 102 aa, Staphylococcus epidermidis
HEHQREDDTQDKHLERNVENSSNQDSPHDALDKSNDTKQDETIDVDSDDNLNESQAHNDNLEEKNETDQQEDKEASSDSDNELKSTEDNAQDKKEDKKKGLL

SEQ ID NO: 1732107 - protein, 7 aa, Staphylococcus epidermidis
HEHYQKR

SEQ ID NO: 1732108 - protein, 13 aa, Staphylococcus epidermidis
HEIESDNDATIEE

SEQ ID NO: 1732109 - protein, 26 aa, Staphylococcus epidermidis
HEKAKNDVNQSQTNQQVENAEQNSLD

SEQ ID NO: 1732110 - protein, 11 aa, Staphylococcus epidermidis
HEKDRNSLKSE

SEQ ID NO: 1732111 - protein, 8 aa, Staphylococcus epidermidis
HERKQKEV

SEQ ID NO: 1732112 - protein, 9 aa, Staphylococcus epidermidis
HESGTRDIR

SEQ ID NO: 1732113 - protein, 10 aa, Staphylococcus epidermidis
HETGKPAHIS

SEQ ID NO: 1732114 - protein, 9 aa, Staphylococcus epidermidis
HETIKSRDI

SEQ ID NO: 1732115 - protein, 11 aa, Staphylococcus epidermidis
HEVDSSEAMKS

SEQ ID NO: 1732116 - protein, 15 aa, Staphylococcus epidermidis
HFPNDQLSDDYSDGD

SEQ ID NO: 1732117 - protein, 6 aa, Staphylococcus epidermidis
HGAHAN

SEQ ID NO: 1732118 - protein, 6 aa, Staphylococcus epidermidis
HGDNPL

SEQ ID NO: 1732119 - protein, 9 aa, Staphylococcus epidermidis
HGGNTKDIS

SEQ ID NO: 1732120 - protein, 12 aa, Staphylococcus epidermidis
HGKQYNQDFETT

SEQ ID NO: 1732121 - protein, 17 aa, Staphylococcus epidermidis
HGMTSTKTMDTAKPIQD

SEQ ID NO: 1732122 - protein, 12 aa, Staphylococcus epidermidis
HGNDPNDHGGFN

SEQ ID NO: 1732123 - protein, 14 aa, Staphylococcus epidermidis
HGNLPKTKHPEFGG

SEQ ID NO: 1732124 - protein, 7 aa, Staphylococcus epidermidis
HGPTNAT

SEQ ID NO: 1732125 - protein, 6 aa, Staphylococcus epidermidis
HGRETD

SEQ ID NO: 1732126 - protein, 6 aa, Staphylococcus epidermidis
HGSDEK

SEQ ID NO: 1732127 - protein, 8 aa, Staphylococcus epidermidis
HGSGTGYA

SEQ ID NO: 1732128 - protein, 12 aa, Staphylococcus epidermidis
HGSNKNKSEDDI

SEQ ID NO: 1732129 - protein, 10 aa, Staphylococcus epidermidis
HGSRTSSSEE

SEQ ID NO: 1732130 - protein, 5 aa, Staphylococcus epidermidis
HGTEM

SEQ ID NO: 1732131 - protein, 6 aa, Staphylococcus epidermidis
HGTHAN

SEQ ID NO: 1732132 - protein, 4 aa, Staphylococcus epidermidis
HGTK

SEQ ID NO: 1732133 - protein, 9 aa, Staphylococcus epidermidis
HGTQVRSDD

SEQ ID NO: 1732134 - protein, 16 aa, Staphylococcus epidermidis
HHGDGNNSSPHGKNKQ

SEQ ID NO: 1732135 - protein, 7 aa, Staphylococcus epidermidis
HHGKDNI

SEQ ID NO: 1732136 - protein, 26 aa, Staphylococcus epidermidis
HHQSHSQPQYRQTSNHHAPTHNGNKK

SEQ ID NO: 1732137 - protein, 40 aa, Staphylococcus epidermidis
HHYRREDTHERYDRQPQHDEAYRRNQEKPHHSDRESRTTD

SEQ ID NO: 1732138 - protein, 19 aa, Staphylococcus epidermidis
HIKQSNQNHSPQSNGNHRN

SEQ ID NO: 1732139 - protein, 15 aa, Staphylococcus epidermidis
HINENKNNALGSIGT

SEQ ID NO: 1732140 - protein, 8 aa, Staphylococcus epidermidis
HINTSDKF

SEQ ID NO: 1732141 - protein, 6 aa, Staphylococcus epidermidis
HKAKND

SEQ ID NO: 1732142 - protein, 8 aa, Staphylococcus epidermidis
HKATTDGF

SEQ ID NO: 1732143 - protein, 4 aa, Staphylococcus epidermidis
HKDK

SEQ ID NO: 1732144 - protein, 6 aa, Staphylococcus epidermidis
HKEDRI

SEQ ID NO: 1732145 - protein, 9 aa, Staphylococcus epidermidis
HKEDRTYHT

SEQ ID NO: 1732146 - protein, 20 aa, Staphylococcus epidermidis
HKGEKIDKKALQATSQTLES

SEQ ID NO: 1732147 - protein, 9 aa, Staphylococcus epidermidis
HKGKDEVQT

SEQ ID NO: 1732148 - protein, 9 aa, Staphylococcus epidermidis
HKGKDQVQT

SEQ ID NO: 1732149 - protein, 7 aa, Staphylococcus epidermidis
HKIKNED

SEQ ID NO: 1732150 - protein, 15 aa, Staphylococcus epidermidis
HKNSKALESVSKPTI

SEQ ID NO: 1732151 - protein, 7 aa, Staphylococcus epidermidis
HKNTPLG

SEQ ID NO: 1732152 - protein, 17 aa, Staphylococcus epidermidis
HKPDNQASVQRRSQPKR

SEQ ID NO: 1732153 - protein, 17 aa, Staphylococcus epidermidis
HKPEPSTAGDRRSKPRR

SEQ ID NO: 1732154 - protein, 5 aa, Staphylococcus epidermidis
HKVGE

SEQ ID NO: 1732155 - protein, 12 aa, Staphylococcus epidermidis
HLEEGQPQYNTE

SEQ ID NO: 1732156 - protein, 4 aa, Staphylococcus epidermidis
HLPH

SEQ ID NO: 1732157 - protein, 4 aa, Staphylococcus epidermidis
HLPV

SEQ ID NO: 1732158 - protein, 15 aa, Staphylococcus epidermidis
HLQTSTQRKSENQIE

SEQ ID NO: 1732159 - protein, 44 aa, Staphylococcus epidermidis
HMADQSGATLAEETTENQSYKSQAEKRAYEHKKQFQSQRKQSKW

SEQ ID NO: 1732160 - protein, 11 aa, Staphylococcus epidermidis
HMKNGQLKPGY

SEQ ID NO: 1732161 - protein, 4 aa, Staphylococcus epidermidis
HNDN

SEQ ID NO: 1732162 - protein, 18 aa, Staphylococcus epidermidis
HNEQEDKRQNTTNQRQKR

SEQ ID NO: 1732163 - protein, 6 aa, Staphylococcus epidermidis
HNETNI

SEQ ID NO: 1732164 - protein, 5 aa, Staphylococcus epidermidis
HNGDL

SEQ ID NO: 1732165 - protein, 16 aa, Staphylococcus epidermidis
HNNDSTDDEKNDAKQL

SEQ ID NO: 1732166 - protein, 7 aa, Staphylococcus epidermidis
HNPIPID

SEQ ID NO: 1732167 - protein, 9 aa, Staphylococcus epidermidis
HNRNPSNIQ

SEQ ID NO: 1732168 - protein, 12 aa, Staphylococcus epidermidis
HNTATTEEKEAA

SEQ ID NO: 1732169 - protein, 20 aa, Staphylococcus epidermidis
HNTNNENDTLVATKSNATWS

SEQ ID NO: 1732170 - protein, 5 aa, Staphylococcus epidermidis
HPDSL

SEQ ID NO: 1732171 - protein, 16 aa, Staphylococcus epidermidis
HPEPNDKEHHINNDSI

SEQ ID NO: 1732172 - protein, 35 aa, Staphylococcus epidermidis
HPESEVTASETKGNSDMSPESKVNMPRKEQTPVPP

SEQ ID NO: 1732173 - protein, 8 aa, Staphylococcus epidermidis
HPEYGGSA

SEQ ID NO: 1732174 - protein, 5 aa, Staphylococcus epidermidis
HPKAR

SEQ ID NO: 1732175 - protein, 4 aa, Staphylococcus epidermidis
HPPY

SEQ ID NO: 1732176 - protein, 23 aa, Staphylococcus epidermidis
HPSDMKKAKHIASKVDPNVVSKD

SEQ ID NO: 1732177 - protein, 13 aa, Staphylococcus epidermidis
HPSPNTAKQVYNG

SEQ ID NO: 1732178 - protein, 10 aa, Staphylococcus epidermidis
HPTSKSQAQL

SEQ ID NO: 1732179 - protein, 17 aa, Staphylococcus epidermidis
HQAISKSEGIADANGYG

SEQ ID NO: 1732180 - protein, 4 aa, Staphylococcus epidermidis
HQDA

SEQ ID NO: 1732181 - protein, 105 aa, Staphylococcus epidermidis
HQDVDSKDNNLSKDEGNQPQSSKADVVDNKEITRDQNEIHKDSATRNEPEKNHKTAEKSKHENKKPYSPINNQSTEPKNQNIEKDNNHSSQETSHNQHHENKGDH

SEQ ID NO: 1732182 - protein, 52 aa, Staphylococcus epidermidis
HQESQQRANSNRATQSKNEREYENHPERYYNGRDYRREQQLEEENEKSSKTK

SEQ ID NO: 1732183 - protein, 29 aa, Staphylococcus epidermidis
HQKDNNKTNDKVEYKQNSEQNDTSVFALV

SEQ ID NO: 1732184 - protein, 50 aa, Staphylococcus epidermidis
HQKINGATNTSNNQEEQPIQSQRDHSKANYGKNNSETDLPETGEEKGSKG

SEQ ID NO: 1732185 - protein, 25 aa, Staphylococcus epidermidis
HQNITQKASQKNNTLYSQPSNDKSY

SEQ ID NO: 1732186 - protein, 12 aa, Staphylococcus epidermidis
HQNQKVNIEDDG

SEQ ID NO: 1732187 - protein, 15 aa, Staphylococcus epidermidis
HQQNISNNNNISNSF

SEQ ID NO: 1732188 - protein, 17 aa, Staphylococcus epidermidis
HQQTHQNINQSTQDNKN

SEQ ID NO: 1732189 - protein, 9 aa, Staphylococcus epidermidis
HQRPETDAL

SEQ ID NO: 1732190 - protein, 8 aa, Staphylococcus epidermidis
HQRPETNA

SEQ ID NO: 1732191 - protein, 12 aa, Staphylococcus epidermidis
HQSFNKNSKQKV

SEQ ID NO: 1732192 - protein, 5 aa, Staphylococcus epidermidis
HQSYQ

SEQ ID NO: 1732193 - protein, 13 aa, Staphylococcus epidermidis
HQYENGKTINKTY

SEQ ID NO: 1732194 - protein, 5 aa, Staphylococcus epidermidis
HRRKY

SEQ ID NO: 1732195 - protein, 13 aa, Staphylococcus epidermidis
HSDENKKHKTTPK

SEQ ID NO: 1732196 - protein, 8 aa, Staphylococcus epidermidis
HSDQSNTI

SEQ ID NO: 1732197 - protein, 5 aa, Staphylococcus epidermidis
HSDTI

SEQ ID NO: 1732198 - protein, 8 aa, Staphylococcus epidermidis
HSENSRLS

SEQ ID NO: 1732199 - protein, 17 aa, Staphylococcus epidermidis
HSGLNNKSELTASRNTF

SEQ ID NO: 1732200 - protein, 7 aa, Staphylococcus epidermidis
HSGYGNG

SEQ ID NO: 1732201 - protein, 13 aa, Staphylococcus epidermidis
HSKKNEEEEYHVP

SEQ ID NO: 1732202 - protein, 4 aa, Staphylococcus epidermidis
HSLT

SEQ ID NO: 1732203 - protein, 11 aa, Staphylococcus epidermidis
HSNDHIRQSNL

SEQ ID NO: 1732204 - protein, 26 aa, Staphylococcus epidermidis
HSNDQDAVERKHKEAQFQKQQDEEIA

SEQ ID NO: 1732205 - protein, 26 aa, Staphylococcus epidermidis
HSNDQDSVERKEKETEFQKQQDEEIA

SEQ ID NO: 1732206 - protein, 27 aa, Staphylococcus epidermidis
HSNKERVKDGLKDINNDIKDTVGTGDY

SEQ ID NO: 1732207 - protein, 12 aa, Staphylococcus epidermidis
HSPADEAGLHKG

SEQ ID NO: 1732208 - protein, 49 aa, Staphylococcus epidermidis
HSPANDVNTLATDTGLENEEPTANDTSSQNSVATSAQQEASTAKHTEDH

SEQ ID NO: 1732209 - protein, 4 aa, Staphylococcus epidermidis
HSPR

SEQ ID NO: 1732210 - protein, 17 aa, Staphylococcus epidermidis
HSQAQEKYDYSTEISGQ

SEQ ID NO: 1732211 - protein, 7 aa, Staphylococcus epidermidis
HSQQEYP

SEQ ID NO: 1732212 - protein, 8 aa, Staphylococcus epidermidis
HSSEKQLN

SEQ ID NO: 1732213 - protein, 8 aa, Staphylococcus epidermidis
HSYSENPV

SEQ ID NO: 1732214 - protein, 6 aa, Staphylococcus epidermidis
HTIPGV

SEQ ID NO: 1732215 - protein, 42 aa, Staphylococcus epidermidis
HTKKEDRNTRRQFNRNAQQQDSYNGITDNQPDEDTSSDQLYS

SEQ ID NO: 1732216 - protein, 6 aa, Staphylococcus epidermidis
HTKSLN

SEQ ID NO: 1732217 - protein, 4 aa, Staphylococcus epidermidis
HTNG

SEQ ID NO: 1732218 - protein, 35 aa, Staphylococcus epidermidis
HTPATTKSSSGNDTSVGTDNVFSDDQSTNHTTQSS

SEQ ID NO: 1732219 - protein, 5 aa, Staphylococcus epidermidis
HTRVQ

SEQ ID NO: 1732220 - protein, 15 aa, Staphylococcus epidermidis
HTTEEVNNIKNQAVQ

SEQ ID NO: 1732221 - protein, 5 aa, Staphylococcus epidermidis
HTVQD

SEQ ID NO: 1732222 - protein, 10 aa, Staphylococcus epidermidis
HTYAPGETVK

SEQ ID NO: 1732223 - protein, 6 aa, Staphylococcus epidermidis
HVSKDK

SEQ ID NO: 1732224 - protein, 6 aa, Staphylococcus epidermidis
HYDPSK

SEQ ID NO: 1732225 - protein, 8 aa, Staphylococcus epidermidis
HYIETQKS

SEQ ID NO: 1732226 - protein, 8 aa, Staphylococcus epidermidis
IAAGSASI

SEQ ID NO: 1732227 - protein, 5 aa, Staphylococcus epidermidis
IAAST

SEQ ID NO: 1732228 - protein, 8 aa, Staphylococcus epidermidis
IADKYDKG

SEQ ID NO: 1732229 - protein, 5 aa, Staphylococcus epidermidis
IADRI

SEQ ID NO: 1732230 - protein, 44 aa, Staphylococcus epidermidis
IADYENQKQQENYLDASNNKRQDYDNAVNAAKGILNQTQSPTMG

SEQ ID NO: 1732231 - protein, 4 aa, Staphylococcus epidermidis
IAEA

SEQ ID NO: 1732232 - protein, 10 aa, Staphylococcus epidermidis
IAENGLKDGK

SEQ ID NO: 1732233 - protein, 4 aa, Staphylococcus epidermidis
IAER

SEQ ID NO: 1732234 - protein, 24 aa, Staphylococcus epidermidis
IAESIDKAQTNEEVKNIKKQSIDE

SEQ ID NO: 1732235 - protein, 8 aa, Staphylococcus epidermidis
IAKTETQM

SEQ ID NO: 1732236 - protein, 4 aa, Staphylococcus epidermidis
IANY

SEQ ID NO: 1732237 - protein, 9 aa, Staphylococcus epidermidis
IAPNGESTK

SEQ ID NO: 1732238 - protein, 15 aa, Staphylococcus epidermidis
IASETKGNSEASEVS

SEQ ID NO: 1732239 - protein, 4 aa, Staphylococcus epidermidis
IASY

SEQ ID NO: 1732240 - protein, 16 aa, Staphylococcus epidermidis
IATEGSGETISTAATS

SEQ ID NO: 1732241 - protein, 17 aa, Staphylococcus epidermidis
IATPNMDNPNGATVKNR

SEQ ID NO: 1732242 - protein, 25 aa, Staphylococcus epidermidis
IATTSSQVKQHSTQQTQAVDNTREL

SEQ ID NO: 1732243 - protein, 25 aa, Staphylococcus epidermidis
IATTSSQVKQHSTQQTQAVDSTREL

SEQ ID NO: 1732244 - protein, 13 aa, Staphylococcus epidermidis
IDAEKRNRRAEMG

SEQ ID NO: 1732245 - protein, 13 aa, Staphylococcus epidermidis
IDATSGEPSDDNG

SEQ ID NO: 1732246 - protein, 7 aa, Staphylococcus epidermidis
IDEDNKV

SEQ ID NO: 1732247 - protein, 6 aa, Staphylococcus epidermidis
IDEQVG

SEQ ID NO: 1732248 - protein, 6 aa, Staphylococcus epidermidis
IDESVG

SEQ ID NO: 1732249 - protein, 6 aa, Staphylococcus epidermidis
IDGANR

SEQ ID NO: 1732250 - protein, 9 aa, Staphylococcus epidermidis
IDGNANPVK

SEQ ID NO: 1732251 - protein, 9 aa, Staphylococcus epidermidis
IDGNNNPIK

SEQ ID NO: 1732252 - protein, 7 aa, Staphylococcus epidermidis
IDGPDEI

SEQ ID NO: 1732253 - protein, 13 aa, Staphylococcus epidermidis
IDGTEGEPTDNDG

SEQ ID NO: 1732254 - protein, 5 aa, Staphylococcus epidermidis
IDKTT

SEQ ID NO: 1732255 - protein, 21 aa, Staphylococcus epidermidis
IDNGDATTQEITYEKSKVEQA

SEQ ID NO: 1732256 - protein, 11 aa, Staphylococcus epidermidis
IDNNPNATIEE

SEQ ID NO: 1732257 - protein, 4 aa, Staphylococcus epidermidis
IDNQ

SEQ ID NO: 1732258 - protein, 13 aa, Staphylococcus epidermidis
IDPDDSRYKDDDY

SEQ ID NO: 1732259 - protein, 7 aa, Staphylococcus epidermidis
IDPDSSP

SEQ ID NO: 1732260 - protein, 19 aa, Staphylococcus epidermidis
IDQAQSNKDVDNAKTRSIQ

SEQ ID NO: 1732261 - protein, 20 aa, Staphylococcus epidermidis
IDQAQSNKDVDNAKTRSIQD

SEQ ID NO: 1732262 - protein, 17 aa, Staphylococcus epidermidis
IDQEDKENVNKDIKEYD

SEQ ID NO: 1732263 - protein, 6 aa, Staphylococcus epidermidis
IDQQGK

SEQ ID NO: 1732264 - protein, 5 aa, Staphylococcus epidermidis
IDRSH

SEQ ID NO: 1732265 - protein, 16 aa, Staphylococcus epidermidis
IDRYETAKSHKQSLER

SEQ ID NO: 1732266 - protein, 16 aa, Staphylococcus epidermidis
IDSDNSNMQLTKADDD

SEQ ID NO: 1732267 - protein, 20 aa, Staphylococcus epidermidis
IDSYKNGNISYNPEVPSYSA

SEQ ID NO: 1732268 - protein, 5 aa, Staphylococcus epidermidis
IDSYS

SEQ ID NO: 1732269 - protein, 4 aa, Staphylococcus epidermidis
IDTA

SEQ ID NO: 1732270 - protein, 15 aa, Staphylococcus epidermidis
IDTRIGEGGEMLSGG

SEQ ID NO: 1732271 - protein, 16 aa, Staphylococcus epidermidis
IDYKGDNDIFVSKKET

SEQ ID NO: 1732272 - protein, 11 aa, Staphylococcus epidermidis
IEASDNSGQVV

SEQ ID NO: 1732273 - protein, 10 aa, Staphylococcus epidermidis
IEASQNKESL

SEQ ID NO: 1732274 - protein, 6 aa, Staphylococcus epidermidis
IEEDSD

SEQ ID NO: 1732275 - protein, 4 aa, Staphylococcus epidermidis
IEEI

SEQ ID NO: 1732276 - protein, 21 aa, Staphylococcus epidermidis
IEEKPSSLEEDFNNQSDNVSA

SEQ ID NO: 1732277 - protein, 4 aa, Staphylococcus epidermidis
IEEL

SEQ ID NO: 1732278 - protein, 42 aa, Staphylococcus epidermidis
IEESDIPKKRSRRAVEGNNASDVNTVTNNTDPNSSNTGPNSL

SEQ ID NO: 1732279 - protein, 8 aa, Staphylococcus epidermidis
IEETDNDG

SEQ ID NO: 1732280 - protein, 12 aa, Staphylococcus epidermidis
IEEVTTNSKEQA

SEQ ID NO: 1732281 - protein, 16 aa, Staphylococcus epidermidis
IEGEGYANTFSTGNLK

SEQ ID NO: 1732282 - protein, 4 aa, Staphylococcus epidermidis
IEGL

SEQ ID NO: 1732283 - protein, 13 aa, Staphylococcus epidermidis
IEGPGDKPITESF

SEQ ID NO: 1732284 - protein, 7 aa, Staphylococcus epidermidis
IEHTGST

SEQ ID NO: 1732285 - protein, 4 aa, Staphylococcus epidermidis
IEKD

SEQ ID NO: 1732286 - protein, 10 aa, Staphylococcus epidermidis
IEKDKIGQDQ

SEQ ID NO: 1732287 - protein, 11 aa, Staphylococcus epidermidis
IEKDNRTMSTN

SEQ ID NO: 1732288 - protein, 25 aa, Staphylococcus epidermidis
IEKKGDKLDVTYKNENPSNTGTTKQ

SEQ ID NO: 1732289 - protein, 9 aa, Staphylococcus epidermidis
IEKVENSMT

SEQ ID NO: 1732290 - protein, 9 aa, Staphylococcus epidermidis
IENAKNTYK

SEQ ID NO: 1732291 - protein, 6 aa, Staphylococcus epidermidis
IENGSY

SEQ ID NO: 1732292 - protein, 8 aa, Staphylococcus epidermidis
IENNGNFA

SEQ ID NO: 1732293 - protein, 6 aa, Staphylococcus epidermidis
IENSQK

SEQ ID NO: 1732294 - protein, 9 aa, Staphylococcus epidermidis
IEPNSGKVE

SEQ ID NO: 1732295 - protein, 9 aa, Staphylococcus epidermidis
IEPNTGKVE

SEQ ID NO: 1732296 - protein, 8 aa, Staphylococcus epidermidis
IEPTTGEV

SEQ ID NO: 1732297 - protein, 11 aa, Staphylococcus epidermidis
IEQAKKDLNQL

SEQ ID NO: 1732298 - protein, 11 aa, Staphylococcus epidermidis
IEQKKRKRTTL

SEQ ID NO: 1732299 - protein, 9 aa, Staphylococcus epidermidis
IERSRPENH

SEQ ID NO: 1732300 - protein, 5 aa, Staphylococcus epidermidis
IESKG

SEQ ID NO: 1732301 - protein, 32 aa, Staphylococcus epidermidis
IESSENKSIKEHDNTSGNESKQHTKLTSKDSM

SEQ ID NO: 1732302 - protein, 17 aa, Staphylococcus epidermidis
IETNKQGLEKDKKENLL

SEQ ID NO: 1732303 - protein, 7 aa, Staphylococcus epidermidis
IETPREV

SEQ ID NO: 1732304 - protein, 22 aa, Staphylococcus epidermidis
IETTDNSGQTVTNKVEGLPDGV

SEQ ID NO: 1732305 - protein, 4 aa, Staphylococcus epidermidis
IGEN

SEQ ID NO: 1732306 - protein, 11 aa, Staphylococcus epidermidis
IGIEREKKETV

SEQ ID NO: 1732307 - protein, 31 aa, Staphylococcus epidermidis
IGKGLTGDYNGKNYRIGKPTSFESASEEYTQ

SEQ ID NO: 1732308 - protein, 9 aa, Staphylococcus epidermidis
IGKPDPVRG

SEQ ID NO: 1732309 - protein, 6 aa, Staphylococcus epidermidis
IGNGTP

SEQ ID NO: 1732310 - protein, 33 aa, Staphylococcus epidermidis
IGRGDNELADPTANATAENGSANRSESKGKYYH

SEQ ID NO: 1732311 - protein, 4 aa, Staphylococcus epidermidis
IGSA

SEQ ID NO: 1732312 - protein, 12 aa, Staphylococcus epidermidis
IGSDENKDRRVN

SEQ ID NO: 1732313 - protein, 8 aa, Staphylococcus epidermidis
IGTAARNG

SEQ ID NO: 1732314 - protein, 5 aa, Staphylococcus epidermidis
IGYKG

SEQ ID NO: 1732315 - protein, 14 aa, Staphylococcus epidermidis
IIEDGGNAIDAAEG

SEQ ID NO: 1732316 - protein, 10 aa, Staphylococcus epidermidis
IIKKDNKSYY

SEQ ID NO: 1732317 - protein, 21 aa, Staphylococcus epidermidis
IINNGDATAQDISSEKSKVEQ

SEQ ID NO: 1732318 - protein, 18 aa, Staphylococcus epidermidis
IKAKSAISYASSKPTIQN

SEQ ID NO: 1732319 - protein, 9 aa, Staphylococcus epidermidis
IKASKATIR

SEQ ID NO: 1732320 - protein, 9 aa, Staphylococcus epidermidis
IKDDIKDMD

SEQ ID NO: 1732321 - protein, 9 aa, Staphylococcus epidermidis
IKDGQHNQN

SEQ ID NO: 1732322 - protein, 4 aa, Staphylococcus epidermidis
IKDQ

SEQ ID NO: 1732323 - protein, 47 aa, Staphylococcus epidermidis
IKEDVNSADSEDQSTSKNTEHKPSNDSKNVSTEDKDHLEKAHSDIDN

SEQ ID NO: 1732324 - protein, 30 aa, Staphylococcus epidermidis
IKEDVTKLQEDHDKTKERQDKLDTKIEKTL

SEQ ID NO: 1732325 - protein, 8 aa, Staphylococcus epidermidis
IKEGDEVD

SEQ ID NO: 1732326 - protein, 8 aa, Staphylococcus epidermidis
IKEGDKVD

SEQ ID NO: 1732327 - protein, 50 aa, Staphylococcus epidermidis
IKEHPDVRKATDATSKATSKATSAISNKASDVKEYVGDKKQEYDNKRELK

SEQ ID NO: 1732328 - protein, 17 aa, Staphylococcus epidermidis
IKERRIADKHEQTSDLA

SEQ ID NO: 1732329 - protein, 4 aa, Staphylococcus epidermidis
IKES

SEQ ID NO: 1732330 - protein, 6 aa, Staphylococcus epidermidis
IKESYS

SEQ ID NO: 1732331 - protein, 33 aa, Staphylococcus epidermidis
IKGNSDESGEGKTVMPRKESTPEPPTVSANEMQ

SEQ ID NO: 1732332 - protein, 9 aa, Staphylococcus epidermidis
IKGSAQGDV

SEQ ID NO: 1732333 - protein, 9 aa, Staphylococcus epidermidis
IKHSRESTD

SEQ ID NO: 1732334 - protein, 9 aa, Staphylococcus epidermidis
IKKQETLYS

SEQ ID NO: 1732335 - protein, 13 aa, Staphylococcus epidermidis
IKLDTTKKSYDVE

SEQ ID NO: 1732336 - protein, 30 aa, Staphylococcus epidermidis
IKLDTTQKSYDVEVKGTAKLKGDHKNQEDF

SEQ ID NO: 1732337 - protein, 14 aa, Staphylococcus epidermidis
IKNADSQEERNAAN

SEQ ID NO: 1732338 - protein, 19 aa, Staphylococcus epidermidis
IKNDDTKKLSQISKDNKTY

SEQ ID NO: 1732339 - protein, 8 aa, Staphylococcus epidermidis
IKNDPKAF

SEQ ID NO: 1732340 - protein, 19 aa, Staphylococcus epidermidis
IKNGKTDTTIHNDKDIKKQ

SEQ ID NO: 1732341 - protein, 16 aa, Staphylococcus epidermidis
IKNKADTLNQSMTELS

SEQ ID NO: 1732342 - protein, 12 aa, Staphylococcus epidermidis
IKNSDGDTIPPG

SEQ ID NO: 1732343 - protein, 13 aa, Staphylococcus epidermidis
IKNSDGDTIPPGS

SEQ ID NO: 1732344 - protein, 4 aa, Staphylococcus epidermidis
IKNT

SEQ ID NO: 1732345 - protein, 9 aa, Staphylococcus epidermidis
IKNVSNDRT

SEQ ID NO: 1732346 - protein, 12 aa, Staphylococcus epidermidis
IKPADKNHPYGH

SEQ ID NO: 1732347 - protein, 12 aa, Staphylococcus epidermidis
IKQNTDLKAYKH

SEQ ID NO: 1732348 - protein, 5 aa, Staphylococcus epidermidis
IKQNV

SEQ ID NO: 1732349 - protein, 7 aa, Staphylococcus epidermidis
IKSEDPE

SEQ ID NO: 1732350 - protein, 8 aa, Staphylococcus epidermidis
IKSEGNII

SEQ ID NO: 1732351 - protein, 22 aa, Staphylococcus epidermidis
IKSSSFGNRTISNNHGTDDAET

SEQ ID NO: 1732352 - protein, 10 aa, Staphylococcus epidermidis
IKTSTNRVRP

SEQ ID NO: 1732353 - protein, 13 aa, Staphylococcus epidermidis
IKVSDKPTAPVKE

SEQ ID NO: 1732354 - protein, 5 aa, Staphylococcus epidermidis
IKWTG

SEQ ID NO: 1732355 - protein, 11 aa, Staphylococcus epidermidis
IKYDSSQNSIK

SEQ ID NO: 1732356 - protein, 18 aa, Staphylococcus epidermidis
IKYNSKNTFKYETYVFPK

SEQ ID NO: 1732357 - protein, 7 aa, Staphylococcus epidermidis
ILENQGQ

SEQ ID NO: 1732358 - protein, 5 aa, Staphylococcus epidermidis
ILGGR

SEQ ID NO: 1732359 - protein, 8 aa, Staphylococcus epidermidis
ILNNQSAS

SEQ ID NO: 1732360 - protein, 40 aa, Staphylococcus epidermidis
INADNEGTNEEKATAIQNVTDAKNNADNQISQATSNHDVD

SEQ ID NO: 1732361 - protein, 5 aa, Staphylococcus epidermidis
INAPH

SEQ ID NO: 1732362 - protein, 16 aa, Staphylococcus epidermidis
INATPNATEEEKQDAI

SEQ ID NO: 1732363 - protein, 18 aa, Staphylococcus epidermidis
INATPNATTDEKNEAIQR

SEQ ID NO: 1732364 - protein, 5 aa, Staphylococcus epidermidis
INDPK

SEQ ID NO: 1732365 - protein, 13 aa, Staphylococcus epidermidis
INEDANQQQAYTN

SEQ ID NO: 1732366 - protein, 27 aa, Staphylococcus epidermidis
INEKEYKKEIEEQLEDAQDKQTKEFPK

SEQ ID NO: 1732367 - protein, 7 aa, Staphylococcus epidermidis
INENEEN

SEQ ID NO: 1732368 - protein, 8 aa, Staphylococcus epidermidis
INENTGKI

SEQ ID NO: 1732369 - protein, 5 aa, Staphylococcus epidermidis
INEPK

SEQ ID NO: 1732370 - protein, 11 aa, Staphylococcus epidermidis
INGNSDKSEEV

SEQ ID NO: 1732371 - protein, 12 aa, Staphylococcus epidermidis
INGSGNKNATVQ

SEQ ID NO: 1732372 - protein, 12 aa, Staphylococcus epidermidis
INGSSNKGATVQ

SEQ ID NO: 1732373 - protein, 46 aa, Staphylococcus epidermidis
INGTNQPTINKSNVNTATQAVNNTKDALDGDHRLEEAKNNANQTIT

SEQ ID NO: 1732374 - protein, 23 aa, Staphylococcus epidermidis
INHSPNINSVNQAKDKANTVNTA

SEQ ID NO: 1732375 - protein, 4 aa, Staphylococcus epidermidis
INHT

SEQ ID NO: 1732376 - protein, 7 aa, Staphylococcus epidermidis
INIDGNN

SEQ ID NO: 1732377 - protein, 18 aa, Staphylococcus epidermidis
INKEKEAQLNELKEKQEL

SEQ ID NO: 1732378 - protein, 6 aa, Staphylococcus epidermidis
INKGDK

SEQ ID NO: 1732379 - protein, 9 aa, Staphylococcus epidermidis
INKKAETAI

SEQ ID NO: 1732380 - protein, 4 aa, Staphylococcus epidermidis
INKP

SEQ ID NO: 1732381 - protein, 22 aa, Staphylococcus epidermidis
INKQENSSSNDQASIPYEQNPN

SEQ ID NO: 1732382 - protein, 4 aa, Staphylococcus epidermidis
INLN

SEQ ID NO: 1732383 - protein, 11 aa, Staphylococcus epidermidis
INLSGGEKQRL

SEQ ID NO: 1732384 - protein, 20 aa, Staphylococcus epidermidis
INNANGNNDVDNAKNNATQV

SEQ ID NO: 1732385 - protein, 15 aa, Staphylococcus epidermidis
INNEKSITKNEDKLN

SEQ ID NO: 1732386 - protein, 20 aa, Staphylococcus epidermidis
INNGDATEQQISNETNRVNQ

SEQ ID NO: 1732387 - protein, 46 aa, Staphylococcus epidermidis
INNGDATSQQINDAKNTVEQAQREYAEAKSNLRADKSQLQSAYDTL

SEQ ID NO: 1732388 - protein, 4 aa, Staphylococcus epidermidis
INNN

SEQ ID NO: 1732389 - protein, 9 aa, Staphylococcus epidermidis
INNPQSQQH

SEQ ID NO: 1732390 - protein, 14 aa, Staphylococcus epidermidis
INNQHEYSVRNRNQ

SEQ ID NO: 1732391 - protein, 22 aa, Staphylococcus epidermidis
INNSIQNAHTNAEVTESLNDGI

SEQ ID NO: 1732392 - protein, 5 aa, Staphylococcus epidermidis
INNSK

SEQ ID NO: 1732393 - protein, 13 aa, Staphylococcus epidermidis
INNSTRDAQVDAV

SEQ ID NO: 1732394 - protein, 26 aa, Staphylococcus epidermidis
INQNNEATQEEKNEAVTQVDTHSADA

SEQ ID NO: 1732395 - protein, 6 aa, Staphylococcus epidermidis
INQRGN

SEQ ID NO: 1732396 - protein, 32 aa, Staphylococcus epidermidis
INQTVQTDGMTQQSVDAYQNAKREAQNESNTA

SEQ ID NO: 1732397 - protein, 21 aa, Staphylococcus epidermidis
INSEASIQTSDNEENSRVSDF

SEQ ID NO: 1732398 - protein, 5 aa, Staphylococcus epidermidis
INSQY

SEQ ID NO: 1732399 - protein, 12 aa, Staphylococcus epidermidis
INSSSGHRNQNN

SEQ ID NO: 1732400 - protein, 7 aa, Staphylococcus epidermidis
INTGNAA

SEQ ID NO: 1732401 - protein, 5 aa, Staphylococcus epidermidis
IPAHR

SEQ ID NO: 1732402 - protein, 12 aa, Staphylococcus epidermidis
IPANEDGLNEAV

SEQ ID NO: 1732403 - protein, 15 aa, Staphylococcus epidermidis
IPDDSLKANNTSAHK

SEQ ID NO: 1732404 - protein, 26 aa, Staphylococcus epidermidis
IPDEYAKDVSKEARTEQLPEGKTALG

SEQ ID NO: 1732405 - protein, 24 aa, Staphylococcus epidermidis
IPDEYAKEVSEEARKEQLPEGKTA

SEQ ID NO: 1732406 - protein, 6 aa, Staphylococcus epidermidis
IPDGDT

SEQ ID NO: 1732407 - protein, 25 aa, Staphylococcus epidermidis
IPEDNVSSKQKKPISQETLKPENQH

SEQ ID NO: 1732408 - protein, 8 aa, Staphylococcus epidermidis
IPEGTKLN

SEQ ID NO: 1732409 - protein, 11 aa, Staphylococcus epidermidis
IPENRQGPALG

SEQ ID NO: 1732410 - protein, 6 aa, Staphylococcus epidermidis
IPESYR

SEQ ID NO: 1732411 - protein, 4 aa, Staphylococcus epidermidis
IPGG

SEQ ID NO: 1732412 - protein, 12 aa, Staphylococcus epidermidis
IPGKIRRKVTFL

SEQ ID NO: 1732413 - protein, 8 aa, Staphylococcus epidermidis
IPNDESTK

SEQ ID NO: 1732414 - protein, 4 aa, Staphylococcus epidermidis
IPNI

SEQ ID NO: 1732415 - protein, 15 aa, Staphylococcus epidermidis
IPNITTDKRGEVPQS

SEQ ID NO: 1732416 - protein, 16 aa, Staphylococcus epidermidis
IPNITTDKRNDVPQSL

SEQ ID NO: 1732417 - protein, 5 aa, Staphylococcus epidermidis
IPNMK

SEQ ID NO: 1732418 - protein, 11 aa, Staphylococcus epidermidis
IPPREKEETLK

SEQ ID NO: 1732419 - protein, 4 aa, Staphylococcus epidermidis
IPQG

SEQ ID NO: 1732420 - protein, 16 aa, Staphylococcus epidermidis
IPSNIKQGNSAQGEQI

SEQ ID NO: 1732421 - protein, 15 aa, Staphylococcus epidermidis
IPTKPISDDKLKKEI

SEQ ID NO: 1732422 - protein, 8 aa, Staphylococcus epidermidis
IPTNKKPK

SEQ ID NO: 1732423 - protein, 11 aa, Staphylococcus epidermidis
IPTPPSAKRSY

SEQ ID NO: 1732424 - protein, 9 aa, Staphylococcus epidermidis
IQDKYKNPL

SEQ ID NO: 1732425 - protein, 6 aa, Staphylococcus epidermidis
IQENND

SEQ ID NO: 1732426 - protein, 9 aa, Staphylococcus epidermidis
IQENRGDLI

SEQ ID NO: 1732427 - protein, 8 aa, Staphylococcus epidermidis
IQNDKSDA

SEQ ID NO: 1732428 - protein, 10 aa, Staphylococcus epidermidis
IQPASEGDAA

SEQ ID NO: 1732429 - protein, 43 aa, Staphylococcus epidermidis
IQPATTVKTNAKQDLQRKANEQKEQINQTPDATEEEKQEAISR

SEQ ID NO: 1732430 - protein, 7 aa, Staphylococcus epidermidis
IQPNGRN

SEQ ID NO: 1732431 - protein, 10 aa, Staphylococcus epidermidis
IQPSKTNTPH

SEQ ID NO: 1732432 - protein, 59 aa, Staphylococcus epidermidis
IQQDFKSDSNNKPSEQSNQQASSSNKTENNKEESSTTTNQSDSDSKDDKSNDGRRSTLE

SEQ ID NO: 1732433 - protein, 58 aa, Staphylococcus epidermidis
IQQDFKSDSNNNPSEQSDQQASPSNKTENNKEESSTTTNQSDSDSKDDKSNDGHRSTL

SEQ ID NO: 1732434 - protein, 4 aa, Staphylococcus epidermidis
IQQS

SEQ ID NO: 1732435 - protein, 10 aa, Staphylococcus epidermidis
IQQSITDKEH

SEQ ID NO: 1732436 - protein, 6 aa, Staphylococcus epidermidis
IQREGI

SEQ ID NO: 1732437 - protein, 11 aa, Staphylococcus epidermidis
IQRKGEDLKSE

SEQ ID NO: 1732438 - protein, 22 aa, Staphylococcus epidermidis
IQTPYSKETKVDEIKDDMKDTK

SEQ ID NO: 1732439 - protein, 11 aa, Staphylococcus epidermidis
IRAKRDKFKEK

SEQ ID NO: 1732440 - protein, 8 aa, Staphylococcus epidermidis
IRDDGERS

SEQ ID NO: 1732441 - protein, 10 aa, Staphylococcus epidermidis
IRDPKEAIKD

SEQ ID NO: 1732442 - protein, 9 aa, Staphylococcus epidermidis
IREALSSST

SEQ ID NO: 1732443 - protein, 4 aa, Staphylococcus epidermidis
IREN

SEQ ID NO: 1732444 - protein, 6 aa, Staphylococcus epidermidis
IRESKV

SEQ ID NO: 1732445 - protein, 10 aa, Staphylococcus epidermidis
IRGDKDVKSL

SEQ ID NO: 1732446 - protein, 8 aa, Staphylococcus epidermidis
IRHDAKNK

SEQ ID NO: 1732447 - protein, 13 aa, Staphylococcus epidermidis
IRKYDDEESLRRH

SEQ ID NO: 1732448 - protein, 14 aa, Staphylococcus epidermidis
IRKYDDEESLRRRH

SEQ ID NO: 1732449 - protein, 12 aa, Staphylococcus epidermidis
IRNKGANKLEES

SEQ ID NO: 1732450 - protein, 22 aa, Staphylococcus epidermidis
IRQNTSEANSHTQALDTARSQL

SEQ ID NO: 1732451 - protein, 6 aa, Staphylococcus epidermidis
ISAETS

SEQ ID NO: 1732452 - protein, 6 aa, Staphylococcus epidermidis
ISASTG

SEQ ID NO: 1732453 - protein, 11 aa, Staphylococcus epidermidis
ISDHSLKATTK

SEQ ID NO: 1732454 - protein, 8 aa, Staphylococcus epidermidis
ISDKPGFA

SEQ ID NO: 1732455 - protein, 9 aa, Staphylococcus epidermidis
ISDSANGGV

SEQ ID NO: 1732456 - protein, 7 aa, Staphylococcus epidermidis
ISDSQGM

SEQ ID NO: 1732457 - protein, 7 aa, Staphylococcus epidermidis
ISEKQEV

SEQ ID NO: 1732458 - protein, 13 aa, Staphylococcus epidermidis
ISEQNKSEKDTTV

SEQ ID NO: 1732459 - protein, 9 aa, Staphylococcus epidermidis
ISERSLADK

SEQ ID NO: 1732460 - protein, 7 aa, Staphylococcus epidermidis
ISGSIGT

SEQ ID NO: 1732461 - protein, 6 aa, Staphylococcus epidermidis
ISGYEN

SEQ ID NO: 1732462 - protein, 8 aa, Staphylococcus epidermidis
ISHPDRPT

SEQ ID NO: 1732463 - protein, 14 aa, Staphylococcus epidermidis
ISIEGKANNQGSGH

SEQ ID NO: 1732464 - protein, 4 aa, Staphylococcus epidermidis
ISKD

SEQ ID NO: 1732465 - protein, 19 aa, Staphylococcus epidermidis
ISKTQLPDTGYSDKASKSN

SEQ ID NO: 1732466 - protein, 4 aa, Staphylococcus epidermidis
ISNT

SEQ ID NO: 1732467 - protein, 10 aa, Staphylococcus epidermidis
ISPADKADKL

SEQ ID NO: 1732468 - protein, 13 aa, Staphylococcus epidermidis
ISPATKIKEDARV

SEQ ID NO: 1732469 - protein, 6 aa, Staphylococcus epidermidis
ISPGQG

SEQ ID NO: 1732470 - protein, 4 aa, Staphylococcus epidermidis
ISPH

SEQ ID NO: 1732471 - protein, 4 aa, Staphylococcus epidermidis
ISPK

SEQ ID NO: 1732472 - protein, 13 aa, Staphylococcus epidermidis
ISPLSDTTNLAAG

SEQ ID NO: 1732473 - protein, 5 aa, Staphylococcus epidermidis
ISPSI

SEQ ID NO: 1732474 - protein, 16 aa, Staphylococcus epidermidis
ISQSDANQAQLDPAEI

SEQ ID NO: 1732475 - protein, 115 aa, Staphylococcus epidermidis
ISRHPQSVRNAESEITKAEKNDEEQNITSNNKENNAATHQNVDSTSHDETRSNENDVADSTLQSKQSHNDTQQSNLSTYHQRPQHREIPQNQHNHDQQQSQIGQQAKQVTNESKG

SEQ ID NO: 1732476 - protein, 115 aa, Staphylococcus epidermidis
ISRHPQSVRNAESEITKAEKNDEEQNITSNNKENNVATHQNVDSTSHDETRSNENDVADSTLQSKQSHNDIQQSNLSTYHQRPQHREIPQNQHNHNQQQSQIGQQAKQVTNESKG

SEQ ID NO: 1732477 - protein, 13 aa, Staphylococcus epidermidis
ISRSYSDKYPENQ

SEQ ID NO: 1732478 - protein, 7 aa, Staphylococcus epidermidis
ISSEREP

SEQ ID NO: 1732479 - protein, 10 aa, Staphylococcus epidermidis
ISSETVEAGS

SEQ ID NO: 1732480 - protein, 76 aa, Staphylococcus epidermidis
ISSKDGEDFKKPKDVNGSDGDNLSVAGHPDNNTTNRSVHGDSDTSSSSSSNGSSSSSNSSSGNTNGSSQSSSGNAL

SEQ ID NO: 1732481 - protein, 9 aa, Staphylococcus epidermidis
ISSKNNKGY

SEQ ID NO: 1732482 - protein, 10 aa, Staphylococcus epidermidis
ISSSDKEEEI

SEQ ID NO: 1732483 - protein, 5 aa, Staphylococcus epidermidis
ISTIT

SEQ ID NO: 1732484 - protein, 6 aa, Staphylococcus epidermidis
ISTNKG

SEQ ID NO: 1732485 - protein, 16 aa, Staphylococcus epidermidis
ISTNMSRDQEESHKSN

SEQ ID NO: 1732486 - protein, 16 aa, Staphylococcus epidermidis
ISTRGGSGNYNNATNK

SEQ ID NO: 1732487 - protein, 7 aa, Staphylococcus epidermidis
ISTSDVN

SEQ ID NO: 1732488 - protein, 6 aa, Staphylococcus epidermidis
ISTSEH

SEQ ID NO: 1732489 - protein, 16 aa, Staphylococcus epidermidis
ISVTSTDTSGNTSKAT

SEQ ID NO: 1732490 - protein, 12 aa, Staphylococcus epidermidis
ITADKKDQNLYG

SEQ ID NO: 1732491 - protein, 7 aa, Staphylococcus epidermidis
ITANKGI

SEQ ID NO: 1732492 - protein, 7 aa, Staphylococcus epidermidis
ITDENGQ

SEQ ID NO: 1732493 - protein, 7 aa, Staphylococcus epidermidis
ITDENPI

SEQ ID NO: 1732494 - protein, 9 aa, Staphylococcus epidermidis
ITDGEDRAR

SEQ ID NO: 1732495 - protein, 8 aa, Staphylococcus epidermidis
ITDSNGEM

SEQ ID NO: 1732496 - protein, 7 aa, Staphylococcus epidermidis
ITDYTDR

SEQ ID NO: 1732497 - protein, 12 aa, Staphylococcus epidermidis
ITETGKTPLGNY

SEQ ID NO: 1732498 - protein, 10 aa, Staphylococcus epidermidis
ITGDPVSERI

SEQ ID NO: 1732499 - protein, 7 aa, Staphylococcus epidermidis
ITGEEKK

SEQ ID NO: 1732500 - protein, 10 aa, Staphylococcus epidermidis
ITGENSKKYR

SEQ ID NO: 1732501 - protein, 18 aa, Staphylococcus epidermidis
ITGKKLERKDFRKGYTAE

SEQ ID NO: 1732502 - protein, 6 aa, Staphylococcus epidermidis
ITGMGT

SEQ ID NO: 1732503 - protein, 17 aa, Staphylococcus epidermidis
ITGNNNITDKDKFKTSI

SEQ ID NO: 1732504 - protein, 18 aa, Staphylococcus epidermidis
ITGRKLERKDFRKGYTAE

SEQ ID NO: 1732505 - protein, 7 aa, Staphylococcus epidermidis
ITGTSRS

SEQ ID NO: 1732506 - protein, 16 aa, Staphylococcus epidermidis
ITKPAVTQKLEEAKAI

SEQ ID NO: 1732507 - protein, 9 aa, Staphylococcus epidermidis
ITKSSIKKE

SEQ ID NO: 1732508 - protein, 4 aa, Staphylococcus epidermidis
ITLE

SEQ ID NO: 1732509 - protein, 6 aa, Staphylococcus epidermidis
ITMGDS

SEQ ID NO: 1732510 - protein, 18 aa, Staphylococcus epidermidis
ITPATTVKTDARKAIQDK

SEQ ID NO: 1732511 - protein, 56 aa, Staphylococcus epidermidis
ITPATTVKTNAKNEIDSQSDNKKVKNEKATDATDEEIQEANRKVDEAQAEAKTNIQ

SEQ ID NO: 1732512 - protein, 4 aa, Staphylococcus epidermidis
ITPD

SEQ ID NO: 1732513 - protein, 7 aa, Staphylococcus epidermidis
ITPNSNK

SEQ ID NO: 1732514 - protein, 23 aa, Staphylococcus epidermidis
ITPTLDSKAPNTIQKSDFTAGRM

SEQ ID NO: 1732515 - protein, 20 aa, Staphylococcus epidermidis
ITPTLDSKAPNTTQESGFTA

SEQ ID NO: 1732516 - protein, 7 aa, Staphylococcus epidermidis
ITSGQNK

SEQ ID NO: 1732517 - protein, 4 aa, Staphylococcus epidermidis
ITSR

SEQ ID NO: 1732518 - protein, 12 aa, Staphylococcus epidermidis
ITTTDNSKDVLT

SEQ ID NO: 1732519 - protein, 14 aa, Staphylococcus epidermidis
ITYDNTNEISDSYH

SEQ ID NO: 1732520 - protein, 5 aa, Staphylococcus epidermidis
IVDQD

SEQ ID NO: 1732521 - protein, 9 aa, Staphylococcus epidermidis
IVESGNHDT

SEQ ID NO: 1732522 - protein, 6 aa, Staphylococcus epidermidis
IVNGTN

SEQ ID NO: 1732523 - protein, 15 aa, Staphylococcus epidermidis
IYDPKTLKSPLDREQ

SEQ ID NO: 1732524 - protein, 28 aa, Staphylococcus epidermidis
IYSNKDNELLTEKPKDFDKNKKQVEKDL

SEQ ID NO: 1732525 - protein, 28 aa, Staphylococcus epidermidis
IYSNKDNELLTKKPKDFDKNKKQVEKDL

SEQ ID NO: 1732526 - protein, 14 aa, Staphylococcus epidermidis
KADDETQSSADSYI

SEQ ID NO: 1732527 - protein, 12 aa, Staphylococcus epidermidis
KADSGNAVKKGD

SEQ ID NO: 1732528 - protein, 5 aa, Staphylococcus epidermidis
KAGAF

SEQ ID NO: 1732529 - protein, 6 aa, Staphylococcus epidermidis
KAGITD

SEQ ID NO: 1732530 - protein, 13 aa, Staphylococcus epidermidis
KAGSQTTIEQTKV

SEQ ID NO: 1732531 - protein, 16 aa, Staphylococcus epidermidis
KAGTENTNGKAPIGGN

SEQ ID NO: 1732532 - protein, 6 aa, Staphylococcus epidermidis
KAINNL

SEQ ID NO: 1732533 - protein, 8 aa, Staphylococcus epidermidis
KAISNNES

SEQ ID NO: 1732534 - protein, 59 aa, Staphylococcus epidermidis
KAKAQQQKQAIQQNNEATNEEKATAENSVDQAVTTATANINRANTNAEVDQAQSNGDNA

SEQ ID NO: 1732535 - protein, 19 aa, Staphylococcus epidermidis
KAKDEVSKATKKAENAMKK

SEQ ID NO: 1732536 - protein, 10 aa, Staphylococcus epidermidis
KAKDSSGQYV

SEQ ID NO: 1732537 - protein, 8 aa, Staphylococcus epidermidis
KAKEKDAI

SEQ ID NO: 1732538 - protein, 7 aa, Staphylococcus epidermidis
KAKGTHN

SEQ ID NO: 1732539 - protein, 11 aa, Staphylococcus epidermidis
KAKKQGMSLQN

SEQ ID NO: 1732540 - protein, 11 aa, Staphylococcus epidermidis
KAKNDSVHQKG

SEQ ID NO: 1732541 - protein, 14 aa, Staphylococcus epidermidis
KAKNEGTSNNPEFK

SEQ ID NO: 1732542 - protein, 5 aa, Staphylococcus epidermidis
KALAN

SEQ ID NO: 1732543 - protein, 13 aa, Staphylococcus epidermidis
KALDEKGLTADDV

SEQ ID NO: 1732544 - protein, 96 aa, Staphylococcus epidermidis
KALEDYDNKKLKEKDIKAKDKTTKEVKKADKAIDDHNAKKPKEKEIKAKDKTTKEVKKADKSLDDHNKKKADEKELKAKDEISDLTKKVKSSLKEI

SEQ ID NO: 1732545 - protein, 6 aa, Staphylococcus epidermidis
KALNNA

SEQ ID NO: 1732546 - protein, 6 aa, Staphylococcus epidermidis
KANDLN

SEQ ID NO: 1732547 - protein, 12 aa, Staphylococcus epidermidis
KANGTAEKVSPR

SEQ ID NO: 1732548 - protein, 17 aa, Staphylococcus epidermidis
KANSDYNIESSTPQDFD

SEQ ID NO: 1732549 - protein, 4 aa, Staphylococcus epidermidis
KAPG

SEQ ID NO: 1732550 - protein, 6 aa, Staphylococcus epidermidis
KAPKTD

SEQ ID NO: 1732551 - protein, 21 aa, Staphylococcus epidermidis
KAQEMSDSAENNTELTSEERE

SEQ ID NO: 1732552 - protein, 13 aa, Staphylococcus epidermidis
KAQINDAESSNHV

SEQ ID NO: 1732553 - protein, 11 aa, Staphylococcus epidermidis
KAQKGAQSNYS

SEQ ID NO: 1732554 - protein, 18 aa, Staphylococcus epidermidis
KAQLEDVTNKVNAANTLT

SEQ ID NO: 1732555 - protein, 19 aa, Staphylococcus epidermidis
KAQTREKVAEQLQSAQALN

SEQ ID NO: 1732556 - protein, 30 aa, Staphylococcus epidermidis
KARGNASTKADEAKGKLDNFNNTKTPTKNL

SEQ ID NO: 1732557 - protein, 6 aa, Staphylococcus epidermidis
KARQSI

SEQ ID NO: 1732558 - protein, 52 aa, Staphylococcus epidermidis
KARVGDYQEAAGRAQDVNNQANQNLRNQASTTPQSAIKSSHSEGKSHSNIKT

SEQ ID NO: 1732559 - protein, 6 aa, Staphylococcus epidermidis
KASDYG

SEQ ID NO: 1732560 - protein, 11 aa, Staphylococcus epidermidis
KATDKSGNENI

SEQ ID NO: 1732561 - protein, 4 aa, Staphylococcus epidermidis
KATP

SEQ ID NO: 1732562 - protein, 8 aa, Staphylococcus epidermidis
KATQDLNT

SEQ ID NO: 1732563 - protein, 5 aa, Staphylococcus epidermidis
KATRE

SEQ ID NO: 1732564 - protein, 13 aa, Staphylococcus epidermidis
KAVDYSTAISQEI

SEQ ID NO: 1732565 - protein, 6 aa, Staphylococcus epidermidis
KAVGAS

SEQ ID NO: 1732566 - protein, 9 aa, Staphylococcus epidermidis
KAVNPPNVM

SEQ ID NO: 1732567 - protein, 7 aa, Staphylococcus epidermidis
KAVVDTT

SEQ ID NO: 1732568 - protein, 10 aa, Staphylococcus epidermidis
KAYGSAYGHG

SEQ ID NO: 1732569 - protein, 4 aa, Staphylococcus epidermidis
KDAQ

SEQ ID NO: 1732570 - protein, 16 aa, Staphylococcus epidermidis
KDAQAKAHNDIKETLK

SEQ ID NO: 1732571 - protein, 11 aa, Staphylococcus epidermidis
KDASSISDKDL

SEQ ID NO: 1732572 - protein, 5 aa, Staphylococcus epidermidis
KDCGP

SEQ ID NO: 1732573 - protein, 9 aa, Staphylococcus epidermidis
KDDAPRQST

SEQ ID NO: 1732574 - protein, 8 aa, Staphylococcus epidermidis
KDDASGLA

SEQ ID NO: 1732575 - protein, 14 aa, Staphylococcus epidermidis
KDDATISVSQSEVN

SEQ ID NO: 1732576 - protein, 37 aa, Staphylococcus epidermidis
KDDKDGRKNRIKNQKNGDENKVKDVQTEELPKTGLTN

SEQ ID NO: 1732577 - protein, 17 aa, Staphylococcus epidermidis
KDDKDKRKDYHNDQVSS

SEQ ID NO: 1732578 - protein, 15 aa, Staphylococcus epidermidis
KDDKPQGTVSTGDAL

SEQ ID NO: 1732579 - protein, 10 aa, Staphylococcus epidermidis
KDDKSNTGNR

SEQ ID NO: 1732580 - protein, 18 aa, Staphylococcus epidermidis
KDDNSGRPIENEKKYPVK

SEQ ID NO: 1732581 - protein, 19 aa, Staphylococcus epidermidis
KDDSNGRPIENEKKYPVKM

SEQ ID NO: 1732582 - protein, 7 aa, Staphylococcus epidermidis
KDEANEI

SEQ ID NO: 1732583 - protein, 9 aa, Staphylococcus epidermidis
KDEGPRQSS

SEQ ID NO: 1732584 - protein, 8 aa, Staphylococcus epidermidis
KDEIESGL

SEQ ID NO: 1732585 - protein, 6 aa, Staphylococcus epidermidis
KDEPNV

SEQ ID NO: 1732586 - protein, 8 aa, Staphylococcus epidermidis
KDEPYNTY

SEQ ID NO: 1732587 - protein, 8 aa, Staphylococcus epidermidis
KDERLKET

SEQ ID NO: 1732588 - protein, 4 aa, Staphylococcus epidermidis
KDFK

SEQ ID NO: 1732589 - protein, 4 aa, Staphylococcus epidermidis
KDFS

SEQ ID NO: 1732590 - protein, 4 aa, Staphylococcus epidermidis
KDGE

SEQ ID NO: 1732591 - protein, 17 aa, Staphylococcus epidermidis
KDGEVDSENTDGTNIKY

SEQ ID NO: 1732592 - protein, 4 aa, Staphylococcus epidermidis
KDGL

SEQ ID NO: 1732593 - protein, 13 aa, Staphylococcus epidermidis
KDGVGDPELTRNS

SEQ ID NO: 1732594 - protein, 4 aa, Staphylococcus epidermidis
KDHE

SEQ ID NO: 1732595 - protein, 21 aa, Staphylococcus epidermidis
KDHSGSSVSQTYKINKDKTIS

SEQ ID NO: 1732596 - protein, 7 aa, Staphylococcus epidermidis
KDHSKET

SEQ ID NO: 1732597 - protein, 4 aa, Staphylococcus epidermidis
KDIE

SEQ ID NO: 1732598 - protein, 6 aa, Staphylococcus epidermidis
KDIGSK

SEQ ID NO: 1732599 - protein, 15 aa, Staphylococcus epidermidis
KDISDKQREKDSLQA

SEQ ID NO: 1732600 - protein, 7 aa, Staphylococcus epidermidis
KDKGATL

SEQ ID NO: 1732601 - protein, 8 aa, Staphylococcus epidermidis
KDKGFKVG

SEQ ID NO: 1732602 - protein, 8 aa, Staphylococcus epidermidis
KDKKLENK

SEQ ID NO: 1732603 - protein, 8 aa, Staphylococcus epidermidis
KDKKMSHS

SEQ ID NO: 1732604 - protein, 8 aa, Staphylococcus epidermidis
KDKKVNND

SEQ ID NO: 1732605 - protein, 6 aa, Staphylococcus epidermidis
KDKLPN

SEQ ID NO: 1732606 - protein, 14 aa, Staphylococcus epidermidis
KDKPEKSKDPKDHP

SEQ ID NO: 1732607 - protein, 10 aa, Staphylococcus epidermidis
KDKPIKPARK

SEQ ID NO: 1732608 - protein, 6 aa, Staphylococcus epidermidis
KDKRIQ

SEQ ID NO: 1732609 - protein, 53 aa, Staphylococcus epidermidis
KDKTDVNENATAQLRQNHSKSQSDWNHQQNQQHKDAWDPEQEINKQKKDDPYI

SEQ ID NO: 1732610 - protein, 53 aa, Staphylococcus epidermidis
KDKTDVNENATAQLRQNHSKSQSDWNHQQNQQQKDAWDPEQEINKQKKDDPYI

SEQ ID NO: 1732611 - protein, 6 aa, Staphylococcus epidermidis
KDLAAA

SEQ ID NO: 1732612 - protein, 10 aa, Staphylococcus epidermidis
KDLDGKNLDK

SEQ ID NO: 1732613 - protein, 11 aa, Staphylococcus epidermidis
KDLGETEESMG

SEQ ID NO: 1732614 - protein, 8 aa, Staphylococcus epidermidis
KDLGPVSA

SEQ ID NO: 1732615 - protein, 10 aa, Staphylococcus epidermidis
KDLNGKNLDK

SEQ ID NO: 1732616 - protein, 6 aa, Staphylococcus epidermidis
KDLPEL

SEQ ID NO: 1732617 - protein, 18 aa, Staphylococcus epidermidis
KDLSGLDDEEPTETQTEL

SEQ ID NO: 1732618 - protein, 8 aa, Staphylococcus epidermidis
KDMPSDLK

SEQ ID NO: 1732619 - protein, 11 aa, Staphylococcus epidermidis
KDMQGTVGATQ

SEQ ID NO: 1732620 - protein, 9 aa, Staphylococcus epidermidis
KDNGEGFDK

SEQ ID NO: 1732621 - protein, 12 aa, Staphylococcus epidermidis
KDNNKIKPKDFY

SEQ ID NO: 1732622 - protein, 6 aa, Staphylococcus epidermidis
KDNQIK

SEQ ID NO: 1732623 - protein, 12 aa, Staphylococcus epidermidis
KDNREKIYPSSS

SEQ ID NO: 1732624 - protein, 8 aa, Staphylococcus epidermidis
KDNTHANE

SEQ ID NO: 1732625 - protein, 9 aa, Staphylococcus epidermidis
KDPLDTKKV

SEQ ID NO: 1732626 - protein, 6 aa, Staphylococcus epidermidis
KDPYDI

SEQ ID NO: 1732627 - protein, 50 aa, Staphylococcus epidermidis
KDQIDKNTAKSNTINEVNDTSRTGNSMNSDNDLDTDIVSDSDSDSDIDTY

SEQ ID NO: 1732628 - protein, 5 aa, Staphylococcus epidermidis
KDQNS

SEQ ID NO: 1732629 - protein, 13 aa, Staphylococcus epidermidis
KDRDMSKSIAKEL

SEQ ID NO: 1732630 - protein, 13 aa, Staphylococcus epidermidis
KDRHDINEGKDVH

SEQ ID NO: 1732631 - protein, 19 aa, Staphylococcus epidermidis
KDRHDINESKDVHDLKTSY

SEQ ID NO: 1732632 - protein, 14 aa, Staphylococcus epidermidis
KDRHDMNDGKDVHD

SEQ ID NO: 1732633 - protein, 14 aa, Staphylococcus epidermidis
KDRKVRKELEEKNR

SEQ ID NO: 1732634 - protein, 18 aa, Staphylococcus epidermidis
KDRLSSVKKVSEKMPKSM

SEQ ID NO: 1732635 - protein, 13 aa, Staphylococcus epidermidis
KDRNSYSKTDHDA

SEQ ID NO: 1732636 - protein, 21 aa, Staphylococcus epidermidis
KDRNSYSKTDHMKNGQLKPGY

SEQ ID NO: 1732637 - protein, 5 aa, Staphylococcus epidermidis
KDRPS

SEQ ID NO: 1732638 - protein, 7 aa, Staphylococcus epidermidis
KDRREGV

SEQ ID NO: 1732639 - protein, 23 aa, Staphylococcus epidermidis
KDSALKQSSHQANNEEEQYKEHV

SEQ ID NO: 1732640 - protein, 23 aa, Staphylococcus epidermidis
KDSKSINDAIKQQQKNKDEKVKN

SEQ ID NO: 1732641 - protein, 20 aa, Staphylococcus epidermidis
KDSKWEKKNQLNVDKNNGGV

SEQ ID NO: 1732642 - protein, 35 aa, Staphylococcus epidermidis
KDSLHGANKLAQNQADSNSIINQSSNLNDKQKQAL

SEQ ID NO: 1732643 - protein, 7 aa, Staphylococcus epidermidis
KDSLSNH

SEQ ID NO: 1732644 - protein, 6 aa, Staphylococcus epidermidis
KDSPEL

SEQ ID NO: 1732645 - protein, 8 aa, Staphylococcus epidermidis
KDSRHQSY

SEQ ID NO: 1732646 - protein, 7 aa, Staphylococcus epidermidis
KDSSQKM

SEQ ID NO: 1732647 - protein, 17 aa, Staphylococcus epidermidis
KDSTNSEAGYRSHEDRS

SEQ ID NO: 1732648 - protein, 6 aa, Staphylococcus epidermidis
KDSTRF

SEQ ID NO: 1732649 - protein, 7 aa, Staphylococcus epidermidis
KDTIDKA

SEQ ID NO: 1732650 - protein, 7 aa, Staphylococcus epidermidis
KDTIDKT

SEQ ID NO: 1732651 - protein, 15 aa, Staphylococcus epidermidis
KDTVSNQTNDTSFDH

SEQ ID NO: 1732652 - protein, 7 aa, Staphylococcus epidermidis
KDVDYST

SEQ ID NO: 1732653 - protein, 4 aa, Staphylococcus epidermidis
KDYD

SEQ ID NO: 1732654 - protein, 7 aa, Staphylococcus epidermidis
KDYHGIK

SEQ ID NO: 1732655 - protein, 21 aa, Staphylococcus epidermidis
KDYKDGEISYNPNVPSYSAQY

SEQ ID NO: 1732656 - protein, 6 aa, Staphylococcus epidermidis
KDYTEG

SEQ ID NO: 1732657 - protein, 17 aa, Staphylococcus epidermidis
KDYYKKQSSDKLTQSAI

SEQ ID NO: 1732658 - protein, 47 aa, Staphylococcus epidermidis
KEAEQEQEQQEESQDVSHQKVEQQASSNENKDEQYEGKKQGHREEDE

SEQ ID NO: 1732659 - protein, 11 aa, Staphylococcus epidermidis
KEAESIKPVDQ

SEQ ID NO: 1732660 - protein, 7 aa, Staphylococcus epidermidis
KEAGGHI

SEQ ID NO: 1732661 - protein, 9 aa, Staphylococcus epidermidis
KEAGGHIPE

SEQ ID NO: 1732662 - protein, 7 aa, Staphylococcus epidermidis
KEAITNP

SEQ ID NO: 1732663 - protein, 8 aa, Staphylococcus epidermidis
KEANGNTL

SEQ ID NO: 1732664 - protein, 4 aa, Staphylococcus epidermidis
KEAS

SEQ ID NO: 1732665 - protein, 5 aa, Staphylococcus epidermidis
KEDAI

SEQ ID NO: 1732666 - protein, 36 aa, Staphylococcus epidermidis
KEDENVSSNSKEMSQYTSAEKNNRDYNLQPKTKSEY

SEQ ID NO: 1732667 - protein, 5 aa, Staphylococcus epidermidis
KEDKI

SEQ ID NO: 1732668 - protein, 6 aa, Staphylococcus epidermidis
KEDRKG

SEQ ID NO: 1732669 - protein, 8 aa, Staphylococcus epidermidis
KEEADEDR

SEQ ID NO: 1732670 - protein, 13 aa, Staphylococcus epidermidis
KEEEPKNKWKPDE

SEQ ID NO: 1732671 - protein, 6 aa, Staphylococcus epidermidis
KEEGRL

SEQ ID NO: 1732672 - protein, 12 aa, Staphylococcus epidermidis
KEFDNKSPSDAI

SEQ ID NO: 1732673 - protein, 13 aa, Staphylococcus epidermidis
KEGANLSGGQAQR

SEQ ID NO: 1732674 - protein, 12 aa, Staphylococcus epidermidis
KEGEQGSRAENI

SEQ ID NO: 1732675 - protein, 16 aa, Staphylococcus epidermidis
KEGFRDDNFDKDDKGT

SEQ ID NO: 1732676 - protein, 18 aa, Staphylococcus epidermidis
KEGIRTKNNASDIPLTNV

SEQ ID NO: 1732677 - protein, 8 aa, Staphylococcus epidermidis
KEGNEELK

SEQ ID NO: 1732678 - protein, 22 aa, Staphylococcus epidermidis
KEGQKNCKSGQTISIANGEAVA

SEQ ID NO: 1732679 - protein, 6 aa, Staphylococcus epidermidis
KEGQSF

SEQ ID NO: 1732680 - protein, 8 aa, Staphylococcus epidermidis
KEGQTYNS

SEQ ID NO: 1732681 - protein, 7 aa, Staphylococcus epidermidis
KEGSTWT

SEQ ID NO: 1732682 - protein, 11 aa, Staphylococcus epidermidis
KEHKKNKKIEV

SEQ ID NO: 1732683 - protein, 6 aa, Staphylococcus epidermidis
KEIEDA

SEQ ID NO: 1732684 - protein, 5 aa, Staphylococcus epidermidis
KEIGS

SEQ ID NO: 1732685 - protein, 8 aa, Staphylococcus epidermidis
KEKDQLKQ

SEQ ID NO: 1732686 - protein, 8 aa, Staphylococcus epidermidis
KEKDTTKY

SEQ ID NO: 1732687 - protein, 10 aa, Staphylococcus epidermidis
KEKEIKNSFS

SEQ ID NO: 1732688 - protein, 6 aa, Staphylococcus epidermidis
KEKEPF

SEQ ID NO: 1732689 - protein, 51 aa, Staphylococcus epidermidis
KEKEVKDEEAKEKEEKAEEKDKKVKQQEENEKKQKEQAAKDKKKRQEAERK

SEQ ID NO: 1732690 - protein, 51 aa, Staphylococcus epidermidis
KEKEVKDEKAKKKEEEAKKKDEKVKQQEENEKKQKKQAQKDKEKRQEAERK

SEQ ID NO: 1732691 - protein, 10 aa, Staphylococcus epidermidis
KEKEVKDSFA

SEQ ID NO: 1732692 - protein, 7 aa, Staphylococcus epidermidis
KEKLSKV

SEQ ID NO: 1732693 - protein, 13 aa, Staphylococcus epidermidis
KEKLSQGNIGIFK

SEQ ID NO: 1732694 - protein, 8 aa, Staphylococcus epidermidis
KEKQKYQN

SEQ ID NO: 1732695 - protein, 8 aa, Staphylococcus epidermidis
KEKYGPNW

SEQ ID NO: 1732696 - protein, 7 aa, Staphylococcus epidermidis
KELDQNE

SEQ ID NO: 1732697 - protein, 11 aa, Staphylococcus epidermidis
KELTANDQNVG

SEQ ID NO: 1732698 - protein, 19 aa, Staphylococcus epidermidis
KELTKSMRAQLDDNQDLKD

SEQ ID NO: 1732699 - protein, 9 aa, Staphylococcus epidermidis
KENENGAPV

SEQ ID NO: 1732700 - protein, 14 aa, Staphylococcus epidermidis
KENGLGDKSGLKKG

SEQ ID NO: 1732701 - protein, 7 aa, Staphylococcus epidermidis
KENNPRM

SEQ ID NO: 1732702 - protein, 8 aa, Staphylococcus epidermidis
KENTPTHE

SEQ ID NO: 1732703 - protein, 8 aa, Staphylococcus epidermidis
KENYEQRS

SEQ ID NO: 1732704 - protein, 14 aa, Staphylococcus epidermidis
KEPIKKSGETALDD

SEQ ID NO: 1732705 - protein, 68 aa, Staphylococcus epidermidis
KEPKQDLEAATAQMEATKGKKSNVSSKLTASDKESTETSKQTAGATGATAATASQASSSESEDDSEQL

SEQ ID NO: 1732706 - protein, 6 aa, Staphylococcus epidermidis
KEPKSV

SEQ ID NO: 1732707 - protein, 46 aa, Staphylococcus epidermidis
KEPLETAKNQLQANIDQKPSTDGMTQQSVQSYQRKLQEAKDKINSI

SEQ ID NO: 1732708 - protein, 4 aa, Staphylococcus epidermidis
KEPY

SEQ ID NO: 1732709 - protein, 14 aa, Staphylococcus epidermidis
KEQAENTVNSVREK

SEQ ID NO: 1732710 - protein, 6 aa, Staphylococcus epidermidis
KEQALN

SEQ ID NO: 1732711 - protein, 9 aa, Staphylococcus epidermidis
KEQDLNTAM

SEQ ID NO: 1732712 - protein, 10 aa, Staphylococcus epidermidis
KEQDLNTAMQ

SEQ ID NO: 1732713 - protein, 5 aa, Staphylococcus epidermidis
KEQLA

SEQ ID NO: 1732714 - protein, 10 aa, Staphylococcus epidermidis
KEQNPSVANV

SEQ ID NO: 1732715 - protein, 9 aa, Staphylococcus epidermidis
KEQQKQFNY

SEQ ID NO: 1732716 - protein, 28 aa, Staphylococcus epidermidis
KEQVAQKDGVHANSDYTNEDSAQKDAYN

SEQ ID NO: 1732717 - protein, 7 aa, Staphylococcus epidermidis
KERPKGW

SEQ ID NO: 1732718 - protein, 5 aa, Staphylococcus epidermidis
KERQL

SEQ ID NO: 1732719 - protein, 10 aa, Staphylococcus epidermidis
KESKEQPTVD

SEQ ID NO: 1732720 - protein, 7 aa, Staphylococcus epidermidis
KESNHPL

SEQ ID NO: 1732721 - protein, 7 aa, Staphylococcus epidermidis
KESNNKR

SEQ ID NO: 1732722 - protein, 10 aa, Staphylococcus epidermidis
KESNYTNQSW

SEQ ID NO: 1732723 - protein, 8 aa, Staphylococcus epidermidis
KESQISRT

SEQ ID NO: 1732724 - protein, 6 aa, Staphylococcus epidermidis
KESQIT

SEQ ID NO: 1732725 - protein, 24 aa, Staphylococcus epidermidis
KESTLNDINQAQTNQNVDTALNNG

SEQ ID NO: 1732726 - protein, 8 aa, Staphylococcus epidermidis
KESVANAQ

SEQ ID NO: 1732727 - protein, 22 aa, Staphylococcus epidermidis
KETVGDKNAINRKGQIPPSSNA

SEQ ID NO: 1732728 - protein, 6 aa, Staphylococcus epidermidis
KEVKAD

SEQ ID NO: 1732729 - protein, 4 aa, Staphylococcus epidermidis
KEVQ

SEQ ID NO: 1732730 - protein, 6 aa, Staphylococcus epidermidis
KEVQPI

SEQ ID NO: 1732731 - protein, 17 aa, Staphylococcus epidermidis
KEVTFKRSSRELPQHDT

SEQ ID NO: 1732732 - protein, 13 aa, Staphylococcus epidermidis
KEVVEKKNPNTLK

SEQ ID NO: 1732733 - protein, 11 aa, Staphylococcus epidermidis
KEYDSPSSIKK

SEQ ID NO: 1732734 - protein, 15 aa, Staphylococcus epidermidis
KEYPSNNYTPEKSWD

SEQ ID NO: 1732735 - protein, 9 aa, Staphylococcus epidermidis
KFEGQSATI

SEQ ID NO: 1732736 - protein, 8 aa, Staphylococcus epidermidis
KFGAPKDV

SEQ ID NO: 1732737 - protein, 5 aa, Staphylococcus epidermidis
KFPGG

SEQ ID NO: 1732738 - protein, 6 aa, Staphylococcus epidermidis
KFPSQH

SEQ ID NO: 1732739 - protein, 5 aa, Staphylococcus epidermidis
KFPVN

SEQ ID NO: 1732740 - protein, 16 aa, Staphylococcus epidermidis
KFQSGKDAVKGVTGRY

SEQ ID NO: 1732741 - protein, 7 aa, Staphylococcus epidermidis
KFQSSSK

SEQ ID NO: 1732742 - protein, 11 aa, Staphylococcus epidermidis
KFRQRGGHAES

SEQ ID NO: 1732743 - protein, 16 aa, Staphylococcus epidermidis
KFRSDIKKSEEQDQDY

SEQ ID NO: 1732744 - protein, 14 aa, Staphylococcus epidermidis
KGAHQIDGKTYNVK

SEQ ID NO: 1732745 - protein, 7 aa, Staphylococcus epidermidis
KGAPNSM

SEQ ID NO: 1732746 - protein, 7 aa, Staphylococcus epidermidis
KGDKITL

SEQ ID NO: 1732747 - protein, 6 aa, Staphylococcus epidermidis
KGDPAV

SEQ ID NO: 1732748 - protein, 14 aa, Staphylococcus epidermidis
KGDSFKKVDKKGKW

SEQ ID NO: 1732749 - protein, 23 aa, Staphylococcus epidermidis
KGDSYKKEAKKQQEGKEPKYVSA

SEQ ID NO: 1732750 - protein, 24 aa, Staphylococcus epidermidis
KGEDNANGEKAQQISERILKEMEL

SEQ ID NO: 1732751 - protein, 9 aa, Staphylococcus epidermidis
KGEFKSEKE

SEQ ID NO: 1732752 - protein, 36 aa, Staphylococcus epidermidis
KGEKSDEDDDEDKDTTTKNETVKVPYTGKKNKSQKV

SEQ ID NO: 1732753 - protein, 36 aa, Staphylococcus epidermidis
KGEKSDEDDEEDKDTTTKNETVKVPYTGKKNKSQKV

SEQ ID NO: 1732754 - protein, 37 aa, Staphylococcus epidermidis
KGEKSEEDDDEEDKDTTTKNETVKVPYTGKKSKSQKV

SEQ ID NO: 1732755 - protein, 37 aa, Staphylococcus epidermidis
KGEKSEEEDDEEDKDTTTKNETVKVPYTGKKSKSQKV

SEQ ID NO: 1732756 - protein, 8 aa, Staphylococcus epidermidis
KGENDPTP

SEQ ID NO: 1732757 - protein, 15 aa, Staphylococcus epidermidis
KGERRAKDELNKKGL

SEQ ID NO: 1732758 - protein, 7 aa, Staphylococcus epidermidis
KGESNAI

SEQ ID NO: 1732759 - protein, 6 aa, Staphylococcus epidermidis
KGEYES

SEQ ID NO: 1732760 - protein, 16 aa, Staphylococcus epidermidis
KGFGEKTFEKLKEYFT

SEQ ID NO: 1732761 - protein, 7 aa, Staphylococcus epidermidis
KGGHAES

SEQ ID NO: 1732762 - protein, 7 aa, Staphylococcus epidermidis
KGGKDNM

SEQ ID NO: 1732763 - protein, 40 aa, Staphylococcus epidermidis
KGHTGDETETLENQTKDKTHHEADKAKDKFAHNHNIEDKN

SEQ ID NO: 1732764 - protein, 8 aa, Staphylococcus epidermidis
KGHTPEEA

SEQ ID NO: 1732765 - protein, 6 aa, Staphylococcus epidermidis
KGIHRP

SEQ ID NO: 1732766 - protein, 7 aa, Staphylococcus epidermidis
KGIPEEE

SEQ ID NO: 1732767 - protein, 5 aa, Staphylococcus epidermidis
KGIPL

SEQ ID NO: 1732768 - protein, 8 aa, Staphylococcus epidermidis
KGISSDMK

SEQ ID NO: 1732769 - protein, 6 aa, Staphylococcus epidermidis
KGKAIQ

SEQ ID NO: 1732770 - protein, 8 aa, Staphylococcus epidermidis
KGKDATIE

SEQ ID NO: 1732771 - protein, 13 aa, Staphylococcus epidermidis
KGKELNEAPGDAF

SEQ ID NO: 1732772 - protein, 9 aa, Staphylococcus epidermidis
KGKKFTKDN

SEQ ID NO: 1732773 - protein, 5 aa, Staphylococcus epidermidis
KGKNI

SEQ ID NO: 1732774 - protein, 6 aa, Staphylococcus epidermidis
KGKREL

SEQ ID NO: 1732775 - protein, 13 aa, Staphylococcus epidermidis
KGKSSKPEEAGIG

SEQ ID NO: 1732776 - protein, 9 aa, Staphylococcus epidermidis
KGKTAGYTV

SEQ ID NO: 1732777 - protein, 6 aa, Staphylococcus epidermidis
KGKVTN

SEQ ID NO: 1732778 - protein, 7 aa, Staphylococcus epidermidis
KGLRKYN

SEQ ID NO: 1732779 - protein, 26 aa, Staphylococcus epidermidis
KGLTTPETIGPKYAPTVNATNDSGHI

SEQ ID NO: 1732780 - protein, 13 aa, Staphylococcus epidermidis
KGNDARLTNTKTA

SEQ ID NO: 1732781 - protein, 8 aa, Staphylococcus epidermidis
KGNKKTNM

SEQ ID NO: 1732782 - protein, 8 aa, Staphylococcus epidermidis
KGNSDASI

SEQ ID NO: 1732783 - protein, 7 aa, Staphylococcus epidermidis
KGPKKVK

SEQ ID NO: 1732784 - protein, 7 aa, Staphylococcus epidermidis
KGQDQHS

SEQ ID NO: 1732785 - protein, 6 aa, Staphylococcus epidermidis
KGQECD

SEQ ID NO: 1732786 - protein, 11 aa, Staphylococcus epidermidis
KGQERKTNDGN

SEQ ID NO: 1732787 - protein, 6 aa, Staphylococcus epidermidis
KGQTYT

SEQ ID NO: 1732788 - protein, 16 aa, Staphylococcus epidermidis
KGRKLIQTSNDNTLAY

SEQ ID NO: 1732789 - protein, 8 aa, Staphylococcus epidermidis
KGRSRRSE

SEQ ID NO: 1732790 - protein, 6 aa, Staphylococcus epidermidis
KGSASQ

SEQ ID NO: 1732791 - protein, 8 aa, Staphylococcus epidermidis
KGSSQQNI

SEQ ID NO: 1732792 - protein, 15 aa, Staphylococcus epidermidis
KGSSQSFTNNYEQLD

SEQ ID NO: 1732793 - protein, 7 aa, Staphylococcus epidermidis
KGSSVGS

SEQ ID NO: 1732794 - protein, 9 aa, Staphylococcus epidermidis
KGSTSIDES

SEQ ID NO: 1732795 - protein, 15 aa, Staphylococcus epidermidis
KGTAKLKNDSKYQSE

SEQ ID NO: 1732796 - protein, 13 aa, Staphylococcus epidermidis
KGTHKIDGKEITV

SEQ ID NO: 1732797 - protein, 18 aa, Staphylococcus epidermidis
KGTKKQMKYTTDKSGKVI

SEQ ID NO: 1732798 - protein, 8 aa, Staphylococcus epidermidis
KGTLTGGV

SEQ ID NO: 1732799 - protein, 8 aa, Staphylococcus epidermidis
KGTNVDGD

SEQ ID NO: 1732800 - protein, 9 aa, Staphylococcus epidermidis
KGTPSYVDP

SEQ ID NO: 1732801 - protein, 10 aa, Staphylococcus epidermidis
KGTVKSVDET

SEQ ID NO: 1732802 - protein, 6 aa, Staphylococcus epidermidis
KGVKSV

SEQ ID NO: 1732803 - protein, 7 aa, Staphylococcus epidermidis
KGVPEEE

SEQ ID NO: 1732804 - protein, 23 aa, Staphylococcus epidermidis
KGWEDKIKTEKPNFTLNTRENNV

SEQ ID NO: 1732805 - protein, 23 aa, Staphylococcus epidermidis
KGWENKIKTEKPNFTLNTQERDV

SEQ ID NO: 1732806 - protein, 5 aa, Staphylococcus epidermidis
KGYDS

SEQ ID NO: 1732807 - protein, 14 aa, Staphylococcus epidermidis
KHAEEGSNQYSTDK

SEQ ID NO: 1732808 - protein, 9 aa, Staphylococcus epidermidis
KHAESRSDI

SEQ ID NO: 1732809 - protein, 16 aa, Staphylococcus epidermidis
KHDKVTKTLVPEKDSR

SEQ ID NO: 1732810 - protein, 5 aa, Staphylococcus epidermidis
KHDYK

SEQ ID NO: 1732811 - protein, 18 aa, Staphylococcus epidermidis
KHEDTKKLKEVAKDNKTY

SEQ ID NO: 1732812 - protein, 8 aa, Staphylococcus epidermidis
KHEEDKLE

SEQ ID NO: 1732813 - protein, 13 aa, Staphylococcus epidermidis
KHERSESNTYRLG

SEQ ID NO: 1732814 - protein, 86 aa, Staphylococcus epidermidis
KHGKGDKPDDSNHHNGNNAKPDNPNHHDGVNPEPNKHNNSKGSNNHHVEKPSHNEHVNHPDKSQSNNDDNQTNGNQSKPSYTHHNE

SEQ ID NO: 1732815 - protein, 9 aa, Staphylococcus epidermidis
KHGRGSEPL

SEQ ID NO: 1732816 - protein, 6 aa, Staphylococcus epidermidis
KHHQLS

SEQ ID NO: 1732817 - protein, 6 aa, Staphylococcus epidermidis
KHLTAA

SEQ ID NO: 1732818 - protein, 9 aa, Staphylococcus epidermidis
KHNETAVKQ

SEQ ID NO: 1732819 - protein, 7 aa, Staphylococcus epidermidis
KHNSSKQ

SEQ ID NO: 1732820 - protein, 8 aa, Staphylococcus epidermidis
KHPGDGKT

SEQ ID NO: 1732821 - protein, 21 aa, Staphylococcus epidermidis
KHPLNDNQIEEISNSFKQHMN

SEQ ID NO: 1732822 - protein, 8 aa, Staphylococcus epidermidis
KHPLTDKQ

SEQ ID NO: 1732823 - protein, 13 aa, Staphylococcus epidermidis
KHQNHTTTQYSEH

SEQ ID NO: 1732824 - protein, 6 aa, Staphylococcus epidermidis
KHRKDK

SEQ ID NO: 1732825 - protein, 17 aa, Staphylococcus epidermidis
KHTITVNENEEKKLGTF

SEQ ID NO: 1732826 - protein, 15 aa, Staphylococcus epidermidis
KHTKTKQTTSNQSEN

SEQ ID NO: 1732827 - protein, 76 aa, Staphylococcus epidermidis
KIAKENDPAYIEKKGEKLAKQNRKEADKMDKKLQKNIEKRHKEEQKQREANQKQRIKDMKKSQKYEEQVGLTPGKI

SEQ ID NO: 1732828 - protein, 131 aa, Staphylococcus epidermidis
KIAKENDPEYIEKKGEKLAKKNRKEADKMDKKLQKNIEKRHKEEDKQREENQKQRIKDMKKSQKYEEKVGLTPGKLDDKTEKKGEKLEKDNRKDVKKLDKKLQKNIEKRHKKEEKQREEAKKARKKEFKKY

SEQ ID NO: 1732829 - protein, 21 aa, Staphylococcus epidermidis
KIDGSTSKFTDRMNEKAKELG

SEQ ID NO: 1732830 - protein, 33 aa, Staphylococcus epidermidis
KIDKEEQIQNDDKHSIPVAKRKKSKEKQLKEED

SEQ ID NO: 1732831 - protein, 7 aa, Staphylococcus epidermidis
KIDQSAN

SEQ ID NO: 1732832 - protein, 112 aa, Staphylococcus epidermidis
KIEKRSKAVHSAERDISNAEHTESEAPHQDLTGNNKSMYDAESMNEQHSTTQHKGQQQVSHEQQRPHHHNTSTYEQHTHPQSYHSYQDKQQQANQPNQFSEQAKEVTEESKG

SEQ ID NO: 1732833 - protein, 8 aa, Staphylococcus epidermidis
KIEQSSNV

SEQ ID NO: 1732834 - protein, 8 aa, Staphylococcus epidermidis
KIGENSSH

SEQ ID NO: 1732835 - protein, 6 aa, Staphylococcus epidermidis
KIGESA

SEQ ID NO: 1732836 - protein, 16 aa, Staphylococcus epidermidis
KIINKDASKDIRTSEF

SEQ ID NO: 1732837 - protein, 13 aa, Staphylococcus epidermidis
KIKKGAKLKNYKK

SEQ ID NO: 1732838 - protein, 19 aa, Staphylococcus epidermidis
KIKNAGAVGVTKNGKHSTQ

SEQ ID NO: 1732839 - protein, 5 aa, Staphylococcus epidermidis
KIKNN

SEQ ID NO: 1732840 - protein, 15 aa, Staphylococcus epidermidis
KIKPADKKENKEEGF

SEQ ID NO: 1732841 - protein, 13 aa, Staphylococcus epidermidis
KIPGKIGTIKESN

SEQ ID NO: 1732842 - protein, 8 aa, Staphylococcus epidermidis
KIPKTRRS

SEQ ID NO: 1732843 - protein, 7 aa, Staphylococcus epidermidis
KIPNTDA

SEQ ID NO: 1732844 - protein, 10 aa, Staphylococcus epidermidis
KIQQKDKDDI

SEQ ID NO: 1732845 - protein, 12 aa, Staphylococcus epidermidis
KIQTKNSSLYTT

SEQ ID NO: 1732846 - protein, 9 aa, Staphylococcus epidermidis
KIRDKGPDY

SEQ ID NO: 1732847 - protein, 7 aa, Staphylococcus epidermidis
KISDDSI

SEQ ID NO: 1732848 - protein, 19 aa, Staphylococcus epidermidis
KISEADSNDQVNNAKDEGL

SEQ ID NO: 1732849 - protein, 6 aa, Staphylococcus epidermidis
KISERY

SEQ ID NO: 1732850 - protein, 26 aa, Staphylococcus epidermidis
KISGNNRNKRPNQLRTPNVTSNTVDN

SEQ ID NO: 1732851 - protein, 18 aa, Staphylococcus epidermidis
KISKQNKRNEQNANEAEK

SEQ ID NO: 1732852 - protein, 16 aa, Staphylococcus epidermidis
KISLTKKVKDKNLENK

SEQ ID NO: 1732853 - protein, 6 aa, Staphylococcus epidermidis
KISSNM

SEQ ID NO: 1732854 - protein, 18 aa, Staphylococcus epidermidis
KISSYVEKKEKEENSLKN

SEQ ID NO: 1732855 - protein, 14 aa, Staphylococcus epidermidis
KITDEQHNKDIKYK

SEQ ID NO: 1732856 - protein, 8 aa, Staphylococcus epidermidis
KITDEQMQ

SEQ ID NO: 1732857 - protein, 25 aa, Staphylococcus epidermidis
KITEAKNDLHGEQKLEQAQQQSINT

SEQ ID NO: 1732858 - protein, 6 aa, Staphylococcus epidermidis
KITGTG

SEQ ID NO: 1732859 - protein, 7 aa, Staphylococcus epidermidis
KITNEVA

SEQ ID NO: 1732860 - protein, 22 aa, Staphylococcus epidermidis
KITSGASKVVGGAEKAAGGVSK

SEQ ID NO: 1732861 - protein, 5 aa, Staphylococcus epidermidis
KITTG

SEQ ID NO: 1732862 - protein, 12 aa, Staphylococcus epidermidis
KIYTDEGGSGYI

SEQ ID NO: 1732863 - protein, 47 aa, Staphylococcus epidermidis
KKAEQEQKEQETSRDVSQQNVEQQTSSKDGNNEQYEGKKQGHREEDD

SEQ ID NO: 1732864 - protein, 11 aa, Staphylococcus epidermidis
KKAKNDKELQR

SEQ ID NO: 1732865 - protein, 7 aa, Staphylococcus epidermidis
KKALSEV

SEQ ID NO: 1732866 - protein, 7 aa, Staphylococcus epidermidis
KKANDQN

SEQ ID NO: 1732867 - protein, 8 aa, Staphylococcus epidermidis
KKAPGHAG

SEQ ID NO: 1732868 - protein, 7 aa, Staphylococcus epidermidis
KKAPKTD

SEQ ID NO: 1732869 - protein, 13 aa, Staphylococcus epidermidis
KKARKLKQQVTQT

SEQ ID NO: 1732870 - protein, 8 aa, Staphylococcus epidermidis
KKASESLN

SEQ ID NO: 1732871 - protein, 25 aa, Staphylococcus epidermidis
KKDDAKSLSKQLTSNNHRLSEEEAR

SEQ ID NO: 1732872 - protein, 5 aa, Staphylococcus epidermidis
KKDDY

SEQ ID NO: 1732873 - protein, 7 aa, Staphylococcus epidermidis
KKDERKI

SEQ ID NO: 1732874 - protein, 7 aa, Staphylococcus epidermidis
KKDGGDL

SEQ ID NO: 1732875 - protein, 19 aa, Staphylococcus epidermidis
KKDINAPNHVTAEKFKGNH

SEQ ID NO: 1732876 - protein, 11 aa, Staphylococcus epidermidis
KKDNPKNMLNP

SEQ ID NO: 1732877 - protein, 12 aa, Staphylococcus epidermidis
KKDQEGKRIKAE

SEQ ID NO: 1732878 - protein, 15 aa, Staphylococcus epidermidis
KKDQHAKKARMTQER

SEQ ID NO: 1732879 - protein, 9 aa, Staphylococcus epidermidis
KKDSDQTKW

SEQ ID NO: 1732880 - protein, 19 aa, Staphylococcus epidermidis
KKDSRSRQGENKQETNIPS

SEQ ID NO: 1732881 - protein, 26 aa, Staphylococcus epidermidis
KKDYKEKKGEGNTDNSGFTPSNEYEA

SEQ ID NO: 1732882 - protein, 11 aa, Staphylococcus epidermidis
KKEEEEEEVEE

SEQ ID NO: 1732883 - protein, 9 aa, Staphylococcus epidermidis
KKEERKESY

SEQ ID NO: 1732884 - protein, 31 aa, Staphylococcus epidermidis
KKEETNNYDGIEKRSEDRTESTTNVDENEAT

SEQ ID NO: 1732885 - protein, 18 aa, Staphylococcus epidermidis
KKEPKASYAYEDKTEFEK

SEQ ID NO: 1732886 - protein, 6 aa, Staphylococcus epidermidis
KKEPMY

SEQ ID NO: 1732887 - protein, 19 aa, Staphylococcus epidermidis
KKESRKTEIPTETEEDVEE

SEQ ID NO: 1732888 - protein, 6 aa, Staphylococcus epidermidis
KKETGI

SEQ ID NO: 1732889 - protein, 27 aa, Staphylococcus epidermidis
KKETPISLEGKASPKSVKTYNNNSSIG

SEQ ID NO: 1732890 - protein, 6 aa, Staphylococcus epidermidis
KKGDKV

SEQ ID NO: 1732891 - protein, 4 aa, Staphylococcus epidermidis
KKGE

SEQ ID NO: 1732892 - protein, 6 aa, Staphylococcus epidermidis
KKGLNG

SEQ ID NO: 1732893 - protein, 22 aa, Staphylococcus epidermidis
KKGLTDNLKKATEDVVKETNDF

SEQ ID NO: 1732894 - protein, 15 aa, Staphylococcus epidermidis
KKGNGKPHHYDEHHR

SEQ ID NO: 1732895 - protein, 4 aa, Staphylococcus epidermidis
KKGQ

SEQ ID NO: 1732896 - protein, 7 aa, Staphylococcus epidermidis
KKGQTYT

SEQ ID NO: 1732897 - protein, 8 aa, Staphylococcus epidermidis
KKGVENVT

SEQ ID NO: 1732898 - protein, 7 aa, Staphylococcus epidermidis
KKGVTKD

SEQ ID NO: 1732899 - protein, 9 aa, Staphylococcus epidermidis
KKHTTKNKD

SEQ ID NO: 1732900 - protein, 7 aa, Staphylococcus epidermidis
KKIKSNT

SEQ ID NO: 1732901 - protein, 6 aa, Staphylococcus epidermidis
KKINSD

SEQ ID NO: 1732902 - protein, 20 aa, Staphylococcus epidermidis
KKKAQASAEKANAEDKAAHQ

SEQ ID NO: 1732903 - protein, 4 aa, Staphylococcus epidermidis
KKKI

SEQ ID NO: 1732904 - protein, 6 aa, Staphylococcus epidermidis
KKKQSF

SEQ ID NO: 1732905 - protein, 9 aa, Staphylococcus epidermidis
KKKVTEDIE

SEQ ID NO: 1732906 - protein, 18 aa, Staphylococcus epidermidis
KKKYKEDVEKREKDYKKY

SEQ ID NO: 1732907 - protein, 13 aa, Staphylococcus epidermidis
KKLAAKQRIQQKA

SEQ ID NO: 1732908 - protein, 16 aa, Staphylococcus epidermidis
KKNGITDKDTKKDIEK

SEQ ID NO: 1732909 - protein, 6 aa, Staphylococcus epidermidis
KKNGTI

SEQ ID NO: 1732910 - protein, 5 aa, Staphylococcus epidermidis
KKNNF

SEQ ID NO: 1732911 - protein, 5 aa, Staphylococcus epidermidis
KKNSK

SEQ ID NO: 1732912 - protein, 8 aa, Staphylococcus epidermidis
KKNSSIYK

SEQ ID NO: 1732913 - protein, 7 aa, Staphylococcus epidermidis
KKPKKIE

SEQ ID NO: 1732914 - protein, 9 aa, Staphylococcus epidermidis
KKPTAKAEF

SEQ ID NO: 1732915 - protein, 8 aa, Staphylococcus epidermidis
KKPTGGTI

SEQ ID NO: 1732916 - protein, 9 aa, Staphylococcus epidermidis
KKQEKHTPH

SEQ ID NO: 1732917 - protein, 17 aa, Staphylococcus epidermidis
KKQESTSSSAQSQSQFA

SEQ ID NO: 1732918 - protein, 12 aa, Staphylococcus epidermidis
KKQLEKQREDLQ

SEQ ID NO: 1732919 - protein, 6 aa, Staphylococcus epidermidis
KKQLSK

SEQ ID NO: 1732920 - protein, 5 aa, Staphylococcus epidermidis
KKQLY

SEQ ID NO: 1732921 - protein, 12 aa, Staphylococcus epidermidis
KKQNAKNELNQY

SEQ ID NO: 1732922 - protein, 35 aa, Staphylococcus epidermidis
KKQQAKESIRNTAEQRKQAIQNNDDATNEEKEVAN

SEQ ID NO: 1732923 - protein, 19 aa, Staphylococcus epidermidis
KKQSAIDEINQAKQNRIDE

SEQ ID NO: 1732924 - protein, 4 aa, Staphylococcus epidermidis
KKRD

SEQ ID NO: 1732925 - protein, 5 aa, Staphylococcus epidermidis
KKRGL

SEQ ID NO: 1732926 - protein, 15 aa, Staphylococcus epidermidis
KKSAGNDAPKKFASK

SEQ ID NO: 1732927 - protein, 8 aa, Staphylococcus epidermidis
KKSEAIQA

SEQ ID NO: 1732928 - protein, 6 aa, Staphylococcus epidermidis
KKSEFS

SEQ ID NO: 1732929 - protein, 7 aa, Staphylococcus epidermidis
KKSIVGD

SEQ ID NO: 1732930 - protein, 20 aa, Staphylococcus epidermidis
KKSNATRKNSKRRKQNESPL

SEQ ID NO: 1732931 - protein, 9 aa, Staphylococcus epidermidis
KKSNGREDK

SEQ ID NO: 1732932 - protein, 10 aa, Staphylococcus epidermidis
KKSQQTFSED

SEQ ID NO: 1732933 - protein, 5 aa, Staphylococcus epidermidis
KKTDE

SEQ ID NO: 1732934 - protein, 7 aa, Staphylococcus epidermidis
KKTENPF

SEQ ID NO: 1732935 - protein, 5 aa, Staphylococcus epidermidis
KKTKI

SEQ ID NO: 1732936 - protein, 4 aa, Staphylococcus epidermidis
KKTN

SEQ ID NO: 1732937 - protein, 8 aa, Staphylococcus epidermidis
KKTNDANI

SEQ ID NO: 1732938 - protein, 6 aa, Staphylococcus epidermidis
KKTPKE

SEQ ID NO: 1732939 - protein, 7 aa, Staphylococcus epidermidis
KKTVSKI

SEQ ID NO: 1732940 - protein, 11 aa, Staphylococcus epidermidis
KKTYQQHTQDV

SEQ ID NO: 1732941 - protein, 12 aa, Staphylococcus epidermidis
KKVDAKEKEDIL

SEQ ID NO: 1732942 - protein, 32 aa, Staphylococcus epidermidis
KKVDENQKLPERNKEKLNNEIKKAQQKLNGQQ

SEQ ID NO: 1732943 - protein, 9 aa, Staphylococcus epidermidis
KKVDKDTLY

SEQ ID NO: 1732944 - protein, 11 aa, Staphylococcus epidermidis
KKVPGTQKELD

SEQ ID NO: 1732945 - protein, 17 aa, Staphylococcus epidermidis
KKVSDSDGNASENEHHK

SEQ ID NO: 1732946 - protein, 5 aa, Staphylococcus epidermidis
KKWPD

SEQ ID NO: 1732947 - protein, 9 aa, Staphylococcus epidermidis
KKYADDETY

SEQ ID NO: 1732948 - protein, 9 aa, Staphylococcus epidermidis
KKYGSSPKA

SEQ ID NO: 1732949 - protein, 7 aa, Staphylococcus epidermidis
KKYIEGS

SEQ ID NO: 1732950 - protein, 8 aa, Staphylococcus epidermidis
KKYREKAR

SEQ ID NO: 1732951 - protein, 13 aa, Staphylococcus epidermidis
KLAPEGKQGQYQG

SEQ ID NO: 1732952 - protein, 6 aa, Staphylococcus epidermidis
KLEINH

SEQ ID NO: 1732953 - protein, 9 aa, Staphylococcus epidermidis
KLEQAAKEM

SEQ ID NO: 1732954 - protein, 20 aa, Staphylococcus epidermidis
KLGKDKISDKAQSFNTNEND

SEQ ID NO: 1732955 - protein, 13 aa, Staphylococcus epidermidis
KLIQTSNENAINY

SEQ ID NO: 1732956 - protein, 6 aa, Staphylococcus epidermidis
KLKKGD

SEQ ID NO: 1732957 - protein, 15 aa, Staphylococcus epidermidis
KLKKSQNSIYKKRNV

SEQ ID NO: 1732958 - protein, 19 aa, Staphylococcus epidermidis
KLKNANNAQQNNENQSKIN

SEQ ID NO: 1732959 - protein, 16 aa, Staphylococcus epidermidis
KLKSTDYEAKPPVIFK

SEQ ID NO: 1732960 - protein, 10 aa, Staphylococcus epidermidis
KLKTDTANEN

SEQ ID NO: 1732961 - protein, 5 aa, Staphylococcus epidermidis
KLNDQ

SEQ ID NO: 1732962 - protein, 31 aa, Staphylococcus epidermidis
KLNKKMGDKLRKRRRKARHKDWKERDRQEQN

SEQ ID NO: 1732963 - protein, 6 aa, Staphylococcus epidermidis
KLNPQG

SEQ ID NO: 1732964 - protein, 36 aa, Staphylococcus epidermidis
KLNSDNNDTKQKKVASKKKKTPRSTKKVVKNKKRSK

SEQ ID NO: 1732965 - protein, 5 aa, Staphylococcus epidermidis
KLNSN

SEQ ID NO: 1732966 - protein, 5 aa, Staphylococcus epidermidis
KLPDP

SEQ ID NO: 1732967 - protein, 7 aa, Staphylococcus epidermidis
KLPEVDY

SEQ ID NO: 1732968 - protein, 8 aa, Staphylococcus epidermidis
KLPGVNTS

SEQ ID NO: 1732969 - protein, 9 aa, Staphylococcus epidermidis
KLPKTRSGK

SEQ ID NO: 1732970 - protein, 11 aa, Staphylococcus epidermidis
KLPSNANVSVK

SEQ ID NO: 1732971 - protein, 7 aa, Staphylococcus epidermidis
KLQGQGK

SEQ ID NO: 1732972 - protein, 6 aa, Staphylococcus epidermidis
KLRKPS

SEQ ID NO: 1732973 - protein, 13 aa, Staphylococcus epidermidis
KLSERKAKTIYSQ

SEQ ID NO: 1732974 - protein, 7 aa, Staphylococcus epidermidis
KLSNKTL

SEQ ID NO: 1732975 - protein, 7 aa, Staphylococcus epidermidis
KLSQSDE

SEQ ID NO: 1732976 - protein, 19 aa, Staphylococcus epidermidis
KLTESLEEQLRNNQDLNDA

SEQ ID NO: 1732977 - protein, 7 aa, Staphylococcus epidermidis
KLTSSQQ

SEQ ID NO: 1732978 - protein, 9 aa, Staphylococcus epidermidis
KMAKEQGLA

SEQ ID NO: 1732979 - protein, 12 aa, Staphylococcus epidermidis
KMNDSGDNLTEN

SEQ ID NO: 1732980 - protein, 12 aa, Staphylococcus epidermidis
KMNNSSENLTED

SEQ ID NO: 1732981 - protein, 22 aa, Staphylococcus epidermidis
KMPRKESTPEAPTVNTDDVETN

SEQ ID NO: 1732982 - protein, 7 aa, Staphylococcus epidermidis
KMSKDTR

SEQ ID NO: 1732983 - protein, 8 aa, Staphylococcus epidermidis
KMSVSTKG

SEQ ID NO: 1732984 - protein, 5 aa, Staphylococcus epidermidis
KMTRP

SEQ ID NO: 1732985 - protein, 11 aa, Staphylococcus epidermidis
KMTRSNDKYVS

SEQ ID NO: 1732986 - protein, 7 aa, Staphylococcus epidermidis
KNAITAL

SEQ ID NO: 1732987 - protein, 6 aa, Staphylococcus epidermidis
KNARKL

SEQ ID NO: 1732988 - protein, 10 aa, Staphylococcus epidermidis
KNATQTKTYG

SEQ ID NO: 1732989 - protein, 5 aa, Staphylococcus epidermidis
KNAWD

SEQ ID NO: 1732990 - protein, 33 aa, Staphylococcus epidermidis
KNDDTEAESTQTTQTDSNDSQSKSDSTSKGPRI

SEQ ID NO: 1732991 - protein, 29 aa, Staphylococcus epidermidis
KNDHTNDSAFNGANKNYTTTMKNANNTVK

SEQ ID NO: 1732992 - protein, 21 aa, Staphylococcus epidermidis
KNDHTNDSAFNGTTKDETTAM

SEQ ID NO: 1732993 - protein, 15 aa, Staphylococcus epidermidis
KNDNDISDKIKDDKL

SEQ ID NO: 1732994 - protein, 9 aa, Staphylococcus epidermidis
KNDRITNYA

SEQ ID NO: 1732995 - protein, 24 aa, Staphylococcus epidermidis
KNEATNVQNKNVSINTSNKSPYKR

SEQ ID NO: 1732996 - protein, 15 aa, Staphylococcus epidermidis
KNEGRNKVMFNPIVK

SEQ ID NO: 1732997 - protein, 4 aa, Staphylococcus epidermidis
KNEK

SEQ ID NO: 1732998 - protein, 10 aa, Staphylococcus epidermidis
KNEKNKRDSL

SEQ ID NO: 1732999 - protein, 5 aa, Staphylococcus epidermidis
KNEKV

SEQ ID NO: 1733000 - protein, 9 aa, Staphylococcus epidermidis
KNENDNTHY

SEQ ID NO: 1733001 - protein, 5 aa, Staphylococcus epidermidis
KNESS

SEQ ID NO: 1733002 - protein, 8 aa, Staphylococcus epidermidis
KNGEEGLS

SEQ ID NO: 1733003 - protein, 11 aa, Staphylococcus epidermidis
KNGFNNEGATV

SEQ ID NO: 1733004 - protein, 9 aa, Staphylococcus epidermidis
KNGIGAQPI

SEQ ID NO: 1733005 - protein, 6 aa, Staphylococcus epidermidis
KNGNIN

SEQ ID NO: 1733006 - protein, 5 aa, Staphylococcus epidermidis
KNGSG

SEQ ID NO: 1733007 - protein, 8 aa, Staphylococcus epidermidis
KNHGDTQS

SEQ ID NO: 1733008 - protein, 9 aa, Staphylococcus epidermidis
KNHKGDNIV

SEQ ID NO: 1733009 - protein, 19 aa, Staphylococcus epidermidis
KNHQPNLKSGHYPKNENQI

SEQ ID NO: 1733010 - protein, 8 aa, Staphylococcus epidermidis
KNHQSTYK

SEQ ID NO: 1733011 - protein, 16 aa, Staphylococcus epidermidis
KNIADEYDVDPRKSAS

SEQ ID NO: 1733012 - protein, 6 aa, Staphylococcus epidermidis
KNIERI

SEQ ID NO: 1733013 - protein, 15 aa, Staphylococcus epidermidis
KNIETRSEAASEITS

SEQ ID NO: 1733014 - protein, 4 aa, Staphylococcus epidermidis
KNIS

SEQ ID NO: 1733015 - protein, 4 aa, Staphylococcus epidermidis
KNKD

SEQ ID NO: 1733016 - protein, 10 aa, Staphylococcus epidermidis
KNKDKYPEKF

SEQ ID NO: 1733017 - protein, 7 aa, Staphylococcus epidermidis
KNKEDDW

SEQ ID NO: 1733018 - protein, 18 aa, Staphylococcus epidermidis
KNKEGQSSKITATKEGGI

SEQ ID NO: 1733019 - protein, 9 aa, Staphylococcus epidermidis
KNKENQAGE

SEQ ID NO: 1733020 - protein, 5 aa, Staphylococcus epidermidis
KNKGL

SEQ ID NO: 1733021 - protein, 6 aa, Staphylococcus epidermidis
KNKIPQ

SEQ ID NO: 1733022 - protein, 5 aa, Staphylococcus epidermidis
KNKLQ

SEQ ID NO: 1733023 - protein, 7 aa, Staphylococcus epidermidis
KNKNNTL

SEQ ID NO: 1733024 - protein, 8 aa, Staphylococcus epidermidis
KNKPPQQL

SEQ ID NO: 1733025 - protein, 8 aa, Staphylococcus epidermidis
KNKSDKHI

SEQ ID NO: 1733026 - protein, 7 aa, Staphylococcus epidermidis
KNLGINP

SEQ ID NO: 1733027 - protein, 17 aa, Staphylococcus epidermidis
KNLKNQHQSRGRRNQNG

SEQ ID NO: 1733028 - protein, 12 aa, Staphylococcus epidermidis
KNLKSKKLGQKI

SEQ ID NO: 1733029 - protein, 8 aa, Staphylococcus epidermidis
KNLKTPLD

SEQ ID NO: 1733030 - protein, 17 aa, Staphylococcus epidermidis
KNLNEKDYEADPPLIWG

SEQ ID NO: 1733031 - protein, 17 aa, Staphylococcus epidermidis
KNLNENEYTADPPLIWG

SEQ ID NO: 1733032 - protein, 12 aa, Staphylococcus epidermidis
KNNAESLAKRQQ

SEQ ID NO: 1733033 - protein, 6 aa, Staphylococcus epidermidis
KNNDVN

SEQ ID NO: 1733034 - protein, 15 aa, Staphylococcus epidermidis
KNNKQIKKANSSYQY

SEQ ID NO: 1733035 - protein, 15 aa, Staphylococcus epidermidis
KNNNESTLEEKASAI

SEQ ID NO: 1733036 - protein, 16 aa, Staphylococcus epidermidis
KNNNTSGQLNNARTSL

SEQ ID NO: 1733037 - protein, 16 aa, Staphylococcus epidermidis
KNNNTSGQLSNARTSL

SEQ ID NO: 1733038 - protein, 7 aa, Staphylococcus epidermidis
KNNQKRL

SEQ ID NO: 1733039 - protein, 8 aa, Staphylococcus epidermidis
KNNQTKTK

SEQ ID NO: 1733040 - protein, 7 aa, Staphylococcus epidermidis
KNNRRRL

SEQ ID NO: 1733041 - protein, 19 aa, Staphylococcus epidermidis
KNNSKTGGKSDGKKNRNVK

SEQ ID NO: 1733042 - protein, 6 aa, Staphylococcus epidermidis
KNNTRF

SEQ ID NO: 1733043 - protein, 5 aa, Staphylococcus epidermidis
KNNYN

SEQ ID NO: 1733044 - protein, 9 aa, Staphylococcus epidermidis
KNPERHRSS

SEQ ID NO: 1733045 - protein, 7 aa, Staphylococcus epidermidis
KNPITGN

SEQ ID NO: 1733046 - protein, 4 aa, Staphylococcus epidermidis
KNPL

SEQ ID NO: 1733047 - protein, 7 aa, Staphylococcus epidermidis
KNPPINE

SEQ ID NO: 1733048 - protein, 15 aa, Staphylococcus epidermidis
KNPTQLEQGHKEPKR

SEQ ID NO: 1733049 - protein, 15 aa, Staphylococcus epidermidis
KNPTTLEASKKEPKR

SEQ ID NO: 1733050 - protein, 18 aa, Staphylococcus epidermidis
KNQLQQAVNDQPLTTGMT

SEQ ID NO: 1733051 - protein, 8 aa, Staphylococcus epidermidis
KNQRQANE

SEQ ID NO: 1733052 - protein, 7 aa, Staphylococcus epidermidis
KNQSEYV

SEQ ID NO: 1733053 - protein, 6 aa, Staphylococcus epidermidis
KNRDER

SEQ ID NO: 1733054 - protein, 13 aa, Staphylococcus epidermidis
KNRHDINEGKDVH

SEQ ID NO: 1733055 - protein, 19 aa, Staphylococcus epidermidis
KNRLENAVNDTDPTHGMTQ

SEQ ID NO: 1733056 - protein, 39 aa, Staphylococcus epidermidis
KNRLENAVNDTDPTHGMTQETINNYNAKKREAQDEIQKA

SEQ ID NO: 1733057 - protein, 331 aa, Staphylococcus epidermidis
KNRQSIDPEEHNNRTNEEQQDETKENVEDKSNQQFPPRNAQRRKRRRDVATNHNKHEDDNNEHSQNSNNSLDDRYDETSLHNGENDNYDTASRSNDNGAHANRSSNDKQNEQGAQDDRLVSGKDATIAGGAAGAGATGKASKEANKKSGARPGPKVNEGHNNDLTDDHERRSNNHHESNDENAVHDSKEDNHSSNKGKKAAATGAGVAGAAGVAGAAKHHHDKKEENHSDRNTSREQHHDNENDRYRNDETTHDNHEHDKKSGKGKKTAAVGAGAAGAAGAAGLAKHEHDKHKNGDKRGDHRQHDDRNQHRDEQRRQHHHEDNHDGKKKGG

SEQ ID NO: 1733058 - protein, 115 aa, Staphylococcus epidermidis
KNRQSINPDEHQRDLKEDDKTNENNKEVDSQNSVSNNSNQQFPPRNAQRRKRRRETATNQSKHQDDKHQKNSDAKTTEGSLDDRYDEAQLQQQHDNSQQQNKIEKQSQDSRMIDG

SEQ ID NO: 1733059 - protein, 8 aa, Staphylococcus epidermidis
KNRSRIPE

SEQ ID NO: 1733060 - protein, 8 aa, Staphylococcus epidermidis
KNRYANAS

SEQ ID NO: 1733061 - protein, 12 aa, Staphylococcus epidermidis
KNSKDGDRQNKA

SEQ ID NO: 1733062 - protein, 11 aa, Staphylococcus epidermidis
KNSKDGDRQNV

SEQ ID NO: 1733063 - protein, 12 aa, Staphylococcus epidermidis
KNSKDKAQATKN

SEQ ID NO: 1733064 - protein, 5 aa, Staphylococcus epidermidis
KNSVK

SEQ ID NO: 1733065 - protein, 5 aa, Staphylococcus epidermidis
KNTDG

SEQ ID NO: 1733066 - protein, 7 aa, Staphylococcus epidermidis
KNTKYVE

SEQ ID NO: 1733067 - protein, 5 aa, Staphylococcus epidermidis
KNVPT

SEQ ID NO: 1733068 - protein, 9 aa, Staphylococcus epidermidis
KPAKYTKDS

SEQ ID NO: 1733069 - protein, 13 aa, Staphylococcus epidermidis
KPATKEDASWDEM

SEQ ID NO: 1733070 - protein, 5 aa, Staphylococcus epidermidis
KPATQ

SEQ ID NO: 1733071 - protein, 17 aa, Staphylococcus epidermidis
KPAYKDVEKVIEERGET

SEQ ID NO: 1733072 - protein, 17 aa, Staphylococcus epidermidis
KPAYKDVEKVIEKRGET

SEQ ID NO: 1733073 - protein, 17 aa, Staphylococcus epidermidis
KPAYQDVDKVIEKRGGT

SEQ ID NO: 1733074 - protein, 6 aa, Staphylococcus epidermidis
KPDALN

SEQ ID NO: 1733075 - protein, 12 aa, Staphylococcus epidermidis
KPDSLPKSAHES

SEQ ID NO: 1733076 - protein, 6 aa, Staphylococcus epidermidis
KPDSNK

SEQ ID NO: 1733077 - protein, 5 aa, Staphylococcus epidermidis
KPEDK

SEQ ID NO: 1733078 - protein, 16 aa, Staphylococcus epidermidis
KPEHRDESFKNYGEVE

SEQ ID NO: 1733079 - protein, 6 aa, Staphylococcus epidermidis
KPFEKY

SEQ ID NO: 1733080 - protein, 5 aa, Staphylococcus epidermidis
KPGAQ

SEQ ID NO: 1733081 - protein, 4 aa, Staphylococcus epidermidis
KPGM

SEQ ID NO: 1733082 - protein, 13 aa, Staphylococcus epidermidis
KPINSNGNDQLES

SEQ ID NO: 1733083 - protein, 7 aa, Staphylococcus epidermidis
KPITTGW

SEQ ID NO: 1733084 - protein, 39 aa, Staphylococcus epidermidis
KPKDDIYNHNGDYANNEYQSNNNHERYENGDQQVNEKNN

SEQ ID NO: 1733085 - protein, 5 aa, Staphylococcus epidermidis
KPKDL

SEQ ID NO: 1733086 - protein, 10 aa, Staphylococcus epidermidis
KPKGKKFNEN

SEQ ID NO: 1733087 - protein, 7 aa, Staphylococcus epidermidis
KPKNRGK

SEQ ID NO: 1733088 - protein, 4 aa, Staphylococcus epidermidis
KPKV

SEQ ID NO: 1733089 - protein, 4 aa, Staphylococcus epidermidis
KPLH

SEQ ID NO: 1733090 - protein, 8 aa, Staphylococcus epidermidis
KPLKTNND

SEQ ID NO: 1733091 - protein, 4 aa, Staphylococcus epidermidis
KPNE

SEQ ID NO: 1733092 - protein, 6 aa, Staphylococcus epidermidis
KPNEQE

SEQ ID NO: 1733093 - protein, 4 aa, Staphylococcus epidermidis
KPNH

SEQ ID NO: 1733094 - protein, 8 aa, Staphylococcus epidermidis
KPNPTDRE

SEQ ID NO: 1733095 - protein, 19 aa, Staphylococcus epidermidis
KPPLAEVKPATREDASWDE

SEQ ID NO: 1733096 - protein, 7 aa, Staphylococcus epidermidis
KPPTPEL

SEQ ID NO: 1733097 - protein, 34 aa, Staphylococcus epidermidis
KPQTDTTNNATTNTTEVTPVKTEFENATPTPTVL

SEQ ID NO: 1733098 - protein, 11 aa, Staphylococcus epidermidis
KPSSEYDLKSR

SEQ ID NO: 1733099 - protein, 36 aa, Staphylococcus epidermidis
KPTAINDLTQEANNQKTLIGNDGNATDDEKEAAKQL

SEQ ID NO: 1733100 - protein, 34 aa, Staphylococcus epidermidis
KPTAKSKIESAVEKKKTEINQTQNATDDEVREGL

SEQ ID NO: 1733101 - protein, 8 aa, Staphylococcus epidermidis
KPTANNEI

SEQ ID NO: 1733102 - protein, 31 aa, Staphylococcus epidermidis
KPTARKAVNKKAEEINASINNTPNATDEEKQ

SEQ ID NO: 1733103 - protein, 4 aa, Staphylococcus epidermidis
KPVK

SEQ ID NO: 1733104 - protein, 4 aa, Staphylococcus epidermidis
KPVQ

SEQ ID NO: 1733105 - protein, 5 aa, Staphylococcus epidermidis
KPVRT

SEQ ID NO: 1733106 - protein, 9 aa, Staphylococcus epidermidis
KPYDDSDDI

SEQ ID NO: 1733107 - protein, 20 aa, Staphylococcus epidermidis
KPYEPKKYKDEAKTKTTSQD

SEQ ID NO: 1733108 - protein, 19 aa, Staphylococcus epidermidis
KPYEPKKYKDETSSYTTAN

SEQ ID NO: 1733109 - protein, 6 aa, Staphylococcus epidermidis
KPYLRE

SEQ ID NO: 1733110 - protein, 16 aa, Staphylococcus epidermidis
KQASAPESSQSQSQFA

SEQ ID NO: 1733111 - protein, 7 aa, Staphylococcus epidermidis
KQATGNL

SEQ ID NO: 1733112 - protein, 7 aa, Staphylococcus epidermidis
KQAVSNS

SEQ ID NO: 1733113 - protein, 25 aa, Staphylococcus epidermidis
KQDDAKALSKEVTSGNSHLSEEEAR

SEQ ID NO: 1733114 - protein, 8 aa, Staphylococcus epidermidis
KQDDDYVQ

SEQ ID NO: 1733115 - protein, 23 aa, Staphylococcus epidermidis
KQDYNDKKGDSTRNHSPNSEYEE

SEQ ID NO: 1733116 - protein, 16 aa, Staphylococcus epidermidis
KQEEGITINENTGELT

SEQ ID NO: 1733117 - protein, 11 aa, Staphylococcus epidermidis
KQENANQDDIE

SEQ ID NO: 1733118 - protein, 30 aa, Staphylococcus epidermidis
KQGEDRLDVATKNQQVQEIKDDIKEKISNV

SEQ ID NO: 1733119 - protein, 4 aa, Staphylococcus epidermidis
KQGV

SEQ ID NO: 1733120 - protein, 8 aa, Staphylococcus epidermidis
KQHATPKQ

SEQ ID NO: 1733121 - protein, 8 aa, Staphylococcus epidermidis
KQHGNQPD

SEQ ID NO: 1733122 - protein, 4 aa, Staphylococcus epidermidis
KQHN

SEQ ID NO: 1733123 - protein, 10 aa, Staphylococcus epidermidis
KQIDKQGKLK

SEQ ID NO: 1733124 - protein, 21 aa, Staphylococcus epidermidis
KQIDQQSEEQDRSKEEYNQTF

SEQ ID NO: 1733125 - protein, 4 aa, Staphylococcus epidermidis
KQIH

SEQ ID NO: 1733126 - protein, 18 aa, Staphylococcus epidermidis
KQIKQANNQINDSLRKTN

SEQ ID NO: 1733127 - protein, 27 aa, Staphylococcus epidermidis
KQKADEIRATINSNNDATTEEKNAAIN

SEQ ID NO: 1733128 - protein, 17 aa, Staphylococcus epidermidis
KQKFEHHKDNSELLTEE

SEQ ID NO: 1733129 - protein, 12 aa, Staphylococcus epidermidis
KQKNQSSEVTDH

SEQ ID NO: 1733130 - protein, 10 aa, Staphylococcus epidermidis
KQKPNESYAE

SEQ ID NO: 1733131 - protein, 9 aa, Staphylococcus epidermidis
KQKSEVKKS

SEQ ID NO: 1733132 - protein, 15 aa, Staphylococcus epidermidis
KQLSSKKYLGYGTAS

SEQ ID NO: 1733133 - protein, 8 aa, Staphylococcus epidermidis
KQNAKNQL

SEQ ID NO: 1733134 - protein, 13 aa, Staphylococcus epidermidis
KQNEELDEKQSEL

SEQ ID NO: 1733135 - protein, 13 aa, Staphylococcus epidermidis
KQNEELEEKQSEL

SEQ ID NO: 1733136 - protein, 12 aa, Staphylococcus epidermidis
KQNESIGEKYEL

SEQ ID NO: 1733137 - protein, 10 aa, Staphylococcus epidermidis
KQNKQTDWSA

SEQ ID NO: 1733138 - protein, 4 aa, Staphylococcus epidermidis
KQNV

SEQ ID NO: 1733139 - protein, 5 aa, Staphylococcus epidermidis
KQQDY

SEQ ID NO: 1733140 - protein, 10 aa, Staphylococcus epidermidis
KQRYNQSAKT

SEQ ID NO: 1733141 - protein, 24 aa, Staphylococcus epidermidis
KQSGIIDDSTAKDIAKAKTTEDAI

SEQ ID NO: 1733142 - protein, 18 aa, Staphylococcus epidermidis
KQSIQNNDDATTEEKEVA

SEQ ID NO: 1733143 - protein, 9 aa, Staphylococcus epidermidis
KQSQEVSKA

SEQ ID NO: 1733144 - protein, 7 aa, Staphylococcus epidermidis
KQTPDKY

SEQ ID NO: 1733145 - protein, 10 aa, Staphylococcus epidermidis
KQTRSEKQIK

SEQ ID NO: 1733146 - protein, 8 aa, Staphylococcus epidermidis
KQTSKLGA

SEQ ID NO: 1733147 - protein, 23 aa, Staphylococcus epidermidis
KQTVQSKNSLEFGDPFGGGFGFF

SEQ ID NO: 1733148 - protein, 7 aa, Staphylococcus epidermidis
KQYGTNS

SEQ ID NO: 1733149 - protein, 8 aa, Staphylococcus epidermidis
KQYRKPTD

SEQ ID NO: 1733150 - protein, 7 aa, Staphylococcus epidermidis
KQYYPGN

SEQ ID NO: 1733151 - protein, 10 aa, Staphylococcus epidermidis
KRAGDYAYAT

SEQ ID NO: 1733152 - protein, 20 aa, Staphylococcus epidermidis
KRANGLNSNNIHNGQTLVIP

SEQ ID NO: 1733153 - protein, 12 aa, Staphylococcus epidermidis
KRDREGENFARK

SEQ ID NO: 1733154 - protein, 11 aa, Staphylococcus epidermidis
KREGKDLPKPA

SEQ ID NO: 1733155 - protein, 38 aa, Staphylococcus epidermidis
KRERDINKDIDDAEQAKVNAQKLEEENRKTLKETQDEV

SEQ ID NO: 1733156 - protein, 6 aa, Staphylococcus epidermidis
KRGIDD

SEQ ID NO: 1733157 - protein, 10 aa, Staphylococcus epidermidis
KRGNPDSNYT

SEQ ID NO: 1733158 - protein, 50 aa, Staphylococcus epidermidis
KRIKKHPDVQKVTNATSKATSKTTSAISNKASDVKEYVGDKKQEFDNKRE

SEQ ID NO: 1733159 - protein, 5 aa, Staphylococcus epidermidis
KRIRP

SEQ ID NO: 1733160 - protein, 9 aa, Staphylococcus epidermidis
KRKKKEEGH

SEQ ID NO: 1733161 - protein, 93 aa, Staphylococcus epidermidis
KRKNKDKRVEQRSTIDSKRESNQSKFKASDLEQTTKSNTDSTQSIDIEDEKRKNHFDSEIDNASQSINTDSKEDRNALSHKNQEEDDASSDVL

SEQ ID NO: 1733162 - protein, 8 aa, Staphylococcus epidermidis
KRKSKEFL

SEQ ID NO: 1733163 - protein, 12 aa, Staphylococcus epidermidis
KRLNHAPGETFE

SEQ ID NO: 1733164 - protein, 17 aa, Staphylococcus epidermidis
KRMDKAETNIEKTSEKL

SEQ ID NO: 1733165 - protein, 7 aa, Staphylococcus epidermidis
KRNELEK

SEQ ID NO: 1733166 - protein, 10 aa, Staphylococcus epidermidis
KRNKRNKRNK

SEQ ID NO: 1733167 - protein, 8 aa, Staphylococcus epidermidis
KRPTYTNA

SEQ ID NO: 1733168 - protein, 10 aa, Staphylococcus epidermidis
KRQGKNPNEL

SEQ ID NO: 1733169 - protein, 7 aa, Staphylococcus epidermidis
KRQTGKL

SEQ ID NO: 1733170 - protein, 8 aa, Staphylococcus epidermidis
KRRDEIAN

SEQ ID NO: 1733171 - protein, 4 aa, Staphylococcus epidermidis
KRRG

SEQ ID NO: 1733172 - protein, 7 aa, Staphylococcus epidermidis
KRRNNRS

SEQ ID NO: 1733173 - protein, 8 aa, Staphylococcus epidermidis
KRSAGNNA

SEQ ID NO: 1733174 - protein, 5 aa, Staphylococcus epidermidis
KRSDY

SEQ ID NO: 1733175 - protein, 14 aa, Staphylococcus epidermidis
KRSYFNKDGRVTIN

SEQ ID NO: 1733176 - protein, 13 aa, Staphylococcus epidermidis
KRVNELQEDKHGL

SEQ ID NO: 1733177 - protein, 21 aa, Staphylococcus epidermidis
KSAANQMTNEYRNAGGRFADV

SEQ ID NO: 1733178 - protein, 5 aa, Staphylococcus epidermidis
KSAGV

SEQ ID NO: 1733179 - protein, 9 aa, Staphylococcus epidermidis
KSAVRYSEV

SEQ ID NO: 1733180 - protein, 9 aa, Staphylococcus epidermidis
KSDAKASSL

SEQ ID NO: 1733181 - protein, 9 aa, Staphylococcus epidermidis
KSDAKGSSI

SEQ ID NO: 1733182 - protein, 5 aa, Staphylococcus epidermidis
KSDIP

SEQ ID NO: 1733183 - protein, 13 aa, Staphylococcus epidermidis
KSDKNGNLGNQRT

SEQ ID NO: 1733184 - protein, 15 aa, Staphylococcus epidermidis
KSDPNSGERVEEGDT

SEQ ID NO: 1733185 - protein, 7 aa, Staphylococcus epidermidis
KSDSLDL

SEQ ID NO: 1733186 - protein, 16 aa, Staphylococcus epidermidis
KSDYNKNNKKIKLNDD

SEQ ID NO: 1733187 - protein, 44 aa, Staphylococcus epidermidis
KSEKNQYKSLKDFDGKKIAAQKGTEQEKIAQNEINNGQISSLSR

SEQ ID NO: 1733188 - protein, 9 aa, Staphylococcus epidermidis
KSELTRDEA

SEQ ID NO: 1733189 - protein, 6 aa, Staphylococcus epidermidis
KSENGK

SEQ ID NO: 1733190 - protein, 28 aa, Staphylococcus epidermidis
KSESGAVKHESFDTNEPFTDDADEEEFE

SEQ ID NO: 1733191 - protein, 9 aa, Staphylococcus epidermidis
KSEVYNGAQ

SEQ ID NO: 1733192 - protein, 5 aa, Staphylococcus epidermidis
KSEYN

SEQ ID NO: 1733193 - protein, 13 aa, Staphylococcus epidermidis
KSFNKSSSAIGQG

SEQ ID NO: 1733194 - protein, 11 aa, Staphylococcus epidermidis
KSGANSRLSTF

SEQ ID NO: 1733195 - protein, 10 aa, Staphylococcus epidermidis
KSGKDRKNKI

SEQ ID NO: 1733196 - protein, 5 aa, Staphylococcus epidermidis
KSGNG

SEQ ID NO: 1733197 - protein, 7 aa, Staphylococcus epidermidis
KSHSPAA

SEQ ID NO: 1733198 - protein, 7 aa, Staphylococcus epidermidis
KSHTSIK

SEQ ID NO: 1733199 - protein, 12 aa, Staphylococcus epidermidis
KSIENKNSFVPA

SEQ ID NO: 1733200 - protein, 9 aa, Staphylococcus epidermidis
KSIKPNMQP

SEQ ID NO: 1733201 - protein, 6 aa, Staphylococcus epidermidis
KSIKQN

SEQ ID NO: 1733202 - protein, 31 aa, Staphylococcus epidermidis
KSKFTDLDDKKADDLEEGKFDDEGGATTSNN

SEQ ID NO: 1733203 - protein, 7 aa, Staphylococcus epidermidis
KSKGTND

SEQ ID NO: 1733204 - protein, 31 aa, Staphylococcus epidermidis
KSKIIGKNDQTQDDIEEGKFDAEGGATANNN

SEQ ID NO: 1733205 - protein, 5 aa, Staphylococcus epidermidis
KSKNF

SEQ ID NO: 1733206 - protein, 11 aa, Staphylococcus epidermidis
KSKNLKGANGH

SEQ ID NO: 1733207 - protein, 12 aa, Staphylococcus epidermidis
KSKNVNKKTLKK

SEQ ID NO: 1733208 - protein, 8 aa, Staphylococcus epidermidis
KSKTHEKS

SEQ ID NO: 1733209 - protein, 10 aa, Staphylococcus epidermidis
KSLNDKKGDV

SEQ ID NO: 1733210 - protein, 14 aa, Staphylococcus epidermidis
KSMKTTSFKKDPMG

SEQ ID NO: 1733211 - protein, 7 aa, Staphylococcus epidermidis
KSNARDV

SEQ ID NO: 1733212 - protein, 6 aa, Staphylococcus epidermidis
KSNGAF

SEQ ID NO: 1733213 - protein, 5 aa, Staphylococcus epidermidis
KSNNY

SEQ ID NO: 1733214 - protein, 6 aa, Staphylococcus epidermidis
KSNQSG

SEQ ID NO: 1733215 - protein, 13 aa, Staphylococcus epidermidis
KSNSPKRKMRIRR

SEQ ID NO: 1733216 - protein, 4 aa, Staphylococcus epidermidis
KSNT

SEQ ID NO: 1733217 - protein, 15 aa, Staphylococcus epidermidis
KSNTDVEKNLDNDGY

SEQ ID NO: 1733218 - protein, 6 aa, Staphylococcus epidermidis
KSPLTS

SEQ ID NO: 1733219 - protein, 7 aa, Staphylococcus epidermidis
KSPSKLR

SEQ ID NO: 1733220 - protein, 12 aa, Staphylococcus epidermidis
KSQADSEAFSKN

SEQ ID NO: 1733221 - protein, 13 aa, Staphylococcus epidermidis
KSQADSESFSKND

SEQ ID NO: 1733222 - protein, 14 aa, Staphylococcus epidermidis
KSQANTDFKPNTNL

SEQ ID NO: 1733223 - protein, 8 aa, Staphylococcus epidermidis
KSQDPIMS

SEQ ID NO: 1733224 - protein, 12 aa, Staphylococcus epidermidis
KSQNEIKEATNE

SEQ ID NO: 1733225 - protein, 5 aa, Staphylococcus epidermidis
KSQSL

SEQ ID NO: 1733226 - protein, 11 aa, Staphylococcus epidermidis
KSRGSEISSGG

SEQ ID NO: 1733227 - protein, 12 aa, Staphylococcus epidermidis
KSRGSEISSGSI

SEQ ID NO: 1733228 - protein, 7 aa, Staphylococcus epidermidis
KSRHMPP

SEQ ID NO: 1733229 - protein, 121 aa, Staphylococcus epidermidis
KSRKKAKDQKVEQRSTKDSENQSYQSKFKASDLDKQSESNNASSQIRNHSDNIEDDKRKHHFETTNEGDQTSSKATNANSKYDAYPGSLRRSDQHEDQANDEKQDHQKDNTEQPNEESDEV

SEQ ID NO: 1733230 - protein, 12 aa, Staphylococcus epidermidis
KSRLENATKYNQ

SEQ ID NO: 1733231 - protein, 7 aa, Staphylococcus epidermidis
KSRTEAM

SEQ ID NO: 1733232 - protein, 7 aa, Staphylococcus epidermidis
KSRTEGE

SEQ ID NO: 1733233 - protein, 7 aa, Staphylococcus epidermidis
KSRTRIP

SEQ ID NO: 1733234 - protein, 14 aa, Staphylococcus epidermidis
KSRVPKANIDGKVG

SEQ ID NO: 1733235 - protein, 21 aa, Staphylococcus epidermidis
KSSEFTGKSDLNLNRNNNLKR

SEQ ID NO: 1733236 - protein, 18 aa, Staphylococcus epidermidis
KSSINDETPNVDEKIGTI

SEQ ID NO: 1733237 - protein, 22 aa, Staphylococcus epidermidis
KSSNNAVESDKSPYIQDKQKRN

SEQ ID NO: 1733238 - protein, 10 aa, Staphylococcus epidermidis
KSSNQKERYI

SEQ ID NO: 1733239 - protein, 12 aa, Staphylococcus epidermidis
KSSNSEKVANNI

SEQ ID NO: 1733240 - protein, 47 aa, Staphylococcus epidermidis
KSSSENASESFKEKREQNKAKKEERAQLKAKRAEEKKRTKNQERLQH

SEQ ID NO: 1733241 - protein, 7 aa, Staphylococcus epidermidis
KSSSLDD

SEQ ID NO: 1733242 - protein, 47 aa, Staphylococcus epidermidis
KSSSNHASESIKQKREQNKIKKEEKAQLKEEKIERKKQKKSRQNNNV

SEQ ID NO: 1733243 - protein, 8 aa, Staphylococcus epidermidis
KSSVGRLG

SEQ ID NO: 1733244 - protein, 5 aa, Staphylococcus epidermidis
KSSYI

SEQ ID NO: 1733245 - protein, 6 aa, Staphylococcus epidermidis
KSTDLR

SEQ ID NO: 1733246 - protein, 7 aa, Staphylococcus epidermidis
KSTELDE

SEQ ID NO: 1733247 - protein, 11 aa, Staphylococcus epidermidis
KSTEQKNKDVP

SEQ ID NO: 1733248 - protein, 6 aa, Staphylococcus epidermidis
KSTNLD

SEQ ID NO: 1733249 - protein, 12 aa, Staphylococcus epidermidis
KSTNLSDKTNHY

SEQ ID NO: 1733250 - protein, 7 aa, Staphylococcus epidermidis
KSTQHHI

SEQ ID NO: 1733251 - protein, 9 aa, Staphylococcus epidermidis
KSVGSLDKN

SEQ ID NO: 1733252 - protein, 9 aa, Staphylococcus epidermidis
KSVKDTKLA

SEQ ID NO: 1733253 - protein, 18 aa, Staphylococcus epidermidis
KSVPFSSDTTPPTINEPA

SEQ ID NO: 1733254 - protein, 7 aa, Staphylococcus epidermidis
KSYPNSG

SEQ ID NO: 1733255 - protein, 4 aa, Staphylococcus epidermidis
KTAN

SEQ ID NO: 1733256 - protein, 13 aa, Staphylococcus epidermidis
KTAQKAHIQPKRA

SEQ ID NO: 1733257 - protein, 9 aa, Staphylococcus epidermidis
KTARTVTDL

SEQ ID NO: 1733258 - protein, 9 aa, Staphylococcus epidermidis
KTATPKPPI

SEQ ID NO: 1733259 - protein, 10 aa, Staphylococcus epidermidis
KTDGHKNAQH

SEQ ID NO: 1733260 - protein, 16 aa, Staphylococcus epidermidis
KTDGMEGSMAQAGNPI

SEQ ID NO: 1733261 - protein, 9 aa, Staphylococcus epidermidis
KTDLESKLT

SEQ ID NO: 1733262 - protein, 11 aa, Staphylococcus epidermidis
KTDSENPDFPT

SEQ ID NO: 1733263 - protein, 5 aa, Staphylococcus epidermidis
KTDTF

SEQ ID NO: 1733264 - protein, 9 aa, Staphylococcus epidermidis
KTEFHASDS

SEQ ID NO: 1733265 - protein, 6 aa, Staphylococcus epidermidis
KTEGIQ

SEQ ID NO: 1733266 - protein, 32 aa, Staphylococcus epidermidis
KTEIDKKEQIKADSKYINADSGLQANYNSALN

SEQ ID NO: 1733267 - protein, 8 aa, Staphylococcus epidermidis
KTELKHND

SEQ ID NO: 1733268 - protein, 11 aa, Staphylococcus epidermidis
KTELPTDTEFN

SEQ ID NO: 1733269 - protein, 5 aa, Staphylococcus epidermidis
KTENG

SEQ ID NO: 1733270 - protein, 8 aa, Staphylococcus epidermidis
KTENISHG

SEQ ID NO: 1733271 - protein, 9 aa, Staphylococcus epidermidis
KTEPALGAS

SEQ ID NO: 1733272 - protein, 8 aa, Staphylococcus epidermidis
KTESIPNA

SEQ ID NO: 1733273 - protein, 7 aa, Staphylococcus epidermidis
KTESIQN

SEQ ID NO: 1733274 - protein, 12 aa, Staphylococcus epidermidis
KTGFNNEGATVH

SEQ ID NO: 1733275 - protein, 6 aa, Staphylococcus epidermidis
KTGSLR

SEQ ID NO: 1733276 - protein, 5 aa, Staphylococcus epidermidis
KTGST

SEQ ID NO: 1733277 - protein, 8 aa, Staphylococcus epidermidis
KTGTLTKG

SEQ ID NO: 1733278 - protein, 13 aa, Staphylococcus epidermidis
KTGTLTNGEPKVT

SEQ ID NO: 1733279 - protein, 13 aa, Staphylococcus epidermidis
KTGTLTVGEPSVT

SEQ ID NO: 1733280 - protein, 7 aa, Staphylococcus epidermidis
KTHEVSG

SEQ ID NO: 1733281 - protein, 12 aa, Staphylococcus epidermidis
KTHGLSEHAKGV

SEQ ID NO: 1733282 - protein, 12 aa, Staphylococcus epidermidis
KTHNKTDEENVT

SEQ ID NO: 1733283 - protein, 7 aa, Staphylococcus epidermidis
KTHTDPM

SEQ ID NO: 1733284 - protein, 17 aa, Staphylococcus epidermidis
KTIEKLNPKLSKDKTNA

SEQ ID NO: 1733285 - protein, 8 aa, Staphylococcus epidermidis
KTIGASQR

SEQ ID NO: 1733286 - protein, 9 aa, Staphylococcus epidermidis
KTKDKSEIK

SEQ ID NO: 1733287 - protein, 5 aa, Staphylococcus epidermidis
KTKIP

SEQ ID NO: 1733288 - protein, 8 aa, Staphylococcus epidermidis
KTKQKSVI

SEQ ID NO: 1733289 - protein, 9 aa, Staphylococcus epidermidis
KTKSKDNKE

SEQ ID NO: 1733290 - protein, 41 aa, Staphylococcus epidermidis
KTLDKAAKKQIHNYTSQQVSNKNNNAWRDASDTEIKTAMDS

SEQ ID NO: 1733291 - protein, 22 aa, Staphylococcus epidermidis
KTLKQAKQLEDEVEKAKEEAKI

SEQ ID NO: 1733292 - protein, 5 aa, Staphylococcus epidermidis
KTMEP

SEQ ID NO: 1733293 - protein, 21 aa, Staphylococcus epidermidis
KTNAKALAKKQRILDKKHAEN

SEQ ID NO: 1733294 - protein, 4 aa, Staphylococcus epidermidis
KTNG

SEQ ID NO: 1733295 - protein, 7 aa, Staphylococcus epidermidis
KTNNKTI

SEQ ID NO: 1733296 - protein, 9 aa, Staphylococcus epidermidis
KTNTDTKNL

SEQ ID NO: 1733297 - protein, 21 aa, Staphylococcus epidermidis
KTPGREDKKSTVTTTSASQLP

SEQ ID NO: 1733298 - protein, 20 aa, Staphylococcus epidermidis
KTPGREDKQTATKSTSTSEL

SEQ ID NO: 1733299 - protein, 13 aa, Staphylococcus epidermidis
KTQAQKVSEGDYS

SEQ ID NO: 1733300 - protein, 6 aa, Staphylococcus epidermidis
KTQETF

SEQ ID NO: 1733301 - protein, 6 aa, Staphylococcus epidermidis
KTQGAE

SEQ ID NO: 1733302 - protein, 9 aa, Staphylococcus epidermidis
KTQLETAKV

SEQ ID NO: 1733303 - protein, 7 aa, Staphylococcus epidermidis
KTQNRIR

SEQ ID NO: 1733304 - protein, 16 aa, Staphylococcus epidermidis
KTQNVKQDNSLSASKQ

SEQ ID NO: 1733305 - protein, 22 aa, Staphylococcus epidermidis
KTQTKKSAKRYAQSLLANCDFK

SEQ ID NO: 1733306 - protein, 9 aa, Staphylococcus epidermidis
KTRLNENNS

SEQ ID NO: 1733307 - protein, 8 aa, Staphylococcus epidermidis
KTSAAATG

SEQ ID NO: 1733308 - protein, 12 aa, Staphylococcus epidermidis
KTSAQGKNIDKA

SEQ ID NO: 1733309 - protein, 8 aa, Staphylococcus epidermidis
KTSEGANP

SEQ ID NO: 1733310 - protein, 9 aa, Staphylococcus epidermidis
KTSFDTGNE

SEQ ID NO: 1733311 - protein, 7 aa, Staphylococcus epidermidis
KTSGQYN

SEQ ID NO: 1733312 - protein, 4 aa, Staphylococcus epidermidis
KTST

SEQ ID NO: 1733313 - protein, 9 aa, Staphylococcus epidermidis
KTTNDLTRD

SEQ ID NO: 1733314 - protein, 5 aa, Staphylococcus epidermidis
KTTNH

SEQ ID NO: 1733315 - protein, 6 aa, Staphylococcus epidermidis
KTTRTA

SEQ ID NO: 1733316 - protein, 4 aa, Staphylococcus epidermidis
KTTS

SEQ ID NO: 1733317 - protein, 7 aa, Staphylococcus epidermidis
KTTTPVK

SEQ ID NO: 1733318 - protein, 12 aa, Staphylococcus epidermidis
KTVKVSDKNLQD

SEQ ID NO: 1733319 - protein, 6 aa, Staphylococcus epidermidis
KTYDQD

SEQ ID NO: 1733320 - protein, 10 aa, Staphylococcus epidermidis
KTYKGVNVKG

SEQ ID NO: 1733321 - protein, 9 aa, Staphylococcus epidermidis
KTYQHHTQD

SEQ ID NO: 1733322 - protein, 7 aa, Staphylococcus epidermidis
KTYTVGK

SEQ ID NO: 1733323 - protein, 24 aa, Staphylococcus epidermidis
KVAASNSFGNRSISSSDKTHDAET

SEQ ID NO: 1733324 - protein, 9 aa, Staphylococcus epidermidis
KVAEKTATA

SEQ ID NO: 1733325 - protein, 8 aa, Staphylococcus epidermidis
KVAPGAGG

SEQ ID NO: 1733326 - protein, 11 aa, Staphylococcus epidermidis
KVATPQLNDNQ

SEQ ID NO: 1733327 - protein, 5 aa, Staphylococcus epidermidis
KVDNV

SEQ ID NO: 1733328 - protein, 5 aa, Staphylococcus epidermidis
KVDQA

SEQ ID NO: 1733329 - protein, 8 aa, Staphylococcus epidermidis
KVDSEGKS

SEQ ID NO: 1733330 - protein, 11 aa, Staphylococcus epidermidis
KVEELPKEERI

SEQ ID NO: 1733331 - protein, 15 aa, Staphylococcus epidermidis
KVEENTKDIKNNHYN

SEQ ID NO: 1733332 - protein, 9 aa, Staphylococcus epidermidis
KVEKDGDKF

SEQ ID NO: 1733333 - protein, 6 aa, Staphylococcus epidermidis
KVETVP

SEQ ID NO: 1733334 - protein, 6 aa, Staphylococcus epidermidis
KVGGKL

SEQ ID NO: 1733335 - protein, 5 aa, Staphylococcus epidermidis
KVGPE

SEQ ID NO: 1733336 - protein, 4 aa, Staphylococcus epidermidis
KVHK

SEQ ID NO: 1733337 - protein, 6 aa, Staphylococcus epidermidis
KVKKES

SEQ ID NO: 1733338 - protein, 6 aa, Staphylococcus epidermidis
KVKKNV

SEQ ID NO: 1733339 - protein, 15 aa, Staphylococcus epidermidis
KVKMTRTSDKYVSLD

SEQ ID NO: 1733340 - protein, 8 aa, Staphylococcus epidermidis
KVNTEEIQ

SEQ ID NO: 1733341 - protein, 4 aa, Staphylococcus epidermidis
KVPS

SEQ ID NO: 1733342 - protein, 12 aa, Staphylococcus epidermidis
KVQNTIDSKAKR

SEQ ID NO: 1733343 - protein, 6 aa, Staphylococcus epidermidis
KVQQGK

SEQ ID NO: 1733344 - protein, 13 aa, Staphylococcus epidermidis
KVQTDNQSLDSNY

SEQ ID NO: 1733345 - protein, 7 aa, Staphylococcus epidermidis
KVSEPYL

SEQ ID NO: 1733346 - protein, 8 aa, Staphylococcus epidermidis
KVSEQTEL

SEQ ID NO: 1733347 - protein, 10 aa, Staphylococcus epidermidis
KVSNLSEKSY

SEQ ID NO: 1733348 - protein, 8 aa, Staphylococcus epidermidis
KVSPAIEG

SEQ ID NO: 1733349 - protein, 14 aa, Staphylococcus epidermidis
KVTDNEIQASQAMD

SEQ ID NO: 1733350 - protein, 14 aa, Staphylococcus epidermidis
KVTENEIQASEAMD

SEQ ID NO: 1733351 - protein, 10 aa, Staphylococcus epidermidis
KVTNANYERH

SEQ ID NO: 1733352 - protein, 7 aa, Staphylococcus epidermidis
KWQKGRN

SEQ ID NO: 1733353 - protein, 5 aa, Staphylococcus epidermidis
KWSDN

SEQ ID NO: 1733354 - protein, 23 aa, Staphylococcus epidermidis
KYDDSQAHEDTEETSSHITPKEN

SEQ ID NO: 1733355 - protein, 7 aa, Staphylococcus epidermidis
KYDIKNQ

SEQ ID NO: 1733356 - protein, 12 aa, Staphylococcus epidermidis
KYDKAGNEVDTT

SEQ ID NO: 1733357 - protein, 72 aa, Staphylococcus epidermidis
KYDNQYQNHKRRAEEDEYRNRAQSQNRPNAQRPNQHRDNRGFEDEPERYYNGRDYRREQQLEEENEKSSRTK

SEQ ID NO: 1733358 - protein, 10 aa, Staphylococcus epidermidis
KYDSSQKSIK

SEQ ID NO: 1733359 - protein, 7 aa, Staphylococcus epidermidis
KYDTDNK

SEQ ID NO: 1733360 - protein, 7 aa, Staphylococcus epidermidis
KYDVKDQ

SEQ ID NO: 1733361 - protein, 4 aa, Staphylococcus epidermidis
KYEA

SEQ ID NO: 1733362 - protein, 9 aa, Staphylococcus epidermidis
KYEEKKGAQ

SEQ ID NO: 1733363 - protein, 11 aa, Staphylococcus epidermidis
KYFSPNGKYRD

SEQ ID NO: 1733364 - protein, 11 aa, Staphylococcus epidermidis
KYFSPNGKYRN

SEQ ID NO: 1733365 - protein, 15 aa, Staphylococcus epidermidis
KYHNKKKGDSEMKLN

SEQ ID NO: 1733366 - protein, 13 aa, Staphylococcus epidermidis
KYINEDSEQQNVY

SEQ ID NO: 1733367 - protein, 5 aa, Staphylococcus epidermidis
KYKTP

SEQ ID NO: 1733368 - protein, 10 aa, Staphylococcus epidermidis
KYKTPSQPII

SEQ ID NO: 1733369 - protein, 16 aa, Staphylococcus epidermidis
KYKTQKDIKSKIEDDN

SEQ ID NO: 1733370 - protein, 10 aa, Staphylococcus epidermidis
KYNAENHDAD

SEQ ID NO: 1733371 - protein, 13 aa, Staphylococcus epidermidis
KYNVKEKLTEQGY

SEQ ID NO: 1733372 - protein, 28 aa, Staphylococcus epidermidis
KYPHGVRKGHPAYQPKLDRDKDNYACEV

SEQ ID NO: 1733373 - protein, 5 aa, Staphylococcus epidermidis
KYPLD

SEQ ID NO: 1733374 - protein, 6 aa, Staphylococcus epidermidis
KYQDMN

SEQ ID NO: 1733375 - protein, 29 aa, Staphylococcus epidermidis
KYQEVSRESGINSKKAAQLRQEYSRQADN

SEQ ID NO: 1733376 - protein, 12 aa, Staphylococcus epidermidis
KYQKDNSQTSTY

SEQ ID NO: 1733377 - protein, 9 aa, Staphylococcus epidermidis
KYSKKNASI

SEQ ID NO: 1733378 - protein, 7 aa, Staphylococcus epidermidis
KYSPEAL

SEQ ID NO: 1733379 - protein, 8 aa, Staphylococcus epidermidis
KYSRGDKR

SEQ ID NO: 1733380 - protein, 6 aa, Staphylococcus epidermidis
KYYENL

SEQ ID NO: 1733381 - protein, 7 aa, Staphylococcus epidermidis
LAAQDHN

SEQ ID NO: 1733382 - protein, 173 aa, Staphylococcus epidermidis
LAASETPITSEISSNSETVANQNSTTIKNSQKETVNSTSLESNHSNSTNKQMSSEVTNTAQSSEKAGISQQSSETSNQSSKLNTYASTDHVESTTTNNDNTAQQDQNKSSNVTSKSTQSNTSSSEKSISSNLTQSIETKATDSLATSEVRTSTNQISNLTSTSTSNQSSPTSF

SEQ ID NO: 1733383 - protein, 41 aa, Staphylococcus epidermidis
LADESPEAQAIQEAKKETKKADGVRPSATELAAQQNAIQRE

SEQ ID NO: 1733384 - protein, 28 aa, Staphylococcus epidermidis
LADESPEAQAIQEAKSEVDSNNKTSMTH

SEQ ID NO: 1733385 - protein, 6 aa, Staphylococcus epidermidis
LADKGF

SEQ ID NO: 1733386 - protein, 4 aa, Staphylococcus epidermidis
LADN

SEQ ID NO: 1733387 - protein, 18 aa, Staphylococcus epidermidis
LAEATQKINQAHSTNDVN

SEQ ID NO: 1733388 - protein, 20 aa, Staphylococcus epidermidis
LAEGRGKAQANALRQTQTEM

SEQ ID NO: 1733389 - protein, 22 aa, Staphylococcus epidermidis
LAEGRGKAQANALRQTQTEMKA

SEQ ID NO: 1733390 - protein, 13 aa, Staphylococcus epidermidis
LAENEKHVRGPGS

SEQ ID NO: 1733391 - protein, 6 aa, Staphylococcus epidermidis
LAETPF

SEQ ID NO: 1733392 - protein, 7 aa, Staphylococcus epidermidis
LAETPFQ

SEQ ID NO: 1733393 - protein, 6 aa, Staphylococcus epidermidis
LAGPSS

SEQ ID NO: 1733394 - protein, 7 aa, Staphylococcus epidermidis
LAGQRDD

SEQ ID NO: 1733395 - protein, 11 aa, Staphylococcus epidermidis
LAGTGTARLTK

SEQ ID NO: 1733396 - protein, 9 aa, Staphylococcus epidermidis
LAKDEGINT

SEQ ID NO: 1733397 - protein, 8 aa, Staphylococcus epidermidis
LAKGLGQN

SEQ ID NO: 1733398 - protein, 59 aa, Staphylococcus epidermidis
LAQERQNGENQELQASRLEQSETNKTKDGLNLSEDQRNNKEHSQIAQNKDNRENKVPYS

SEQ ID NO: 1733399 - protein, 16 aa, Staphylococcus epidermidis
LAQQKNVKDEKNMSNR

SEQ ID NO: 1733400 - protein, 7 aa, Staphylococcus epidermidis
LAQQTHS

SEQ ID NO: 1733401 - protein, 9 aa, Staphylococcus epidermidis
LARQSNNDI

SEQ ID NO: 1733402 - protein, 8 aa, Staphylococcus epidermidis
LASKGMSL

SEQ ID NO: 1733403 - protein, 8 aa, Staphylococcus epidermidis
LASKTNTQ

SEQ ID NO: 1733404 - protein, 8 aa, Staphylococcus epidermidis
LASSNPAT

SEQ ID NO: 1733405 - protein, 39 aa, Staphylococcus epidermidis
LATDAKNKNAIIDQTPNATAEEKEEANNKVDRLQEEADA

SEQ ID NO: 1733406 - protein, 4 aa, Staphylococcus epidermidis
LATN

SEQ ID NO: 1733407 - protein, 13 aa, Staphylococcus epidermidis
LATPTKEQARGLR

SEQ ID NO: 1733408 - protein, 12 aa, Staphylococcus epidermidis
LDDYKTQKDNIN

SEQ ID NO: 1733409 - protein, 6 aa, Staphylococcus epidermidis
LDEKNK

SEQ ID NO: 1733410 - protein, 12 aa, Staphylococcus epidermidis
LDENKTSKTTIK

SEQ ID NO: 1733411 - protein, 9 aa, Staphylococcus epidermidis
LDKNSKNPI

SEQ ID NO: 1733412 - protein, 15 aa, Staphylococcus epidermidis
LDKTKYEADPPAFFW

SEQ ID NO: 1733413 - protein, 15 aa, Staphylococcus epidermidis
LDKTKYEANPPLFIW

SEQ ID NO: 1733414 - protein, 4 aa, Staphylococcus epidermidis
LDNL

SEQ ID NO: 1733415 - protein, 5 aa, Staphylococcus epidermidis
LDNLG

SEQ ID NO: 1733416 - protein, 6 aa, Staphylococcus epidermidis
LDPLPS

SEQ ID NO: 1733417 - protein, 17 aa, Staphylococcus epidermidis
LDPTRKNKGQEHQVQKL

SEQ ID NO: 1733418 - protein, 5 aa, Staphylococcus epidermidis
LDQEN

SEQ ID NO: 1733419 - protein, 8 aa, Staphylococcus epidermidis
LDQTRGKY

SEQ ID NO: 1733420 - protein, 12 aa, Staphylococcus epidermidis
LDSAGGGDGSSF

SEQ ID NO: 1733421 - protein, 27 aa, Staphylococcus epidermidis
LDSDPIKTGAQYAKKHGWDTPQKAIYG

SEQ ID NO: 1733422 - protein, 7 aa, Staphylococcus epidermidis
LDSDSDK

SEQ ID NO: 1733423 - protein, 163 aa, Staphylococcus epidermidis
LDSDSDSDGDSDSGSDSGADSDSDSDSDSDSDSNTDSDSDSDSDSDSNADSDSDSDSDSDADSDSDSDSDSDSDSDSDADSDSDSDSDSDSDSGADSDSDSDSDSDSDSDSDSDSDSDTSSGKGSHTGKKPSNTKGNTNRPSQSHTNQPQRPKYNQTNQNNID

SEQ ID NO: 1733424 - protein, 21 aa, Staphylococcus epidermidis
LDSEPSKNVVPGMNAEVKIHK

SEQ ID NO: 1733425 - protein, 10 aa, Staphylococcus epidermidis
LDSKDKVQTV

SEQ ID NO: 1733426 - protein, 6 aa, Staphylococcus epidermidis
LDSKIE

SEQ ID NO: 1733427 - protein, 30 aa, Staphylococcus epidermidis
LDSNEIKNNQSHTKANTNNKNMSNKENSME

SEQ ID NO: 1733428 - protein, 29 aa, Staphylococcus epidermidis
LDTNRKPFVAQGGSKKRDDNEEKLSPGKA

SEQ ID NO: 1733429 - protein, 31 aa, Staphylococcus epidermidis
LDTNRKPFVARGDSARGNKDEKEEKLSPGKA

SEQ ID NO: 1733430 - protein, 6 aa, Staphylococcus epidermidis
LDTSNQ

SEQ ID NO: 1733431 - protein, 24 aa, Staphylococcus epidermidis
LDTVKSYEEVKKDNIPKKAMSKLE

SEQ ID NO: 1733432 - protein, 5 aa, Staphylococcus epidermidis
LEAPS

SEQ ID NO: 1733433 - protein, 5 aa, Staphylococcus epidermidis
LEATN

SEQ ID NO: 1733434 - protein, 7 aa, Staphylococcus epidermidis
LEDNDEK

SEQ ID NO: 1733435 - protein, 4 aa, Staphylococcus epidermidis
LEDR

SEQ ID NO: 1733436 - protein, 12 aa, Staphylococcus epidermidis
LEEREKQDEQEN

SEQ ID NO: 1733437 - protein, 6 aa, Staphylococcus epidermidis
LEGKLS

SEQ ID NO: 1733438 - protein, 21 aa, Staphylococcus epidermidis
LEGNGTSFSENKSSKPSTTEL

SEQ ID NO: 1733439 - protein, 7 aa, Staphylococcus epidermidis
LEGTPEL

SEQ ID NO: 1733440 - protein, 44 aa, Staphylococcus epidermidis
LEHENAKVSQLENKEDITENEPNDSLVEDKNSKYSDNKRFENIS

SEQ ID NO: 1733441 - protein, 19 aa, Staphylococcus epidermidis
LEHPNDDFDSVSNGNGLDN

SEQ ID NO: 1733442 - protein, 22 aa, Staphylococcus epidermidis
LEKGDDKEQLKTSNDALKQAKD

SEQ ID NO: 1733443 - protein, 5 aa, Staphylococcus epidermidis
LENEQ

SEQ ID NO: 1733444 - protein, 13 aa, Staphylococcus epidermidis
LENQASQETINNV

SEQ ID NO: 1733445 - protein, 7 aa, Staphylococcus epidermidis
LEPNGVP

SEQ ID NO: 1733446 - protein, 4 aa, Staphylococcus epidermidis
LEQT

SEQ ID NO: 1733447 - protein, 13 aa, Staphylococcus epidermidis
LESPNESSSSVAK

SEQ ID NO: 1733448 - protein, 7 aa, Staphylococcus epidermidis
LESSDIQ

SEQ ID NO: 1733449 - protein, 11 aa, Staphylococcus epidermidis
LETDTQYNQQL

SEQ ID NO: 1733450 - protein, 8 aa, Staphylococcus epidermidis
LETRSEHP

SEQ ID NO: 1733451 - protein, 12 aa, Staphylococcus epidermidis
LGAKTGTGTYGA

SEQ ID NO: 1733452 - protein, 5 aa, Staphylococcus epidermidis
LGASG

SEQ ID NO: 1733453 - protein, 6 aa, Staphylococcus epidermidis
LGDGNF

SEQ ID NO: 1733454 - protein, 6 aa, Staphylococcus epidermidis
LGEGGA

SEQ ID NO: 1733455 - protein, 7 aa, Staphylococcus epidermidis
LGEGGVT

SEQ ID NO: 1733456 - protein, 5 aa, Staphylococcus epidermidis
LGETA

SEQ ID NO: 1733457 - protein, 5 aa, Staphylococcus epidermidis
LGGGG

SEQ ID NO: 1733458 - protein, 18 aa, Staphylococcus epidermidis
LGGPTGYAINPARDLGPR

SEQ ID NO: 1733459 - protein, 5 aa, Staphylococcus epidermidis
LGGSQ

SEQ ID NO: 1733460 - protein, 4 aa, Staphylococcus epidermidis
LGIN

SEQ ID NO: 1733461 - protein, 10 aa, Staphylococcus epidermidis
LGKPHDKPEF

SEQ ID NO: 1733462 - protein, 10 aa, Staphylococcus epidermidis
LGKPVSNRWG

SEQ ID NO: 1733463 - protein, 7 aa, Staphylococcus epidermidis
LGNPKVI

SEQ ID NO: 1733464 - protein, 7 aa, Staphylococcus epidermidis
LGNQYGG

SEQ ID NO: 1733465 - protein, 18 aa, Staphylococcus epidermidis
LGNRYEGYSPDGVPGGDG

SEQ ID NO: 1733466 - protein, 17 aa, Staphylococcus epidermidis
LGNRYEGYSPDGVVGGD

SEQ ID NO: 1733467 - protein, 10 aa, Staphylococcus epidermidis
LGNTAKLAQA

SEQ ID NO: 1733468 - protein, 13 aa, Staphylococcus epidermidis
LGNTTENEERPKG

SEQ ID NO: 1733469 - protein, 12 aa, Staphylococcus epidermidis
LGPSSSAHASKE

SEQ ID NO: 1733470 - protein, 12 aa, Staphylococcus epidermidis
LGQNASASKRYG

SEQ ID NO: 1733471 - protein, 20 aa, Staphylococcus epidermidis
LGQSSLSDYNESFLNFKMSL

SEQ ID NO: 1733472 - protein, 11 aa, Staphylococcus epidermidis
LGSDQAAHAGQ

SEQ ID NO: 1733473 - protein, 4 aa, Staphylococcus epidermidis
LGSG

SEQ ID NO: 1733474 - protein, 17 aa, Staphylococcus epidermidis
LGTPHNGTPAADKLGTR

SEQ ID NO: 1733475 - protein, 6 aa, Staphylococcus epidermidis
LHETPR

SEQ ID NO: 1733476 - protein, 8 aa, Staphylococcus epidermidis
LHTTRDSG

SEQ ID NO: 1733477 - protein, 6 aa, Staphylococcus epidermidis
LIDGPG

SEQ ID NO: 1733478 - protein, 20 aa, Staphylococcus epidermidis
LIDKNKVDKNISTRDTKNKV

SEQ ID NO: 1733479 - protein, 8 aa, Staphylococcus epidermidis
LIEKDGKK

SEQ ID NO: 1733480 - protein, 9 aa, Staphylococcus epidermidis
LIKDGKDQW

SEQ ID NO: 1733481 - protein, 45 aa, Staphylococcus epidermidis
LINPSDETLSSKEKETAKNTIEENQTEMNENERKVKEYKKELSEI

SEQ ID NO: 1733482 - protein, 13 aa, Staphylococcus epidermidis
LKAKDEASEKAFK

SEQ ID NO: 1733483 - protein, 10 aa, Staphylococcus epidermidis
LKAQEGKTEF

SEQ ID NO: 1733484 - protein, 10 aa, Staphylococcus epidermidis
LKASGANKTK

SEQ ID NO: 1733485 - protein, 8 aa, Staphylococcus epidermidis
LKATREYK

SEQ ID NO: 1733486 - protein, 8 aa, Staphylococcus epidermidis
LKDDEKGV

SEQ ID NO: 1733487 - protein, 8 aa, Staphylococcus epidermidis
LKDETEKY

SEQ ID NO: 1733488 - protein, 9 aa, Staphylococcus epidermidis
LKDETNNTG

SEQ ID NO: 1733489 - protein, 18 aa, Staphylococcus epidermidis
LKDKNGNAIGTTTTDVSG

SEQ ID NO: 1733490 - protein, 4 aa, Staphylococcus epidermidis
LKDP

SEQ ID NO: 1733491 - protein, 7 aa, Staphylococcus epidermidis
LKDQPSV

SEQ ID NO: 1733492 - protein, 36 aa, Staphylococcus epidermidis
LKEAHQPSSENKEKIREQREAYKNSRKELKEQREIR

SEQ ID NO: 1733493 - protein, 18 aa, Staphylococcus epidermidis
LKENGSEVYDTQDNGELS

SEQ ID NO: 1733494 - protein, 4 aa, Staphylococcus epidermidis
LKGD

SEQ ID NO: 1733495 - protein, 22 aa, Staphylococcus epidermidis
LKGETKTKYDAMKKDNTENTNK

SEQ ID NO: 1733496 - protein, 22 aa, Staphylococcus epidermidis
LKGETKTKYDSMKKDNTETTNK

SEQ ID NO: 1733497 - protein, 9 aa, Staphylococcus epidermidis
LKGNNEEQI

SEQ ID NO: 1733498 - protein, 8 aa, Staphylococcus epidermidis
LKGPAGPD

SEQ ID NO: 1733499 - protein, 8 aa, Staphylococcus epidermidis
LKGSDKIT

SEQ ID NO: 1733500 - protein, 17 aa, Staphylococcus epidermidis
LKGTSANTEKNTDRMAN

SEQ ID NO: 1733501 - protein, 15 aa, Staphylococcus epidermidis
LKITTTDEDKDKDTI

SEQ ID NO: 1733502 - protein, 6 aa, Staphylococcus epidermidis
LKNATN

SEQ ID NO: 1733503 - protein, 8 aa, Staphylococcus epidermidis
LKNENTNL

SEQ ID NO: 1733504 - protein, 13 aa, Staphylococcus epidermidis
LKNTLKSRNTSRN

SEQ ID NO: 1733505 - protein, 17 aa, Staphylococcus epidermidis
LKNTNYDLKVENNFKVN

SEQ ID NO: 1733506 - protein, 6 aa, Staphylococcus epidermidis
LKPDQL

SEQ ID NO: 1733507 - protein, 10 aa, Staphylococcus epidermidis
LKPEHRDDSF

SEQ ID NO: 1733508 - protein, 13 aa, Staphylococcus epidermidis
LKQFKDKGGRAEA

SEQ ID NO: 1733509 - protein, 18 aa, Staphylococcus epidermidis
LKQKDTYKYVGKTGTGIV

SEQ ID NO: 1733510 - protein, 13 aa, Staphylococcus epidermidis
LKQKEENNADSKF

SEQ ID NO: 1733511 - protein, 4 aa, Staphylococcus epidermidis
LKQL

SEQ ID NO: 1733512 - protein, 7 aa, Staphylococcus epidermidis
LKRYKND

SEQ ID NO: 1733513 - protein, 7 aa, Staphylococcus epidermidis
LKSAQGD

SEQ ID NO: 1733514 - protein, 10 aa, Staphylococcus epidermidis
LKSKESKKRF

SEQ ID NO: 1733515 - protein, 10 aa, Staphylococcus epidermidis
LKSQKQANQL

SEQ ID NO: 1733516 - protein, 6 aa, Staphylococcus epidermidis
LKTAKE

SEQ ID NO: 1733517 - protein, 9 aa, Staphylococcus epidermidis
LKTASREQI

SEQ ID NO: 1733518 - protein, 17 aa, Staphylococcus epidermidis
LKTNQYSKLGYNPNVPS

SEQ ID NO: 1733519 - protein, 10 aa, Staphylococcus epidermidis
LKYSDNSTIN

SEQ ID NO: 1733520 - protein, 9 aa, Staphylococcus epidermidis
LKYSENTTI

SEQ ID NO: 1733521 - protein, 6 aa, Staphylococcus epidermidis
LLGTNN

SEQ ID NO: 1733522 - protein, 15 aa, Staphylococcus epidermidis
LLKNNERYKKFIKNE

SEQ ID NO: 1733523 - protein, 12 aa, Staphylococcus epidermidis
LMGGGDSIATSP

SEQ ID NO: 1733524 - protein, 12 aa, Staphylococcus epidermidis
LNDAQRQALTDT

SEQ ID NO: 1733525 - protein, 22 aa, Staphylococcus epidermidis
LNDAQRQKAIENVQAQQTIPEV

SEQ ID NO: 1733526 - protein, 4 aa, Staphylococcus epidermidis
LNDF

SEQ ID NO: 1733527 - protein, 9 aa, Staphylococcus epidermidis
LNDKTEESI

SEQ ID NO: 1733528 - protein, 6 aa, Staphylococcus epidermidis
LNDNSV

SEQ ID NO: 1733529 - protein, 8 aa, Staphylococcus epidermidis
LNDQQQAE

SEQ ID NO: 1733530 - protein, 4 aa, Staphylococcus epidermidis
LNEE

SEQ ID NO: 1733531 - protein, 17 aa, Staphylococcus epidermidis
LNEIEYDDNNNKEQAKN

SEQ ID NO: 1733532 - protein, 4 aa, Staphylococcus epidermidis
LNEQ

SEQ ID NO: 1733533 - protein, 8 aa, Staphylococcus epidermidis
LNEQQNQV

SEQ ID NO: 1733534 - protein, 4 aa, Staphylococcus epidermidis
LNGK

SEQ ID NO: 1733535 - protein, 7 aa, Staphylococcus epidermidis
LNGSGAL

SEQ ID NO: 1733536 - protein, 13 aa, Staphylococcus epidermidis
LNGSKDIDKNSPF

SEQ ID NO: 1733537 - protein, 5 aa, Staphylococcus epidermidis
LNHQS

SEQ ID NO: 1733538 - protein, 19 aa, Staphylococcus epidermidis
LNKANNGLGQVNSGLGDMQ

SEQ ID NO: 1733539 - protein, 20 aa, Staphylococcus epidermidis
LNKAQLEDVTNKVNSANTLT

SEQ ID NO: 1733540 - protein, 12 aa, Staphylococcus epidermidis
LNKDAESIHPVE

SEQ ID NO: 1733541 - protein, 6 aa, Staphylococcus epidermidis
LNKHNH

SEQ ID NO: 1733542 - protein, 31 aa, Staphylococcus epidermidis
LNKQITKQSLSTLQKQNVDVSPKDIQGITNP

SEQ ID NO: 1733543 - protein, 9 aa, Staphylococcus epidermidis
LNKTQGQNL

SEQ ID NO: 1733544 - protein, 8 aa, Staphylococcus epidermidis
LNPDDSPY

SEQ ID NO: 1733545 - protein, 9 aa, Staphylococcus epidermidis
LNPGDRRDI

SEQ ID NO: 1733546 - protein, 13 aa, Staphylococcus epidermidis
LNPNESEPESYDK

SEQ ID NO: 1733547 - protein, 13 aa, Staphylococcus epidermidis
LNPNQSEPGSYDK

SEQ ID NO: 1733548 - protein, 6 aa, Staphylococcus epidermidis
LNPQGL

SEQ ID NO: 1733549 - protein, 7 aa, Staphylococcus epidermidis
LNPTDEA

SEQ ID NO: 1733550 - protein, 7 aa, Staphylococcus epidermidis
LNQANRK

SEQ ID NO: 1733551 - protein, 21 aa, Staphylococcus epidermidis
LNQAQKEQLNQEIQQTHTRSE

SEQ ID NO: 1733552 - protein, 12 aa, Staphylococcus epidermidis
LNQDPEVDEEDK

SEQ ID NO: 1733553 - protein, 11 aa, Staphylococcus epidermidis
LNQDTNGVNDR

SEQ ID NO: 1733554 - protein, 6 aa, Staphylococcus epidermidis
LNQEKA

SEQ ID NO: 1733555 - protein, 9 aa, Staphylococcus epidermidis
LNQPQSRDA

SEQ ID NO: 1733556 - protein, 8 aa, Staphylococcus epidermidis
LNQQQSRN

SEQ ID NO: 1733557 - protein, 89 aa, Staphylococcus epidermidis
LNQTDDDDSNTHSQEIENNKQNSAGQTESLSSSTSHNQANARLSDQVKDPNETSQQLPTNVSNDSINQSHSETNMNNEPLQVDNSTMQA

SEQ ID NO: 1733558 - protein, 89 aa, Staphylococcus epidermidis
LNQTDDDDSNTHSQEIENNKQNSSGQTESLRSSTSQNQANARLSDQFKDTNETSQQLPTNVSDDSINQSHSEANMNNEPLKVDNSTMQA

SEQ ID NO: 1733559 - protein, 18 aa, Staphylococcus epidermidis
LNRRGDINNKKPRSISAY

SEQ ID NO: 1733560 - protein, 6 aa, Staphylococcus epidermidis
LNSAMS

SEQ ID NO: 1733561 - protein, 7 aa, Staphylococcus epidermidis
LNSDSHK

SEQ ID NO: 1733562 - protein, 8 aa, Staphylococcus epidermidis
LNSDSRKI

SEQ ID NO: 1733563 - protein, 8 aa, Staphylococcus epidermidis
LNSDSRKV

SEQ ID NO: 1733564 - protein, 7 aa, Staphylococcus epidermidis
LNSGPAL

SEQ ID NO: 1733565 - protein, 8 aa, Staphylococcus epidermidis
LNSGSSRF

SEQ ID NO: 1733566 - protein, 20 aa, Staphylococcus epidermidis
LNSNSNQDFQTNNQHSKKNP

SEQ ID NO: 1733567 - protein, 18 aa, Staphylococcus epidermidis
LNTSQSKNSPHKSASPRM

SEQ ID NO: 1733568 - protein, 18 aa, Staphylococcus epidermidis
LNTSQSKTSPHKSASPRM

SEQ ID NO: 1733569 - protein, 9 aa, Staphylococcus epidermidis
LNVQPTDNS

SEQ ID NO: 1733570 - protein, 10 aa, Staphylococcus epidermidis
LNVQPTDNSF

SEQ ID NO: 1733571 - protein, 42 aa, Staphylococcus epidermidis
LNVSNEPSKDTSNCDSETNTTQETVDQLPDTGDSNDSAPLAG

SEQ ID NO: 1733572 - protein, 10 aa, Staphylococcus epidermidis
LPAEKVDDTY

SEQ ID NO: 1733573 - protein, 13 aa, Staphylococcus epidermidis
LPDNDDKSLASRT

SEQ ID NO: 1733574 - protein, 7 aa, Staphylococcus epidermidis
LPDSAAK

SEQ ID NO: 1733575 - protein, 9 aa, Staphylococcus epidermidis
LPEEAKKPF

SEQ ID NO: 1733576 - protein, 12 aa, Staphylococcus epidermidis
LPEIEPSSRRFG

SEQ ID NO: 1733577 - protein, 15 aa, Staphylococcus epidermidis
LPEKIKNASYTYNQN

SEQ ID NO: 1733578 - protein, 12 aa, Staphylococcus epidermidis
LPENERRKYEKE

SEQ ID NO: 1733579 - protein, 4 aa, Staphylococcus epidermidis
LPGG

SEQ ID NO: 1733580 - protein, 5 aa, Staphylococcus epidermidis
LPGIE

SEQ ID NO: 1733581 - protein, 17 aa, Staphylococcus epidermidis
LPGQGQTSRANKGQIED

SEQ ID NO: 1733582 - protein, 9 aa, Staphylococcus epidermidis
LPGRRAEEE

SEQ ID NO: 1733583 - protein, 5 aa, Staphylococcus epidermidis
LPKDY

SEQ ID NO: 1733584 - protein, 8 aa, Staphylococcus epidermidis
LPKTDKVA

SEQ ID NO: 1733585 - protein, 8 aa, Staphylococcus epidermidis
LPLGDKEV

SEQ ID NO: 1733586 - protein, 8 aa, Staphylococcus epidermidis
LPNDDSTK

SEQ ID NO: 1733587 - protein, 8 aa, Staphylococcus epidermidis
LPNGESTK

SEQ ID NO: 1733588 - protein, 6 aa, Staphylococcus epidermidis
LPNNPY

SEQ ID NO: 1733589 - protein, 7 aa, Staphylococcus epidermidis
LPPEQRK

SEQ ID NO: 1733590 - protein, 5 aa, Staphylococcus epidermidis
LPPLT

SEQ ID NO: 1733591 - protein, 4 aa, Staphylococcus epidermidis
LPQF

SEQ ID NO: 1733592 - protein, 5 aa, Staphylococcus epidermidis
LPQGW

SEQ ID NO: 1733593 - protein, 30 aa, Staphylococcus epidermidis
LPQRSTTEKRGRRSTRSVVEERSSRSDYLD

SEQ ID NO: 1733594 - protein, 11 aa, Staphylococcus epidermidis
LPRNEKDNKMY

SEQ ID NO: 1733595 - protein, 6 aa, Staphylococcus epidermidis
LPSDKV

SEQ ID NO: 1733596 - protein, 7 aa, Staphylococcus epidermidis
LPSSIEQ

SEQ ID NO: 1733597 - protein, 11 aa, Staphylococcus epidermidis
LPSTPNKELTF

SEQ ID NO: 1733598 - protein, 9 aa, Staphylococcus epidermidis
LPTSEDGSI

SEQ ID NO: 1733599 - protein, 50 aa, Staphylococcus epidermidis
LPTSYDTSDDSAASSAQSGAQGDSEEGTEMTASNPTINQPTGGKSGETSK

SEQ ID NO: 1733600 - protein, 4 aa, Staphylococcus epidermidis
LQEA

SEQ ID NO: 1733601 - protein, 6 aa, Staphylococcus epidermidis
LQEKEN

SEQ ID NO: 1733602 - protein, 9 aa, Staphylococcus epidermidis
LQGNDSNIT

SEQ ID NO: 1733603 - protein, 9 aa, Staphylococcus epidermidis
LQGTDTNID

SEQ ID NO: 1733604 - protein, 6 aa, Staphylococcus epidermidis
LQKGSN

SEQ ID NO: 1733605 - protein, 13 aa, Staphylococcus epidermidis
LQNTLSQQLKRTY

SEQ ID NO: 1733606 - protein, 4 aa, Staphylococcus epidermidis
LQPI

SEQ ID NO: 1733607 - protein, 7 aa, Staphylococcus epidermidis
LQPKGTF

SEQ ID NO: 1733608 - protein, 29 aa, Staphylococcus epidermidis
LQQQTAKESVKNATKLEEIATASNNAQAL

SEQ ID NO: 1733609 - protein, 20 aa, Staphylococcus epidermidis
LQQTTNNKSQNNTVSQRTQT

SEQ ID NO: 1733610 - protein, 10 aa, Staphylococcus epidermidis
LQRNNPNITY

SEQ ID NO: 1733611 - protein, 11 aa, Staphylococcus epidermidis
LQTQATNKNIE

SEQ ID NO: 1733612 - protein, 5 aa, Staphylococcus epidermidis
LRHPN

SEQ ID NO: 1733613 - protein, 5 aa, Staphylococcus epidermidis
LRKSS

SEQ ID NO: 1733614 - protein, 4 aa, Staphylococcus epidermidis
LRND

SEQ ID NO: 1733615 - protein, 16 aa, Staphylococcus epidermidis
LRNSELDEAERSSSDI

SEQ ID NO: 1733616 - protein, 6 aa, Staphylococcus epidermidis
LRQDEV

SEQ ID NO: 1733617 - protein, 8 aa, Staphylococcus epidermidis
LRTATADT

SEQ ID NO: 1733618 - protein, 6 aa, Staphylococcus epidermidis
LSAGTA

SEQ ID NO: 1733619 - protein, 7 aa, Staphylococcus epidermidis
LSAGTAS

SEQ ID NO: 1733620 - protein, 9 aa, Staphylococcus epidermidis
LSAHAAPRE

SEQ ID NO: 1733621 - protein, 10 aa, Staphylococcus epidermidis
LSASSIVQDQ

SEQ ID NO: 1733622 - protein, 9 aa, Staphylococcus epidermidis
LSATNQLDT

SEQ ID NO: 1733623 - protein, 22 aa, Staphylococcus epidermidis
LSDKDVDNKDIEKLKAEASAME

SEQ ID NO: 1733624 - protein, 4 aa, Staphylococcus epidermidis
LSDQ

SEQ ID NO: 1733625 - protein, 16 aa, Staphylococcus epidermidis
LSEDAKSSSNMEETIP

SEQ ID NO: 1733626 - protein, 8 aa, Staphylococcus epidermidis
LSEPTNYT

SEQ ID NO: 1733627 - protein, 4 aa, Staphylococcus epidermidis
LSGN

SEQ ID NO: 1733628 - protein, 9 aa, Staphylococcus epidermidis
LSGNSTFKT

SEQ ID NO: 1733629 - protein, 10 aa, Staphylococcus epidermidis
LSGSTKSLTP

SEQ ID NO: 1733630 - protein, 10 aa, Staphylococcus epidermidis
LSKDTDIQLS

SEQ ID NO: 1733631 - protein, 9 aa, Staphylococcus epidermidis
LSKKAKYDV

SEQ ID NO: 1733632 - protein, 12 aa, Staphylococcus epidermidis
LSKSINKIDGVK

SEQ ID NO: 1733633 - protein, 5 aa, Staphylococcus epidermidis
LSLSE

SEQ ID NO: 1733634 - protein, 27 aa, Staphylococcus epidermidis
LSNANDNIGSHTYSNTKPEIENETADR

SEQ ID NO: 1733635 - protein, 9 aa, Staphylococcus epidermidis
LSNESNDQD

SEQ ID NO: 1733636 - protein, 16 aa, Staphylococcus epidermidis
LSNNNFKYSEKSLNSY

SEQ ID NO: 1733637 - protein, 10 aa, Staphylococcus epidermidis
LSNPFGSDGG

SEQ ID NO: 1733638 - protein, 9 aa, Staphylococcus epidermidis
LSPKTEESI

SEQ ID NO: 1733639 - protein, 12 aa, Staphylococcus epidermidis
LSPNYTTETNRR

SEQ ID NO: 1733640 - protein, 5 aa, Staphylococcus epidermidis
LSPTY

SEQ ID NO: 1733641 - protein, 27 aa, Staphylococcus epidermidis
LSQAEKTLNEEPKTPKIDKDKGEEFTT

SEQ ID NO: 1733642 - protein, 5 aa, Staphylococcus epidermidis
LSQKE

SEQ ID NO: 1733643 - protein, 12 aa, Staphylococcus epidermidis
LSQREDEGKFEK

SEQ ID NO: 1733644 - protein, 6 aa, Staphylococcus epidermidis
LSQSGL

SEQ ID NO: 1733645 - protein, 10 aa, Staphylococcus epidermidis
LSQSKQDNIS

SEQ ID NO: 1733646 - protein, 5 aa, Staphylococcus epidermidis
LSRED

SEQ ID NO: 1733647 - protein, 15 aa, Staphylococcus epidermidis
LSRKISNNQLTIDEA

SEQ ID NO: 1733648 - protein, 16 aa, Staphylococcus epidermidis
LSRKISSKQLTIDEAK

SEQ ID NO: 1733649 - protein, 7 aa, Staphylococcus epidermidis
LSRNKSQ

SEQ ID NO: 1733650 - protein, 8 aa, Staphylococcus epidermidis
LSSGKKDF

SEQ ID NO: 1733651 - protein, 8 aa, Staphylococcus epidermidis
LSSNNDVG

SEQ ID NO: 1733652 - protein, 10 aa, Staphylococcus epidermidis
LSSPNKTSQL

SEQ ID NO: 1733653 - protein, 39 aa, Staphylococcus epidermidis
LSSQRSTTSMTEKSNQCYSSENNTIKSLPETGNVDKSVP

SEQ ID NO: 1733654 - protein, 4 aa, Staphylococcus epidermidis
LSSS

SEQ ID NO: 1733655 - protein, 6 aa, Staphylococcus epidermidis
LSTETL

SEQ ID NO: 1733656 - protein, 9 aa, Staphylococcus epidermidis
LSTGEASNI

SEQ ID NO: 1733657 - protein, 14 aa, Staphylococcus epidermidis
LSTGTQSTHTQSYI

SEQ ID NO: 1733658 - protein, 15 aa, Staphylococcus epidermidis
LSTKDNKVDPDEAKE

SEQ ID NO: 1733659 - protein, 11 aa, Staphylococcus epidermidis
LSTNNDVGQHA

SEQ ID NO: 1733660 - protein, 20 aa, Staphylococcus epidermidis
LSTTSNLAKKGVLSKGSTYL

SEQ ID NO: 1733661 - protein, 12 aa, Staphylococcus epidermidis
LSYDKSNANDEV

SEQ ID NO: 1733662 - protein, 5 aa, Staphylococcus epidermidis
LTDET

SEQ ID NO: 1733663 - protein, 5 aa, Staphylococcus epidermidis
LTEEQ

SEQ ID NO: 1733664 - protein, 10 aa, Staphylococcus epidermidis
LTESIRSDIK

SEQ ID NO: 1733665 - protein, 7 aa, Staphylococcus epidermidis
LTGGAGA

SEQ ID NO: 1733666 - protein, 7 aa, Staphylococcus epidermidis
LTGLDGT

SEQ ID NO: 1733667 - protein, 6 aa, Staphylococcus epidermidis
LTGNDL

SEQ ID NO: 1733668 - protein, 8 aa, Staphylococcus epidermidis
LTGRNLKD

SEQ ID NO: 1733669 - protein, 7 aa, Staphylococcus epidermidis
LTNDEIN

SEQ ID NO: 1733670 - protein, 17 aa, Staphylococcus epidermidis
LTNDGKTKEGKNEDEVY

SEQ ID NO: 1733671 - protein, 13 aa, Staphylococcus epidermidis
LTNDKKPASVRRY

SEQ ID NO: 1733672 - protein, 4 aa, Staphylococcus epidermidis
LTNV

SEQ ID NO: 1733673 - protein, 12 aa, Staphylococcus epidermidis
LTPDYKTPSVAS

SEQ ID NO: 1733674 - protein, 29 aa, Staphylococcus epidermidis
LTQARNNINGAQTNATVDEKLEEAKQSLQ

SEQ ID NO: 1733675 - protein, 25 aa, Staphylococcus epidermidis
LTQASENLNGDQRVEESKAHANQTI

SEQ ID NO: 1733676 - protein, 4 aa, Staphylococcus epidermidis
LTQD

SEQ ID NO: 1733677 - protein, 17 aa, Staphylococcus epidermidis
LTSDGKTKANTKDNDVY

SEQ ID NO: 1733678 - protein, 13 aa, Staphylococcus epidermidis
LTSEYGEKYPADI

SEQ ID NO: 1733679 - protein, 4 aa, Staphylococcus epidermidis
LTSK

SEQ ID NO: 1733680 - protein, 13 aa, Staphylococcus epidermidis
LTSNQTSELRNEA

SEQ ID NO: 1733681 - protein, 5 aa, Staphylococcus epidermidis
LTSYQ

SEQ ID NO: 1733682 - protein, 10 aa, Staphylococcus epidermidis
LTTANERLDS

SEQ ID NO: 1733683 - protein, 4 aa, Staphylococcus epidermidis
LTTE

SEQ ID NO: 1733684 - protein, 4 aa, Staphylococcus epidermidis
LTTF

SEQ ID NO: 1733685 - protein, 6 aa, Staphylococcus epidermidis
LTTNQL

SEQ ID NO: 1733686 - protein, 33 aa, Staphylococcus epidermidis
LTTRESNSGHGFGDNPNYNYGGTVSRVTANTGA

SEQ ID NO: 1733687 - protein, 19 aa, Staphylococcus epidermidis
LTTTVNGKETVQSPETAQA

SEQ ID NO: 1733688 - protein, 10 aa, Staphylococcus epidermidis
LVEKGQHKSL

SEQ ID NO: 1733689 - protein, 5 aa, Staphylococcus epidermidis
LYSSE

SEQ ID NO: 1733690 - protein, 43 aa, Staphylococcus epidermidis
MADQSGATLAEETTENQSYKSQAEKRAYEHKKQFQSQRKQSKW

SEQ ID NO: 1733691 - protein, 43 aa, Staphylococcus epidermidis
MADQSGATLAEETTKNQSYKSQAEKRAYEHKQQFQSQRKQSKW

SEQ ID NO: 1733692 - protein, 5 aa, Staphylococcus epidermidis
MAGVP

SEQ ID NO: 1733693 - protein, 9 aa, Staphylococcus epidermidis
MASGNGQAT

SEQ ID NO: 1733694 - protein, 18 aa, Staphylococcus epidermidis
MATPSKPIVNANNQEANV

SEQ ID NO: 1733695 - protein, 19 aa, Staphylococcus epidermidis
MDDKPDKDDIEVQRNSEFT

SEQ ID NO: 1733696 - protein, 22 aa, Staphylococcus epidermidis
MDTTNNGQNWSAPINGSTVNSG

SEQ ID NO: 1733697 - protein, 22 aa, Staphylococcus epidermidis
MDTTNNGQNWSAPINGSTVRSG

SEQ ID NO: 1733698 - protein, 4 aa, Staphylococcus epidermidis
MEDP

SEQ ID NO: 1733699 - protein, 7 aa, Staphylococcus epidermidis
MEKENEY

SEQ ID NO: 1733700 - protein, 19 aa, Staphylococcus epidermidis
MEPDAPVDKSEMKSEDSLY

SEQ ID NO: 1733701 - protein, 11 aa, Staphylococcus epidermidis
MERERQSSTYI

SEQ ID NO: 1733702 - protein, 9 aa, Staphylococcus epidermidis
MESKGNRIY

SEQ ID NO: 1733703 - protein, 7 aa, Staphylococcus epidermidis
MGGGTDV

SEQ ID NO: 1733704 - protein, 7 aa, Staphylococcus epidermidis
MGGQAGG

SEQ ID NO: 1733705 - protein, 10 aa, Staphylococcus epidermidis
MGGQTYTASN

SEQ ID NO: 1733706 - protein, 5 aa, Staphylococcus epidermidis
MIKEG

SEQ ID NO: 1733707 - protein, 12 aa, Staphylococcus epidermidis
MKAKAGNQSITV

SEQ ID NO: 1733708 - protein, 10 aa, Staphylococcus epidermidis
MKDEKEQRIK

SEQ ID NO: 1733709 - protein, 11 aa, Staphylococcus epidermidis
MKDNKKEDERI

SEQ ID NO: 1733710 - protein, 8 aa, Staphylococcus epidermidis
MKDNTNKL

SEQ ID NO: 1733711 - protein, 35 aa, Staphylococcus epidermidis
MKGQDPKNQKVDYSKNKPPHDTHKDQKHHEKKEDK

SEQ ID NO: 1733712 - protein, 4 aa, Staphylococcus epidermidis
MKKY

SEQ ID NO: 1733713 - protein, 24 aa, Staphylococcus epidermidis
MKQPQSLDKVKQSYYSHTPQSKIK

SEQ ID NO: 1733714 - protein, 11 aa, Staphylococcus epidermidis
MKQTKNDDQRI

SEQ ID NO: 1733715 - protein, 10 aa, Staphylococcus epidermidis
MKSASTRGYH

SEQ ID NO: 1733716 - protein, 8 aa, Staphylococcus epidermidis
MKSSNTHH

SEQ ID NO: 1733717 - protein, 27 aa, Staphylococcus epidermidis
MNDTQQEVASENNAGDNETTPQNLPSQ

SEQ ID NO: 1733718 - protein, 16 aa, Staphylococcus epidermidis
MNKNGSTLNPSSNQFD

SEQ ID NO: 1733719 - protein, 9 aa, Staphylococcus epidermidis
MNNEETSLY

SEQ ID NO: 1733720 - protein, 8 aa, Staphylococcus epidermidis
MNPNKERL

SEQ ID NO: 1733721 - protein, 10 aa, Staphylococcus epidermidis
MNSSDNTNSL

SEQ ID NO: 1733722 - protein, 4 aa, Staphylococcus epidermidis
MNYE

SEQ ID NO: 1733723 - protein, 11 aa, Staphylococcus epidermidis
MPKKELAPHSP

SEQ ID NO: 1733724 - protein, 7 aa, Staphylococcus epidermidis
MPQNGTI

SEQ ID NO: 1733725 - protein, 20 aa, Staphylococcus epidermidis
MPRKESTPQAPTISTNEEQA

SEQ ID NO: 1733726 - protein, 15 aa, Staphylococcus epidermidis
MPRKESTPSAPTVKA

SEQ ID NO: 1733727 - protein, 16 aa, Staphylococcus epidermidis
MPRKSKEEKQKLEQTR

SEQ ID NO: 1733728 - protein, 16 aa, Staphylococcus epidermidis
MPSKQGRPTVNDRISD

SEQ ID NO: 1733729 - protein, 28 aa, Staphylococcus epidermidis
MQKKNDQISITSPMKDSPAEKAGIRPKD

SEQ ID NO: 1733730 - protein, 5 aa, Staphylococcus epidermidis
MQNDK

SEQ ID NO: 1733731 - protein, 7 aa, Staphylococcus epidermidis
MSAEDER

SEQ ID NO: 1733732 - protein, 4 aa, Staphylococcus epidermidis
MSAN

SEQ ID NO: 1733733 - protein, 7 aa, Staphylococcus epidermidis
MSDDNAI

SEQ ID NO: 1733734 - protein, 5 aa, Staphylococcus epidermidis
MSEAA

SEQ ID NO: 1733735 - protein, 24 aa, Staphylococcus epidermidis
MSKGHTDELQESSNREEQVAQEHS

SEQ ID NO: 1733736 - protein, 7 aa, Staphylococcus epidermidis
MSYNTRK

SEQ ID NO: 1733737 - protein, 11 aa, Staphylococcus epidermidis
MTDDQVTPTSV

SEQ ID NO: 1733738 - protein, 58 aa, Staphylococcus epidermidis
MTKKPTGKTKNPEQNQNKKATTKVKGHNNIENETGEEKSDQKDKDELPKTGGEQTGFN

SEQ ID NO: 1733739 - protein, 6 aa, Staphylococcus epidermidis
MTSDTN

SEQ ID NO: 1733740 - protein, 10 aa, Staphylococcus epidermidis
MTTPKSKVQL

SEQ ID NO: 1733741 - protein, 7 aa, Staphylococcus epidermidis
NAAGDII

SEQ ID NO: 1733742 - protein, 6 aa, Staphylococcus epidermidis
NADIPT

SEQ ID NO: 1733743 - protein, 6 aa, Staphylococcus epidermidis
NADSRK

SEQ ID NO: 1733744 - protein, 18 aa, Staphylococcus epidermidis
NAEENNDSWRKNQDETQL

SEQ ID NO: 1733745 - protein, 15 aa, Staphylococcus epidermidis
NAEEQNEAWNKNQNE

SEQ ID NO: 1733746 - protein, 19 aa, Staphylococcus epidermidis
NAEHTTQGVKNIKDDAITS

SEQ ID NO: 1733747 - protein, 16 aa, Staphylococcus epidermidis
NAENNQEIATADIQGG

SEQ ID NO: 1733748 - protein, 5 aa, Staphylococcus epidermidis
NAGAI

SEQ ID NO: 1733749 - protein, 26 aa, Staphylococcus epidermidis
NAGSTLDPQTIKNDGVTEKEYAAVSQ

SEQ ID NO: 1733750 - protein, 85 aa, Staphylococcus epidermidis
NAGSYNKRDNQKNKDEKSFINPDNPNLQQDKKQGENSYSDTGNDSKLNKSNNQTEEAEDNKNGHDKNIDSKEKDSLGNNDLPENV

SEQ ID NO: 1733751 - protein, 7 aa, Staphylococcus epidermidis
NAGVTAP

SEQ ID NO: 1733752 - protein, 4 aa, Staphylococcus epidermidis
NAHQ

SEQ ID NO: 1733753 - protein, 47 aa, Staphylococcus epidermidis
NAIHSTSNYFNEDSTQKNTYDNAIDNGSTYITGQHNPELNKSTIDQT

SEQ ID NO: 1733754 - protein, 20 aa, Staphylococcus epidermidis
NAKDQLNGEQRLKEHQQKSE

SEQ ID NO: 1733755 - protein, 9 aa, Staphylococcus epidermidis
NAKNKKEAI

SEQ ID NO: 1733756 - protein, 9 aa, Staphylococcus epidermidis
NAKNNAISE

SEQ ID NO: 1733757 - protein, 16 aa, Staphylococcus epidermidis
NAKNNLRADKRELQTA

SEQ ID NO: 1733758 - protein, 5 aa, Staphylococcus epidermidis
NAKRE

SEQ ID NO: 1733759 - protein, 6 aa, Staphylococcus epidermidis
NAKREL

SEQ ID NO: 1733760 - protein, 21 aa, Staphylococcus epidermidis
NALDGEDQLRRAKENANQEIN

SEQ ID NO: 1733761 - protein, 10 aa, Staphylococcus epidermidis
NAMGQGISKA

SEQ ID NO: 1733762 - protein, 6 aa, Staphylococcus epidermidis
NANDEN

SEQ ID NO: 1733763 - protein, 18 aa, Staphylococcus epidermidis
NAQDKNQQREGVKTSLSK

SEQ ID NO: 1733764 - protein, 8 aa, Staphylococcus epidermidis
NAQKQSLK

SEQ ID NO: 1733765 - protein, 52 aa, Staphylococcus epidermidis
NARNSLVPDKTQLQEAKNRLENSINQQTDTDGMTEDSLNNYNDKLTKARQNL

SEQ ID NO: 1733766 - protein, 29 aa, Staphylococcus epidermidis
NASAHAAQTNDNSGQQKTVQSNENQGNGL

SEQ ID NO: 1733767 - protein, 64 aa, Staphylococcus epidermidis
NASAHAEQNNSDQPQDKKVATTSTEKSDKTVQTTPATQNASNQQNTNNQQPADTSTNEDEEDYS

SEQ ID NO: 1733768 - protein, 8 aa, Staphylococcus epidermidis
NASEREND

SEQ ID NO: 1733769 - protein, 21 aa, Staphylococcus epidermidis
NAVHTGKSYAKQESWTSPEKA

SEQ ID NO: 1733770 - protein, 16 aa, Staphylococcus epidermidis
NCSEQRKDITHSEEGA

SEQ ID NO: 1733771 - protein, 7 aa, Staphylococcus epidermidis
NDADNQW

SEQ ID NO: 1733772 - protein, 11 aa, Staphylococcus epidermidis
NDAKNNGNTSI

SEQ ID NO: 1733773 - protein, 19 aa, Staphylococcus epidermidis
NDANDRIRNAKADSEVLTA

SEQ ID NO: 1733774 - protein, 44 aa, Staphylococcus epidermidis
NDATAEEIQEANRKIEEAKIEAKDNIQHSSTRDQVNEAKTNGIN

SEQ ID NO: 1733775 - protein, 44 aa, Staphylococcus epidermidis
NDATDEEIQEANRKIEEAKIEAKDNIQRNSTRVQVNEAKTNGIN

SEQ ID NO: 1733776 - protein, 5 aa, Staphylococcus epidermidis
NDAVE

SEQ ID NO: 1733777 - protein, 6 aa, Staphylococcus epidermidis
NDDEIN

SEQ ID NO: 1733778 - protein, 54 aa, Staphylococcus epidermidis
NDDKVNNDPNVSQNYKKQVESQNDDINKQVDSAKSDIKNNKNSESQIDKLQSEI

SEQ ID NO: 1733779 - protein, 31 aa, Staphylococcus epidermidis
NDEAQKALSQINSANTNADVDTAKNSGLNTI

SEQ ID NO: 1733780 - protein, 18 aa, Staphylococcus epidermidis
NDEGTTIQSNKVDIGKKI

SEQ ID NO: 1733781 - protein, 8 aa, Staphylococcus epidermidis
NDENSRMS

SEQ ID NO: 1733782 - protein, 17 aa, Staphylococcus epidermidis
NDEPEAVDTDYNDYHRS

SEQ ID NO: 1733783 - protein, 11 aa, Staphylococcus epidermidis
NDESKVEDSGY

SEQ ID NO: 1733784 - protein, 5 aa, Staphylococcus epidermidis
NDEYR

SEQ ID NO: 1733785 - protein, 11 aa, Staphylococcus epidermidis
NDFDTTASNAQ

SEQ ID NO: 1733786 - protein, 17 aa, Staphylococcus epidermidis
NDGVEALTDEILKIIKK

SEQ ID NO: 1733787 - protein, 13 aa, Staphylococcus epidermidis
NDHPEVKKPLNKL

SEQ ID NO: 1733788 - protein, 14 aa, Staphylococcus epidermidis
NDIATAGQKLRKGL

SEQ ID NO: 1733789 - protein, 4 aa, Staphylococcus epidermidis
NDID

SEQ ID NO: 1733790 - protein, 6 aa, Staphylococcus epidermidis
NDIETY

SEQ ID NO: 1733791 - protein, 6 aa, Staphylococcus epidermidis
NDKDKI

SEQ ID NO: 1733792 - protein, 6 aa, Staphylococcus epidermidis
NDKDQI

SEQ ID NO: 1733793 - protein, 18 aa, Staphylococcus epidermidis
NDKGKKISEVKPTTSGWS

SEQ ID NO: 1733794 - protein, 7 aa, Staphylococcus epidermidis
NDKNGYT

SEQ ID NO: 1733795 - protein, 6 aa, Staphylococcus epidermidis
NDKNRI

SEQ ID NO: 1733796 - protein, 11 aa, Staphylococcus epidermidis
NDKPASSYNNT

SEQ ID NO: 1733797 - protein, 10 aa, Staphylococcus epidermidis
NDKVSKDEDK

SEQ ID NO: 1733798 - protein, 4 aa, Staphylococcus epidermidis
NDKW

SEQ ID NO: 1733799 - protein, 9 aa, Staphylococcus epidermidis
NDLDKFPSQ

SEQ ID NO: 1733800 - protein, 20 aa, Staphylococcus epidermidis
NDLHGEQKLQKAQQDANNEL

SEQ ID NO: 1733801 - protein, 21 aa, Staphylococcus epidermidis
NDLKKQADTIANPINKKTTDV

SEQ ID NO: 1733802 - protein, 23 aa, Staphylococcus epidermidis
NDLSNNTTVPKSKSGSDNEIGSG

SEQ ID NO: 1733803 - protein, 5 aa, Staphylococcus epidermidis
NDNDE

SEQ ID NO: 1733804 - protein, 92 aa, Staphylococcus epidermidis
NDPKKEPEKVSERIPNKEPETPHMKDPNKTPTTPTHKKETIKITKKDETKVKGKKTTNDDKSSTKNKKHETKHQSDKSKTLPNTGVDTTTPT

SEQ ID NO: 1733805 - protein, 7 aa, Staphylococcus epidermidis
NDQFSER

SEQ ID NO: 1733806 - protein, 64 aa, Staphylococcus epidermidis
NDQLTDAQGYLTQAKQRVKDYQDAAGRAQDVNGAVNNDLRNQQSTAQQSANQTHKDAGRSYSNM

SEQ ID NO: 1733807 - protein, 10 aa, Staphylococcus epidermidis
NDQRNEMRRP

SEQ ID NO: 1733808 - protein, 8 aa, Staphylococcus epidermidis
NDRAQNPN

SEQ ID NO: 1733809 - protein, 9 aa, Staphylococcus epidermidis
NDSAQNDGL

SEQ ID NO: 1733810 - protein, 10 aa, Staphylococcus epidermidis
NDSESISENT

SEQ ID NO: 1733811 - protein, 5 aa, Staphylococcus epidermidis
NDSHI

SEQ ID NO: 1733812 - protein, 7 aa, Staphylococcus epidermidis
NDSNDTH

SEQ ID NO: 1733813 - protein, 15 aa, Staphylococcus epidermidis
NDTSIANLESSLNNN

SEQ ID NO: 1733814 - protein, 204 aa, Staphylococcus epidermidis
NDTSRTGISMNSDNDLDTDIVSNSDSENDTYLDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNIN

SEQ ID NO: 1733815 - protein, 17 aa, Staphylococcus epidermidis
NDTTTHAAEVTSQDAQA

SEQ ID NO: 1733816 - protein, 5 aa, Staphylococcus epidermidis
NDVDG

SEQ ID NO: 1733817 - protein, 9 aa, Staphylococcus epidermidis
NDVPNQFPK

SEQ ID NO: 1733818 - protein, 30 aa, Staphylococcus epidermidis
NDYKNGDISYNPNVPSYSAKYQLNNNDYNV

SEQ ID NO: 1733819 - protein, 4 aa, Staphylococcus epidermidis
NEAA

SEQ ID NO: 1733820 - protein, 21 aa, Staphylococcus epidermidis
NEAGKNVSEKFENISSNNHIE

SEQ ID NO: 1733821 - protein, 21 aa, Staphylococcus epidermidis
NEAGMGSAPNAAATAAVPHPV

SEQ ID NO: 1733822 - protein, 84 aa, Staphylococcus epidermidis
NEAKAEENSVQDFKDSNTDDELSDSNDQSSDEEENDVINNNQSINSDDNNQINKKEETNNNDGIEKSSEDRTESTTNVDENEAT

SEQ ID NO: 1733823 - protein, 53 aa, Staphylococcus epidermidis
NEAKAEENSVQDVKDSNTDDELSDSNDQSSDEEKNDVINNNQSINTDDNNQII

SEQ ID NO: 1733824 - protein, 31 aa, Staphylococcus epidermidis
NEANPDHPIKQDDYHGEINADDTSKLTNEGV

SEQ ID NO: 1733825 - protein, 7 aa, Staphylococcus epidermidis
NEASNQI

SEQ ID NO: 1733826 - protein, 7 aa, Staphylococcus epidermidis
NEDDASL

SEQ ID NO: 1733827 - protein, 16 aa, Staphylococcus epidermidis
NEDESAQNEYSTALQK

SEQ ID NO: 1733828 - protein, 7 aa, Staphylococcus epidermidis
NEDKKTY

SEQ ID NO: 1733829 - protein, 7 aa, Staphylococcus epidermidis
NEDKRTY

SEQ ID NO: 1733830 - protein, 8 aa, Staphylococcus epidermidis
NEDLENAG

SEQ ID NO: 1733831 - protein, 20 aa, Staphylococcus epidermidis
NEDNNNVALDNRASQATINT

SEQ ID NO: 1733832 - protein, 17 aa, Staphylococcus epidermidis
NEDSGDKIRGKKINVGD

SEQ ID NO: 1733833 - protein, 5 aa, Staphylococcus epidermidis
NEEDL

SEQ ID NO: 1733834 - protein, 8 aa, Staphylococcus epidermidis
NEEDNNVY

SEQ ID NO: 1733835 - protein, 13 aa, Staphylococcus epidermidis
NEEISGNENYWNE

SEQ ID NO: 1733836 - protein, 10 aa, Staphylococcus epidermidis
NEEREERIRR

SEQ ID NO: 1733837 - protein, 6 aa, Staphylococcus epidermidis
NEFKTY

SEQ ID NO: 1733838 - protein, 5 aa, Staphylococcus epidermidis
NEFSG

SEQ ID NO: 1733839 - protein, 7 aa, Staphylococcus epidermidis
NEHAKET

SEQ ID NO: 1733840 - protein, 19 aa, Staphylococcus epidermidis
NEHEDADNNLNQEEDSKKE

SEQ ID NO: 1733841 - protein, 5 aa, Staphylococcus epidermidis
NEHLK

SEQ ID NO: 1733842 - protein, 8 aa, Staphylococcus epidermidis
NEIEQATN

SEQ ID NO: 1733843 - protein, 16 aa, Staphylococcus epidermidis
NEIEYDNKTNKERSQN

SEQ ID NO: 1733844 - protein, 4 aa, Staphylococcus epidermidis
NEIH

SEQ ID NO: 1733845 - protein, 6 aa, Staphylococcus epidermidis
NEIQTR

SEQ ID NO: 1733846 - protein, 17 aa, Staphylococcus epidermidis
NEITDQLNKGQNTLSTI

SEQ ID NO: 1733847 - protein, 18 aa, Staphylococcus epidermidis
NEKDLQKITDTAKKQDGL

SEQ ID NO: 1733848 - protein, 8 aa, Staphylococcus epidermidis
NEKEKDKI

SEQ ID NO: 1733849 - protein, 5 aa, Staphylococcus epidermidis
NEKGL

SEQ ID NO: 1733850 - protein, 8 aa, Staphylococcus epidermidis
NEKNRNNK

SEQ ID NO: 1733851 - protein, 9 aa, Staphylococcus epidermidis
NEKNSTIVN

SEQ ID NO: 1733852 - protein, 8 aa, Staphylococcus epidermidis
NEKQDKLQ

SEQ ID NO: 1733853 - protein, 7 aa, Staphylococcus epidermidis
NEKQGMA

SEQ ID NO: 1733854 - protein, 7 aa, Staphylococcus epidermidis
NEKQGMQ

SEQ ID NO: 1733855 - protein, 47 aa, Staphylococcus epidermidis
NEKQSAINTDNEGTIEEKQKAIQSLNDAKNSADEQITQAASNQNVDN

SEQ ID NO: 1733856 - protein, 45 aa, Staphylococcus epidermidis
NEKYDNEFKKEEDHNSKEMEKISKGAKDENASKLQKKEHDDHGGG

SEQ ID NO: 1733857 - protein, 5 aa, Staphylococcus epidermidis
NELKD

SEQ ID NO: 1733858 - protein, 12 aa, Staphylococcus epidermidis
NELNNTKTNADR

SEQ ID NO: 1733859 - protein, 23 aa, Staphylococcus epidermidis
NELTDPEKGKGFTKDDNDTEEKV

SEQ ID NO: 1733860 - protein, 15 aa, Staphylococcus epidermidis
NELTEVKNQQVEYRN

SEQ ID NO: 1733861 - protein, 6 aa, Staphylococcus epidermidis
NELTGK

SEQ ID NO: 1733862 - protein, 29 aa, Staphylococcus epidermidis
NEMSDNEVKKLTPSDVEALSDSEVAEYNK

SEQ ID NO: 1733863 - protein, 6 aa, Staphylococcus epidermidis
NENESE

SEQ ID NO: 1733864 - protein, 7 aa, Staphylococcus epidermidis
NEPVNAK

SEQ ID NO: 1733865 - protein, 17 aa, Staphylococcus epidermidis
NEQEDQVNSQPNKRKKR

SEQ ID NO: 1733866 - protein, 7 aa, Staphylococcus epidermidis
NEQFSER

SEQ ID NO: 1733867 - protein, 16 aa, Staphylococcus epidermidis
NEQGKEVARTKNTVDG

SEQ ID NO: 1733868 - protein, 8 aa, Staphylococcus epidermidis
NEQGVEVA

SEQ ID NO: 1733869 - protein, 7 aa, Staphylococcus epidermidis
NEQMSDS

SEQ ID NO: 1733870 - protein, 8 aa, Staphylococcus epidermidis
NEQQEKTE

SEQ ID NO: 1733871 - protein, 7 aa, Staphylococcus epidermidis
NEQSLKS

SEQ ID NO: 1733872 - protein, 5 aa, Staphylococcus epidermidis
NESGA

SEQ ID NO: 1733873 - protein, 14 aa, Staphylococcus epidermidis
NESRAGKLTDTFPG

SEQ ID NO: 1733874 - protein, 67 aa, Staphylococcus epidermidis
NESTQDHLSSTQPNLGASSENDYSNTDINNKDDRKIESSKHESKDDSTSNELEYQPLKSNKNSESFK

SEQ ID NO: 1733875 - protein, 7 aa, Staphylococcus epidermidis
NETSDYQ

SEQ ID NO: 1733876 - protein, 14 aa, Staphylococcus epidermidis
NEVDQALDKARPKI

SEQ ID NO: 1733877 - protein, 6 aa, Staphylococcus epidermidis
NEVHPE

SEQ ID NO: 1733878 - protein, 13 aa, Staphylococcus epidermidis
NEYETLKSEGNYV

SEQ ID NO: 1733879 - protein, 13 aa, Staphylococcus epidermidis
NFEPNAKGGILEG

SEQ ID NO: 1733880 - protein, 242 aa, Staphylococcus epidermidis
NFKDDFEKNRQSINPDEQQTELKEDDKTNENKKEADSQNSLSNNSNQQFPPRNAQRRKRRRETATNQSKQQDDKHQKNSDAKTTEGSLDDRYDEAQLQQQHDKSQQQNKTEKQSQDNRMKDGKDAAIVNGTSESPEHKSKSTQNRPGPKAQQQKRKSESTQSKPSTNKDKKAATGAGIAGAAGVAGAAETSKRHHNKKDKQDSKHSNHENDEKSVKNDDQKQSKKGKKAAVGAGAAAGVGAA

SEQ ID NO: 1733881 - protein, 11 aa, Staphylococcus epidermidis
NFKDPAPKNAV

SEQ ID NO: 1733882 - protein, 9 aa, Staphylococcus epidermidis
NFKNDKSQL

SEQ ID NO: 1733883 - protein, 12 aa, Staphylococcus epidermidis
NFKQGDKIGTPG

SEQ ID NO: 1733884 - protein, 9 aa, Staphylococcus epidermidis
NFKREKDSK

SEQ ID NO: 1733885 - protein, 6 aa, Staphylococcus epidermidis
NFSGNE

SEQ ID NO: 1733886 - protein, 10 aa, Staphylococcus epidermidis
NGANITGISS

SEQ ID NO: 1733887 - protein, 7 aa, Staphylococcus epidermidis
NGASVEP

SEQ ID NO: 1733888 - protein, 20 aa, Staphylococcus epidermidis
NGATSRDQVAEKLKEAQALD

SEQ ID NO: 1733889 - protein, 24 aa, Staphylococcus epidermidis
NGDATEQQITTETDRVNQQTTNLT

SEQ ID NO: 1733890 - protein, 10 aa, Staphylococcus epidermidis
NGDKHSGETL

SEQ ID NO: 1733891 - protein, 9 aa, Staphylococcus epidermidis
NGDKKVNTH

SEQ ID NO: 1733892 - protein, 7 aa, Staphylococcus epidermidis
NGDSQLG

SEQ ID NO: 1733893 - protein, 10 aa, Staphylococcus epidermidis
NGDTPYRNHP

SEQ ID NO: 1733894 - protein, 9 aa, Staphylococcus epidermidis
NGESTQTRI

SEQ ID NO: 1733895 - protein, 6 aa, Staphylococcus epidermidis
NGGDNI

SEQ ID NO: 1733896 - protein, 24 aa, Staphylococcus epidermidis
NGGDWGSTAPSKGYSVGKKPVQGA

SEQ ID NO: 1733897 - protein, 18 aa, Staphylococcus epidermidis
NGGQASTVTATKEGTTWS

SEQ ID NO: 1733898 - protein, 6 aa, Staphylococcus epidermidis
NGHGGS

SEQ ID NO: 1733899 - protein, 4 aa, Staphylococcus epidermidis
NGHI

SEQ ID NO: 1733900 - protein, 7 aa, Staphylococcus epidermidis
NGIKSTT

SEQ ID NO: 1733901 - protein, 11 aa, Staphylococcus epidermidis
NGKATSYKQTA

SEQ ID NO: 1733902 - protein, 16 aa, Staphylococcus epidermidis
NGKEYQLSDLSSDNMA

SEQ ID NO: 1733903 - protein, 5 aa, Staphylococcus epidermidis
NGKGF

SEQ ID NO: 1733904 - protein, 6 aa, Staphylococcus epidermidis
NGKIPG

SEQ ID NO: 1733905 - protein, 17 aa, Staphylococcus epidermidis
NGKISKDQKIKITSDYE

SEQ ID NO: 1733906 - protein, 7 aa, Staphylococcus epidermidis
NGKKDYD

SEQ ID NO: 1733907 - protein, 6 aa, Staphylococcus epidermidis
NGKPAS

SEQ ID NO: 1733908 - protein, 21 aa, Staphylococcus epidermidis
NGKQIGDESSSETYGPYDPDE

SEQ ID NO: 1733909 - protein, 8 aa, Staphylococcus epidermidis
NGKSATLT

SEQ ID NO: 1733910 - protein, 21 aa, Staphylococcus epidermidis
NGLNGDQKLQDAKTDANQQIT

SEQ ID NO: 1733911 - protein, 5 aa, Staphylococcus epidermidis
NGMTG

SEQ ID NO: 1733912 - protein, 6 aa, Staphylococcus epidermidis
NGNAPY

SEQ ID NO: 1733913 - protein, 28 aa, Staphylococcus epidermidis
NGNPNATIEEKTEAINKVNTAKAEAIKN

SEQ ID NO: 1733914 - protein, 17 aa, Staphylococcus epidermidis
NGNQEEIDYQREHGGTL

SEQ ID NO: 1733915 - protein, 15 aa, Staphylococcus epidermidis
NGNYIDKEKSKKEGF

SEQ ID NO: 1733916 - protein, 7 aa, Staphylococcus epidermidis
NGPDKVG

SEQ ID NO: 1733917 - protein, 4 aa, Staphylococcus epidermidis
NGQN

SEQ ID NO: 1733918 - protein, 7 aa, Staphylococcus epidermidis
NGQPTVA

SEQ ID NO: 1733919 - protein, 15 aa, Staphylococcus epidermidis
NGQVPSYRSKSKETI

SEQ ID NO: 1733920 - protein, 22 aa, Staphylococcus epidermidis
NGRIDVKSEPGKGSIFKVLFND

SEQ ID NO: 1733921 - protein, 5 aa, Staphylococcus epidermidis
NGRIG

SEQ ID NO: 1733922 - protein, 15 aa, Staphylococcus epidermidis
NGSGSKDSKAYDTYT

SEQ ID NO: 1733923 - protein, 7 aa, Staphylococcus epidermidis
NGSNVSL

SEQ ID NO: 1733924 - protein, 14 aa, Staphylococcus epidermidis
NGSSTAQGDNPTYS

SEQ ID NO: 1733925 - protein, 15 aa, Staphylococcus epidermidis
NGSSTAQGDNPTYSL

SEQ ID NO: 1733926 - protein, 4 aa, Staphylococcus epidermidis
NGTN

SEQ ID NO: 1733927 - protein, 16 aa, Staphylococcus epidermidis
NGVGIENENASNLKSI

SEQ ID NO: 1733928 - protein, 16 aa, Staphylococcus epidermidis
NGVGMENEDASNLKSI

SEQ ID NO: 1733929 - protein, 9 aa, Staphylococcus epidermidis
NGVKGAANG

SEQ ID NO: 1733930 - protein, 14 aa, Staphylococcus epidermidis
NGVPTSTIDKATIE

SEQ ID NO: 1733931 - protein, 12 aa, Staphylococcus epidermidis
NGYEPPYQRQSK

SEQ ID NO: 1733932 - protein, 9 aa, Staphylococcus epidermidis
NGYSDTNKE

SEQ ID NO: 1733933 - protein, 128 aa, Staphylococcus epidermidis
NGYYDDDSDSDSDSDSDSDDSDSDSDSDSDSDSDSDSDSDSDSDSDSDSDSDSDSDSDSDSDSDSDSDSDSDSDSDSDSDSDSDSDSDSASDSDSDSDSGLDNSSDKNTKDKLPDTGANEDHDSKGTL

SEQ ID NO: 1733934 - protein, 215 aa, Staphylococcus epidermidis
NGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDLGNSSDKSTKDKLPDTGANEDYGSKGTL

SEQ ID NO: 1733935 - protein, 207 aa, Staphylococcus epidermidis
NGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTL

SEQ ID NO: 1733936 - protein, 7 aa, Staphylococcus epidermidis
NHAKPPK

SEQ ID NO: 1733937 - protein, 10 aa, Staphylococcus epidermidis
NHANTNQDVQ

SEQ ID NO: 1733938 - protein, 24 aa, Staphylococcus epidermidis
NHEATTEEQNEAISQVEAHSSDAI

SEQ ID NO: 1733939 - protein, 8 aa, Staphylococcus epidermidis
NHEIEEKK

SEQ ID NO: 1733940 - protein, 13 aa, Staphylococcus epidermidis
NHENTGRIVIDFN

SEQ ID NO: 1733941 - protein, 6 aa, Staphylococcus epidermidis
NHGTEA

SEQ ID NO: 1733942 - protein, 56 aa, Staphylococcus epidermidis
NHKSEISNDIDDQTTDQGVEQVKNEGLTTLEGDVGQPVVKPNARNEINNKVTEQKN

SEQ ID NO: 1733943 - protein, 8 aa, Staphylococcus epidermidis
NHKVSGET

SEQ ID NO: 1733944 - protein, 5 aa, Staphylococcus epidermidis
NHLDS

SEQ ID NO: 1733945 - protein, 4 aa, Staphylococcus epidermidis
NHLK

SEQ ID NO: 1733946 - protein, 117 aa, Staphylococcus epidermidis
NHNDSKNDDNKVSDQSKKDSDKKDNDKDKAASDKDKDKNKDKSSSDNNSSSSNSNASGSDENGNNSNSDNQNGTTNNQNQGTQNQNNQQNNGNAAQGNNGQQNKQGQQSHTVNGQEN

SEQ ID NO: 1733947 - protein, 132 aa, Staphylococcus epidermidis
NHNDSKSDDQKIANQSKKDSDKKDGEQSGDNKDKNHDSKKDKKSDSDKKANDDSDKKANDDSDKKANDDSDKNTNDDSDNSSSNPNATSTNNNVNVANNNSNYTNQNQQDNANQNSNNQQTTQGQQSHTVYG

SEQ ID NO: 1733948 - protein, 11 aa, Staphylococcus epidermidis
NHPQGSQGATE

SEQ ID NO: 1733949 - protein, 10 aa, Staphylococcus epidermidis
NHQKTKDEIN

SEQ ID NO: 1733950 - protein, 6 aa, Staphylococcus epidermidis
NHSSKK

SEQ ID NO: 1733951 - protein, 11 aa, Staphylococcus epidermidis
NIAKKAVSAAK

SEQ ID NO: 1733952 - protein, 7 aa, Staphylococcus epidermidis
NIASQGI

SEQ ID NO: 1733953 - protein, 19 aa, Staphylococcus epidermidis
NIDTPTPENGLSLGSGDSL

SEQ ID NO: 1733954 - protein, 4 aa, Staphylococcus epidermidis
NIGN

SEQ ID NO: 1733955 - protein, 4 aa, Staphylococcus epidermidis
NIGY

SEQ ID NO: 1733956 - protein, 25 aa, Staphylococcus epidermidis
NIHTSDDLSSLANTLSNASDLDNAM

SEQ ID NO: 1733957 - protein, 8 aa, Staphylococcus epidermidis
NIKGSKNK

SEQ ID NO: 1733958 - protein, 9 aa, Staphylococcus epidermidis
NINQSTTVA

SEQ ID NO: 1733959 - protein, 8 aa, Staphylococcus epidermidis
NIPTNQAP

SEQ ID NO: 1733960 - protein, 6 aa, Staphylococcus epidermidis
NIRPLP

SEQ ID NO: 1733961 - protein, 25 aa, Staphylococcus epidermidis
NISDNESVTNESKYINAEPEKQHTF

SEQ ID NO: 1733962 - protein, 14 aa, Staphylococcus epidermidis
NISDNESVTNESNY

SEQ ID NO: 1733963 - protein, 5 aa, Staphylococcus epidermidis
NISES

SEQ ID NO: 1733964 - protein, 7 aa, Staphylococcus epidermidis
NITDGAE

SEQ ID NO: 1733965 - protein, 9 aa, Staphylococcus epidermidis
NKAAEDYNV

SEQ ID NO: 1733966 - protein, 16 aa, Staphylococcus epidermidis
NKAKNDLRADKSQLEH

SEQ ID NO: 1733967 - protein, 9 aa, Staphylococcus epidermidis
NKAPRIYEK

SEQ ID NO: 1733968 - protein, 15 aa, Staphylococcus epidermidis
NKDESHNENNEMNEF

SEQ ID NO: 1733969 - protein, 28 aa, Staphylococcus epidermidis
NKDGSSVQEVTNSKGGNQLDGKSDKYKS

SEQ ID NO: 1733970 - protein, 9 aa, Staphylococcus epidermidis
NKDNKNNIG

SEQ ID NO: 1733971 - protein, 6 aa, Staphylococcus epidermidis
NKDNQV

SEQ ID NO: 1733972 - protein, 8 aa, Staphylococcus epidermidis
NKDRMKDT

SEQ ID NO: 1733973 - protein, 8 aa, Staphylococcus epidermidis
NKDTMSGT

SEQ ID NO: 1733974 - protein, 4 aa, Staphylococcus epidermidis
NKDY

SEQ ID NO: 1733975 - protein, 10 aa, Staphylococcus epidermidis
NKEAVDTEAP

SEQ ID NO: 1733976 - protein, 13 aa, Staphylococcus epidermidis
NKEDSKEAEIKQN

SEQ ID NO: 1733977 - protein, 9 aa, Staphylococcus epidermidis
NKEIRPNDG

SEQ ID NO: 1733978 - protein, 14 aa, Staphylococcus epidermidis
NKEKKEDAERKNSE

SEQ ID NO: 1733979 - protein, 50 aa, Staphylococcus epidermidis
NKEKNKTNTSKVKTKAHISEKGKEKSKTKSKPKTNKALPDTGETNETNRT

SEQ ID NO: 1733980 - protein, 8 aa, Staphylococcus epidermidis
NKENNDAL

SEQ ID NO: 1733981 - protein, 7 aa, Staphylococcus epidermidis
NKESQRL

SEQ ID NO: 1733982 - protein, 17 aa, Staphylococcus epidermidis
NKESVKDSKRKDTGTIT

SEQ ID NO: 1733983 - protein, 6 aa, Staphylococcus epidermidis
NKETKV

SEQ ID NO: 1733984 - protein, 21 aa, Staphylococcus epidermidis
NKFKQNQEATIEEKQSAINEL

SEQ ID NO: 1733985 - protein, 6 aa, Staphylococcus epidermidis
NKGESL

SEQ ID NO: 1733986 - protein, 9 aa, Staphylococcus epidermidis
NKGLKDNNT

SEQ ID NO: 1733987 - protein, 14 aa, Staphylococcus epidermidis
NKGQEIDNLADNQQ

SEQ ID NO: 1733988 - protein, 19 aa, Staphylococcus epidermidis
NKGYGYQDIEKGKKNTANT

SEQ ID NO: 1733989 - protein, 7 aa, Staphylococcus epidermidis
NKHDSDE

SEQ ID NO: 1733990 - protein, 7 aa, Staphylococcus epidermidis
NKHHNGQ

SEQ ID NO: 1733991 - protein, 17 aa, Staphylococcus epidermidis
NKHQNNYIEKQNELDKR

SEQ ID NO: 1733992 - protein, 12 aa, Staphylococcus epidermidis
NKHRQTIDDQQM

SEQ ID NO: 1733993 - protein, 13 aa, Staphylococcus epidermidis
NKIENQNKKEELD

SEQ ID NO: 1733994 - protein, 11 aa, Staphylococcus epidermidis
NKIKLSDSDLE

SEQ ID NO: 1733995 - protein, 16 aa, Staphylococcus epidermidis
NKISIDGKSDNQGSGH

SEQ ID NO: 1733996 - protein, 6 aa, Staphylococcus epidermidis
NKITNY

SEQ ID NO: 1733997 - protein, 10 aa, Staphylococcus epidermidis
NKKDNTTTAA

SEQ ID NO: 1733998 - protein, 8 aa, Staphylococcus epidermidis
NKKPGESI

SEQ ID NO: 1733999 - protein, 7 aa, Staphylococcus epidermidis
NKKSIKP

SEQ ID NO: 1734000 - protein, 9 aa, Staphylococcus epidermidis
NKKTYSRKA

SEQ ID NO: 1734001 - protein, 21 aa, Staphylococcus epidermidis
NKLKETAQTVLDEENQNVPFD

SEQ ID NO: 1734002 - protein, 8 aa, Staphylococcus epidermidis
NKLNNDMG

SEQ ID NO: 1734003 - protein, 15 aa, Staphylococcus epidermidis
NKLPDVEKDLKKADK

SEQ ID NO: 1734004 - protein, 4 aa, Staphylococcus epidermidis
NKLS

SEQ ID NO: 1734005 - protein, 35 aa, Staphylococcus epidermidis
NKLSERSTKLLSDSQNSKSTADSISGELNKLDDNV

SEQ ID NO: 1734006 - protein, 10 aa, Staphylococcus epidermidis
NKLTSEAYAK

SEQ ID NO: 1734007 - protein, 9 aa, Staphylococcus epidermidis
NKNGSRFKQ

SEQ ID NO: 1734008 - protein, 7 aa, Staphylococcus epidermidis
NKNISHG

SEQ ID NO: 1734009 - protein, 8 aa, Staphylococcus epidermidis
NKNKGRKL

SEQ ID NO: 1734010 - protein, 15 aa, Staphylococcus epidermidis
NKNQEVYDTKNKTIE

SEQ ID NO: 1734011 - protein, 6 aa, Staphylococcus epidermidis
NKNQIS

SEQ ID NO: 1734012 - protein, 7 aa, Staphylococcus epidermidis
NKNQTSK

SEQ ID NO: 1734013 - protein, 9 aa, Staphylococcus epidermidis
NKNSPRAIG

SEQ ID NO: 1734014 - protein, 11 aa, Staphylococcus epidermidis
NKPRNENTHPV

SEQ ID NO: 1734015 - protein, 6 aa, Staphylococcus epidermidis
NKPSYA

SEQ ID NO: 1734016 - protein, 6 aa, Staphylococcus epidermidis
NKQDID

SEQ ID NO: 1734017 - protein, 12 aa, Staphylococcus epidermidis
NKQENNDRDKVE

SEQ ID NO: 1734018 - protein, 8 aa, Staphylococcus epidermidis
NKQETGIT

SEQ ID NO: 1734019 - protein, 13 aa, Staphylococcus epidermidis
NKQSVENNKKELN

SEQ ID NO: 1734020 - protein, 8 aa, Staphylococcus epidermidis
NKRKVKRD

SEQ ID NO: 1734021 - protein, 16 aa, Staphylococcus epidermidis
NKRNSVGKVEERKNEI

SEQ ID NO: 1734022 - protein, 18 aa, Staphylococcus epidermidis
NKRSSGNKDQQVEPNRPM

SEQ ID NO: 1734023 - protein, 13 aa, Staphylococcus epidermidis
NKRTDQNDDESPE

SEQ ID NO: 1734024 - protein, 10 aa, Staphylococcus epidermidis
NKSENELNTK

SEQ ID NO: 1734025 - protein, 9 aa, Staphylococcus epidermidis
NKSPKEVKT

SEQ ID NO: 1734026 - protein, 8 aa, Staphylococcus epidermidis
NKTEPDNH

SEQ ID NO: 1734027 - protein, 4 aa, Staphylococcus epidermidis
NKTI

SEQ ID NO: 1734028 - protein, 6 aa, Staphylococcus epidermidis
NKTIGQ

SEQ ID NO: 1734029 - protein, 6 aa, Staphylococcus epidermidis
NKTPSH

SEQ ID NO: 1734030 - protein, 31 aa, Staphylococcus epidermidis
NKVNTCDDKECNLNSNKFDENNNVEKNSDVL

SEQ ID NO: 1734031 - protein, 50 aa, Staphylococcus epidermidis
NLANPSASVEDTKSKSETETEKLAAAAKAKRDKINNNNKVASNTKNLMQE

SEQ ID NO: 1734032 - protein, 14 aa, Staphylococcus epidermidis
NLAPSERKEIVIDF

SEQ ID NO: 1734033 - protein, 6 aa, Staphylococcus epidermidis
NLEEQV

SEQ ID NO: 1734034 - protein, 4 aa, Staphylococcus epidermidis
NLEK

SEQ ID NO: 1734035 - protein, 12 aa, Staphylococcus epidermidis
NLESQDSFNEKT

SEQ ID NO: 1734036 - protein, 11 aa, Staphylococcus epidermidis
NLGDSKKVGSC

SEQ ID NO: 1734037 - protein, 29 aa, Staphylococcus epidermidis
NLHASGRALGTRANDLNEQMSNNDKKNQL

SEQ ID NO: 1734038 - protein, 5 aa, Staphylococcus epidermidis
NLKKQ

SEQ ID NO: 1734039 - protein, 7 aa, Staphylococcus epidermidis
NLKKQSK

SEQ ID NO: 1734040 - protein, 30 aa, Staphylococcus epidermidis
NLKPSDNENKTEEERSDNQTSHFKAKDDYY

SEQ ID NO: 1734041 - protein, 23 aa, Staphylococcus epidermidis
NLNNAQKDAEKNLVNSASTLEQV

SEQ ID NO: 1734042 - protein, 18 aa, Staphylococcus epidermidis
NLPEKTITTVKEKGKKID

SEQ ID NO: 1734043 - protein, 5 aa, Staphylococcus epidermidis
NLSNK

SEQ ID NO: 1734044 - protein, 6 aa, Staphylococcus epidermidis
NLSSSM

SEQ ID NO: 1734045 - protein, 17 aa, Staphylococcus epidermidis
NLTGGFGAQGASTLTQQ

SEQ ID NO: 1734046 - protein, 6 aa, Staphylococcus epidermidis
NLTQQE

SEQ ID NO: 1734047 - protein, 6 aa, Staphylococcus epidermidis
NLTRAN

SEQ ID NO: 1734048 - protein, 6 aa, Staphylococcus epidermidis
NLTTEQ

SEQ ID NO: 1734049 - protein, 4 aa, Staphylococcus epidermidis
NMIP

SEQ ID NO: 1734050 - protein, 13 aa, Staphylococcus epidermidis
NMKNDSDVGDGQP

SEQ ID NO: 1734051 - protein, 6 aa, Staphylococcus epidermidis
NMPANL

SEQ ID NO: 1734052 - protein, 5 aa, Staphylococcus epidermidis
NMSQS

SEQ ID NO: 1734053 - protein, 13 aa, Staphylococcus epidermidis
NNAEATDEEKAAA

SEQ ID NO: 1734054 - protein, 17 aa, Staphylococcus epidermidis
NNAHSTQEVNESKTHSI

SEQ ID NO: 1734055 - protein, 19 aa, Staphylococcus epidermidis
NNAKAEKKILKGKDEITAL

SEQ ID NO: 1734056 - protein, 11 aa, Staphylococcus epidermidis
NNAKKGGASDK

SEQ ID NO: 1734057 - protein, 53 aa, Staphylococcus epidermidis
NNAQDNAQAQSNDTEQTQSQSQNANNEINQSNKENNASNANTLPTNENSENDI

SEQ ID NO: 1734058 - protein, 4 aa, Staphylococcus epidermidis
NNDH

SEQ ID NO: 1734059 - protein, 7 aa, Staphylococcus epidermidis
NNDIGTY

SEQ ID NO: 1734060 - protein, 7 aa, Staphylococcus epidermidis
NNDKDTI

SEQ ID NO: 1734061 - protein, 10 aa, Staphylococcus epidermidis
NNDKKTYSHY

SEQ ID NO: 1734062 - protein, 6 aa, Staphylococcus epidermidis
NNDQWQ

SEQ ID NO: 1734063 - protein, 10 aa, Staphylococcus epidermidis
NNDRSQNPKF

SEQ ID NO: 1734064 - protein, 13 aa, Staphylococcus epidermidis
NNEEATKEEKDVA

SEQ ID NO: 1734065 - protein, 8 aa, Staphylococcus epidermidis
NNEENNVK

SEQ ID NO: 1734066 - protein, 5 aa, Staphylococcus epidermidis
NNEPI

SEQ ID NO: 1734067 - protein, 6 aa, Staphylococcus epidermidis
NNESIS

SEQ ID NO: 1734068 - protein, 9 aa, Staphylococcus epidermidis
NNGGQNSHG

SEQ ID NO: 1734069 - protein, 13 aa, Staphylococcus epidermidis
NNHALDQGEQGVS

SEQ ID NO: 1734070 - protein, 6 aa, Staphylococcus epidermidis
NNIEHR

SEQ ID NO: 1734071 - protein, 12 aa, Staphylococcus epidermidis
NNISSNSGKGHK

SEQ ID NO: 1734072 - protein, 14 aa, Staphylococcus epidermidis
NNKRANTTFSPNKN

SEQ ID NO: 1734073 - protein, 21 aa, Staphylococcus epidermidis
NNKSNITEEKNKENKNNEIKY

SEQ ID NO: 1734074 - protein, 6 aa, Staphylococcus epidermidis
NNKTIY

SEQ ID NO: 1734075 - protein, 21 aa, Staphylococcus epidermidis
NNLHGDQKLAQSKQDANNQLN

SEQ ID NO: 1734076 - protein, 11 aa, Staphylococcus epidermidis
NNLKNSGYSYV

SEQ ID NO: 1734077 - protein, 14 aa, Staphylococcus epidermidis
NNLSSESQNRANQI

SEQ ID NO: 1734078 - protein, 12 aa, Staphylococcus epidermidis
NNNASAQAKLAA

SEQ ID NO: 1734079 - protein, 6 aa, Staphylococcus epidermidis
NNNEQI

SEQ ID NO: 1734080 - protein, 15 aa, Staphylococcus epidermidis
NNNKDATNEEKAEAK

SEQ ID NO: 1734081 - protein, 12 aa, Staphylococcus epidermidis
NNNKHTDSRTYG

SEQ ID NO: 1734082 - protein, 9 aa, Staphylococcus epidermidis
NNNKVSGET

SEQ ID NO: 1734083 - protein, 16 aa, Staphylococcus epidermidis
NNNQDATTEEKQAALT

SEQ ID NO: 1734084 - protein, 5 aa, Staphylococcus epidermidis
NNNQQ

SEQ ID NO: 1734085 - protein, 11 aa, Staphylococcus epidermidis
NNPKEANDRKD

SEQ ID NO: 1734086 - protein, 24 aa, Staphylococcus epidermidis
NNPQRSGEEALVNGSNTRSEVEEH

SEQ ID NO: 1734087 - protein, 25 aa, Staphylococcus epidermidis
NNPTFQADKNDINTQTYEPDHTEQE

SEQ ID NO: 1734088 - protein, 14 aa, Staphylococcus epidermidis
NNQAPKVESKSHDL

SEQ ID NO: 1734089 - protein, 14 aa, Staphylococcus epidermidis
NNQAPTVESKSHDL

SEQ ID NO: 1734090 - protein, 15 aa, Staphylococcus epidermidis
NNQAPTVESKSHDLN

SEQ ID NO: 1734091 - protein, 4 aa, Staphylococcus epidermidis
NNQD

SEQ ID NO: 1734092 - protein, 16 aa, Staphylococcus epidermidis
NNQEVEEKKVRVDESY

SEQ ID NO: 1734093 - protein, 13 aa, Staphylococcus epidermidis
NNQEVGEKKVRVG

SEQ ID NO: 1734094 - protein, 7 aa, Staphylococcus epidermidis
NNQFSER

SEQ ID NO: 1734095 - protein, 6 aa, Staphylococcus epidermidis
NNQIPN

SEQ ID NO: 1734096 - protein, 6 aa, Staphylococcus epidermidis
NNQKRL

SEQ ID NO: 1734097 - protein, 11 aa, Staphylococcus epidermidis
NNQSKEVNTPI

SEQ ID NO: 1734098 - protein, 27 aa, Staphylococcus epidermidis
NNQVNQEAKELNEENHTQTYQQHAKPQ

SEQ ID NO: 1734099 - protein, 12 aa, Staphylococcus epidermidis
NNRQKIQSNRLK

SEQ ID NO: 1734100 - protein, 6 aa, Staphylococcus epidermidis
NNRTQQ

SEQ ID NO: 1734101 - protein, 8 aa, Staphylococcus epidermidis
NNTGRDLY

SEQ ID NO: 1734102 - protein, 9 aa, Staphylococcus epidermidis
NNTKANNEA

SEQ ID NO: 1734103 - protein, 47 aa, Staphylococcus epidermidis
NNTNGTQNSNERRNLANNDNLNQNHTRQDEWDPEKELKDRKKDDPYI

SEQ ID NO: 1734104 - protein, 7 aa, Staphylococcus epidermidis
NNVEDKE

SEQ ID NO: 1734105 - protein, 6 aa, Staphylococcus epidermidis
NNVTKQ

SEQ ID NO: 1734106 - protein, 9 aa, Staphylococcus epidermidis
NNYDNNVKQ

SEQ ID NO: 1734107 - protein, 5 aa, Staphylococcus epidermidis
NNYEN

SEQ ID NO: 1734108 - protein, 6 aa, Staphylococcus epidermidis
NNYNHQ

SEQ ID NO: 1734109 - protein, 7 aa, Staphylococcus epidermidis
NPATDKG

SEQ ID NO: 1734110 - protein, 9 aa, Staphylococcus epidermidis
NPDEQEETW

SEQ ID NO: 1734111 - protein, 27 aa, Staphylococcus epidermidis
NPDLNSSNVKDVTSQFAPKVSADGTRV

SEQ ID NO: 1734112 - protein, 27 aa, Staphylococcus epidermidis
NPDLNSSNVKDVTSQFTPKVSADGTRV

SEQ ID NO: 1734113 - protein, 8 aa, Staphylococcus epidermidis
NPDYKEKV

SEQ ID NO: 1734114 - protein, 8 aa, Staphylococcus epidermidis
NPEAHRNS

SEQ ID NO: 1734115 - protein, 8 aa, Staphylococcus epidermidis
NPFEPTKE

SEQ ID NO: 1734116 - protein, 5 aa, Staphylococcus epidermidis
NPGEI

SEQ ID NO: 1734117 - protein, 5 aa, Staphylococcus epidermidis
NPGQV

SEQ ID NO: 1734118 - protein, 8 aa, Staphylococcus epidermidis
NPHQTRYS

SEQ ID NO: 1734119 - protein, 21 aa, Staphylococcus epidermidis
NPIDPNSTEGRVNERIKNQES

SEQ ID NO: 1734120 - protein, 8 aa, Staphylococcus epidermidis
NPIQKKNL

SEQ ID NO: 1734121 - protein, 8 aa, Staphylococcus epidermidis
NPKEEGKF

SEQ ID NO: 1734122 - protein, 8 aa, Staphylococcus epidermidis
NPKNQDHN

SEQ ID NO: 1734123 - protein, 5 aa, Staphylococcus epidermidis
NPKTL

SEQ ID NO: 1734124 - protein, 4 aa, Staphylococcus epidermidis
NPKY

SEQ ID NO: 1734125 - protein, 20 aa, Staphylococcus epidermidis
NPLDRDKSELRNKAVGDGDP

SEQ ID NO: 1734126 - protein, 37 aa, Staphylococcus epidermidis
NPLSDTSNNVQQNLNDTQNPNGSSSGEPQNGKRYSLK

SEQ ID NO: 1734127 - protein, 7 aa, Staphylococcus epidermidis
NPNEFSG

SEQ ID NO: 1734128 - protein, 6 aa, Staphylococcus epidermidis
NPRNGD

SEQ ID NO: 1734129 - protein, 11 aa, Staphylococcus epidermidis
NPSGSGSTLNR

SEQ ID NO: 1734130 - protein, 4 aa, Staphylococcus epidermidis
NPTT

SEQ ID NO: 1734131 - protein, 5 aa, Staphylococcus epidermidis
NPTVT

SEQ ID NO: 1734132 - protein, 18 aa, Staphylococcus epidermidis
NQAHSNEDVQNAENAGVA

SEQ ID NO: 1734133 - protein, 14 aa, Staphylococcus epidermidis
NQAQAANGLHKEKA

SEQ ID NO: 1734134 - protein, 22 aa, Staphylococcus epidermidis
NQAQINAEKGLVNQSTTRTEVA

SEQ ID NO: 1734135 - protein, 63 aa, Staphylococcus epidermidis
NQAQSTQQVSEAKNNGINTINQDQPNAVKKNNTKTLLEQKGNEKKSAIAQTPDATTEEKQEAV

SEQ ID NO: 1734136 - protein, 14 aa, Staphylococcus epidermidis
NQDDIKKNKKDISN

SEQ ID NO: 1734137 - protein, 10 aa, Staphylococcus epidermidis
NQDQNLNSSM

SEQ ID NO: 1734138 - protein, 19 aa, Staphylococcus epidermidis
NQDRRDNDVEQHKNTGLQE

SEQ ID NO: 1734139 - protein, 5 aa, Staphylococcus epidermidis
NQDSA

SEQ ID NO: 1734140 - protein, 18 aa, Staphylococcus epidermidis
NQDTPDAQSDDYNDYHRS

SEQ ID NO: 1734141 - protein, 15 aa, Staphylococcus epidermidis
NQEQKKRHNVKPGIT

SEQ ID NO: 1734142 - protein, 12 aa, Staphylococcus epidermidis
NQEVKTVSHTHR

SEQ ID NO: 1734143 - protein, 38 aa, Staphylococcus epidermidis
NQHLNNDMKSNVKDSDSFETIKSNGNAQKYRGSKAVNK

SEQ ID NO: 1734144 - protein, 11 aa, Staphylococcus epidermidis
NQKANDSSVQK

SEQ ID NO: 1734145 - protein, 28 aa, Staphylococcus epidermidis
NQKANEARTAIQNEHSNNGVAQAKSNGI

SEQ ID NO: 1734146 - protein, 30 aa, Staphylococcus epidermidis
NQKATEAKTNIQNAHNNEGVNQAKTNGIDQ

SEQ ID NO: 1734147 - protein, 10 aa, Staphylococcus epidermidis
NQKDSDLNAE

SEQ ID NO: 1734148 - protein, 8 aa, Staphylococcus epidermidis
NQKLRNTL

SEQ ID NO: 1734149 - protein, 9 aa, Staphylococcus epidermidis
NQKQTNLNA

SEQ ID NO: 1734150 - protein, 33 aa, Staphylococcus epidermidis
NQKTQAVDTAHQNLNGQQKLEQARNSANTEIND

SEQ ID NO: 1734151 - protein, 6 aa, Staphylococcus epidermidis
NQLDAQ

SEQ ID NO: 1734152 - protein, 6 aa, Staphylococcus epidermidis
NQLPND

SEQ ID NO: 1734153 - protein, 16 aa, Staphylococcus epidermidis
NQLSKVQKKQIQSIQG

SEQ ID NO: 1734154 - protein, 6 aa, Staphylococcus epidermidis
NQNDSK

SEQ ID NO: 1734155 - protein, 8 aa, Staphylococcus epidermidis
NQNQPIYQ

SEQ ID NO: 1734156 - protein, 7 aa, Staphylococcus epidermidis
NQNYSYE

SEQ ID NO: 1734157 - protein, 5 aa, Staphylococcus epidermidis
NQPIY

SEQ ID NO: 1734158 - protein, 11 aa, Staphylococcus epidermidis
NQPKNKNAPHP

SEQ ID NO: 1734159 - protein, 13 aa, Staphylococcus epidermidis
NQPTKSKNENLEK

SEQ ID NO: 1734160 - protein, 6 aa, Staphylococcus epidermidis
NQQISG

SEQ ID NO: 1734161 - protein, 11 aa, Staphylococcus epidermidis
NQQTSRPNVAK

SEQ ID NO: 1734162 - protein, 5 aa, Staphylococcus epidermidis
NQRDL

SEQ ID NO: 1734163 - protein, 5 aa, Staphylococcus epidermidis
NQRDN

SEQ ID NO: 1734164 - protein, 19 aa, Staphylococcus epidermidis
NQRQAPPAFSNTNKNGVPH

SEQ ID NO: 1734165 - protein, 11 aa, Staphylococcus epidermidis
NQRVAENDAEL

SEQ ID NO: 1734166 - protein, 9 aa, Staphylococcus epidermidis
NQSENRKTG

SEQ ID NO: 1734167 - protein, 10 aa, Staphylococcus epidermidis
NQSITNSQMD

SEQ ID NO: 1734168 - protein, 4 aa, Staphylococcus epidermidis
NQSQ

SEQ ID NO: 1734169 - protein, 13 aa, Staphylococcus epidermidis
NQSQASGTNSDAY

SEQ ID NO: 1734170 - protein, 9 aa, Staphylococcus epidermidis
NQSQTNQLI

SEQ ID NO: 1734171 - protein, 17 aa, Staphylococcus epidermidis
NQSRPTMDEESDDDHSE

SEQ ID NO: 1734172 - protein, 9 aa, Staphylococcus epidermidis
NQSSPSYPI

SEQ ID NO: 1734173 - protein, 55 aa, Staphylococcus epidermidis
NQSVKDTELEQITARSKNFSSYAKDHSNLQTSDSDKTLEGDIDKGVQVSDKNLQD

SEQ ID NO: 1734174 - protein, 6 aa, Staphylococcus epidermidis
NQTSNL

SEQ ID NO: 1734175 - protein, 10 aa, Staphylococcus epidermidis
NQVEKGYKDY

SEQ ID NO: 1734176 - protein, 16 aa, Staphylococcus epidermidis
NQVNQSYTHHANEQQF

SEQ ID NO: 1734177 - protein, 10 aa, Staphylococcus epidermidis
NQVTNNANQA

SEQ ID NO: 1734178 - protein, 7 aa, Staphylococcus epidermidis
NQYTVES

SEQ ID NO: 1734179 - protein, 17 aa, Staphylococcus epidermidis
NRAESQINTAKSEADQV

SEQ ID NO: 1734180 - protein, 8 aa, Staphylococcus epidermidis
NRAGTEKG

SEQ ID NO: 1734181 - protein, 19 aa, Staphylococcus epidermidis
NRANTDNEVDNAKTSGLNN

SEQ ID NO: 1734182 - protein, 31 aa, Staphylococcus epidermidis
NRATQTIKNAENNLNGQSKLAEAKSDGNQSI

SEQ ID NO: 1734183 - protein, 8 aa, Staphylococcus epidermidis
NREESLEK

SEQ ID NO: 1734184 - protein, 5 aa, Staphylococcus epidermidis
NREIS

SEQ ID NO: 1734185 - protein, 19 aa, Staphylococcus epidermidis
NRERELESQNKKENQKNIK

SEQ ID NO: 1734186 - protein, 18 aa, Staphylococcus epidermidis
NRETKQNNHSKVSQYTQN

SEQ ID NO: 1734187 - protein, 7 aa, Staphylococcus epidermidis
NRETMSG

SEQ ID NO: 1734188 - protein, 16 aa, Staphylococcus epidermidis
NRGKANALNEGIKQAS

SEQ ID NO: 1734189 - protein, 16 aa, Staphylococcus epidermidis
NRGKANALNEGVKQAS

SEQ ID NO: 1734190 - protein, 5 aa, Staphylococcus epidermidis
NRGLP

SEQ ID NO: 1734191 - protein, 9 aa, Staphylococcus epidermidis
NRITDEEMQ

SEQ ID NO: 1734192 - protein, 9 aa, Staphylococcus epidermidis
NRKKKKKLK

SEQ ID NO: 1734193 - protein, 6 aa, Staphylococcus epidermidis
NRKKSD

SEQ ID NO: 1734194 - protein, 5 aa, Staphylococcus epidermidis
NRKNI

SEQ ID NO: 1734195 - protein, 12 aa, Staphylococcus epidermidis
NRKSDSSKNYKG

SEQ ID NO: 1734196 - protein, 22 aa, Staphylococcus epidermidis
NRLGGTASWKDNRQPDKNIAGV

SEQ ID NO: 1734197 - protein, 11 aa, Staphylococcus epidermidis
NRNRKNEPVKN

SEQ ID NO: 1734198 - protein, 6 aa, Staphylococcus epidermidis
NRPDEV

SEQ ID NO: 1734199 - protein, 13 aa, Staphylococcus epidermidis
NRSDDFENTVSQS

SEQ ID NO: 1734200 - protein, 10 aa, Staphylococcus epidermidis
NRSDDFKNTV

SEQ ID NO: 1734201 - protein, 6 aa, Staphylococcus epidermidis
NRSGSF

SEQ ID NO: 1734202 - protein, 14 aa, Staphylococcus epidermidis
NRTSRYSSRAPKRK

SEQ ID NO: 1734203 - protein, 6 aa, Staphylococcus epidermidis
NRYKRS

SEQ ID NO: 1734204 - protein, 6 aa, Staphylococcus epidermidis
NSAHKL

SEQ ID NO: 1734205 - protein, 22 aa, Staphylococcus epidermidis
NSAKEQEERQHKKNDDKDKQIK

SEQ ID NO: 1734206 - protein, 10 aa, Staphylococcus epidermidis
NSDEDLEERE

SEQ ID NO: 1734207 - protein, 4 aa, Staphylococcus epidermidis
NSDK

SEQ ID NO: 1734208 - protein, 8 aa, Staphylococcus epidermidis
NSDKGAHD

SEQ ID NO: 1734209 - protein, 9 aa, Staphylococcus epidermidis
NSDKPTIDN

SEQ ID NO: 1734210 - protein, 5 aa, Staphylococcus epidermidis
NSDLP

SEQ ID NO: 1734211 - protein, 5 aa, Staphylococcus epidermidis
NSDST

SEQ ID NO: 1734212 - protein, 30 aa, Staphylococcus epidermidis
NSELAKAQEQINSEHTTQRVNDAKTNAVST

SEQ ID NO: 1734213 - protein, 13 aa, Staphylococcus epidermidis
NSELEYQPNTPQG

SEQ ID NO: 1734214 - protein, 12 aa, Staphylococcus epidermidis
NSFGKTNKNGVP

SEQ ID NO: 1734215 - protein, 8 aa, Staphylococcus epidermidis
NSGDLSSR

SEQ ID NO: 1734216 - protein, 13 aa, Staphylococcus epidermidis
NSGGTTVAEGTVK

SEQ ID NO: 1734217 - protein, 7 aa, Staphylococcus epidermidis
NSGKETA

SEQ ID NO: 1734218 - protein, 7 aa, Staphylococcus epidermidis
NSGNDNQ

SEQ ID NO: 1734219 - protein, 6 aa, Staphylococcus epidermidis
NSGPAL

SEQ ID NO: 1734220 - protein, 11 aa, Staphylococcus epidermidis
NSGTMSAKEAA

SEQ ID NO: 1734221 - protein, 12 aa, Staphylococcus epidermidis
NSGTTSAKEAAN

SEQ ID NO: 1734222 - protein, 6 aa, Staphylococcus epidermidis
NSGVEA

SEQ ID NO: 1734223 - protein, 24 aa, Staphylococcus epidermidis
NSGYDTKKKKLPKFSKGTKKKDGI

SEQ ID NO: 1734224 - protein, 26 aa, Staphylococcus epidermidis
NSIEQTTKEVKDNYYKNSSVDANGNN

SEQ ID NO: 1734225 - protein, 4 aa, Staphylococcus epidermidis
NSIN

SEQ ID NO: 1734226 - protein, 12 aa, Staphylococcus epidermidis
NSINKEFRQTNS

SEQ ID NO: 1734227 - protein, 5 aa, Staphylococcus epidermidis
NSITA

SEQ ID NO: 1734228 - protein, 8 aa, Staphylococcus epidermidis
NSKIQRKI

SEQ ID NO: 1734229 - protein, 12 aa, Staphylococcus epidermidis
NSKIRNVKSQSN

SEQ ID NO: 1734230 - protein, 6 aa, Staphylococcus epidermidis
NSKMKQ

SEQ ID NO: 1734231 - protein, 5 aa, Staphylococcus epidermidis
NSKQV

SEQ ID NO: 1734232 - protein, 10 aa, Staphylococcus epidermidis
NSLKTDKNTV

SEQ ID NO: 1734233 - protein, 14 aa, Staphylococcus epidermidis
NSLNSEPNADSYGS

SEQ ID NO: 1734234 - protein, 17 aa, Staphylococcus epidermidis
NSLSSNSDIENAKVTGI

SEQ ID NO: 1734235 - protein, 11 aa, Staphylococcus epidermidis
NSNEDAEIKAQ

SEQ ID NO: 1734236 - protein, 7 aa, Staphylococcus epidermidis
NSNFPKE

SEQ ID NO: 1734237 - protein, 15 aa, Staphylococcus epidermidis
NSNTENQKHVEKQNQ

SEQ ID NO: 1734238 - protein, 7 aa, Staphylococcus epidermidis
NSPEAQT

SEQ ID NO: 1734239 - protein, 4 aa, Staphylococcus epidermidis
NSPR

SEQ ID NO: 1734240 - protein, 9 aa, Staphylococcus epidermidis
NSPSEDTIT

SEQ ID NO: 1734241 - protein, 7 aa, Staphylococcus epidermidis
NSQQTGY

SEQ ID NO: 1734242 - protein, 5 aa, Staphylococcus epidermidis
NSSFR

SEQ ID NO: 1734243 - protein, 5 aa, Staphylococcus epidermidis
NSSKT

SEQ ID NO: 1734244 - protein, 10 aa, Staphylococcus epidermidis
NSSKVQTGDS

SEQ ID NO: 1734245 - protein, 10 aa, Staphylococcus epidermidis
NSSNSGQLVE

SEQ ID NO: 1734246 - protein, 15 aa, Staphylococcus epidermidis
NSSQSSNPNVSSDQL

SEQ ID NO: 1734247 - protein, 8 aa, Staphylococcus epidermidis
NSTVPDTS

SEQ ID NO: 1734248 - protein, 29 aa, Staphylococcus epidermidis
NSVNDVNNVKTGSNYINENNGPKEAYNQA

SEQ ID NO: 1734249 - protein, 4 aa, Staphylococcus epidermidis
NSYD

SEQ ID NO: 1734250 - protein, 8 aa, Staphylococcus epidermidis
NTADKTAI

SEQ ID NO: 1734251 - protein, 21 aa, Staphylococcus epidermidis
NTAHTRTDITAEQSKANQVNS

SEQ ID NO: 1734252 - protein, 11 aa, Staphylococcus epidermidis
NTAQINAEKDL

SEQ ID NO: 1734253 - protein, 39 aa, Staphylococcus epidermidis
NTDNATDFNSLSKKDKDKLSDEIKDKQKDIVKSVFKKLD

SEQ ID NO: 1734254 - protein, 5 aa, Staphylococcus epidermidis
NTDRV

SEQ ID NO: 1734255 - protein, 7 aa, Staphylococcus epidermidis
NTEADSQ

SEQ ID NO: 1734256 - protein, 5 aa, Staphylococcus epidermidis
NTERM

SEQ ID NO: 1734257 - protein, 5 aa, Staphylococcus epidermidis
NTFAG

SEQ ID NO: 1734258 - protein, 9 aa, Staphylococcus epidermidis
NTGEGGLSD

SEQ ID NO: 1734259 - protein, 6 aa, Staphylococcus epidermidis
NTIDNK

SEQ ID NO: 1734260 - protein, 5 aa, Staphylococcus epidermidis
NTITE

SEQ ID NO: 1734261 - protein, 7 aa, Staphylococcus epidermidis
NTKAFTG

SEQ ID NO: 1734262 - protein, 5 aa, Staphylococcus epidermidis
NTKQV

SEQ ID NO: 1734263 - protein, 22 aa, Staphylococcus epidermidis
NTNATTREQVAKNLDNAQSLDK

SEQ ID NO: 1734264 - protein, 5 aa, Staphylococcus epidermidis
NTNDG

SEQ ID NO: 1734265 - protein, 8 aa, Staphylococcus epidermidis
NTNDTSMA

SEQ ID NO: 1734266 - protein, 20 aa, Staphylococcus epidermidis
NTNQRPVLGPDEVSTSNDIK

SEQ ID NO: 1734267 - protein, 20 aa, Staphylococcus epidermidis
NTPDATEEEKQEATNRVNAG

SEQ ID NO: 1734268 - protein, 21 aa, Staphylococcus epidermidis
NTPDATEEEKQEATNRVNAGL

SEQ ID NO: 1734269 - protein, 12 aa, Staphylococcus epidermidis
NTPDFDKNGITF

SEQ ID NO: 1734270 - protein, 6 aa, Staphylococcus epidermidis
NTPKNA

SEQ ID NO: 1734271 - protein, 21 aa, Staphylococcus epidermidis
NTQNESNYNNAKNEMKKFSSS

SEQ ID NO: 1734272 - protein, 6 aa, Staphylococcus epidermidis
NTQRDQ

SEQ ID NO: 1734273 - protein, 7 aa, Staphylococcus epidermidis
NTSELKN

SEQ ID NO: 1734274 - protein, 10 aa, Staphylococcus epidermidis
NTTNPKADIP

SEQ ID NO: 1734275 - protein, 9 aa, Staphylococcus epidermidis
NTTRQTVSK

SEQ ID NO: 1734276 - protein, 6 aa, Staphylococcus epidermidis
NTVGGV

SEQ ID NO: 1734277 - protein, 10 aa, Staphylococcus epidermidis
NTYKSPMGSY

SEQ ID NO: 1734278 - protein, 33 aa, Staphylococcus epidermidis
NTYQDINTNNDGSALQIDKEKNKKAIQEFFDDN

SEQ ID NO: 1734279 - protein, 9 aa, Staphylococcus epidermidis
NTYTPLPAT

SEQ ID NO: 1734280 - protein, 23 aa, Staphylococcus epidermidis
NVASSENSKSNEPKPLSKPMTAK

SEQ ID NO: 1734281 - protein, 29 aa, Staphylococcus epidermidis
NVDQPINSDSVEISGGFNGKKGVKEAKQI

SEQ ID NO: 1734282 - protein, 26 aa, Staphylococcus epidermidis
NVEPNAIQKDEAKQAIQDKKNAQNNI

SEQ ID NO: 1734283 - protein, 7 aa, Staphylococcus epidermidis
NVGGDLS

SEQ ID NO: 1734284 - protein, 23 aa, Staphylococcus epidermidis
NVGGNTENSSDFNQIRTDNTSTT

SEQ ID NO: 1734285 - protein, 10 aa, Staphylococcus epidermidis
NVKKSGKTSK

SEQ ID NO: 1734286 - protein, 23 aa, Staphylococcus epidermidis
NVNNEQKNPEPVTTQNSVDKSKL

SEQ ID NO: 1734287 - protein, 16 aa, Staphylococcus epidermidis
NVNVKGNNNVSTSKIK

SEQ ID NO: 1734288 - protein, 8 aa, Staphylococcus epidermidis
NVPNTTIT

SEQ ID NO: 1734289 - protein, 10 aa, Staphylococcus epidermidis
NVPQRQTVKD

SEQ ID NO: 1734290 - protein, 7 aa, Staphylococcus epidermidis
NVPSSQI

SEQ ID NO: 1734291 - protein, 20 aa, Staphylococcus epidermidis
NVSNPYESHQINDDKDTAIA

SEQ ID NO: 1734292 - protein, 12 aa, Staphylococcus epidermidis
NVSSNAERQAYS

SEQ ID NO: 1734293 - protein, 9 aa, Staphylococcus epidermidis
NVTQSVNQN

SEQ ID NO: 1734294 - protein, 6 aa, Staphylococcus epidermidis
NYAASS

SEQ ID NO: 1734295 - protein, 7 aa, Staphylococcus epidermidis
NYAQSSN

SEQ ID NO: 1734296 - protein, 5 aa, Staphylococcus epidermidis
NYEED

SEQ ID NO: 1734297 - protein, 6 aa, Staphylococcus epidermidis
NYKAKK

SEQ ID NO: 1734298 - protein, 5 aa, Staphylococcus epidermidis
NYKGT

SEQ ID NO: 1734299 - protein, 5 aa, Staphylococcus epidermidis
NYKKA

SEQ ID NO: 1734300 - protein, 11 aa, Staphylococcus epidermidis
NYKNYSKSSDQ

SEQ ID NO: 1734301 - protein, 8 aa, Staphylococcus epidermidis
NYNKTYGS

SEQ ID NO: 1734302 - protein, 10 aa, Staphylococcus epidermidis
NYNTKPVPEQ

SEQ ID NO: 1734303 - protein, 5 aa, Staphylococcus epidermidis
NYPSA

SEQ ID NO: 1734304 - protein, 10 aa, Staphylococcus epidermidis
NYQATDEEVY

SEQ ID NO: 1734305 - protein, 5 aa, Staphylococcus epidermidis
NYSDI

SEQ ID NO: 1734306 - protein, 4 aa, Staphylococcus epidermidis
NYSG

SEQ ID NO: 1734307 - protein, 15 aa, Staphylococcus epidermidis
NYSKTKDEDGTQGDT

SEQ ID NO: 1734308 - protein, 6 aa, Staphylococcus epidermidis
PAANDV

SEQ ID NO: 1734309 - protein, 6 aa, Staphylococcus epidermidis
PAASAT

SEQ ID NO: 1734310 - protein, 10 aa, Staphylococcus epidermidis
PADKNSTYRY

SEQ ID NO: 1734311 - protein, 10 aa, Staphylococcus epidermidis
PADKRGTYSA

SEQ ID NO: 1734312 - protein, 8 aa, Staphylococcus epidermidis
PADKSNRY

SEQ ID NO: 1734313 - protein, 9 aa, Staphylococcus epidermidis
PAEKVGKTA

SEQ ID NO: 1734314 - protein, 14 aa, Staphylococcus epidermidis
PAFTESKLEDPIPA

SEQ ID NO: 1734315 - protein, 8 aa, Staphylococcus epidermidis
PAKAGQST

SEQ ID NO: 1734316 - protein, 12 aa, Staphylococcus epidermidis
PAKGKYKLSSNE

SEQ ID NO: 1734317 - protein, 13 aa, Staphylococcus epidermidis
PAKSGWNELRGGT

SEQ ID NO: 1734318 - protein, 5 aa, Staphylococcus epidermidis
PALNE

SEQ ID NO: 1734319 - protein, 10 aa, Staphylococcus epidermidis
PALTSEKTNA

SEQ ID NO: 1734320 - protein, 7 aa, Staphylococcus epidermidis
PANESRE

SEQ ID NO: 1734321 - protein, 10 aa, Staphylococcus epidermidis
PANGAAADLS

SEQ ID NO: 1734322 - protein, 10 aa, Staphylococcus epidermidis
PANGASADIS

SEQ ID NO: 1734323 - protein, 4 aa, Staphylococcus epidermidis
PASR

SEQ ID NO: 1734324 - protein, 12 aa, Staphylococcus epidermidis
PATGLDIETERT

SEQ ID NO: 1734325 - protein, 126 aa, Staphylococcus epidermidis
PATKVKQDARQTIEAKAQAQQEQINSNNKATTEEKEEALNKVNTHKQNALSNINNAHSNQEVQTAQQNGVNAINQDQPEALKKPQATSELNQNAQTKKQDINQTPDATDEEKLAANNQVDQALTDG

SEQ ID NO: 1734326 - protein, 12 aa, Staphylococcus epidermidis
PATQAVSQTTGI

SEQ ID NO: 1734327 - protein, 16 aa, Staphylococcus epidermidis
PATSVKSKAKKDIDQK

SEQ ID NO: 1734328 - protein, 7 aa, Staphylococcus epidermidis
PAVASGP

SEQ ID NO: 1734329 - protein, 40 aa, Staphylococcus epidermidis
PDAHKKSDAKQSIDDKYNEQSNTINTTPDATDEEKQKALD

SEQ ID NO: 1734330 - protein, 13 aa, Staphylococcus epidermidis
PDATEDEKQDAIN

SEQ ID NO: 1734331 - protein, 4 aa, Staphylococcus epidermidis
PDDR

SEQ ID NO: 1734332 - protein, 6 aa, Staphylococcus epidermidis
PDDTEF

SEQ ID NO: 1734333 - protein, 5 aa, Staphylococcus epidermidis
PDEEM

SEQ ID NO: 1734334 - protein, 4 aa, Staphylococcus epidermidis
PDFD

SEQ ID NO: 1734335 - protein, 8 aa, Staphylococcus epidermidis
PDFKTPSV

SEQ ID NO: 1734336 - protein, 7 aa, Staphylococcus epidermidis
PDGNTKI

SEQ ID NO: 1734337 - protein, 10 aa, Staphylococcus epidermidis
PDNKNTKELR

SEQ ID NO: 1734338 - protein, 15 aa, Staphylococcus epidermidis
PDRKPFELKDFFVKN

SEQ ID NO: 1734339 - protein, 6 aa, Staphylococcus epidermidis
PDSPTA

SEQ ID NO: 1734340 - protein, 11 aa, Staphylococcus epidermidis
PDSQSGNNTDL

SEQ ID NO: 1734341 - protein, 10 aa, Staphylococcus epidermidis
PDTGKSVSHS

SEQ ID NO: 1734342 - protein, 4 aa, Staphylococcus epidermidis
PEAL

SEQ ID NO: 1734343 - protein, 9 aa, Staphylococcus epidermidis
PEATRDEVE

SEQ ID NO: 1734344 - protein, 11 aa, Staphylococcus epidermidis
PEDGPNAQSTN

SEQ ID NO: 1734345 - protein, 16 aa, Staphylococcus epidermidis
PEDKSRIIEEQKEKFG

SEQ ID NO: 1734346 - protein, 7 aa, Staphylococcus epidermidis
PEDVQHQ

SEQ ID NO: 1734347 - protein, 5 aa, Staphylococcus epidermidis
PEEAF

SEQ ID NO: 1734348 - protein, 8 aa, Staphylococcus epidermidis
PEEAKPKF

SEQ ID NO: 1734349 - protein, 9 aa, Staphylococcus epidermidis
PEEHRSEGV

SEQ ID NO: 1734350 - protein, 13 aa, Staphylococcus epidermidis
PEETFEKKKEYAQ

SEQ ID NO: 1734351 - protein, 4 aa, Staphylococcus epidermidis
PEEV

SEQ ID NO: 1734352 - protein, 5 aa, Staphylococcus epidermidis
PEGYQ

SEQ ID NO: 1734353 - protein, 10 aa, Staphylococcus epidermidis
PEHRQGPALG

SEQ ID NO: 1734354 - protein, 12 aa, Staphylococcus epidermidis
PEISTSSRKFGS

SEQ ID NO: 1734355 - protein, 4 aa, Staphylococcus epidermidis
PEKL

SEQ ID NO: 1734356 - protein, 26 aa, Staphylococcus epidermidis
PEKMADNLKKQGSYVPGIRPGEQTKK

SEQ ID NO: 1734357 - protein, 12 aa, Staphylococcus epidermidis
PEKPNIKSIKLD

SEQ ID NO: 1734358 - protein, 5 aa, Staphylococcus epidermidis
PEKRG

SEQ ID NO: 1734359 - protein, 13 aa, Staphylococcus epidermidis
PELHKESNYRMPG

SEQ ID NO: 1734360 - protein, 14 aa, Staphylococcus epidermidis
PEMNAHGSSMTNTV

SEQ ID NO: 1734361 - protein, 7 aa, Staphylococcus epidermidis
PENIDGI

SEQ ID NO: 1734362 - protein, 8 aa, Staphylococcus epidermidis
PENIDGVD

SEQ ID NO: 1734363 - protein, 7 aa, Staphylococcus epidermidis
PEQKAEQ

SEQ ID NO: 1734364 - protein, 6 aa, Staphylococcus epidermidis
PEREEI

SEQ ID NO: 1734365 - protein, 8 aa, Staphylococcus epidermidis
PESPIKNA

SEQ ID NO: 1734366 - protein, 20 aa, Staphylococcus epidermidis
PETTVKQNAKQEIEQSAQNQ

SEQ ID NO: 1734367 - protein, 5 aa, Staphylococcus epidermidis
PEVQS

SEQ ID NO: 1734368 - protein, 5 aa, Staphylococcus epidermidis
PEVTE

SEQ ID NO: 1734369 - protein, 6 aa, Staphylococcus epidermidis
PFTTPE

SEQ ID NO: 1734370 - protein, 32 aa, Staphylococcus epidermidis
PGDPFSGQQGPNIKQEALDAQREKLGLNDSIP

SEQ ID NO: 1734371 - protein, 8 aa, Staphylococcus epidermidis
PGGTSSNV

SEQ ID NO: 1734372 - protein, 24 aa, Staphylococcus epidermidis
PGHGGSDQGASSNTPTKSLEKNYT

SEQ ID NO: 1734373 - protein, 5 aa, Staphylococcus epidermidis
PGIRG

SEQ ID NO: 1734374 - protein, 14 aa, Staphylococcus epidermidis
PGKPGGVNKEYAGQ

SEQ ID NO: 1734375 - protein, 54 aa, Staphylococcus epidermidis
PGQASAAELDSTQSNNPEGATLDETAQPSQDPNVNPQANNEIDQSNVNQATDNQ

SEQ ID NO: 1734376 - protein, 4 aa, Staphylococcus epidermidis
PGSE

SEQ ID NO: 1734377 - protein, 32 aa, Staphylococcus epidermidis
PGSGLDPDKLPKGDISKYQSSAQSAEQATTYG

SEQ ID NO: 1734378 - protein, 4 aa, Staphylococcus epidermidis
PGVS

SEQ ID NO: 1734379 - protein, 7 aa, Staphylococcus epidermidis
PGYKPQN

SEQ ID NO: 1734380 - protein, 10 aa, Staphylococcus epidermidis
PHANIDGKVG

SEQ ID NO: 1734381 - protein, 4 aa, Staphylococcus epidermidis
PHDV

SEQ ID NO: 1734382 - protein, 8 aa, Staphylococcus epidermidis
PHGNPEKV

SEQ ID NO: 1734383 - protein, 12 aa, Staphylococcus epidermidis
PHIGQTSTSHHD

SEQ ID NO: 1734384 - protein, 21 aa, Staphylococcus epidermidis
PIDPNSEEGRVNEKIKKQESN

SEQ ID NO: 1734385 - protein, 8 aa, Staphylococcus epidermidis
PIGDPNTF

SEQ ID NO: 1734386 - protein, 13 aa, Staphylococcus epidermidis
PIGKPPKKKKSKK

SEQ ID NO: 1734387 - protein, 9 aa, Staphylococcus epidermidis
PIKNQTKEI

SEQ ID NO: 1734388 - protein, 17 aa, Staphylococcus epidermidis
PIKYKNSGPLTWPIKKA

SEQ ID NO: 1734389 - protein, 7 aa, Staphylococcus epidermidis
PIQKQNL

SEQ ID NO: 1734390 - protein, 11 aa, Staphylococcus epidermidis
PISDASGRKKP

SEQ ID NO: 1734391 - protein, 15 aa, Staphylococcus epidermidis
PKAEFEKKNPINRGT

SEQ ID NO: 1734392 - protein, 9 aa, Staphylococcus epidermidis
PKDEGDVTI

SEQ ID NO: 1734393 - protein, 5 aa, Staphylococcus epidermidis
PKDHK

SEQ ID NO: 1734394 - protein, 10 aa, Staphylococcus epidermidis
PKDNSKYELK

SEQ ID NO: 1734395 - protein, 8 aa, Staphylococcus epidermidis
PKEKALSK

SEQ ID NO: 1734396 - protein, 6 aa, Staphylococcus epidermidis
PKFDND

SEQ ID NO: 1734397 - protein, 4 aa, Staphylococcus epidermidis
PKGI

SEQ ID NO: 1734398 - protein, 9 aa, Staphylococcus epidermidis
PKGKNMESR

SEQ ID NO: 1734399 - protein, 8 aa, Staphylococcus epidermidis
PKGTKFNE

SEQ ID NO: 1734400 - protein, 4 aa, Staphylococcus epidermidis
PKGV

SEQ ID NO: 1734401 - protein, 9 aa, Staphylococcus epidermidis
PKHGGPAVA

SEQ ID NO: 1734402 - protein, 10 aa, Staphylococcus epidermidis
PKHQTFTNPI

SEQ ID NO: 1734403 - protein, 14 aa, Staphylococcus epidermidis
PKKEIAPHSPSLTY

SEQ ID NO: 1734404 - protein, 9 aa, Staphylococcus epidermidis
PKKETTDGF

SEQ ID NO: 1734405 - protein, 5 aa, Staphylococcus epidermidis
PKKSY

SEQ ID NO: 1734406 - protein, 9 aa, Staphylococcus epidermidis
PKLTAKEEK

SEQ ID NO: 1734407 - protein, 10 aa, Staphylococcus epidermidis
PKNPGEHQYA

SEQ ID NO: 1734408 - protein, 5 aa, Staphylococcus epidermidis
PKNPP

SEQ ID NO: 1734409 - protein, 5 aa, Staphylococcus epidermidis
PKSGR

SEQ ID NO: 1734410 - protein, 5 aa, Staphylococcus epidermidis
PKTEH

SEQ ID NO: 1734411 - protein, 7 aa, Staphylococcus epidermidis
PKYEAST

SEQ ID NO: 1734412 - protein, 8 aa, Staphylococcus epidermidis
PLANSDKG

SEQ ID NO: 1734413 - protein, 14 aa, Staphylococcus epidermidis
PLEQGTQSNNKDTF

SEQ ID NO: 1734414 - protein, 12 aa, Staphylococcus epidermidis
PLNTKKLPNNVL

SEQ ID NO: 1734415 - protein, 4 aa, Staphylococcus epidermidis
PLPT

SEQ ID NO: 1734416 - protein, 12 aa, Staphylococcus epidermidis
PLPTTHEALNSR

SEQ ID NO: 1734417 - protein, 5 aa, Staphylococcus epidermidis
PLRKQ

SEQ ID NO: 1734418 - protein, 5 aa, Staphylococcus epidermidis
PLTSE

SEQ ID NO: 1734419 - protein, 5 aa, Staphylococcus epidermidis
PLVRQ

SEQ ID NO: 1734420 - protein, 6 aa, Staphylococcus epidermidis
PLVRQN

SEQ ID NO: 1734421 - protein, 13 aa, Staphylococcus epidermidis
PMAANNNQSLEDM

SEQ ID NO: 1734422 - protein, 5 aa, Staphylococcus epidermidis
PNDEA

SEQ ID NO: 1734423 - protein, 8 aa, Staphylococcus epidermidis
PNDESTKL

SEQ ID NO: 1734424 - protein, 4 aa, Staphylococcus epidermidis
PNDT

SEQ ID NO: 1734425 - protein, 6 aa, Staphylococcus epidermidis
PNDTEF

SEQ ID NO: 1734426 - protein, 13 aa, Staphylococcus epidermidis
PNERNVTDRQRQY

SEQ ID NO: 1734427 - protein, 23 aa, Staphylococcus epidermidis
PNGYDTEVGERGVKLSGGQKQRL

SEQ ID NO: 1734428 - protein, 13 aa, Staphylococcus epidermidis
PNHASADELNQNQ

SEQ ID NO: 1734429 - protein, 13 aa, Staphylococcus epidermidis
PNIPRAKANLKKE

SEQ ID NO: 1734430 - protein, 13 aa, Staphylococcus epidermidis
PNIPRAKANMKKE

SEQ ID NO: 1734431 - protein, 9 aa, Staphylococcus epidermidis
PNISSDLSG

SEQ ID NO: 1734432 - protein, 7 aa, Staphylococcus epidermidis
PNKTNTL

SEQ ID NO: 1734433 - protein, 39 aa, Staphylococcus epidermidis
PNLTNDQKAKEKELVNSKQTRTEVQEQLNQAKALDGSMG

SEQ ID NO: 1734434 - protein, 6 aa, Staphylococcus epidermidis
PNNEST

SEQ ID NO: 1734435 - protein, 15 aa, Staphylococcus epidermidis
PNNIADAGRKLRKGL

SEQ ID NO: 1734436 - protein, 15 aa, Staphylococcus epidermidis
PNNISDAGRKLRKGL

SEQ ID NO: 1734437 - protein, 17 aa, Staphylococcus epidermidis
PNNKTYQLGDDNKNVKT

SEQ ID NO: 1734438 - protein, 6 aa, Staphylococcus epidermidis
PNNNST

SEQ ID NO: 1734439 - protein, 11 aa, Staphylococcus epidermidis
PNTDKVANDLT

SEQ ID NO: 1734440 - protein, 12 aa, Staphylococcus epidermidis
PPERDAIEGGKE

SEQ ID NO: 1734441 - protein, 9 aa, Staphylococcus epidermidis
PPKSNNDVE

SEQ ID NO: 1734442 - protein, 12 aa, Staphylococcus epidermidis
PPNGAKSMSDEA

SEQ ID NO: 1734443 - protein, 6 aa, Staphylococcus epidermidis
PPNNTY

SEQ ID NO: 1734444 - protein, 4 aa, Staphylococcus epidermidis
PPNS

SEQ ID NO: 1734445 - protein, 9 aa, Staphylococcus epidermidis
PPNTDTSST

SEQ ID NO: 1734446 - protein, 14 aa, Staphylococcus epidermidis
PPRTPEREEEPPPL

SEQ ID NO: 1734447 - protein, 12 aa, Staphylococcus epidermidis
PPTQRNKTYGFR

SEQ ID NO: 1734448 - protein, 6 aa, Staphylococcus epidermidis
PQAKNQ

SEQ ID NO: 1734449 - protein, 6 aa, Staphylococcus epidermidis
PQAVEG

SEQ ID NO: 1734450 - protein, 4 aa, Staphylococcus epidermidis
PQLE

SEQ ID NO: 1734451 - protein, 15 aa, Staphylococcus epidermidis
PQTHNDQINSQYSND

SEQ ID NO: 1734452 - protein, 6 aa, Staphylococcus epidermidis
PQYERT

SEQ ID NO: 1734453 - protein, 6 aa, Staphylococcus epidermidis
PRDTRA

SEQ ID NO: 1734454 - protein, 17 aa, Staphylococcus epidermidis
PRDYEQRNVNNRETVTE

SEQ ID NO: 1734455 - protein, 4 aa, Staphylococcus epidermidis
PRIP

SEQ ID NO: 1734456 - protein, 20 aa, Staphylococcus epidermidis
PRKETTPGAPTIKADQTNAT

SEQ ID NO: 1734457 - protein, 18 aa, Staphylococcus epidermidis
PRLRRRHTKRQAHEKRGV

SEQ ID NO: 1734458 - protein, 10 aa, Staphylococcus epidermidis
PRMSSKEKRL

SEQ ID NO: 1734459 - protein, 14 aa, Staphylococcus epidermidis
PRTPSRNATNPPQQ

SEQ ID NO: 1734460 - protein, 24 aa, Staphylococcus epidermidis
PRYKSKKGWYKDKPPKEKGGMPTE

SEQ ID NO: 1734461 - protein, 24 aa, Staphylococcus epidermidis
PRYKSKKGWYKDTPPKEKGGMPTE

SEQ ID NO: 1734462 - protein, 13 aa, Staphylococcus epidermidis
PRYPKLGEKNYTE

SEQ ID NO: 1734463 - protein, 8 aa, Staphylococcus epidermidis
PSEEEPQF

SEQ ID NO: 1734464 - protein, 6 aa, Staphylococcus epidermidis
PSGVPA

SEQ ID NO: 1734465 - protein, 5 aa, Staphylococcus epidermidis
PSISD

SEQ ID NO: 1734466 - protein, 4 aa, Staphylococcus epidermidis
PSLS

SEQ ID NO: 1734467 - protein, 14 aa, Staphylococcus epidermidis
PSNDIDSKLNKDNS

SEQ ID NO: 1734468 - protein, 7 aa, Staphylococcus epidermidis
PSNIEEI

SEQ ID NO: 1734469 - protein, 6 aa, Staphylococcus epidermidis
PSNQSI

SEQ ID NO: 1734470 - protein, 15 aa, Staphylococcus epidermidis
PSPTTYVDGSESSIN

SEQ ID NO: 1734471 - protein, 8 aa, Staphylococcus epidermidis
PSSESQKI

SEQ ID NO: 1734472 - protein, 6 aa, Staphylococcus epidermidis
PSVALG

SEQ ID NO: 1734473 - protein, 4 aa, Staphylococcus epidermidis
PTFN

SEQ ID NO: 1734474 - protein, 6 aa, Staphylococcus epidermidis
PTFNTQ

SEQ ID NO: 1734475 - protein, 50 aa, Staphylococcus epidermidis
PTKGEPPHTIRNNNSPITSNQNSENKQVNLNNATESELKGVPGIGPTKAK

SEQ ID NO: 1734476 - protein, 7 aa, Staphylococcus epidermidis
PTKKNHY

SEQ ID NO: 1734477 - protein, 14 aa, Staphylococcus epidermidis
PTKPIQDDKLKKEI

SEQ ID NO: 1734478 - protein, 14 aa, Staphylococcus epidermidis
PTKPISDDKLKKEI

SEQ ID NO: 1734479 - protein, 14 aa, Staphylococcus epidermidis
PTKQIKDKKLKKEI

SEQ ID NO: 1734480 - protein, 8 aa, Staphylococcus epidermidis
PTKSHSDI

SEQ ID NO: 1734481 - protein, 18 aa, Staphylococcus epidermidis
PTLNPTVDKSDAIYRNKK

SEQ ID NO: 1734482 - protein, 7 aa, Staphylococcus epidermidis
PTSDEGR

SEQ ID NO: 1734483 - protein, 47 aa, Staphylococcus epidermidis
PTSFDAGSESEASGGAQAGGEEGEGAQASNPTVNNPSGGKDGDTSKY

SEQ ID NO: 1734484 - protein, 10 aa, Staphylococcus epidermidis
PTTALDIDNT

SEQ ID NO: 1734485 - protein, 9 aa, Staphylococcus epidermidis
PTTQETKSK

SEQ ID NO: 1734486 - protein, 23 aa, Staphylococcus epidermidis
PTVAKKQNAINELTQKASEQKTL

SEQ ID NO: 1734487 - protein, 16 aa, Staphylococcus epidermidis
PTVKETPNAKKWATEQ

SEQ ID NO: 1734488 - protein, 18 aa, Staphylococcus epidermidis
PTVKETPNARKWANEQLD

SEQ ID NO: 1734489 - protein, 4 aa, Staphylococcus epidermidis
PVAG

SEQ ID NO: 1734490 - protein, 5 aa, Staphylococcus epidermidis
PVDRN

SEQ ID NO: 1734491 - protein, 12 aa, Staphylococcus epidermidis
PVFSDGAAGAKL

SEQ ID NO: 1734492 - protein, 13 aa, Staphylococcus epidermidis
PVGKPPKKKKTNK

SEQ ID NO: 1734493 - protein, 6 aa, Staphylococcus epidermidis
PVKDGG

SEQ ID NO: 1734494 - protein, 10 aa, Staphylococcus epidermidis
PVKKQSAIDE

SEQ ID NO: 1734495 - protein, 20 aa, Staphylococcus epidermidis
PVKQQSTSKAEVQRKGQVLE

SEQ ID NO: 1734496 - protein, 12 aa, Staphylococcus epidermidis
PVKSDAKSGNSI

SEQ ID NO: 1734497 - protein, 34 aa, Staphylococcus epidermidis
PVKTPTPNKVPLPKPQKTSEHKVEYDKKAKYNKE

SEQ ID NO: 1734498 - protein, 7 aa, Staphylococcus epidermidis
PVNGKPF

SEQ ID NO: 1734499 - protein, 16 aa, Staphylococcus epidermidis
PVNPGNSGGAVVDKDG

SEQ ID NO: 1734500 - protein, 10 aa, Staphylococcus epidermidis
PVSIGDTYST

SEQ ID NO: 1734501 - protein, 5 aa, Staphylococcus epidermidis
PVTGT

SEQ ID NO: 1734502 - protein, 31 aa, Staphylococcus epidermidis
PYGGSSGAESETDQNVTKSTQQESEAKEELQ

SEQ ID NO: 1734503 - protein, 12 aa, Staphylococcus epidermidis
PYGKEGLQALSG

SEQ ID NO: 1734504 - protein, 19 aa, Staphylococcus epidermidis
PYGYTPYDDNGNLKSNEEF

SEQ ID NO: 1734505 - protein, 13 aa, Staphylococcus epidermidis
PYGYTPYDEHGKI

SEQ ID NO: 1734506 - protein, 10 aa, Staphylococcus epidermidis
PYPSEKAKFA

SEQ ID NO: 1734507 - protein, 11 aa, Staphylococcus epidermidis
PYPSEQAKHVR

SEQ ID NO: 1734508 - protein, 7 aa, Staphylococcus epidermidis
PYTTEDK

SEQ ID NO: 1734509 - protein, 13 aa, Staphylococcus epidermidis
QAAITGESVPVEK

SEQ ID NO: 1734510 - protein, 21 aa, Staphylococcus epidermidis
QAAKEKKSKLTNGSKETQLTE

SEQ ID NO: 1734511 - protein, 8 aa, Staphylococcus epidermidis
QAATQAGG

SEQ ID NO: 1734512 - protein, 9 aa, Staphylococcus epidermidis
QADKVKEAV

SEQ ID NO: 1734513 - protein, 14 aa, Staphylococcus epidermidis
QADNSNASNPLKGK

SEQ ID NO: 1734514 - protein, 11 aa, Staphylococcus epidermidis
QADSDDDNAYD

SEQ ID NO: 1734515 - protein, 14 aa, Staphylococcus epidermidis
QAFHTGKQSEGASD

SEQ ID NO: 1734516 - protein, 44 aa, Staphylococcus epidermidis
QAHPQTKETGRHRLNEKANQQQSTIATHPNSTIEERQEASAKLQ

SEQ ID NO: 1734517 - protein, 7 aa, Staphylococcus epidermidis
QAHRPQF

SEQ ID NO: 1734518 - protein, 11 aa, Staphylococcus epidermidis
QAKHPEDVSGN

SEQ ID NO: 1734519 - protein, 92 aa, Staphylococcus epidermidis
QAKYNKKSKKANREDQMQENDYQDNDDYSYGYDDGYNNYQEPIEPQVDPKELKAQRKREKAEIRAKKKEKKKAYNKRMKEKRKNQPSAVNQR

SEQ ID NO: 1734520 - protein, 15 aa, Staphylococcus epidermidis
QAKYNKKSKNTDFED

SEQ ID NO: 1734521 - protein, 21 aa, Staphylococcus epidermidis
QALPVQASSNYINSDEDLKQQ

SEQ ID NO: 1734522 - protein, 8 aa, Staphylococcus epidermidis
QANEISRQ

SEQ ID NO: 1734523 - protein, 8 aa, Staphylococcus epidermidis
QANNALPK

SEQ ID NO: 1734524 - protein, 9 aa, Staphylococcus epidermidis
QANSFDDLK

SEQ ID NO: 1734525 - protein, 7 aa, Staphylococcus epidermidis
QAPPNLK

SEQ ID NO: 1734526 - protein, 293 aa, Staphylococcus epidermidis
QAQAAEDTHQNVDKPTQTQELTQSVQKENQSTEASESSTEKTQVQSPNQQAQVTTKHNDEQMKEASNQNLNEADNPKQIDSKKEEPATHQDAVPSKKTDDATHQKEPSTNHQSQEPPENEYSVQKNVSDNTESNKNNQDSQTQQATNSGKNTYSKEPEQSQDTTQQKAKEQESQNDSKKKEKQVDKGEKQPSQNLQQSAENNESKVDKPKKGEQIQTKSSNTNHNSLNQNKEKEKHQQTIQSTNNKEEIPKPSKQTTKANKKSASQSSQSSQSLQSKQSNKLPKKAAQAQYKN

SEQ ID NO: 1734527 - protein, 4 aa, Staphylococcus epidermidis
QAQD

SEQ ID NO: 1734528 - protein, 21 aa, Staphylococcus epidermidis
QAQRSNLETKVQNSNSRPEVQ

SEQ ID NO: 1734529 - protein, 8 aa, Staphylococcus epidermidis
QAQTKQHV

SEQ ID NO: 1734530 - protein, 6 aa, Staphylococcus epidermidis
QARSHV

SEQ ID NO: 1734531 - protein, 10 aa, Staphylococcus epidermidis
QASHTTRLDE

SEQ ID NO: 1734532 - protein, 21 aa, Staphylococcus epidermidis
QATGRGATLLSGKGAYQQNNT

SEQ ID NO: 1734533 - protein, 12 aa, Staphylococcus epidermidis
QATQGAEAFNKA

SEQ ID NO: 1734534 - protein, 8 aa, Staphylococcus epidermidis
QATQPESD

SEQ ID NO: 1734535 - protein, 9 aa, Staphylococcus epidermidis
QATQPESDI

SEQ ID NO: 1734536 - protein, 26 aa, Staphylococcus epidermidis
QAVDAKDAPIQKAIKSKNRSELESIN

SEQ ID NO: 1734537 - protein, 17 aa, Staphylococcus epidermidis
QAVNKAKNIINDQPTPV

SEQ ID NO: 1734538 - protein, 9 aa, Staphylococcus epidermidis
QAYSRSVEK

SEQ ID NO: 1734539 - protein, 16 aa, Staphylococcus epidermidis
QDDNTKSTPSKNSKQI

SEQ ID NO: 1734540 - protein, 5 aa, Staphylococcus epidermidis
QDDTS

SEQ ID NO: 1734541 - protein, 85 aa, Staphylococcus epidermidis
QDEEPSQEDTSSTSDHDVSSKDETKQQEIDNDKYQSKKPNKSDDAIATSDYKEDASSVNKETDTNHNDKLRDHSTYTEDRHSSVV

SEQ ID NO: 1734542 - protein, 7 aa, Staphylococcus epidermidis
QDEIDNG

SEQ ID NO: 1734543 - protein, 7 aa, Staphylococcus epidermidis
QDELDNY

SEQ ID NO: 1734544 - protein, 22 aa, Staphylococcus epidermidis
QDENGKVSQEYKTLTKDDLPEG

SEQ ID NO: 1734545 - protein, 9 aa, Staphylococcus epidermidis
QDGEKQTTL

SEQ ID NO: 1734546 - protein, 9 aa, Staphylococcus epidermidis
QDGQQQTTL

SEQ ID NO: 1734547 - protein, 13 aa, Staphylococcus epidermidis
QDILSKGKERIDT

SEQ ID NO: 1734548 - protein, 16 aa, Staphylococcus epidermidis
QDKTTEYARKTKRSVD

SEQ ID NO: 1734549 - protein, 15 aa, Staphylococcus epidermidis
QDKTTEYARKTRRSV

SEQ ID NO: 1734550 - protein, 11 aa, Staphylococcus epidermidis
QDMQGTVGATQ

SEQ ID NO: 1734551 - protein, 5 aa, Staphylococcus epidermidis
QDNDD

SEQ ID NO: 1734552 - protein, 5 aa, Staphylococcus epidermidis
QDNDN

SEQ ID NO: 1734553 - protein, 6 aa, Staphylococcus epidermidis
QDNEID

SEQ ID NO: 1734554 - protein, 10 aa, Staphylococcus epidermidis
QDNGQGIPAD

SEQ ID NO: 1734555 - protein, 15 aa, Staphylococcus epidermidis
QDTIESNSSSVPNSV

SEQ ID NO: 1734556 - protein, 12 aa, Staphylococcus epidermidis
QDVSMEEIRHHD

SEQ ID NO: 1734557 - protein, 9 aa, Staphylococcus epidermidis
QEADDQRKK

SEQ ID NO: 1734558 - protein, 77 aa, Staphylococcus epidermidis
QEAKADENSGNQNDNVSTNQNVQNKDQSTQQVQNQPKNTSATQNSNTQNNQPTTVQDQNAQANNTKSDSSQSAGLSE

SEQ ID NO: 1734559 - protein, 9 aa, Staphylococcus epidermidis
QEASANMGN

SEQ ID NO: 1734560 - protein, 13 aa, Staphylococcus epidermidis
QEASIANNNIQEA

SEQ ID NO: 1734561 - protein, 15 aa, Staphylococcus epidermidis
QEDGISSKVKSNYFK

SEQ ID NO: 1734562 - protein, 7 aa, Staphylococcus epidermidis
QEDKIAK

SEQ ID NO: 1734563 - protein, 8 aa, Staphylococcus epidermidis
QEDKIAKS

SEQ ID NO: 1734564 - protein, 6 aa, Staphylococcus epidermidis
QEEGRN

SEQ ID NO: 1734565 - protein, 34 aa, Staphylococcus epidermidis
QEEIHQQRDDKSYKQNNQMSKSKDDDNKIGEESL

SEQ ID NO: 1734566 - protein, 9 aa, Staphylococcus epidermidis
QEESSPKNM

SEQ ID NO: 1734567 - protein, 4 aa, Staphylococcus epidermidis
QEFN

SEQ ID NO: 1734568 - protein, 5 aa, Staphylococcus epidermidis
QEGDV

SEQ ID NO: 1734569 - protein, 8 aa, Staphylococcus epidermidis
QEGVNPTI

SEQ ID NO: 1734570 - protein, 16 aa, Staphylococcus epidermidis
QEIAARKNGERSTSER

SEQ ID NO: 1734571 - protein, 6 aa, Staphylococcus epidermidis
QELETA

SEQ ID NO: 1734572 - protein, 15 aa, Staphylococcus epidermidis
QEMHRGKKYGKKKRS

SEQ ID NO: 1734573 - protein, 17 aa, Staphylococcus epidermidis
QEMPDLSGKTEKEAEQI

SEQ ID NO: 1734574 - protein, 7 aa, Staphylococcus epidermidis
QEMTNEI

SEQ ID NO: 1734575 - protein, 9 aa, Staphylococcus epidermidis
QENDDQRKR

SEQ ID NO: 1734576 - protein, 8 aa, Staphylococcus epidermidis
QENGGKHI

SEQ ID NO: 1734577 - protein, 4 aa, Staphylococcus epidermidis
QENV

SEQ ID NO: 1734578 - protein, 8 aa, Staphylococcus epidermidis
QERNRIGQ

SEQ ID NO: 1734579 - protein, 6 aa, Staphylococcus epidermidis
QERQCP

SEQ ID NO: 1734580 - protein, 6 aa, Staphylococcus epidermidis
QETALK

SEQ ID NO: 1734581 - protein, 15 aa, Staphylococcus epidermidis
QETENSIKEDAKRIS

SEQ ID NO: 1734582 - protein, 6 aa, Staphylococcus epidermidis
QETLAQ

SEQ ID NO: 1734583 - protein, 17 aa, Staphylococcus epidermidis
QETNESRQSTEDDEEFP

SEQ ID NO: 1734584 - protein, 10 aa, Staphylococcus epidermidis
QETSNRKISL

SEQ ID NO: 1734585 - protein, 8 aa, Staphylococcus epidermidis
QEVASTSY

SEQ ID NO: 1734586 - protein, 4 aa, Staphylococcus epidermidis
QFNE

SEQ ID NO: 1734587 - protein, 8 aa, Staphylococcus epidermidis
QFNTTRSG

SEQ ID NO: 1734588 - protein, 6 aa, Staphylococcus epidermidis
QGATPY

SEQ ID NO: 1734589 - protein, 5 aa, Staphylococcus epidermidis
QGDYT

SEQ ID NO: 1734590 - protein, 6 aa, Staphylococcus epidermidis
QGEATI

SEQ ID NO: 1734591 - protein, 6 aa, Staphylococcus epidermidis
QGIDKN

SEQ ID NO: 1734592 - protein, 5 aa, Staphylococcus epidermidis
QGISE

SEQ ID NO: 1734593 - protein, 10 aa, Staphylococcus epidermidis
QGKDMSNSVL

SEQ ID NO: 1734594 - protein, 22 aa, Staphylococcus epidermidis
QGKIKAGEPMAKTGNSGQWTTG

SEQ ID NO: 1734595 - protein, 6 aa, Staphylococcus epidermidis
QGKRDL

SEQ ID NO: 1734596 - protein, 17 aa, Staphylococcus epidermidis
QGLGPKALTKTNSNGVP

SEQ ID NO: 1734597 - protein, 11 aa, Staphylococcus epidermidis
QGLKSNRTDVE

SEQ ID NO: 1734598 - protein, 6 aa, Staphylococcus epidermidis
QGLRKD

SEQ ID NO: 1734599 - protein, 4 aa, Staphylococcus epidermidis
QGND

SEQ ID NO: 1734600 - protein, 6 aa, Staphylococcus epidermidis
QGNLDE

SEQ ID NO: 1734601 - protein, 4 aa, Staphylococcus epidermidis
QGPL

SEQ ID NO: 1734602 - protein, 5 aa, Staphylococcus epidermidis
QGQQG

SEQ ID NO: 1734603 - protein, 8 aa, Staphylococcus epidermidis
QGSKPYKL

SEQ ID NO: 1734604 - protein, 4 aa, Staphylococcus epidermidis
QGSN

SEQ ID NO: 1734605 - protein, 6 aa, Staphylococcus epidermidis
QGSQYK

SEQ ID NO: 1734606 - protein, 8 aa, Staphylococcus epidermidis
QGTPNITP

SEQ ID NO: 1734607 - protein, 9 aa, Staphylococcus epidermidis
QGTPTNTIG

SEQ ID NO: 1734608 - protein, 4 aa, Staphylococcus epidermidis
QGTR

SEQ ID NO: 1734609 - protein, 6 aa, Staphylococcus epidermidis
QGYGAT

SEQ ID NO: 1734610 - protein, 6 aa, Staphylococcus epidermidis
QHGSQE

SEQ ID NO: 1734611 - protein, 28 aa, Staphylococcus epidermidis
QHNQKGTTQNYKDKQNSEQNDQSVFALV

SEQ ID NO: 1734612 - protein, 9 aa, Staphylococcus epidermidis
QHNYTQEEL

SEQ ID NO: 1734613 - protein, 5 aa, Staphylococcus epidermidis
QHPQS

SEQ ID NO: 1734614 - protein, 53 aa, Staphylococcus epidermidis
QHQESQQRANSNRAIQSKNEREYENHPERYYNGRDYRREQQLEEENEKSSKTK

SEQ ID NO: 1734615 - protein, 20 aa, Staphylococcus epidermidis
QHRSNERYDEHVDKGRDNDR

SEQ ID NO: 1734616 - protein, 9 aa, Staphylococcus epidermidis
QHTPKTRKL

SEQ ID NO: 1734617 - protein, 14 aa, Staphylococcus epidermidis
QIAHAENNKQVDDI

SEQ ID NO: 1734618 - protein, 20 aa, Staphylococcus epidermidis
QIKQDDKRLKQRKIDIKRRY

SEQ ID NO: 1734619 - protein, 10 aa, Staphylococcus epidermidis
QIKQDNQNIQ

SEQ ID NO: 1734620 - protein, 26 aa, Staphylococcus epidermidis
QINTAKNDLHGAEKLQRDKGTANQEI

SEQ ID NO: 1734621 - protein, 27 aa, Staphylococcus epidermidis
QISYKTNAPFRGDGSQKTGNNSVNTQT

SEQ ID NO: 1734622 - protein, 33 aa, Staphylococcus epidermidis
QITARSKDFSSYAKDHSSLSTSDSDKTLEGDID

SEQ ID NO: 1734623 - protein, 12 aa, Staphylococcus epidermidis
QIVGQNGQSYAQ

SEQ ID NO: 1734624 - protein, 22 aa, Staphylococcus epidermidis
QKAEEVKRTKDALDGNHRLEEA

SEQ ID NO: 1734625 - protein, 6 aa, Staphylococcus epidermidis
QKASSV

SEQ ID NO: 1734626 - protein, 9 aa, Staphylococcus epidermidis
QKDKTNEVS

SEQ ID NO: 1734627 - protein, 8 aa, Staphylococcus epidermidis
QKEKESKM

SEQ ID NO: 1734628 - protein, 6 aa, Staphylococcus epidermidis
QKEKVV

SEQ ID NO: 1734629 - protein, 12 aa, Staphylococcus epidermidis
QKELSESSDSKD

SEQ ID NO: 1734630 - protein, 14 aa, Staphylococcus epidermidis
QKEQQYKTKHTDIT

SEQ ID NO: 1734631 - protein, 7 aa, Staphylococcus epidermidis
QKGIYDR

SEQ ID NO: 1734632 - protein, 9 aa, Staphylococcus epidermidis
QKHEEAKLK

SEQ ID NO: 1734633 - protein, 5 aa, Staphylococcus epidermidis
QKHTG

SEQ ID NO: 1734634 - protein, 5 aa, Staphylococcus epidermidis
QKIAN

SEQ ID NO: 1734635 - protein, 18 aa, Staphylococcus epidermidis
QKIKNAGAIGITQNGQHY

SEQ ID NO: 1734636 - protein, 4 aa, Staphylococcus epidermidis
QKKE

SEQ ID NO: 1734637 - protein, 19 aa, Staphylococcus epidermidis
QKKPQAKQALSAKATEKLN

SEQ ID NO: 1734638 - protein, 12 aa, Staphylococcus epidermidis
QKKPYNTPGVKV

SEQ ID NO: 1734639 - protein, 15 aa, Staphylococcus epidermidis
QKMPGDGGDTPHQDM

SEQ ID NO: 1734640 - protein, 108 aa, Staphylococcus epidermidis
QKPSNDSTYQTQSKAKQDSSKQLPQEKTTKRQIQTTENEQTTKVDSKKANDTQNVEQHTQEPKNDTSTSQKNHHQVATKEQSNRSTTRETQKQSANANQNHQSTHQAQ

SEQ ID NO: 1734641 - protein, 108 aa, Staphylococcus epidermidis
QKPSNDSTYQTQSKTKQDSSKQLPQEKTTKRQIQTTENEQTTKADSKKANDTQNVEKHTQEPKNDTSTSQKNHHQVATKEQSNRSTTRETQKQSANANQNHQSTHQAQ

SEQ ID NO: 1734642 - protein, 108 aa, Staphylococcus epidermidis
QKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQSTHQAQ

SEQ ID NO: 1734643 - protein, 108 aa, Staphylococcus epidermidis
QKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQ

SEQ ID NO: 1734644 - protein, 33 aa, Staphylococcus epidermidis
QKPTARKAISDKASQLNNSINNTPYATEEERQI

SEQ ID NO: 1734645 - protein, 4 aa, Staphylococcus epidermidis
QKQI

SEQ ID NO: 1734646 - protein, 6 aa, Staphylococcus epidermidis
QKRTQL

SEQ ID NO: 1734647 - protein, 8 aa, Staphylococcus epidermidis
QKSKKGLT

SEQ ID NO: 1734648 - protein, 56 aa, Staphylococcus epidermidis
QKSPQDNTHLTEEEVKEPSSVESSNSSIDTAQQPSHTTINREESVQTSDNVEDSHV

SEQ ID NO: 1734649 - protein, 56 aa, Staphylococcus epidermidis
QKTPQDNTHLTEEEVKESSSVESSNSSIDTAQQPSHTTINREESVQTSDNVEDSHV

SEQ ID NO: 1734650 - protein, 36 aa, Staphylococcus epidermidis
QKTTTPSKLTQEDGDYATTVSGKVTDKDVGGKSREV

SEQ ID NO: 1734651 - protein, 15 aa, Staphylococcus epidermidis
QKTYTISGDKSADIT

SEQ ID NO: 1734652 - protein, 9 aa, Staphylococcus epidermidis
QKVQQKSDS

SEQ ID NO: 1734653 - protein, 6 aa, Staphylococcus epidermidis
QKYDKK

SEQ ID NO: 1734654 - protein, 7 aa, Staphylococcus epidermidis
QKYHMNG

SEQ ID NO: 1734655 - protein, 21 aa, Staphylococcus epidermidis
QLAKEKGEIKPPSDTTSQKYE

SEQ ID NO: 1734656 - protein, 21 aa, Staphylococcus epidermidis
QLEPKKVNTKISKNKSQTSYQ

SEQ ID NO: 1734657 - protein, 93 aa, Staphylococcus epidermidis
QLGDTTSKPQPLENEVTKSSNSEISTQTPTTNTTQSENTSNTKETDSHITSEKPKQITDNTNAQTTASSSTTNKQKVHTRVRRSATSPITSEG

SEQ ID NO: 1734658 - protein, 9 aa, Staphylococcus epidermidis
QLKKSPNHK

SEQ ID NO: 1734659 - protein, 5 aa, Staphylococcus epidermidis
QLNDE

SEQ ID NO: 1734660 - protein, 11 aa, Staphylococcus epidermidis
QLNETNGKQWD

SEQ ID NO: 1734661 - protein, 26 aa, Staphylococcus epidermidis
QLNSEESKNLPTAESVRSALANDSNI

SEQ ID NO: 1734662 - protein, 17 aa, Staphylococcus epidermidis
QLQTNQAELRQENNDYK

SEQ ID NO: 1734663 - protein, 5 aa, Staphylococcus epidermidis
QLRDK

SEQ ID NO: 1734664 - protein, 19 aa, Staphylococcus epidermidis
QLSNKAANVLKDKAQVKKG

SEQ ID NO: 1734665 - protein, 11 aa, Staphylococcus epidermidis
QLSPEKQASQI

SEQ ID NO: 1734666 - protein, 16 aa, Staphylococcus epidermidis
QMGRDTKFTASESAEA

SEQ ID NO: 1734667 - protein, 5 aa, Staphylococcus epidermidis
QMKGK

SEQ ID NO: 1734668 - protein, 28 aa, Staphylococcus epidermidis
QMTDGDAVGKESNNPLLPPVDTGEAIGL

SEQ ID NO: 1734669 - protein, 12 aa, Staphylococcus epidermidis
QMTKSSHDPSKR

SEQ ID NO: 1734670 - protein, 6 aa, Staphylococcus epidermidis
QNALDN

SEQ ID NO: 1734671 - protein, 7 aa, Staphylococcus epidermidis
QNANTVQ

SEQ ID NO: 1734672 - protein, 5 aa, Staphylococcus epidermidis
QNAPL

SEQ ID NO: 1734673 - protein, 9 aa, Staphylococcus epidermidis
QNDKEPSHM

SEQ ID NO: 1734674 - protein, 7 aa, Staphylococcus epidermidis
QNEDQKS

SEQ ID NO: 1734675 - protein, 8 aa, Staphylococcus epidermidis
QNEPERDQ

SEQ ID NO: 1734676 - protein, 9 aa, Staphylococcus epidermidis
QNEQGTWQA

SEQ ID NO: 1734677 - protein, 6 aa, Staphylococcus epidermidis
QNEQGV

SEQ ID NO: 1734678 - protein, 6 aa, Staphylococcus epidermidis
QNESKA

SEQ ID NO: 1734679 - protein, 9 aa, Staphylococcus epidermidis
QNGEPRVNS

SEQ ID NO: 1734680 - protein, 32 aa, Staphylococcus epidermidis
QNHQSDLQKAHDDYKKTLDERIATNETSIKQY

SEQ ID NO: 1734681 - protein, 48 aa, Staphylococcus epidermidis
QNIDTSGKTPSSIKKYNEAKSRIQSQIDSAKNEANSVLTNDNPQVSQV

SEQ ID NO: 1734682 - protein, 12 aa, Staphylococcus epidermidis
QNKAKQNKVNLW

SEQ ID NO: 1734683 - protein, 6 aa, Staphylococcus epidermidis
QNKERI

SEQ ID NO: 1734684 - protein, 5 aa, Staphylococcus epidermidis
QNKGV

SEQ ID NO: 1734685 - protein, 6 aa, Staphylococcus epidermidis
QNKGVD

SEQ ID NO: 1734686 - protein, 14 aa, Staphylococcus epidermidis
QNKSKKGSKKRSKT

SEQ ID NO: 1734687 - protein, 13 aa, Staphylococcus epidermidis
QNLDPLQSPNSQH

SEQ ID NO: 1734688 - protein, 23 aa, Staphylococcus epidermidis
QNLHGENKLRQAQETAKNEIQNL

SEQ ID NO: 1734689 - protein, 12 aa, Staphylococcus epidermidis
QNLQTAQQLDNA

SEQ ID NO: 1734690 - protein, 9 aa, Staphylococcus epidermidis
QNMTNENYN

SEQ ID NO: 1734691 - protein, 19 aa, Staphylococcus epidermidis
QNNANLSIEDQNRVKSSLS

SEQ ID NO: 1734692 - protein, 5 aa, Staphylococcus epidermidis
QNNED

SEQ ID NO: 1734693 - protein, 8 aa, Staphylococcus epidermidis
QNNEEYQK

SEQ ID NO: 1734694 - protein, 5 aa, Staphylococcus epidermidis
QNNVP

SEQ ID NO: 1734695 - protein, 5 aa, Staphylococcus epidermidis
QNPEL

SEQ ID NO: 1734696 - protein, 5 aa, Staphylococcus epidermidis
QNPQI

SEQ ID NO: 1734697 - protein, 13 aa, Staphylococcus epidermidis
QNQASKNTRLDET

SEQ ID NO: 1734698 - protein, 10 aa, Staphylococcus epidermidis
QNQDNQTKAA

SEQ ID NO: 1734699 - protein, 7 aa, Staphylococcus epidermidis
QNRANTF

SEQ ID NO: 1734700 - protein, 40 aa, Staphylococcus epidermidis
QNRTAKTTVKIKRDGQTKSVDLQPKKVERKITKTKTQTTY

SEQ ID NO: 1734701 - protein, 7 aa, Staphylococcus epidermidis
QNSELTF

SEQ ID NO: 1734702 - protein, 10 aa, Staphylococcus epidermidis
QNTPEKLNGF

SEQ ID NO: 1734703 - protein, 8 aa, Staphylococcus epidermidis
QNTTYGIG

SEQ ID NO: 1734704 - protein, 12 aa, Staphylococcus epidermidis
QNTYEQSTTLKQ

SEQ ID NO: 1734705 - protein, 8 aa, Staphylococcus epidermidis
QNTYTQKH

SEQ ID NO: 1734706 - protein, 16 aa, Staphylococcus epidermidis
QNYNAKRQKAEQAIQK

SEQ ID NO: 1734707 - protein, 8 aa, Staphylococcus epidermidis
QNYSIGPN

SEQ ID NO: 1734708 - protein, 42 aa, Staphylococcus epidermidis
QPATTIKSDAKTAIDQKAQQQSTIIDGNNDATDEEKTEAKNL

SEQ ID NO: 1734709 - protein, 4 aa, Staphylococcus epidermidis
QPES

SEQ ID NO: 1734710 - protein, 21 aa, Staphylococcus epidermidis
QPESEVTASETKGNSDASQEI

SEQ ID NO: 1734711 - protein, 20 aa, Staphylococcus epidermidis
QPGEWKNQDLGTGAGNDSVE

SEQ ID NO: 1734712 - protein, 5 aa, Staphylococcus epidermidis
QPGTF

SEQ ID NO: 1734713 - protein, 8 aa, Staphylococcus epidermidis
QPKENNSV

SEQ ID NO: 1734714 - protein, 8 aa, Staphylococcus epidermidis
QPKNYQTQ

SEQ ID NO: 1734715 - protein, 10 aa, Staphylococcus epidermidis
QPLSNNDALK

SEQ ID NO: 1734716 - protein, 4 aa, Staphylococcus epidermidis
QPLT

SEQ ID NO: 1734717 - protein, 7 aa, Staphylococcus epidermidis
QPPTPEL

SEQ ID NO: 1734718 - protein, 7 aa, Staphylococcus epidermidis
QPRTPQG

SEQ ID NO: 1734719 - protein, 4 aa, Staphylococcus epidermidis
QPSL

SEQ ID NO: 1734720 - protein, 15 aa, Staphylococcus epidermidis
QPTDLNNKKPATINA

SEQ ID NO: 1734721 - protein, 20 aa, Staphylococcus epidermidis
QPTKQKTTSKAEVQRKGQVL

SEQ ID NO: 1734722 - protein, 21 aa, Staphylococcus epidermidis
QPTKQKTTSKAEVQRKGQVLE

SEQ ID NO: 1734723 - protein, 5 aa, Staphylococcus epidermidis
QPTSL

SEQ ID NO: 1734724 - protein, 4 aa, Staphylococcus epidermidis
QQAN

SEQ ID NO: 1734725 - protein, 150 aa, Staphylococcus epidermidis
QQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQ

SEQ ID NO: 1734726 - protein, 150 aa, Staphylococcus epidermidis
QQAQAAETSVQHADAHPEDSQTTQQLKNDKVEETLKASKQGNADSQQVQTIDQSKTNQNNQHSVTESAQLKSDETANQPKKEEGSSVKQDVQPSKNVNQQDVATQSNERENNDIKGEGQTSKTSNQHIQSSNSHNQSTGTKDSYSEEIDQ

SEQ ID NO: 1734727 - protein, 150 aa, Staphylococcus epidermidis
QQAQAAETSVQHADAHPEDSQTTQQLKNDKVEETLKASKQGTAYSQQVQTINQSKTNQNNQHSVAESEQLKSDETANQPKKEEGSSVKQDVQPSKNVNQQDAATQSNERKNIDIKGEGQTSKTSNQHIQSSNSHNQSTETKDSDSEEIDQ

SEQ ID NO: 1734728 - protein, 150 aa, Staphylococcus epidermidis
QQAQAAETSVQHADAHPEDSQTTQQLKNDKVEETLKASKQVNADSQQVQTIDQSKTNQNNQHSVAESAQLKSDETANQPKKEESSSVKQDVQPSKNVNQQDVATQSNERENNDIKGEGQTSKTSNQHIQTSNSHNQSTGTKDSDSEEIDQ

SEQ ID NO: 1734729 - protein, 10 aa, Staphylococcus epidermidis
QQAQQDLDGV

SEQ ID NO: 1734730 - protein, 6 aa, Staphylococcus epidermidis
QQASKL

SEQ ID NO: 1734731 - protein, 10 aa, Staphylococcus epidermidis
QQDKYETNVS

SEQ ID NO: 1734732 - protein, 18 aa, Staphylococcus epidermidis
QQDYITDAQYKEAMSQLG

SEQ ID NO: 1734733 - protein, 17 aa, Staphylococcus epidermidis
QQDYNGEITADDTSKLI

SEQ ID NO: 1734734 - protein, 8 aa, Staphylococcus epidermidis
QQEDYESD

SEQ ID NO: 1734735 - protein, 13 aa, Staphylococcus epidermidis
QQEEEIKQKEYEL

SEQ ID NO: 1734736 - protein, 12 aa, Staphylococcus epidermidis
QQIKDDKQKMQD

SEQ ID NO: 1734737 - protein, 9 aa, Staphylococcus epidermidis
QQKEEKKPT

SEQ ID NO: 1734738 - protein, 7 aa, Staphylococcus epidermidis
QQKLNEA

SEQ ID NO: 1734739 - protein, 4 aa, Staphylococcus epidermidis
QQKQ

SEQ ID NO: 1734740 - protein, 9 aa, Staphylococcus epidermidis
QQKRAKAHR

SEQ ID NO: 1734741 - protein, 27 aa, Staphylococcus epidermidis
QQLANSKHQATQNVDGLSSLNDGQKRE

SEQ ID NO: 1734742 - protein, 16 aa, Staphylococcus epidermidis
QQLEDKGKVKYPNTGI

SEQ ID NO: 1734743 - protein, 6 aa, Staphylococcus epidermidis
QQLRDK

SEQ ID NO: 1734744 - protein, 12 aa, Staphylococcus epidermidis
QQLTSDRKINTA

SEQ ID NO: 1734745 - protein, 4 aa, Staphylococcus epidermidis
QQND

SEQ ID NO: 1734746 - protein, 7 aa, Staphylococcus epidermidis
QQNETYK

SEQ ID NO: 1734747 - protein, 8 aa, Staphylococcus epidermidis
QQPPEAVS

SEQ ID NO: 1734748 - protein, 4 aa, Staphylococcus epidermidis
QQSP

SEQ ID NO: 1734749 - protein, 10 aa, Staphylococcus epidermidis
QQSPANKMGL

SEQ ID NO: 1734750 - protein, 9 aa, Staphylococcus epidermidis
QQSPPNKMG

SEQ ID NO: 1734751 - protein, 9 aa, Staphylococcus epidermidis
QQYGGESAA

SEQ ID NO: 1734752 - protein, 9 aa, Staphylococcus epidermidis
QQYGGESGA

SEQ ID NO: 1734753 - protein, 18 aa, Staphylococcus epidermidis
QRAKNNQKNYKKTISIFF

SEQ ID NO: 1734754 - protein, 8 aa, Staphylococcus epidermidis
QRDGYSQE

SEQ ID NO: 1734755 - protein, 5 aa, Staphylococcus epidermidis
QRDSK

SEQ ID NO: 1734756 - protein, 9 aa, Staphylococcus epidermidis
QRIKQENRT

SEQ ID NO: 1734757 - protein, 13 aa, Staphylococcus epidermidis
QRIREERGKVYAD

SEQ ID NO: 1734758 - protein, 4 aa, Staphylococcus epidermidis
QRKN

SEQ ID NO: 1734759 - protein, 17 aa, Staphylococcus epidermidis
QRKYKRAARKYKRRNKK

SEQ ID NO: 1734760 - protein, 10 aa, Staphylococcus epidermidis
QRPNENRTAN

SEQ ID NO: 1734761 - protein, 5 aa, Staphylococcus epidermidis
QRQQV

SEQ ID NO: 1734762 - protein, 6 aa, Staphylococcus epidermidis
QRRDPV

SEQ ID NO: 1734763 - protein, 6 aa, Staphylococcus epidermidis
QRTRDQ

SEQ ID NO: 1734764 - protein, 14 aa, Staphylococcus epidermidis
QRYQEPEIPDTTKA

SEQ ID NO: 1734765 - protein, 8 aa, Staphylococcus epidermidis
QRYTITQK

SEQ ID NO: 1734766 - protein, 9 aa, Staphylococcus epidermidis
QRYTITQKE

SEQ ID NO: 1734767 - protein, 9 aa, Staphylococcus epidermidis
QSADTTQSL

SEQ ID NO: 1734768 - protein, 10 aa, Staphylococcus epidermidis
QSAHSEQTYE

SEQ ID NO: 1734769 - protein, 6 aa, Staphylococcus epidermidis
QSDDEG

SEQ ID NO: 1734770 - protein, 7 aa, Staphylococcus epidermidis
QSEQPRW

SEQ ID NO: 1734771 - protein, 7 aa, Staphylococcus epidermidis
QSERPRW

SEQ ID NO: 1734772 - protein, 14 aa, Staphylococcus epidermidis
QSEYFEDTDDGNRQ

SEQ ID NO: 1734773 - protein, 14 aa, Staphylococcus epidermidis
QSEYFEDTDDNKRQ

SEQ ID NO: 1734774 - protein, 12 aa, Staphylococcus epidermidis
QSFGNKQNANKT

SEQ ID NO: 1734775 - protein, 13 aa, Staphylococcus epidermidis
QSFNKSSSAIGQG

SEQ ID NO: 1734776 - protein, 21 aa, Staphylococcus epidermidis
QSHALDDDATFKKVSEKDAHK

SEQ ID NO: 1734777 - protein, 17 aa, Staphylococcus epidermidis
QSHVSNAEEKETPLNHK

SEQ ID NO: 1734778 - protein, 30 aa, Staphylococcus epidermidis
QSIAKKDQVKADSKYLNEDPQIKQNYDDAV

SEQ ID NO: 1734779 - protein, 6 aa, Staphylococcus epidermidis
QSIANE

SEQ ID NO: 1734780 - protein, 34 aa, Staphylococcus epidermidis
QSIANKDATLNSSNYLNEDSEKKLAYDNAVSQAE

SEQ ID NO: 1734781 - protein, 8 aa, Staphylococcus epidermidis
QSIANNQM

SEQ ID NO: 1734782 - protein, 16 aa, Staphylococcus epidermidis
QSIKDNHRLKNSNNKI

SEQ ID NO: 1734783 - protein, 30 aa, Staphylococcus epidermidis
QSITDENNVKQTSNYINETVGKQTAYNNAV

SEQ ID NO: 1734784 - protein, 13 aa, Staphylococcus epidermidis
QSKDGRISKDDMN

SEQ ID NO: 1734785 - protein, 19 aa, Staphylococcus epidermidis
QSKFETNKEATKEEKQKAL

SEQ ID NO: 1734786 - protein, 8 aa, Staphylococcus epidermidis
QSKGLSTN

SEQ ID NO: 1734787 - protein, 18 aa, Staphylococcus epidermidis
QSKVHQQSKYINEDPQVQ

SEQ ID NO: 1734788 - protein, 4 aa, Staphylococcus epidermidis
QSKY

SEQ ID NO: 1734789 - protein, 33 aa, Staphylococcus epidermidis
QSLLENGSITQEQYDNQQRDKIGKKQLDELSKK

SEQ ID NO: 1734790 - protein, 15 aa, Staphylococcus epidermidis
QSLSRDDSGNLKTDG

SEQ ID NO: 1734791 - protein, 11 aa, Staphylococcus epidermidis
QSNPTDLNATN

SEQ ID NO: 1734792 - protein, 5 aa, Staphylococcus epidermidis
QSNTN

SEQ ID NO: 1734793 - protein, 5 aa, Staphylococcus epidermidis
QSPII

SEQ ID NO: 1734794 - protein, 5 aa, Staphylococcus epidermidis
QSPLS

SEQ ID NO: 1734795 - protein, 23 aa, Staphylococcus epidermidis
QSQIDTINANNKSTNEEKSAAID

SEQ ID NO: 1734796 - protein, 12 aa, Staphylococcus epidermidis
QSQNNESVSAAL

SEQ ID NO: 1734797 - protein, 6 aa, Staphylococcus epidermidis
QSRSYT

SEQ ID NO: 1734798 - protein, 4 aa, Staphylococcus epidermidis
QSSD

SEQ ID NO: 1734799 - protein, 7 aa, Staphylococcus epidermidis
QSSLDHA

SEQ ID NO: 1734800 - protein, 8 aa, Staphylococcus epidermidis
QSSTDTNP

SEQ ID NO: 1734801 - protein, 8 aa, Staphylococcus epidermidis
QSSTNPLK

SEQ ID NO: 1734802 - protein, 13 aa, Staphylococcus epidermidis
QSTIQNEESQDNR

SEQ ID NO: 1734803 - protein, 7 aa, Staphylococcus epidermidis
QSTLGGT

SEQ ID NO: 1734804 - protein, 6 aa, Staphylococcus epidermidis
QSTNTY

SEQ ID NO: 1734805 - protein, 4 aa, Staphylococcus epidermidis
QSVD

SEQ ID NO: 1734806 - protein, 10 aa, Staphylococcus epidermidis
QSVDKITNNS

SEQ ID NO: 1734807 - protein, 5 aa, Staphylococcus epidermidis
QSVTE

SEQ ID NO: 1734808 - protein, 22 aa, Staphylococcus epidermidis
QSYISREERQDHDSTFYKGQKH

SEQ ID NO: 1734809 - protein, 22 aa, Staphylococcus epidermidis
QSYISREERQHRDSTFYKEQKH

SEQ ID NO: 1734810 - protein, 4 aa, Staphylococcus epidermidis
QSYP

SEQ ID NO: 1734811 - protein, 13 aa, Staphylococcus epidermidis
QSYTKDKHESHAY

SEQ ID NO: 1734812 - protein, 6 aa, Staphylococcus epidermidis
QTAGAN

SEQ ID NO: 1734813 - protein, 12 aa, Staphylococcus epidermidis
QTAHIQSTGCDA

SEQ ID NO: 1734814 - protein, 4 aa, Staphylococcus epidermidis
QTDS

SEQ ID NO: 1734815 - protein, 10 aa, Staphylococcus epidermidis
QTFKSEGTEF

SEQ ID NO: 1734816 - protein, 13 aa, Staphylococcus epidermidis
QTHQTATIEEKEA

SEQ ID NO: 1734817 - protein, 10 aa, Staphylococcus epidermidis
QTKHSEQQLY

SEQ ID NO: 1734818 - protein, 40 aa, Staphylococcus epidermidis
QTLSQESGNTNYIEKRDKTAEKPKKLKTKYDKKDPISKSI

SEQ ID NO: 1734819 - protein, 41 aa, Staphylococcus epidermidis
QTNFTKKQQARDQVNQKFQEKEAELNSTPHATQDEKQDALT

SEQ ID NO: 1734820 - protein, 9 aa, Staphylococcus epidermidis
QTPALQKEA

SEQ ID NO: 1734821 - protein, 6 aa, Staphylococcus epidermidis
QTPMTT

SEQ ID NO: 1734822 - protein, 9 aa, Staphylococcus epidermidis
QTPSLQREA

SEQ ID NO: 1734823 - protein, 8 aa, Staphylococcus epidermidis
QTQAQNKR

SEQ ID NO: 1734824 - protein, 5 aa, Staphylococcus epidermidis
QTRQS

SEQ ID NO: 1734825 - protein, 7 aa, Staphylococcus epidermidis
QTRSGQD

SEQ ID NO: 1734826 - protein, 13 aa, Staphylococcus epidermidis
QTRVSTQNITRYS

SEQ ID NO: 1734827 - protein, 22 aa, Staphylococcus epidermidis
QTSGIPGDITEENRYSKQYDSI

SEQ ID NO: 1734828 - protein, 9 aa, Staphylococcus epidermidis
QTSLNDESI

SEQ ID NO: 1734829 - protein, 7 aa, Staphylococcus epidermidis
QTSVKST

SEQ ID NO: 1734830 - protein, 16 aa, Staphylococcus epidermidis
QTTMKGTDSDNSLDPI

SEQ ID NO: 1734831 - protein, 25 aa, Staphylococcus epidermidis
QTVNTTKDALHGAQKLTQDQQAAET

SEQ ID NO: 1734832 - protein, 12 aa, Staphylococcus epidermidis
QTVREKSKSNEK

SEQ ID NO: 1734833 - protein, 6 aa, Staphylococcus epidermidis
QTYDNG

SEQ ID NO: 1734834 - protein, 5 aa, Staphylococcus epidermidis
QVDEN

SEQ ID NO: 1734835 - protein, 4 aa, Staphylococcus epidermidis
QVER

SEQ ID NO: 1734836 - protein, 7 aa, Staphylococcus epidermidis
QVGSGGN

SEQ ID NO: 1734837 - protein, 22 aa, Staphylococcus epidermidis
QVIDNGDATTQQISNAKTNVER

SEQ ID NO: 1734838 - protein, 33 aa, Staphylococcus epidermidis
QVIESTPEATKEEKDEAKKLLNNESASATGAIN

SEQ ID NO: 1734839 - protein, 4 aa, Staphylococcus epidermidis
QVKS

SEQ ID NO: 1734840 - protein, 6 aa, Staphylococcus epidermidis
QVNEPY

SEQ ID NO: 1734841 - protein, 7 aa, Staphylococcus epidermidis
QVNSFSP

SEQ ID NO: 1734842 - protein, 9 aa, Staphylococcus epidermidis
QVQDENKEM

SEQ ID NO: 1734843 - protein, 10 aa, Staphylococcus epidermidis
QVTGKGTHGE

SEQ ID NO: 1734844 - protein, 7 aa, Staphylococcus epidermidis
QYDQTNV

SEQ ID NO: 1734845 - protein, 6 aa, Staphylococcus epidermidis
QYEEGF

SEQ ID NO: 1734846 - protein, 7 aa, Staphylococcus epidermidis
QYGPATV

SEQ ID NO: 1734847 - protein, 13 aa, Staphylococcus epidermidis
QYKEKKTKQVKED

SEQ ID NO: 1734848 - protein, 12 aa, Staphylococcus epidermidis
QYNKQQSDYTQN

SEQ ID NO: 1734849 - protein, 11 aa, Staphylococcus epidermidis
QYNSENHDSEL

SEQ ID NO: 1734850 - protein, 8 aa, Staphylococcus epidermidis
QYSDDNGK

SEQ ID NO: 1734851 - protein, 14 aa, Staphylococcus epidermidis
QYTPDFSKKKNATL

SEQ ID NO: 1734852 - protein, 11 aa, Staphylococcus epidermidis
QYVPDQETASI

SEQ ID NO: 1734853 - protein, 12 aa, Staphylococcus epidermidis
RAASKKELIDII

SEQ ID NO: 1734854 - protein, 8 aa, Staphylococcus epidermidis
RAEEANIS

SEQ ID NO: 1734855 - protein, 13 aa, Staphylococcus epidermidis
RAENNQKNNKKDN

SEQ ID NO: 1734856 - protein, 4 aa, Staphylococcus epidermidis
RAEY

SEQ ID NO: 1734857 - protein, 5 aa, Staphylococcus epidermidis
RAKGQ

SEQ ID NO: 1734858 - protein, 6 aa, Staphylococcus epidermidis
RAKGSL

SEQ ID NO: 1734859 - protein, 8 aa, Staphylococcus epidermidis
RAKNGRVS

SEQ ID NO: 1734860 - protein, 10 aa, Staphylococcus epidermidis
RAKRDKFKQK

SEQ ID NO: 1734861 - protein, 7 aa, Staphylococcus epidermidis
RALRRQR

SEQ ID NO: 1734862 - protein, 6 aa, Staphylococcus epidermidis
RANKRY

SEQ ID NO: 1734863 - protein, 6 aa, Staphylococcus epidermidis
RARTLK

SEQ ID NO: 1734864 - protein, 4 aa, Staphylococcus epidermidis
RDAL

SEQ ID NO: 1734865 - protein, 7 aa, Staphylococcus epidermidis
RDEAQKL

SEQ ID NO: 1734866 - protein, 7 aa, Staphylococcus epidermidis
RDEEQSS

SEQ ID NO: 1734867 - protein, 9 aa, Staphylococcus epidermidis
RDEHRKRSE

SEQ ID NO: 1734868 - protein, 12 aa, Staphylococcus epidermidis
RDEKSQGTVASG

SEQ ID NO: 1734869 - protein, 27 aa, Staphylococcus epidermidis
RDGIQNKEDIKRSSAYINADPAKVTAY

SEQ ID NO: 1734870 - protein, 7 aa, Staphylococcus epidermidis
RDGSLDK

SEQ ID NO: 1734871 - protein, 7 aa, Staphylococcus epidermidis
RDHHTKT

SEQ ID NO: 1734872 - protein, 8 aa, Staphylococcus epidermidis
RDISGEPV

SEQ ID NO: 1734873 - protein, 13 aa, Staphylococcus epidermidis
RDKHGWKTERSND

SEQ ID NO: 1734874 - protein, 12 aa, Staphylococcus epidermidis
RDKTVKAPKKLK

SEQ ID NO: 1734875 - protein, 13 aa, Staphylococcus epidermidis
RDRIKDKASGRKT

SEQ ID NO: 1734876 - protein, 13 aa, Staphylococcus epidermidis
RDRVKDKESGRKT

SEQ ID NO: 1734877 - protein, 16 aa, Staphylococcus epidermidis
RDSQKGTNQYGPNPKG

SEQ ID NO: 1734878 - protein, 15 aa, Staphylococcus epidermidis
RDSSSETVEASEDFD

SEQ ID NO: 1734879 - protein, 13 aa, Staphylococcus epidermidis
RDTVATEKSLPPW

SEQ ID NO: 1734880 - protein, 6 aa, Staphylococcus epidermidis
RDVPKD

SEQ ID NO: 1734881 - protein, 7 aa, Staphylococcus epidermidis
RDYSQGT

SEQ ID NO: 1734882 - protein, 4 aa, Staphylococcus epidermidis
REAA

SEQ ID NO: 1734883 - protein, 6 aa, Staphylococcus epidermidis
REATRS

SEQ ID NO: 1734884 - protein, 6 aa, Staphylococcus epidermidis
REEQAK

SEQ ID NO: 1734885 - protein, 7 aa, Staphylococcus epidermidis
REERIRR

SEQ ID NO: 1734886 - protein, 53 aa, Staphylococcus epidermidis
REFDPNLAPGTEKVVQKGEPGIETTTTPTYVNPNTGEKVGEGEPTEKITKQPV

SEQ ID NO: 1734887 - protein, 53 aa, Staphylococcus epidermidis
REFDPNLAPGTEKVVQKGEPGIETTTTPTYVNPNTGEKVGEGTPTTKITKQPV

SEQ ID NO: 1734888 - protein, 105 aa, Staphylococcus epidermidis
REFNPDLKPGEERVKQKGEPGTKTITTPTTKNPLTGEKVGEGEPTEKITKQPVDEITEYGGEEIKPGHKDEFDPNAPKGSQTTQPGKPGVKNPDTGEVVTPPVDD

SEQ ID NO: 1734889 - protein, 53 aa, Staphylococcus epidermidis
REFNPDLKPGEERVKQKGEPGTKTITTPTTKNPLTGEKVGEGEPTEKVTKQPV

SEQ ID NO: 1734890 - protein, 105 aa, Staphylococcus epidermidis
REFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDD

SEQ ID NO: 1734891 - protein, 34 aa, Staphylococcus epidermidis
REKKDNNDSNKSSQTKSDQQNNDSDSDSNSDDDE

SEQ ID NO: 1734892 - protein, 9 aa, Staphylococcus epidermidis
REKSAGYRA

SEQ ID NO: 1734893 - protein, 11 aa, Staphylococcus epidermidis
REKYYSPNGKY

SEQ ID NO: 1734894 - protein, 16 aa, Staphylococcus epidermidis
RENNIEDRYNKEAGTL

SEQ ID NO: 1734895 - protein, 4 aa, Staphylococcus epidermidis
RENP

SEQ ID NO: 1734896 - protein, 6 aa, Staphylococcus epidermidis
REPTET

SEQ ID NO: 1734897 - protein, 7 aa, Staphylococcus epidermidis
REPTETI

SEQ ID NO: 1734898 - protein, 4 aa, Staphylococcus epidermidis
REQA

SEQ ID NO: 1734899 - protein, 8 aa, Staphylococcus epidermidis
REQGVNNN

SEQ ID NO: 1734900 - protein, 5 aa, Staphylococcus epidermidis
REQYR

SEQ ID NO: 1734901 - protein, 11 aa, Staphylococcus epidermidis
RESEAKAKTEK

SEQ ID NO: 1734902 - protein, 5 aa, Staphylococcus epidermidis
RESKA

SEQ ID NO: 1734903 - protein, 9 aa, Staphylococcus epidermidis
RESNFQSDA

SEQ ID NO: 1734904 - protein, 815 aa, Staphylococcus epidermidis
RESTSTSTSDSASTSTSESDSDSASTSLSGSSSTSVSDSTSASTSESASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSTSISESLSTSDSDSKSMSTSESASTSTSVSDSESASTSISESTSTSTSDSASTSTSVSDSNSASTSLSESTSTSLSDSTSTSTSDSTSASTSESDSNSTSTSMSESLSTSVSDSTSTSTSDSASTSTSVSDSNSASTSLSDSTSTSISDSTSASTSDSASESASESESTSESTSVSESSSTSVSDSTSTSTSESASTSTSESESTSESTSLSGSSSTSVSDSTSTSTSDSASTSTSVSDSNSASTSLSESTSTSLSDSTSTSTSDSASESASESESTSTSVSDSTSASTSTSESESNSTSTSLSESTSTSLSGSTSTSTSDSASTSASESDSNSASTSLSGSLSTSVSDSTSASTSDSTSTSTSVSDSNSTSTSLSESTSTSLSDSTSTSTSDSASTSTSVSDSNSASTSLSESSSTSVSDSTSTSTSESASTSTSVSDSNSTSTSLSESTSTSLSNSTSTSTSDSASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQ

SEQ ID NO: 1734905 - protein, 7 aa, Staphylococcus epidermidis
RETTKNI

SEQ ID NO: 1734906 - protein, 20 aa, Staphylococcus epidermidis
REVNDNNLADQSPEAQEIQE

SEQ ID NO: 1734907 - protein, 7 aa, Staphylococcus epidermidis
RFGTGKN

SEQ ID NO: 1734908 - protein, 4 aa, Staphylococcus epidermidis
RFKD

SEQ ID NO: 1734909 - protein, 9 aa, Staphylococcus epidermidis
RGDVSATDK

SEQ ID NO: 1734910 - protein, 10 aa, Staphylococcus epidermidis
RGIANGASRV

SEQ ID NO: 1734911 - protein, 10 aa, Staphylococcus epidermidis
RGIEGGEAGT

SEQ ID NO: 1734912 - protein, 5 aa, Staphylococcus epidermidis
RGKDD

SEQ ID NO: 1734913 - protein, 4 aa, Staphylococcus epidermidis
RGKL

SEQ ID NO: 1734914 - protein, 15 aa, Staphylococcus epidermidis
RGLSNATEQSTRQRI

SEQ ID NO: 1734915 - protein, 4 aa, Staphylococcus epidermidis
RGMT

SEQ ID NO: 1734916 - protein, 4 aa, Staphylococcus epidermidis
RGPI

SEQ ID NO: 1734917 - protein, 8 aa, Staphylococcus epidermidis
RGQEVSNK

SEQ ID NO: 1734918 - protein, 16 aa, Staphylococcus epidermidis
RGRHDDITNRGTVNPA

SEQ ID NO: 1734919 - protein, 18 aa, Staphylococcus epidermidis
RGRQTTKRSVKDNSGKKQ

SEQ ID NO: 1734920 - protein, 11 aa, Staphylococcus epidermidis
RGVRNKTPEIM

SEQ ID NO: 1734921 - protein, 11 aa, Staphylococcus epidermidis
RHDINEGKDVH

SEQ ID NO: 1734922 - protein, 5 aa, Staphylococcus epidermidis
RHKAQ

SEQ ID NO: 1734923 - protein, 4 aa, Staphylococcus epidermidis
RHRQ

SEQ ID NO: 1734924 - protein, 7 aa, Staphylococcus epidermidis
RIDAVSD

SEQ ID NO: 1734925 - protein, 7 aa, Staphylococcus epidermidis
RIGGSKA

SEQ ID NO: 1734926 - protein, 6 aa, Staphylococcus epidermidis
RIGSTI

SEQ ID NO: 1734927 - protein, 15 aa, Staphylococcus epidermidis
RIGSTSEVNGVNTSD

SEQ ID NO: 1734928 - protein, 5 aa, Staphylococcus epidermidis
RIKSY

SEQ ID NO: 1734929 - protein, 13 aa, Staphylococcus epidermidis
RINDKQYADAKKI

SEQ ID NO: 1734930 - protein, 12 aa, Staphylococcus epidermidis
RINGDGAPYKRR

SEQ ID NO: 1734931 - protein, 17 aa, Staphylococcus epidermidis
RITSKEKRRAMKKGVMS

SEQ ID NO: 1734932 - protein, 7 aa, Staphylococcus epidermidis
RKASHDL

SEQ ID NO: 1734933 - protein, 8 aa, Staphylococcus epidermidis
RKDEPGLI

SEQ ID NO: 1734934 - protein, 11 aa, Staphylococcus epidermidis
RKDFRKGYTAE

SEQ ID NO: 1734935 - protein, 4 aa, Staphylococcus epidermidis
RKDK

SEQ ID NO: 1734936 - protein, 16 aa, Staphylococcus epidermidis
RKEPDKYSYPKERIQI

SEQ ID NO: 1734937 - protein, 52 aa, Staphylococcus epidermidis
RKESRDKLKQEYNKYKENPESYKSSAKDLATQIGNKANETIQEVKKNPKDYV

SEQ ID NO: 1734938 - protein, 17 aa, Staphylococcus epidermidis
RKGDRKQHRYDEQQPPK

SEQ ID NO: 1734939 - protein, 5 aa, Staphylococcus epidermidis
RKGIS

SEQ ID NO: 1734940 - protein, 5 aa, Staphylococcus epidermidis
RKIRG

SEQ ID NO: 1734941 - protein, 82 aa, Staphylococcus epidermidis
RKKDKNEETQIDEDDKKGIPVAKRKKDNQQENKEVKQQTKKKVQISQPKSKYSSRTASKSKTTKKATNQVTKKGAKNKKRSK

SEQ ID NO: 1734942 - protein, 10 aa, Staphylococcus epidermidis
RKKQEARTTI

SEQ ID NO: 1734943 - protein, 36 aa, Staphylococcus epidermidis
RKKRSALDELQASADNQIQNINQNTEATVEERNEAL

SEQ ID NO: 1734944 - protein, 8 aa, Staphylococcus epidermidis
RKLDSTNQ

SEQ ID NO: 1734945 - protein, 10 aa, Staphylococcus epidermidis
RKLKDYEPEQ

SEQ ID NO: 1734946 - protein, 27 aa, Staphylococcus epidermidis
RKNEEEEEKLRDNKDHQISDSKKAAPL

SEQ ID NO: 1734947 - protein, 4 aa, Staphylococcus epidermidis
RKNI

SEQ ID NO: 1734948 - protein, 11 aa, Staphylococcus epidermidis
RKNKKSGQPAY

SEQ ID NO: 1734949 - protein, 7 aa, Staphylococcus epidermidis
RKNLTEP

SEQ ID NO: 1734950 - protein, 9 aa, Staphylococcus epidermidis
RKNRRKEER

SEQ ID NO: 1734951 - protein, 12 aa, Staphylococcus epidermidis
RKQKSLTQENLA

SEQ ID NO: 1734952 - protein, 8 aa, Staphylococcus epidermidis
RKQPEHGN

SEQ ID NO: 1734953 - protein, 7 aa, Staphylococcus epidermidis
RKRGLEP

SEQ ID NO: 1734954 - protein, 5 aa, Staphylococcus epidermidis
RKSGE

SEQ ID NO: 1734955 - protein, 15 aa, Staphylococcus epidermidis
RKSPSKPASDRYSDF

SEQ ID NO: 1734956 - protein, 8 aa, Staphylococcus epidermidis
RKTAKSQR

SEQ ID NO: 1734957 - protein, 7 aa, Staphylococcus epidermidis
RKVQQVE

SEQ ID NO: 1734958 - protein, 17 aa, Staphylococcus epidermidis
RKYEDEEDLKMLRGRHR

SEQ ID NO: 1734959 - protein, 26 aa, Staphylococcus epidermidis
RLASDTDQIRDSKNQHVTDGKQDIQA

SEQ ID NO: 1734960 - protein, 11 aa, Staphylococcus epidermidis
RLGQNEASKIA

SEQ ID NO: 1734961 - protein, 5 aa, Staphylococcus epidermidis
RLGYS

SEQ ID NO: 1734962 - protein, 10 aa, Staphylococcus epidermidis
RLQDKYKNPF

SEQ ID NO: 1734963 - protein, 15 aa, Staphylococcus epidermidis
RLQKRQNDHRKIGRG

SEQ ID NO: 1734964 - protein, 8 aa, Staphylococcus epidermidis
RLSDTDKI

SEQ ID NO: 1734965 - protein, 14 aa, Staphylococcus epidermidis
RLSQQKNVKDETYM

SEQ ID NO: 1734966 - protein, 11 aa, Staphylococcus epidermidis
RLTEDIQGKVD

SEQ ID NO: 1734967 - protein, 6 aa, Staphylococcus epidermidis
RMDNDE

SEQ ID NO: 1734968 - protein, 7 aa, Staphylococcus epidermidis
RMRDTNQ

SEQ ID NO: 1734969 - protein, 7 aa, Staphylococcus epidermidis
RMSGDTS

SEQ ID NO: 1734970 - protein, 5 aa, Staphylococcus epidermidis
RMSQN

SEQ ID NO: 1734971 - protein, 6 aa, Staphylococcus epidermidis
RMSQSQ

SEQ ID NO: 1734972 - protein, 5 aa, Staphylococcus epidermidis
RMSQT

SEQ ID NO: 1734973 - protein, 8 aa, Staphylococcus epidermidis
RNDNEKKM

SEQ ID NO: 1734974 - protein, 4 aa, Staphylococcus epidermidis
RNDS

SEQ ID NO: 1734975 - protein, 6 aa, Staphylococcus epidermidis
RNEERR

SEQ ID NO: 1734976 - protein, 5 aa, Staphylococcus epidermidis
RNGHW

SEQ ID NO: 1734977 - protein, 4 aa, Staphylococcus epidermidis
RNGS

SEQ ID NO: 1734978 - protein, 7 aa, Staphylococcus epidermidis
RNKSINL

SEQ ID NO: 1734979 - protein, 7 aa, Staphylococcus epidermidis
RNKSSKK

SEQ ID NO: 1734980 - protein, 4 aa, Staphylococcus epidermidis
RNNG

SEQ ID NO: 1734981 - protein, 7 aa, Staphylococcus epidermidis
RNNKSST

SEQ ID NO: 1734982 - protein, 8 aa, Staphylococcus epidermidis
RNNRETKG

SEQ ID NO: 1734983 - protein, 5 aa, Staphylococcus epidermidis
RNNYK

SEQ ID NO: 1734984 - protein, 7 aa, Staphylococcus epidermidis
RNPTLQR

SEQ ID NO: 1734985 - protein, 7 aa, Staphylococcus epidermidis
RNPTVAQ

SEQ ID NO: 1734986 - protein, 9 aa, Staphylococcus epidermidis
RNTKTAKGY

SEQ ID NO: 1734987 - protein, 13 aa, Staphylococcus epidermidis
RNTNLQKDDYVDT

SEQ ID NO: 1734988 - protein, 7 aa, Staphylococcus epidermidis
RNTREAK

SEQ ID NO: 1734989 - protein, 8 aa, Staphylococcus epidermidis
RNTRTAKG

SEQ ID NO: 1734990 - protein, 6 aa, Staphylococcus epidermidis
RNYKSG

SEQ ID NO: 1734991 - protein, 8 aa, Staphylococcus epidermidis
RPASTYSR

SEQ ID NO: 1734992 - protein, 9 aa, Staphylococcus epidermidis
RPDATEEEI

SEQ ID NO: 1734993 - protein, 4 aa, Staphylococcus epidermidis
RPES

SEQ ID NO: 1734994 - protein, 7 aa, Staphylococcus epidermidis
RPHTRYA

SEQ ID NO: 1734995 - protein, 5 aa, Staphylococcus epidermidis
RPITT

SEQ ID NO: 1734996 - protein, 14 aa, Staphylococcus epidermidis
RPKKNRDLKDEKIT

SEQ ID NO: 1734997 - protein, 15 aa, Staphylococcus epidermidis
RPTNVNASVSHSTGI

SEQ ID NO: 1734998 - protein, 4 aa, Staphylococcus epidermidis
RPYH

SEQ ID NO: 1734999 - protein, 8 aa, Staphylococcus epidermidis
RQANNNYK

SEQ ID NO: 1735000 - protein, 10 aa, Staphylococcus epidermidis
RQFTKGEHIP

SEQ ID NO: 1735001 - protein, 5 aa, Staphylococcus epidermidis
RQGEP

SEQ ID NO: 1735002 - protein, 6 aa, Staphylococcus epidermidis
RQGIRK

SEQ ID NO: 1735003 - protein, 7 aa, Staphylococcus epidermidis
RQKNNTF

SEQ ID NO: 1735004 - protein, 4 aa, Staphylococcus epidermidis
RQMQ

SEQ ID NO: 1735005 - protein, 5 aa, Staphylococcus epidermidis
RQNRT

SEQ ID NO: 1735006 - protein, 24 aa, Staphylococcus epidermidis
RQNYNDAQDNVERDTIQGENKIGN

SEQ ID NO: 1735007 - protein, 11 aa, Staphylococcus epidermidis
RQSNSNTNRRF

SEQ ID NO: 1735008 - protein, 4 aa, Staphylococcus epidermidis
RQTN

SEQ ID NO: 1735009 - protein, 10 aa, Staphylococcus epidermidis
RQTNGHEYAS

SEQ ID NO: 1735010 - protein, 14 aa, Staphylococcus epidermidis
RQVNKNVKNSKEFE

SEQ ID NO: 1735011 - protein, 5 aa, Staphylococcus epidermidis
RRDIS

SEQ ID NO: 1735012 - protein, 6 aa, Staphylococcus epidermidis
RRDKKA

SEQ ID NO: 1735013 - protein, 13 aa, Staphylococcus epidermidis
RRERKKNKLEKEI

SEQ ID NO: 1735014 - protein, 10 aa, Staphylococcus epidermidis
RRIKQDGSYE

SEQ ID NO: 1735015 - protein, 17 aa, Staphylococcus epidermidis
RRKKEEEEKQSIKNHRK

SEQ ID NO: 1735016 - protein, 6 aa, Staphylococcus epidermidis
RRKSLS

SEQ ID NO: 1735017 - protein, 5 aa, Staphylococcus epidermidis
RRNLK

SEQ ID NO: 1735018 - protein, 13 aa, Staphylococcus epidermidis
RRSGYSTGHKPRK

SEQ ID NO: 1735019 - protein, 5 aa, Staphylococcus epidermidis
RRSRS

SEQ ID NO: 1735020 - protein, 9 aa, Staphylococcus epidermidis
RSAHSSVNF

SEQ ID NO: 1735021 - protein, 6 aa, Staphylococcus epidermidis
RSDEYS

SEQ ID NO: 1735022 - protein, 4 aa, Staphylococcus epidermidis
RSDI

SEQ ID NO: 1735023 - protein, 8 aa, Staphylococcus epidermidis
RSEAVRTK

SEQ ID NO: 1735024 - protein, 7 aa, Staphylococcus epidermidis
RSEEAAR

SEQ ID NO: 1735025 - protein, 8 aa, Staphylococcus epidermidis
RSEGHTEY

SEQ ID NO: 1735026 - protein, 25 aa, Staphylococcus epidermidis
RSELDTAKADASSTLRNTNPSVEQV

SEQ ID NO: 1735027 - protein, 5 aa, Staphylococcus epidermidis
RSGNI

SEQ ID NO: 1735028 - protein, 4 aa, Staphylococcus epidermidis
RSHH

SEQ ID NO: 1735029 - protein, 6 aa, Staphylococcus epidermidis
RSIKSD

SEQ ID NO: 1735030 - protein, 33 aa, Staphylococcus epidermidis
RSKEGDCGGCKSNCKCDTNPSPHKNKLNIPHIK

SEQ ID NO: 1735031 - protein, 13 aa, Staphylococcus epidermidis
RSKSEKESEKIAN

SEQ ID NO: 1735032 - protein, 11 aa, Staphylococcus epidermidis
RSLSDNKKALK

SEQ ID NO: 1735033 - protein, 7 aa, Staphylococcus epidermidis
RSMGDGV

SEQ ID NO: 1735034 - protein, 4 aa, Staphylococcus epidermidis
RSNA

SEQ ID NO: 1735035 - protein, 8 aa, Staphylococcus epidermidis
RSPASPGS

SEQ ID NO: 1735036 - protein, 12 aa, Staphylococcus epidermidis
RSSRSQSNSLKR

SEQ ID NO: 1735037 - protein, 31 aa, Staphylococcus epidermidis
RTALDYKKSKKTNKRGEQNQIKVNNNSKYPD

SEQ ID NO: 1735038 - protein, 6 aa, Staphylococcus epidermidis
RTASTS

SEQ ID NO: 1735039 - protein, 9 aa, Staphylococcus epidermidis
RTEEDVEKE

SEQ ID NO: 1735040 - protein, 18 aa, Staphylococcus epidermidis
RTKDSDWKLTSGRYPQHK

SEQ ID NO: 1735041 - protein, 7 aa, Staphylococcus epidermidis
RTKNTID

SEQ ID NO: 1735042 - protein, 8 aa, Staphylococcus epidermidis
RTKQTKAH

SEQ ID NO: 1735043 - protein, 7 aa, Staphylococcus epidermidis
RTMGASE

SEQ ID NO: 1735044 - protein, 8 aa, Staphylococcus epidermidis
RTMGASES

SEQ ID NO: 1735045 - protein, 7 aa, Staphylococcus epidermidis
RTNNNDQ

SEQ ID NO: 1735046 - protein, 12 aa, Staphylococcus epidermidis
RTNTTERIAASE

SEQ ID NO: 1735047 - protein, 9 aa, Staphylococcus epidermidis
RTPDGQEAT

SEQ ID NO: 1735048 - protein, 10 aa, Staphylococcus epidermidis
RTPDGQEATL

SEQ ID NO: 1735049 - protein, 4 aa, Staphylococcus epidermidis
RTPL

SEQ ID NO: 1735050 - protein, 8 aa, Staphylococcus epidermidis
RTQRTKMS

SEQ ID NO: 1735051 - protein, 5 aa, Staphylococcus epidermidis
RTQVY

SEQ ID NO: 1735052 - protein, 5 aa, Staphylococcus epidermidis
RTRDQ

SEQ ID NO: 1735053 - protein, 11 aa, Staphylococcus epidermidis
RTSQEMTNEIR

SEQ ID NO: 1735054 - protein, 10 aa, Staphylococcus epidermidis
RTTNPKADIP

SEQ ID NO: 1735055 - protein, 7 aa, Staphylococcus epidermidis
RTTSYEI

SEQ ID NO: 1735056 - protein, 6 aa, Staphylococcus epidermidis
RTYSIS

SEQ ID NO: 1735057 - protein, 5 aa, Staphylococcus epidermidis
RVDTP

SEQ ID NO: 1735058 - protein, 6 aa, Staphylococcus epidermidis
RVDYGA

SEQ ID NO: 1735059 - protein, 25 aa, Staphylococcus epidermidis
RVENGANYFSNKAQKVEKKVGEAVN

SEQ ID NO: 1735060 - protein, 8 aa, Staphylococcus epidermidis
RVETEEYA

SEQ ID NO: 1735061 - protein, 5 aa, Staphylococcus epidermidis
RVGPF

SEQ ID NO: 1735062 - protein, 7 aa, Staphylococcus epidermidis
RVNEEEV

SEQ ID NO: 1735063 - protein, 4 aa, Staphylococcus epidermidis
RVNS

SEQ ID NO: 1735064 - protein, 750 aa, Staphylococcus epidermidis
RVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKLATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDY

SEQ ID NO: 1735065 - protein, 727 aa, Staphylococcus epidermidis
RVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQFNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYT

SEQ ID NO: 1735066 - protein, 739 aa, Staphylococcus epidermidis
RVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYT

SEQ ID NO: 1735067 - protein, 679 aa, Staphylococcus epidermidis
RVTTGTVDTGGQPARADQGQEGPQAGADTHNTASQPGVTGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDY

SEQ ID NO: 1735068 - protein, 12 aa, Staphylococcus epidermidis
RVVPGYSENITN

SEQ ID NO: 1735069 - protein, 6 aa, Staphylococcus epidermidis
RYGKTD

SEQ ID NO: 1735070 - protein, 9 aa, Staphylococcus epidermidis
RYNEKPAFK

SEQ ID NO: 1735071 - protein, 12 aa, Staphylococcus epidermidis
RYPKLGEKHYTE

SEQ ID NO: 1735072 - protein, 21 aa, Staphylococcus epidermidis
RYPKLGEKRYTEKAFNIMDEG

SEQ ID NO: 1735073 - protein, 10 aa, Staphylococcus epidermidis
RYSEDRQYHK

SEQ ID NO: 1735074 - protein, 6 aa, Staphylococcus epidermidis
RYSQSR

SEQ ID NO: 1735075 - protein, 19 aa, Staphylococcus epidermidis
RYYGEDAGDYSIKQEEEIT

SEQ ID NO: 1735076 - protein, 16 aa, Staphylococcus epidermidis
SAAANSDAVENPKKNV

SEQ ID NO: 1735077 - protein, 25 aa, Staphylococcus epidermidis
SAAEHIDEDSHETPSKASKSQREQS

SEQ ID NO: 1735078 - protein, 50 aa, Staphylococcus epidermidis
SAAGQGSQSNDNSSSDSENENSSLMPKDNTNASNSNSKTSSSDGKMPSVP

SEQ ID NO: 1735079 - protein, 23 aa, Staphylococcus epidermidis
SADEITTNNDGHSKDYDKKKKIH

SEQ ID NO: 1735080 - protein, 8 aa, Staphylococcus epidermidis
SADEQETY

SEQ ID NO: 1735081 - protein, 8 aa, Staphylococcus epidermidis
SADYQSKM

SEQ ID NO: 1735082 - protein, 7 aa, Staphylococcus epidermidis
SAEANIA

SEQ ID NO: 1735083 - protein, 8 aa, Staphylococcus epidermidis
SAEDEYGN

SEQ ID NO: 1735084 - protein, 10 aa, Staphylococcus epidermidis
SAEKASEHPL

SEQ ID NO: 1735085 - protein, 10 aa, Staphylococcus epidermidis
SAENTSEHPL

SEQ ID NO: 1735086 - protein, 4 aa, Staphylococcus epidermidis
SAES

SEQ ID NO: 1735087 - protein, 7 aa, Staphylococcus epidermidis
SAFGASS

SEQ ID NO: 1735088 - protein, 7 aa, Staphylococcus epidermidis
SAGASDM

SEQ ID NO: 1735089 - protein, 8 aa, Staphylococcus epidermidis
SAGPLENF

SEQ ID NO: 1735090 - protein, 7 aa, Staphylococcus epidermidis
SAGSTQV

SEQ ID NO: 1735091 - protein, 24 aa, Staphylococcus epidermidis
SAHATLEKTTPQEKGVVKEKPEEI

SEQ ID NO: 1735092 - protein, 6 aa, Staphylococcus epidermidis
SAIPPK

SEQ ID NO: 1735093 - protein, 12 aa, Staphylococcus epidermidis
SAISSVGNDNPY

SEQ ID NO: 1735094 - protein, 6 aa, Staphylococcus epidermidis
SAKDQK

SEQ ID NO: 1735095 - protein, 6 aa, Staphylococcus epidermidis
SAKETT

SEQ ID NO: 1735096 - protein, 14 aa, Staphylococcus epidermidis
SANEGIGLSGVHED

SEQ ID NO: 1735097 - protein, 12 aa, Staphylococcus epidermidis
SANEGNTSPDPQ

SEQ ID NO: 1735098 - protein, 6 aa, Staphylococcus epidermidis
SAQAFN

SEQ ID NO: 1735099 - protein, 5 aa, Staphylococcus epidermidis
SAQAQ

SEQ ID NO: 1735100 - protein, 8 aa, Staphylococcus epidermidis
SAQKKIPS

SEQ ID NO: 1735101 - protein, 6 aa, Staphylococcus epidermidis
SASDEI

SEQ ID NO: 1735102 - protein, 8 aa, Staphylococcus epidermidis
SASDKNGV

SEQ ID NO: 1735103 - protein, 7 aa, Staphylococcus epidermidis
SASEEVE

SEQ ID NO: 1735104 - protein, 6 aa, Staphylococcus epidermidis
SASNLS

SEQ ID NO: 1735105 - protein, 12 aa, Staphylococcus epidermidis
SASRSGDKIKTT

SEQ ID NO: 1735106 - protein, 7 aa, Staphylococcus epidermidis
SASRYKE

SEQ ID NO: 1735107 - protein, 5 aa, Staphylococcus epidermidis
SASTW

SEQ ID NO: 1735108 - protein, 7 aa, Staphylococcus epidermidis
SATFRDT

SEQ ID NO: 1735109 - protein, 16 aa, Staphylococcus epidermidis
SATGANGNYNANTNTL

SEQ ID NO: 1735110 - protein, 8 aa, Staphylococcus epidermidis
SATIDGAN

SEQ ID NO: 1735111 - protein, 8 aa, Staphylococcus epidermidis
SATNHEST

SEQ ID NO: 1735112 - protein, 16 aa, Staphylococcus epidermidis
SATNTITGTPTKVGSY

SEQ ID NO: 1735113 - protein, 6 aa, Staphylococcus epidermidis
SATQYQ

SEQ ID NO: 1735114 - protein, 7 aa, Staphylococcus epidermidis
SAVQGFG

SEQ ID NO: 1735115 - protein, 6 aa, Staphylococcus epidermidis
SAVTRT

SEQ ID NO: 1735116 - protein, 6 aa, Staphylococcus epidermidis
SCKTNG

SEQ ID NO: 1735117 - protein, 7 aa, Staphylococcus epidermidis
SCPTPSQ

SEQ ID NO: 1735118 - protein, 11 aa, Staphylococcus epidermidis
SDAEKKYITEH

SEQ ID NO: 1735119 - protein, 4 aa, Staphylococcus epidermidis
SDAG

SEQ ID NO: 1735120 - protein, 15 aa, Staphylococcus epidermidis
SDASQYSNQNKSISP

SEQ ID NO: 1735121 - protein, 15 aa, Staphylococcus epidermidis
SDAYQGLDDKQIAEA

SEQ ID NO: 1735122 - protein, 5 aa, Staphylococcus epidermidis
SDDID

SEQ ID NO: 1735123 - protein, 18 aa, Staphylococcus epidermidis
SDDIDKYDDGVKETRYPV

SEQ ID NO: 1735124 - protein, 34 aa, Staphylococcus epidermidis
SDDNNQCPKCGQSLPKNNKAKQTSSHSFNDNATN

SEQ ID NO: 1735125 - protein, 11 aa, Staphylococcus epidermidis
SDDTSNAYESF

SEQ ID NO: 1735126 - protein, 4 aa, Staphylococcus epidermidis
SDED

SEQ ID NO: 1735127 - protein, 10 aa, Staphylococcus epidermidis
SDEDSGQITI

SEQ ID NO: 1735128 - protein, 28 aa, Staphylococcus epidermidis
SDEEHHKETGDDHHYDESGNEKKVGPKA

SEQ ID NO: 1735129 - protein, 9 aa, Staphylococcus epidermidis
SDEITSNSI

SEQ ID NO: 1735130 - protein, 80 aa, Staphylococcus epidermidis
SDEYEKEKKNSKQVQDSNKLVDKEQKNTQNTKDLKKENTKDSSKNNLDSKDKENIKKDNNIKKATDKPTKEKLLPNTGMT

SEQ ID NO: 1735131 - protein, 4 aa, Staphylococcus epidermidis
SDFK

SEQ ID NO: 1735132 - protein, 13 aa, Staphylococcus epidermidis
SDGGQLKNAKKLK

SEQ ID NO: 1735133 - protein, 33 aa, Staphylococcus epidermidis
SDGRQSINAITPDTSIKRNAKSDIDIKAADKKI

SEQ ID NO: 1735134 - protein, 7 aa, Staphylococcus epidermidis
SDGRQTI

SEQ ID NO: 1735135 - protein, 16 aa, Staphylococcus epidermidis
SDGSLQESINKPRFYN

SEQ ID NO: 1735136 - protein, 17 aa, Staphylococcus epidermidis
SDIDKYENGKKMNKYPV

SEQ ID NO: 1735137 - protein, 16 aa, Staphylococcus epidermidis
SDIDSTSDSVVKTATK

SEQ ID NO: 1735138 - protein, 19 aa, Staphylococcus epidermidis
SDIKETVSKLNKNNSSVAS

SEQ ID NO: 1735139 - protein, 5 aa, Staphylococcus epidermidis
SDIND

SEQ ID NO: 1735140 - protein, 10 aa, Staphylococcus epidermidis
SDKANYTPQD

SEQ ID NO: 1735141 - protein, 9 aa, Staphylococcus epidermidis
SDKEDAELE

SEQ ID NO: 1735142 - protein, 9 aa, Staphylococcus epidermidis
SDKIPKDYK

SEQ ID NO: 1735143 - protein, 13 aa, Staphylococcus epidermidis
SDKPTQFKEPLDN

SEQ ID NO: 1735144 - protein, 16 aa, Staphylococcus epidermidis
SDKQDRKQKMDKRPYQ

SEQ ID NO: 1735145 - protein, 10 aa, Staphylococcus epidermidis
SDKQYADAKK

SEQ ID NO: 1735146 - protein, 57 aa, Staphylococcus epidermidis
SDKVDNPQQNSVADTHKNEEDGRSNHSENANDSIADDGDLSEKTQKNTDDNADDQTI

SEQ ID NO: 1735147 - protein, 8 aa, Staphylococcus epidermidis
SDLTQTYD

SEQ ID NO: 1735148 - protein, 5 aa, Staphylococcus epidermidis
SDPIT

SEQ ID NO: 1735149 - protein, 7 aa, Staphylococcus epidermidis
SDQETNK

SEQ ID NO: 1735150 - protein, 6 aa, Staphylococcus epidermidis
SDQPSE

SEQ ID NO: 1735151 - protein, 13 aa, Staphylococcus epidermidis
SDSDIDISDEDFD

SEQ ID NO: 1735152 - protein, 12 aa, Staphylococcus epidermidis
SDSSEVDESGMP

SEQ ID NO: 1735153 - protein, 4 aa, Staphylococcus epidermidis
SDTI

SEQ ID NO: 1735154 - protein, 6 aa, Staphylococcus epidermidis
SDTPDN

SEQ ID NO: 1735155 - protein, 7 aa, Staphylococcus epidermidis
SDTPDNA

SEQ ID NO: 1735156 - protein, 14 aa, Staphylococcus epidermidis
SDTVGAYDKESKMM

SEQ ID NO: 1735157 - protein, 9 aa, Staphylococcus epidermidis
SDYKGMNKQ

SEQ ID NO: 1735158 - protein, 12 aa, Staphylococcus epidermidis
SEAAKSTGIDTT

SEQ ID NO: 1735159 - protein, 12 aa, Staphylococcus epidermidis
SEASSISNSELK

SEQ ID NO: 1735160 - protein, 19 aa, Staphylococcus epidermidis
SEDAMSSVPNKIREGAYGL

SEQ ID NO: 1735161 - protein, 9 aa, Staphylococcus epidermidis
SEDFTNSNE

SEQ ID NO: 1735162 - protein, 11 aa, Staphylococcus epidermidis
SEDKAGSPTIK

SEQ ID NO: 1735163 - protein, 6 aa, Staphylococcus epidermidis
SEDTGG

SEQ ID NO: 1735164 - protein, 10 aa, Staphylococcus epidermidis
SEDYKRNQRD

SEQ ID NO: 1735165 - protein, 10 aa, Staphylococcus epidermidis
SEEKENLQNN

SEQ ID NO: 1735166 - protein, 5 aa, Staphylococcus epidermidis
SEEVQ

SEQ ID NO: 1735167 - protein, 5 aa, Staphylococcus epidermidis
SEGAD

SEQ ID NO: 1735168 - protein, 5 aa, Staphylococcus epidermidis
SEGGY

SEQ ID NO: 1735169 - protein, 5 aa, Staphylococcus epidermidis
SEGIG

SEQ ID NO: 1735170 - protein, 9 aa, Staphylococcus epidermidis
SEGYDDRHE

SEQ ID NO: 1735171 - protein, 19 aa, Staphylococcus epidermidis
SEIGPKIKSIGDSMKSVGR

SEQ ID NO: 1735172 - protein, 6 aa, Staphylococcus epidermidis
SEIKTS

SEQ ID NO: 1735173 - protein, 6 aa, Staphylococcus epidermidis
SEIQSR

SEQ ID NO: 1735174 - protein, 12 aa, Staphylococcus epidermidis
SEITQTENRANA

SEQ ID NO: 1735175 - protein, 10 aa, Staphylococcus epidermidis
SEKDEKIEKN

SEQ ID NO: 1735176 - protein, 26 aa, Staphylococcus epidermidis
SEKIAEGNAYQKQSYEVQKDTNQQMK

SEQ ID NO: 1735177 - protein, 14 aa, Staphylococcus epidermidis
SEKLGNPKSGDAIL

SEQ ID NO: 1735178 - protein, 7 aa, Staphylococcus epidermidis
SEKNQLS

SEQ ID NO: 1735179 - protein, 16 aa, Staphylococcus epidermidis
SEKTGQSISKNTEAQK

SEQ ID NO: 1735180 - protein, 16 aa, Staphylococcus epidermidis
SELASDLTKKEVNETK

SEQ ID NO: 1735181 - protein, 11 aa, Staphylococcus epidermidis
SELGKDDPFNP

SEQ ID NO: 1735182 - protein, 13 aa, Staphylococcus epidermidis
SENEVEDMIDEPN

SEQ ID NO: 1735183 - protein, 5 aa, Staphylococcus epidermidis
SENFK

SEQ ID NO: 1735184 - protein, 20 aa, Staphylococcus epidermidis
SENGEGFTPEEAQYAINHLD

SEQ ID NO: 1735185 - protein, 20 aa, Staphylococcus epidermidis
SENNTQAAIQNQSKDPYEDK

SEQ ID NO: 1735186 - protein, 12 aa, Staphylococcus epidermidis
SEQIRGKQEQSA

SEQ ID NO: 1735187 - protein, 11 aa, Staphylococcus epidermidis
SEQNISANSEV

SEQ ID NO: 1735188 - protein, 7 aa, Staphylococcus epidermidis
SEQRTLG

SEQ ID NO: 1735189 - protein, 5 aa, Staphylococcus epidermidis
SEQVE

SEQ ID NO: 1735190 - protein, 16 aa, Staphylococcus epidermidis
SESFGSSPKDGSERKM

SEQ ID NO: 1735191 - protein, 15 aa, Staphylococcus epidermidis
SESFGSTPKDGTERK

SEQ ID NO: 1735192 - protein, 52 aa, Staphylococcus epidermidis
SESNSNSMYTSESERNNNERHSESLTQSQQQHQHTSDEHNSKIRQDEDQDAR

SEQ ID NO: 1735193 - protein, 25 aa, Staphylococcus epidermidis
SESSGMDAGGMGMPEESTVQLPTKT

SEQ ID NO: 1735194 - protein, 9 aa, Staphylococcus epidermidis
SESTGRPYG

SEQ ID NO: 1735195 - protein, 27 aa, Staphylococcus epidermidis
SETALTAANRTKFQTEAKNGDRKAQGL

SEQ ID NO: 1735196 - protein, 8 aa, Staphylococcus epidermidis
SETELPTT

SEQ ID NO: 1735197 - protein, 4 aa, Staphylococcus epidermidis
SETI

SEQ ID NO: 1735198 - protein, 10 aa, Staphylococcus epidermidis
SETNPELNQG

SEQ ID NO: 1735199 - protein, 6 aa, Staphylococcus epidermidis
SEVKTS

SEQ ID NO: 1735200 - protein, 7 aa, Staphylococcus epidermidis
SFATSWN

SEQ ID NO: 1735201 - protein, 11 aa, Staphylococcus epidermidis
SFDPKSSEHNA

SEQ ID NO: 1735202 - protein, 35 aa, Staphylococcus epidermidis
SFDQTTNTITGTPSEVGTTTVTVNTTDATGNVTSK

SEQ ID NO: 1735203 - protein, 7 aa, Staphylococcus epidermidis
SFEEEVS

SEQ ID NO: 1735204 - protein, 9 aa, Staphylococcus epidermidis
SFNARPGHG

SEQ ID NO: 1735205 - protein, 5 aa, Staphylococcus epidermidis
SFNTK

SEQ ID NO: 1735206 - protein, 10 aa, Staphylococcus epidermidis
SFPSGHSNAS

SEQ ID NO: 1735207 - protein, 7 aa, Staphylococcus epidermidis
SFSKNEK

SEQ ID NO: 1735208 - protein, 6 aa, Staphylococcus epidermidis
SFSSYS

SEQ ID NO: 1735209 - protein, 11 aa, Staphylococcus epidermidis
SGAEGTRVEDT

SEQ ID NO: 1735210 - protein, 7 aa, Staphylococcus epidermidis
SGAGQVG

SEQ ID NO: 1735211 - protein, 13 aa, Staphylococcus epidermidis
SGAINKPVSIPNT

SEQ ID NO: 1735212 - protein, 8 aa, Staphylococcus epidermidis
SGAISPGT

SEQ ID NO: 1735213 - protein, 8 aa, Staphylococcus epidermidis
SGAKKNNV

SEQ ID NO: 1735214 - protein, 8 aa, Staphylococcus epidermidis
SGASLGSG

SEQ ID NO: 1735215 - protein, 17 aa, Staphylococcus epidermidis
SGATYDIEGESLDNEDK

SEQ ID NO: 1735216 - protein, 16 aa, Staphylococcus epidermidis
SGATYDVAGDNYEVED

SEQ ID NO: 1735217 - protein, 22 aa, Staphylococcus epidermidis
SGDKSKIDQRIDNEANPSDLIS

SEQ ID NO: 1735218 - protein, 7 aa, Staphylococcus epidermidis
SGDLDQQ

SEQ ID NO: 1735219 - protein, 14 aa, Staphylococcus epidermidis
SGDNFKDNKKDSLG

SEQ ID NO: 1735220 - protein, 18 aa, Staphylococcus epidermidis
SGDTEKTTPEFNIGDTPS

SEQ ID NO: 1735221 - protein, 12 aa, Staphylococcus epidermidis
SGDTHNNFIYNE

SEQ ID NO: 1735222 - protein, 13 aa, Staphylococcus epidermidis
SGDYGEYSQLNTP

SEQ ID NO: 1735223 - protein, 7 aa, Staphylococcus epidermidis
SGETLTY

SEQ ID NO: 1735224 - protein, 9 aa, Staphylococcus epidermidis
SGGNANPKQ

SEQ ID NO: 1735225 - protein, 10 aa, Staphylococcus epidermidis
SGGPGTQGKT

SEQ ID NO: 1735226 - protein, 6 aa, Staphylococcus epidermidis
SGGRGG

SEQ ID NO: 1735227 - protein, 6 aa, Staphylococcus epidermidis
SGHTVR

SEQ ID NO: 1735228 - protein, 9 aa, Staphylococcus epidermidis
SGKDMSNSV

SEQ ID NO: 1735229 - protein, 5 aa, Staphylococcus epidermidis
SGKNV

SEQ ID NO: 1735230 - protein, 8 aa, Staphylococcus epidermidis
SGKSEDEI

SEQ ID NO: 1735231 - protein, 15 aa, Staphylococcus epidermidis
SGLENEEPQESQTEL

SEQ ID NO: 1735232 - protein, 11 aa, Staphylococcus epidermidis
SGLTKDQRADL

SEQ ID NO: 1735233 - protein, 38 aa, Staphylococcus epidermidis
SGLTNEQKAKENQAVNDAETRDQVANKLRDAEALDQSM

SEQ ID NO: 1735234 - protein, 38 aa, Staphylococcus epidermidis
SGLTNEQKPKENQAVNGAQTRDQVANKLRDAEALDQSM

SEQ ID NO: 1735235 - protein, 5 aa, Staphylococcus epidermidis
SGMKG

SEQ ID NO: 1735236 - protein, 23 aa, Staphylococcus epidermidis
SGPFSDSESQHQSDNSNLNGKDK

SEQ ID NO: 1735237 - protein, 23 aa, Staphylococcus epidermidis
SGPFSGSESQHQSDNSNLNGKDK

SEQ ID NO: 1735238 - protein, 23 aa, Staphylococcus epidermidis
SGPFSKIGTNQQNQSTDLKGKDK

SEQ ID NO: 1735239 - protein, 41 aa, Staphylococcus epidermidis
SGQAGQNDSDSDNDSLMPTDNNRTSNSSTHMAQKGQMPSVP

SEQ ID NO: 1735240 - protein, 7 aa, Staphylococcus epidermidis
SGQFSTI

SEQ ID NO: 1735241 - protein, 5 aa, Staphylococcus epidermidis
SGQKI

SEQ ID NO: 1735242 - protein, 13 aa, Staphylococcus epidermidis
SGQQEGKSESEVC

SEQ ID NO: 1735243 - protein, 4 aa, Staphylococcus epidermidis
SGSI

SEQ ID NO: 1735244 - protein, 5 aa, Staphylococcus epidermidis
SGSIK

SEQ ID NO: 1735245 - protein, 9 aa, Staphylococcus epidermidis
SGSTGQPKG

SEQ ID NO: 1735246 - protein, 9 aa, Staphylococcus epidermidis
SGSTKAITP

SEQ ID NO: 1735247 - protein, 10 aa, Staphylococcus epidermidis
SGVDAQKGGI

SEQ ID NO: 1735248 - protein, 7 aa, Staphylococcus epidermidis
SGVDSNY

SEQ ID NO: 1735249 - protein, 45 aa, Staphylococcus epidermidis
SGVKNDVNKVKDIGGKARDIGGTTFDKAKDIGTKALDKAKDVSST

SEQ ID NO: 1735250 - protein, 27 aa, Staphylococcus epidermidis
SGVNNSLNKQISKTQLPNTGYSDKTSK

SEQ ID NO: 1735251 - protein, 9 aa, Staphylococcus epidermidis
SHAAEGKSI

SEQ ID NO: 1735252 - protein, 93 aa, Staphylococcus epidermidis
SHDAQAAENSSTQSDTKTTTTTGQNSDGTPPTGTATTTNTSNHKNQADSSQNQNNIQPSTTPTNNSSSQTTTKPNSQSDKKITAKDYQATTYK

SEQ ID NO: 1735253 - protein, 4 aa, Staphylococcus epidermidis
SHDK

SEQ ID NO: 1735254 - protein, 5 aa, Staphylococcus epidermidis
SHDNL

SEQ ID NO: 1735255 - protein, 10 aa, Staphylococcus epidermidis
SHEEAKTKAK

SEQ ID NO: 1735256 - protein, 6 aa, Staphylococcus epidermidis
SHEGEL

SEQ ID NO: 1735257 - protein, 4 aa, Staphylococcus epidermidis
SHET

SEQ ID NO: 1735258 - protein, 11 aa, Staphylococcus epidermidis
SHETKKTKHKI

SEQ ID NO: 1735259 - protein, 6 aa, Staphylococcus epidermidis
SHGTEA

SEQ ID NO: 1735260 - protein, 11 aa, Staphylococcus epidermidis
SHGTNDAQKSM

SEQ ID NO: 1735261 - protein, 9 aa, Staphylococcus epidermidis
SHKGERRPM

SEQ ID NO: 1735262 - protein, 9 aa, Staphylococcus epidermidis
SHPNEKLKG

SEQ ID NO: 1735263 - protein, 12 aa, Staphylococcus epidermidis
SHQREENDNDDL

SEQ ID NO: 1735264 - protein, 13 aa, Staphylococcus epidermidis
SHSHDHSHDHDHG

SEQ ID NO: 1735265 - protein, 6 aa, Staphylococcus epidermidis
SHSTDN

SEQ ID NO: 1735266 - protein, 7 aa, Staphylococcus epidermidis
SHTGSKN

SEQ ID NO: 1735267 - protein, 11 aa, Staphylococcus epidermidis
SIADSGLKNGK

SEQ ID NO: 1735268 - protein, 28 aa, Staphylococcus epidermidis
SIDLGSAEHSRGSEISKQAKDLTANTLP

SEQ ID NO: 1735269 - protein, 5 aa, Staphylococcus epidermidis
SIDTT

SEQ ID NO: 1735270 - protein, 19 aa, Staphylococcus epidermidis
SIDTVDQKQSSEDNGKYKV

SEQ ID NO: 1735271 - protein, 5 aa, Staphylococcus epidermidis
SIETS

SEQ ID NO: 1735272 - protein, 19 aa, Staphylococcus epidermidis
SIETTSISEDGESRISGKT

SEQ ID NO: 1735273 - protein, 4 aa, Staphylococcus epidermidis
SIGG

SEQ ID NO: 1735274 - protein, 7 aa, Staphylococcus epidermidis
SIGQKPV

SEQ ID NO: 1735275 - protein, 6 aa, Staphylococcus epidermidis
SIGTPT

SEQ ID NO: 1735276 - protein, 833 aa, Staphylococcus epidermidis
SIKASESASTSKKLSESASTSTSDSASTQASESASTSKKLSESTSTSTSDSASTSTSESDSTSESTSLSDSTSASLSESTSTSTSDSASTSTSESDSNSTSTSLSESTSTSLSESTSTSTSDSASTSASVSDSNSASTSLRESTSTSLSDSTSTSTSDSASTSTSESDSDSASTSLSGSSSTSVSDSTSASTSESASTSTSISDSNSTSTSLSESTSTSLSESTSTSTSDSASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSKKLSESASTSMSDSASASTSESNSTSTSLSGSTSTSLSGSTSTSTSESASTSTSVSDSNSASTSLSESTSTSLSDSTSTSTSDSTSASTSESDSNSTSTSMSESLSTSVSDSTSTSTSDSASTSTSVSDSNSASTSLSDSTSTSISDSTSASTSDSASESASESESTSESTSVSESSSTSVSDSTSTSTSESASTSTSESESTSESTSVSESSSTSVSDSTSTSTSESASTSTSESESTSESTSLSGSSSTSVSDSTSTSTSESASTSTSVSDSNSTSTSLSESTSTSLSNSTSTSTSDSASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQ

SEQ ID NO: 1735277 - protein, 27 aa, Staphylococcus epidermidis
SIKDKNDTKNSSKYINEDHDEQQAYDN

SEQ ID NO: 1735278 - protein, 12 aa, Staphylococcus epidermidis
SIKHSNNSDVPN

SEQ ID NO: 1735279 - protein, 10 aa, Staphylococcus epidermidis
SIKKGTVNKA

SEQ ID NO: 1735280 - protein, 5 aa, Staphylococcus epidermidis
SIKTH

SEQ ID NO: 1735281 - protein, 11 aa, Staphylococcus epidermidis
SIKTSDNAYPA

SEQ ID NO: 1735282 - protein, 7 aa, Staphylococcus epidermidis
SINNSNS

SEQ ID NO: 1735283 - protein, 16 aa, Staphylococcus epidermidis
SINPEPTIQSKGKTYR

SEQ ID NO: 1735284 - protein, 7 aa, Staphylococcus epidermidis
SINPNTG

SEQ ID NO: 1735285 - protein, 9 aa, Staphylococcus epidermidis
SINPNTGEI

SEQ ID NO: 1735286 - protein, 8 aa, Staphylococcus epidermidis
SINPNTGK

SEQ ID NO: 1735287 - protein, 5 aa, Staphylococcus epidermidis
SIPSW

SEQ ID NO: 1735288 - protein, 27 aa, Staphylococcus epidermidis
SIQNQSTVRQESKYINASDDKKEQYNH

SEQ ID NO: 1735289 - protein, 24 aa, Staphylococcus epidermidis
SISNNETKETTENTVNDKDELNHK

SEQ ID NO: 1735290 - protein, 4 aa, Staphylococcus epidermidis
SISP

SEQ ID NO: 1735291 - protein, 77 aa, Staphylococcus epidermidis
SISSKDGEDFKKPNDVQGSSPDSLSVSGHSDNNTTNRSVHGSSDTSSSSNGGSNSASSGNSSNSSNGASQGNSGNTF

SEQ ID NO: 1735292 - protein, 6 aa, Staphylococcus epidermidis
SITDGY

SEQ ID NO: 1735293 - protein, 16 aa, Staphylococcus epidermidis
SITGKGIKGTVDGTTY

SEQ ID NO: 1735294 - protein, 6 aa, Staphylococcus epidermidis
SITNKP

SEQ ID NO: 1735295 - protein, 6 aa, Staphylococcus epidermidis
SITNPI

SEQ ID NO: 1735296 - protein, 9 aa, Staphylococcus epidermidis
SKAKDKAIQ

SEQ ID NO: 1735297 - protein, 11 aa, Staphylococcus epidermidis
SKAQDKPAYDL

SEQ ID NO: 1735298 - protein, 16 aa, Staphylococcus epidermidis
SKDDDDKKTEKKPKRS

SEQ ID NO: 1735299 - protein, 8 aa, Staphylococcus epidermidis
SKDDERTV

SEQ ID NO: 1735300 - protein, 5 aa, Staphylococcus epidermidis
SKDGK

SEQ ID NO: 1735301 - protein, 5 aa, Staphylococcus epidermidis
SKDKK

SEQ ID NO: 1735302 - protein, 8 aa, Staphylococcus epidermidis
SKDKKGNI

SEQ ID NO: 1735303 - protein, 8 aa, Staphylococcus epidermidis
SKDPNPEY

SEQ ID NO: 1735304 - protein, 11 aa, Staphylococcus epidermidis
SKDQKEELNKN

SEQ ID NO: 1735305 - protein, 9 aa, Staphylococcus epidermidis
SKEATTDNK

SEQ ID NO: 1735306 - protein, 11 aa, Staphylococcus epidermidis
SKEEKEKRDSL

SEQ ID NO: 1735307 - protein, 9 aa, Staphylococcus epidermidis
SKEEQEDIR

SEQ ID NO: 1735308 - protein, 6 aa, Staphylococcus epidermidis
SKESKL

SEQ ID NO: 1735309 - protein, 7 aa, Staphylococcus epidermidis
SKESNYK

SEQ ID NO: 1735310 - protein, 15 aa, Staphylococcus epidermidis
SKEYVDELKQELEFY

SEQ ID NO: 1735311 - protein, 35 aa, Staphylococcus epidermidis
SKGEQEDDSDDEDVKTTNETVKVPYSGSKGKSQTV

SEQ ID NO: 1735312 - protein, 11 aa, Staphylococcus epidermidis
SKGFKDGPRTY

SEQ ID NO: 1735313 - protein, 20 aa, Staphylococcus epidermidis
SKGKQAHKFEQQLDKNNIKH

SEQ ID NO: 1735314 - protein, 10 aa, Staphylococcus epidermidis
SKGLSKAGTW

SEQ ID NO: 1735315 - protein, 6 aa, Staphylococcus epidermidis
SKGSLL

SEQ ID NO: 1735316 - protein, 9 aa, Staphylococcus epidermidis
SKIDRNSPF

SEQ ID NO: 1735317 - protein, 5 aa, Staphylococcus epidermidis
SKIGR

SEQ ID NO: 1735318 - protein, 18 aa, Staphylococcus epidermidis
SKIQGRNTDGGLEWSPDH

SEQ ID NO: 1735319 - protein, 9 aa, Staphylococcus epidermidis
SKITDYNDR

SEQ ID NO: 1735320 - protein, 18 aa, Staphylococcus epidermidis
SKITGTIGHDPKSNKGIM

SEQ ID NO: 1735321 - protein, 8 aa, Staphylococcus epidermidis
SKKDHKNI

SEQ ID NO: 1735322 - protein, 6 aa, Staphylococcus epidermidis
SKKEEV

SEQ ID NO: 1735323 - protein, 6 aa, Staphylococcus epidermidis
SKKGNC

SEQ ID NO: 1735324 - protein, 10 aa, Staphylococcus epidermidis
SKKITENGTF

SEQ ID NO: 1735325 - protein, 57 aa, Staphylococcus epidermidis
SKKKIKNQTEAQYKEKEQHLKESHEEALEKERVENKKAVTKQKEDFDATVNSKDREI

SEQ ID NO: 1735326 - protein, 6 aa, Staphylococcus epidermidis
SKKKLQ

SEQ ID NO: 1735327 - protein, 13 aa, Staphylococcus epidermidis
SKKKMEKNNGDEL

SEQ ID NO: 1735328 - protein, 14 aa, Staphylococcus epidermidis
SKKKMEKNNGDELN

SEQ ID NO: 1735329 - protein, 14 aa, Staphylococcus epidermidis
SKKKMEKNNGKELD

SEQ ID NO: 1735330 - protein, 46 aa, Staphylococcus epidermidis
SKKKVKNQTEAHYKEKEQHLKESHEEALEKERVENKKVVTKQQEDF

SEQ ID NO: 1735331 - protein, 14 aa, Staphylococcus epidermidis
SKKNNYPSNYGKND

SEQ ID NO: 1735332 - protein, 7 aa, Staphylococcus epidermidis
SKKPGEM

SEQ ID NO: 1735333 - protein, 9 aa, Staphylococcus epidermidis
SKKPQAKLE

SEQ ID NO: 1735334 - protein, 6 aa, Staphylococcus epidermidis
SKKQYI

SEQ ID NO: 1735335 - protein, 37 aa, Staphylococcus epidermidis
SKKSEMKEKVESGEIPAQQAQKMKQKMGNQSVDVKQA

SEQ ID NO: 1735336 - protein, 10 aa, Staphylococcus epidermidis
SKKSTSHKDN

SEQ ID NO: 1735337 - protein, 8 aa, Staphylococcus epidermidis
SKLEPPLD

SEQ ID NO: 1735338 - protein, 6 aa, Staphylococcus epidermidis
SKLKER

SEQ ID NO: 1735339 - protein, 9 aa, Staphylococcus epidermidis
SKLKNDDVT

SEQ ID NO: 1735340 - protein, 14 aa, Staphylococcus epidermidis
SKLLTKEKYDQRPL

SEQ ID NO: 1735341 - protein, 16 aa, Staphylococcus epidermidis
SKLNEGTTFKIHFPRE

SEQ ID NO: 1735342 - protein, 27 aa, Staphylococcus epidermidis
SKLSEKTTAQLDEEDSTLARQVDEYND

SEQ ID NO: 1735343 - protein, 11 aa, Staphylococcus epidermidis
SKLSYEPASQE

SEQ ID NO: 1735344 - protein, 9 aa, Staphylococcus epidermidis
SKNAMSKTQ

SEQ ID NO: 1735345 - protein, 25 aa, Staphylococcus epidermidis
SKNEADNAMKQIKTSKQSDKQIANQ

SEQ ID NO: 1735346 - protein, 5 aa, Staphylococcus epidermidis
SKNGT

SEQ ID NO: 1735347 - protein, 10 aa, Staphylococcus epidermidis
SKNKEERTSY

SEQ ID NO: 1735348 - protein, 4 aa, Staphylococcus epidermidis
SKNL

SEQ ID NO: 1735349 - protein, 9 aa, Staphylococcus epidermidis
SKNNDDFNT

SEQ ID NO: 1735350 - protein, 4 aa, Staphylococcus epidermidis
SKNR

SEQ ID NO: 1735351 - protein, 17 aa, Staphylococcus epidermidis
SKNVSDQTSSDNLSNDN

SEQ ID NO: 1735352 - protein, 20 aa, Staphylococcus epidermidis
SKNVSNQASTDNLSNDNTIH

SEQ ID NO: 1735353 - protein, 11 aa, Staphylococcus epidermidis
SKPTKAMKDEM

SEQ ID NO: 1735354 - protein, 18 aa, Staphylococcus epidermidis
SKQEAKEIVDEPEAEKES

SEQ ID NO: 1735355 - protein, 9 aa, Staphylococcus epidermidis
SKRHKRRNT

SEQ ID NO: 1735356 - protein, 7 aa, Staphylococcus epidermidis
SKRTKHN

SEQ ID NO: 1735357 - protein, 10 aa, Staphylococcus epidermidis
SKSAARNEIH

SEQ ID NO: 1735358 - protein, 7 aa, Staphylococcus epidermidis
SKSKKSL

SEQ ID NO: 1735359 - protein, 10 aa, Staphylococcus epidermidis
SKSKTKPDAA

SEQ ID NO: 1735360 - protein, 5 aa, Staphylococcus epidermidis
SKSKV

SEQ ID NO: 1735361 - protein, 18 aa, Staphylococcus epidermidis
SKTEGHGENHSENNLERK

SEQ ID NO: 1735362 - protein, 30 aa, Staphylococcus epidermidis
SKTESNKYGPSPKYNCNETNFHGDNANPVD

SEQ ID NO: 1735363 - protein, 15 aa, Staphylococcus epidermidis
SKTNANWAAPKERGV

SEQ ID NO: 1735364 - protein, 19 aa, Staphylococcus epidermidis
SKTVREGDVVKQDKLADTL

SEQ ID NO: 1735365 - protein, 7 aa, Staphylococcus epidermidis
SKTYASL

SEQ ID NO: 1735366 - protein, 59 aa, Staphylococcus epidermidis
SKVEPYTNSEKVQQQMQQGSQNPQAASQSITQQAGQLSQGLQQAQQGNQKVMNGQKEIQ

SEQ ID NO: 1735367 - protein, 14 aa, Staphylococcus epidermidis
SKVGDQFKERSSLK

SEQ ID NO: 1735368 - protein, 15 aa, Staphylococcus epidermidis
SKVKDDVKKQESPFT

SEQ ID NO: 1735369 - protein, 9 aa, Staphylococcus epidermidis
SKVSARETF

SEQ ID NO: 1735370 - protein, 5 aa, Staphylococcus epidermidis
SKVSL

SEQ ID NO: 1735371 - protein, 9 aa, Staphylococcus epidermidis
SLATTSSDD

SEQ ID NO: 1735372 - protein, 11 aa, Staphylococcus epidermidis
SLDKSDNAYPA

SEQ ID NO: 1735373 - protein, 18 aa, Staphylococcus epidermidis
SLDKSDNAYPALVTSVLP

SEQ ID NO: 1735374 - protein, 20 aa, Staphylococcus epidermidis
SLDTNDKISKEFHQDSQKAS

SEQ ID NO: 1735375 - protein, 10 aa, Staphylococcus epidermidis
SLEDAKKKLE

SEQ ID NO: 1735376 - protein, 10 aa, Staphylococcus epidermidis
SLENKQKYTT

SEQ ID NO: 1735377 - protein, 16 aa, Staphylococcus epidermidis
SLETQITSAKDNANAV

SEQ ID NO: 1735378 - protein, 6 aa, Staphylococcus epidermidis
SLGATN

SEQ ID NO: 1735379 - protein, 6 aa, Staphylococcus epidermidis
SLGETN

SEQ ID NO: 1735380 - protein, 5 aa, Staphylococcus epidermidis
SLGGE

SEQ ID NO: 1735381 - protein, 8 aa, Staphylococcus epidermidis
SLHPTNQA

SEQ ID NO: 1735382 - protein, 4 aa, Staphylococcus epidermidis
SLKA

SEQ ID NO: 1735383 - protein, 4 aa, Staphylococcus epidermidis
SLKE

SEQ ID NO: 1735384 - protein, 25 aa, Staphylococcus epidermidis
SLKGEPEEYLGTDGLKTGTSDEGYS

SEQ ID NO: 1735385 - protein, 18 aa, Staphylococcus epidermidis
SLNDKNPSHIKEAEKDLK

SEQ ID NO: 1735386 - protein, 10 aa, Staphylococcus epidermidis
SLNDKNPTHI

SEQ ID NO: 1735387 - protein, 13 aa, Staphylococcus epidermidis
SLNGENLSGGEVQ

SEQ ID NO: 1735388 - protein, 18 aa, Staphylococcus epidermidis
SLNQSEPNQGSSDHDTIA

SEQ ID NO: 1735389 - protein, 15 aa, Staphylococcus epidermidis
SLPDTGISDKNNDKT

SEQ ID NO: 1735390 - protein, 11 aa, Staphylococcus epidermidis
SLPSEKIDDTY

SEQ ID NO: 1735391 - protein, 4 aa, Staphylococcus epidermidis
SLQA

SEQ ID NO: 1735392 - protein, 13 aa, Staphylococcus epidermidis
SLRSTDKSKSLGT

SEQ ID NO: 1735393 - protein, 545 aa, Staphylococcus epidermidis
SLSDSTSASLSESTSTSTSDSASTSTSESDSNSTSTSLSESTSTSLSESTSTSTSDSASTSASVSDSNSASTSLRESTSTSTSDSASTSTSESDSDSASTSLSGSSSTSVSDSTSASTSESASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSTSISESLSTSDSDSKSMSTSESASTSTSVSDSESASTSISESTSTSTSDSASTSTSVSDSNSASTSLSESSSTSVSDSTSTSTSESASTSTSVSDSNSTSTSLSESTSTSLSNSTSTSTSDSASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQ

SEQ ID NO: 1735394 - protein, 5 aa, Staphylococcus epidermidis
SLSGS

SEQ ID NO: 1735395 - protein, 5 aa, Staphylococcus epidermidis
SLSNL

SEQ ID NO: 1735396 - protein, 8 aa, Staphylococcus epidermidis
SLSNSEKF

SEQ ID NO: 1735397 - protein, 9 aa, Staphylococcus epidermidis
SLSNSSNDM

SEQ ID NO: 1735398 - protein, 24 aa, Staphylococcus epidermidis
SLTKEDLDNYQTRIDKAKDKSNID

SEQ ID NO: 1735399 - protein, 9 aa, Staphylococcus epidermidis
SMGKPLPGI

SEQ ID NO: 1735400 - protein, 11 aa, Staphylococcus epidermidis
SMGNSNAITTN

SEQ ID NO: 1735401 - protein, 18 aa, Staphylococcus epidermidis
SMSMEGGHGNAAAYGKTI

SEQ ID NO: 1735402 - protein, 10 aa, Staphylococcus epidermidis
SNAGSDGLKG

SEQ ID NO: 1735403 - protein, 26 aa, Staphylococcus epidermidis
SNDTRVGTSSINEIAKPENMHKGQDG

SEQ ID NO: 1735404 - protein, 5 aa, Staphylococcus epidermidis
SNEII

SEQ ID NO: 1735405 - protein, 16 aa, Staphylococcus epidermidis
SNEKKFQKKLKDNSYV

SEQ ID NO: 1735406 - protein, 4 aa, Staphylococcus epidermidis
SNEP

SEQ ID NO: 1735407 - protein, 9 aa, Staphylococcus epidermidis
SNEPIKDSE

SEQ ID NO: 1735408 - protein, 18 aa, Staphylococcus epidermidis
SNEPIKDSEWSVTGYPNT

SEQ ID NO: 1735409 - protein, 14 aa, Staphylococcus epidermidis
SNGLTSKGSNTREA

SEQ ID NO: 1735410 - protein, 11 aa, Staphylococcus epidermidis
SNGSGASQGMI

SEQ ID NO: 1735411 - protein, 8 aa, Staphylococcus epidermidis
SNGSHEEN

SEQ ID NO: 1735412 - protein, 10 aa, Staphylococcus epidermidis
SNGSSGQSEA

SEQ ID NO: 1735413 - protein, 35 aa, Staphylococcus epidermidis
SNHTEQDSRGTQPYSSKHSYSQPEDKDNDNTQQAQ

SEQ ID NO: 1735414 - protein, 24 aa, Staphylococcus epidermidis
SNISTKENALHGEQKLATAKTEAI

SEQ ID NO: 1735415 - protein, 4 aa, Staphylococcus epidermidis
SNKS

SEQ ID NO: 1735416 - protein, 34 aa, Staphylococcus epidermidis
SNKTIEKQPKGFSERDVSQAQGSRLRLAAYSQGG

SEQ ID NO: 1735417 - protein, 9 aa, Staphylococcus epidermidis
SNLKQDLTH

SEQ ID NO: 1735418 - protein, 8 aa, Staphylococcus epidermidis
SNLPTGVQ

SEQ ID NO: 1735419 - protein, 4 aa, Staphylococcus epidermidis
SNND

SEQ ID NO: 1735420 - protein, 8 aa, Staphylococcus epidermidis
SNNELNSL

SEQ ID NO: 1735421 - protein, 5 aa, Staphylococcus epidermidis
SNNQS

SEQ ID NO: 1735422 - protein, 146 aa, Staphylococcus epidermidis
SNNQTTPSTGNATSTNQSTPVETKKEEKPAATQAQNKNQESNKEETQATPSDKKEEKKPTETKKEEKPATTQAQNKNQESNKEETQVTPSDKKEEKKPTETKKEETTTSNTKKDEENKDKQKAKNNGQTHLNSNEDENKQTTEEKP

SEQ ID NO: 1735423 - protein, 7 aa, Staphylococcus epidermidis
SNPGPGL

SEQ ID NO: 1735424 - protein, 4 aa, Staphylococcus epidermidis
SNPN

SEQ ID NO: 1735425 - protein, 6 aa, Staphylococcus epidermidis
SNPNTL

SEQ ID NO: 1735426 - protein, 15 aa, Staphylococcus epidermidis
SNQTDKQAQATQQDI

SEQ ID NO: 1735427 - protein, 4 aa, Staphylococcus epidermidis
SNRI

SEQ ID NO: 1735428 - protein, 14 aa, Staphylococcus epidermidis
SNSAINASRRLAKD

SEQ ID NO: 1735429 - protein, 9 aa, Staphylococcus epidermidis
SNSGKVTYQ

SEQ ID NO: 1735430 - protein, 13 aa, Staphylococcus epidermidis
SNSINNSDSSTII

SEQ ID NO: 1735431 - protein, 14 aa, Staphylococcus epidermidis
SNSINNSDSSTIIK

SEQ ID NO: 1735432 - protein, 10 aa, Staphylococcus epidermidis
SNSSFDKNLE

SEQ ID NO: 1735433 - protein, 19 aa, Staphylococcus epidermidis
SNSVPFSSDTTPPTINEPA

SEQ ID NO: 1735434 - protein, 8 aa, Staphylococcus epidermidis
SNTIAESL

SEQ ID NO: 1735435 - protein, 6 aa, Staphylococcus epidermidis
SNTLGY

SEQ ID NO: 1735436 - protein, 7 aa, Staphylococcus epidermidis
SNTTEAF

SEQ ID NO: 1735437 - protein, 4 aa, Staphylococcus epidermidis
SNVE

SEQ ID NO: 1735438 - protein, 8 aa, Staphylococcus epidermidis
SNVEGTQT

SEQ ID NO: 1735439 - protein, 11 aa, Staphylococcus epidermidis
SNWENNKSYPD

SEQ ID NO: 1735440 - protein, 6 aa, Staphylococcus epidermidis
SNWKNH

SEQ ID NO: 1735441 - protein, 5 aa, Staphylococcus epidermidis
SNYGS

SEQ ID NO: 1735442 - protein, 18 aa, Staphylococcus epidermidis
SNYINEDASEKEAYEQAI

SEQ ID NO: 1735443 - protein, 6 aa, Staphylococcus epidermidis
SNYNEV

SEQ ID NO: 1735444 - protein, 5 aa, Staphylococcus epidermidis
SNYSI

SEQ ID NO: 1735445 - protein, 6 aa, Staphylococcus epidermidis
SPALEA

SEQ ID NO: 1735446 - protein, 5 aa, Staphylococcus epidermidis
SPALF

SEQ ID NO: 1735447 - protein, 4 aa, Staphylococcus epidermidis
SPDT

SEQ ID NO: 1735448 - protein, 11 aa, Staphylococcus epidermidis
SPEENFKNGYS

SEQ ID NO: 1735449 - protein, 16 aa, Staphylococcus epidermidis
SPEQAKGESTDEGTDI

SEQ ID NO: 1735450 - protein, 4 aa, Staphylococcus epidermidis
SPFE

SEQ ID NO: 1735451 - protein, 10 aa, Staphylococcus epidermidis
SPGKETERYL

SEQ ID NO: 1735452 - protein, 12 aa, Staphylococcus epidermidis
SPIEKSETQINS

SEQ ID NO: 1735453 - protein, 5 aa, Staphylococcus epidermidis
SPISR

SEQ ID NO: 1735454 - protein, 11 aa, Staphylococcus epidermidis
SPKERQSTLQQ

SEQ ID NO: 1735455 - protein, 5 aa, Staphylococcus epidermidis
SPKGA

SEQ ID NO: 1735456 - protein, 8 aa, Staphylococcus epidermidis
SPKQYRTI

SEQ ID NO: 1735457 - protein, 4 aa, Staphylococcus epidermidis
SPPM

SEQ ID NO: 1735458 - protein, 6 aa, Staphylococcus epidermidis
SPPNNP

SEQ ID NO: 1735459 - protein, 4 aa, Staphylococcus epidermidis
SPQI

SEQ ID NO: 1735460 - protein, 21 aa, Staphylococcus epidermidis
SPRERNVTSQQGYAITQSKGY

SEQ ID NO: 1735461 - protein, 9 aa, Staphylococcus epidermidis
SPSDSGESK

SEQ ID NO: 1735462 - protein, 11 aa, Staphylococcus epidermidis
SPTFTDGVTGA

SEQ ID NO: 1735463 - protein, 9 aa, Staphylococcus epidermidis
SPTGNSAAV

SEQ ID NO: 1735464 - protein, 25 aa, Staphylococcus epidermidis
SPTNAEKAVESDKSPYIQNKQEKNV

SEQ ID NO: 1735465 - protein, 9 aa, Staphylococcus epidermidis
SPYTNKDTF

SEQ ID NO: 1735466 - protein, 16 aa, Staphylococcus epidermidis
SQEEQEAKEKGKENKE

SEQ ID NO: 1735467 - protein, 6 aa, Staphylococcus epidermidis
SQEEVA

SEQ ID NO: 1735468 - protein, 5 aa, Staphylococcus epidermidis
SQEKV

SEQ ID NO: 1735469 - protein, 5 aa, Staphylococcus epidermidis
SQEVT

SEQ ID NO: 1735470 - protein, 9 aa, Staphylococcus epidermidis
SQGSNLQAS

SEQ ID NO: 1735471 - protein, 8 aa, Staphylococcus epidermidis
SQHFSPKM

SEQ ID NO: 1735472 - protein, 4 aa, Staphylococcus epidermidis
SQHP

SEQ ID NO: 1735473 - protein, 11 aa, Staphylococcus epidermidis
SQHSQSKKAYK

SEQ ID NO: 1735474 - protein, 5 aa, Staphylococcus epidermidis
SQIGT

SEQ ID NO: 1735475 - protein, 11 aa, Staphylococcus epidermidis
SQIREEESKLD

SEQ ID NO: 1735476 - protein, 52 aa, Staphylococcus epidermidis
SQITLGDNDTSKAIEHEDEDKKKDEHIKGENGRHDGSVKGHVTRDVDDYDGK

SEQ ID NO: 1735477 - protein, 15 aa, Staphylococcus epidermidis
SQKGQQYKTKHTDIT

SEQ ID NO: 1735478 - protein, 5 aa, Staphylococcus epidermidis
SQKPS

SEQ ID NO: 1735479 - protein, 13 aa, Staphylococcus epidermidis
SQMKKGKGQRFSE

SEQ ID NO: 1735480 - protein, 4 aa, Staphylococcus epidermidis
SQPF

SEQ ID NO: 1735481 - protein, 6 aa, Staphylococcus epidermidis
SQQEDV

SEQ ID NO: 1735482 - protein, 9 aa, Staphylococcus epidermidis
SQQQPDGKF

SEQ ID NO: 1735483 - protein, 8 aa, Staphylococcus epidermidis
SQQYEPKA

SEQ ID NO: 1735484 - protein, 8 aa, Staphylococcus epidermidis
SQSNSTGL

SEQ ID NO: 1735485 - protein, 5 aa, Staphylococcus epidermidis
SQSSD

SEQ ID NO: 1735486 - protein, 9 aa, Staphylococcus epidermidis
SQSSNVYPT

SEQ ID NO: 1735487 - protein, 9 aa, Staphylococcus epidermidis
SQSTRDNIR

SEQ ID NO: 1735488 - protein, 5 aa, Staphylococcus epidermidis
SQTNA

SEQ ID NO: 1735489 - protein, 10 aa, Staphylococcus epidermidis
SQTQGASPYY

SEQ ID NO: 1735490 - protein, 14 aa, Staphylococcus epidermidis
SQVSQSQIKATEHQ

SEQ ID NO: 1735491 - protein, 8 aa, Staphylococcus epidermidis
SQYDQLKG

SEQ ID NO: 1735492 - protein, 4 aa, Staphylococcus epidermidis
SQYG

SEQ ID NO: 1735493 - protein, 13 aa, Staphylococcus epidermidis
SQYGNGNSGTYAD

SEQ ID NO: 1735494 - protein, 14 aa, Staphylococcus epidermidis
SQYGNGNSGTYASG

SEQ ID NO: 1735495 - protein, 6 aa, Staphylococcus epidermidis
SQYRRK

SEQ ID NO: 1735496 - protein, 8 aa, Staphylococcus epidermidis
SQYRRKRR

SEQ ID NO: 1735497 - protein, 12 aa, Staphylococcus epidermidis
SRAKRKKDVGTA

SEQ ID NO: 1735498 - protein, 5 aa, Staphylococcus epidermidis
SRDDT

SEQ ID NO: 1735499 - protein, 9 aa, Staphylococcus epidermidis
SRDKAKKIT

SEQ ID NO: 1735500 - protein, 7 aa, Staphylococcus epidermidis
SRDKDDA

SEQ ID NO: 1735501 - protein, 5 aa, Staphylococcus epidermidis
SRDTN

SEQ ID NO: 1735502 - protein, 17 aa, Staphylococcus epidermidis
SREQEGAGGDSGRQLRQ

SEQ ID NO: 1735503 - protein, 5 aa, Staphylococcus epidermidis
SRETL

SEQ ID NO: 1735504 - protein, 4 aa, Staphylococcus epidermidis
SRGK

SEQ ID NO: 1735505 - protein, 17 aa, Staphylococcus epidermidis
SRHLTKTSKENGQHTNE

SEQ ID NO: 1735506 - protein, 114 aa, Staphylococcus epidermidis
SRHPQSVRNAESEITKAEKNDEEQNITSNNKENNAATHQNVDSTSHDETRSNENDVADSTLQSKQSHNDNQQSNLSTYHQRPQHREIPQNQHNHDQQQSQIGQQAKQVTNESKG

SEQ ID NO: 1735507 - protein, 53 aa, Staphylococcus epidermidis
SRKESRDKLKQEYNKYKEDPELYKSSAKDLATQISNKANETIQEVKKNPKDYV

SEQ ID NO: 1735508 - protein, 8 aa, Staphylococcus epidermidis
SRKYDRHS

SEQ ID NO: 1735509 - protein, 15 aa, Staphylococcus epidermidis
SRKYNRHDNQEKAQA

SEQ ID NO: 1735510 - protein, 8 aa, Staphylococcus epidermidis
SRLKSNAV

SEQ ID NO: 1735511 - protein, 10 aa, Staphylococcus epidermidis
SRNSHEKNGW

SEQ ID NO: 1735512 - protein, 10 aa, Staphylococcus epidermidis
SRNTHGKNGW

SEQ ID NO: 1735513 - protein, 10 aa, Staphylococcus epidermidis
SRNTHGNNGW

SEQ ID NO: 1735514 - protein, 7 aa, Staphylococcus epidermidis
SRRDGFN

SEQ ID NO: 1735515 - protein, 6 aa, Staphylococcus epidermidis
SRSNAI

SEQ ID NO: 1735516 - protein, 8 aa, Staphylococcus epidermidis
SRSSAVKS

SEQ ID NO: 1735517 - protein, 6 aa, Staphylococcus epidermidis
SRTEGE

SEQ ID NO: 1735518 - protein, 18 aa, Staphylococcus epidermidis
SRTKEKAEKLAKATQQQF

SEQ ID NO: 1735519 - protein, 5 aa, Staphylococcus epidermidis
SRTQN

SEQ ID NO: 1735520 - protein, 4 aa, Staphylococcus epidermidis
SSAH

SEQ ID NO: 1735521 - protein, 4 aa, Staphylococcus epidermidis
SSAI

SEQ ID NO: 1735522 - protein, 6 aa, Staphylococcus epidermidis
SSAKRW

SEQ ID NO: 1735523 - protein, 11 aa, Staphylococcus epidermidis
SSAMGQGIAKA

SEQ ID NO: 1735524 - protein, 10 aa, Staphylococcus epidermidis
SSDLGASPMT

SEQ ID NO: 1735525 - protein, 5 aa, Staphylococcus epidermidis
SSDPM

SEQ ID NO: 1735526 - protein, 9 aa, Staphylococcus epidermidis
SSDSGEITY

SEQ ID NO: 1735527 - protein, 8 aa, Staphylococcus epidermidis
SSDSNYQF

SEQ ID NO: 1735528 - protein, 10 aa, Staphylococcus epidermidis
SSDVDASDML

SEQ ID NO: 1735529 - protein, 9 aa, Staphylococcus epidermidis
SSENPREIE

SEQ ID NO: 1735530 - protein, 9 aa, Staphylococcus epidermidis
SSENQQQYN

SEQ ID NO: 1735531 - protein, 5 aa, Staphylococcus epidermidis
SSEQS

SEQ ID NO: 1735532 - protein, 4 aa, Staphylococcus epidermidis
SSFE

SEQ ID NO: 1735533 - protein, 8 aa, Staphylococcus epidermidis
SSGASQQA

SEQ ID NO: 1735534 - protein, 10 aa, Staphylococcus epidermidis
SSGKHNKYHL

SEQ ID NO: 1735535 - protein, 23 aa, Staphylococcus epidermidis
SSGTRADINAKQPLTQAKVEKAV

SEQ ID NO: 1735536 - protein, 5 aa, Staphylococcus epidermidis
SSHVT

SEQ ID NO: 1735537 - protein, 7 aa, Staphylococcus epidermidis
SSIAGPA

SEQ ID NO: 1735538 - protein, 7 aa, Staphylococcus epidermidis
SSIDSKD

SEQ ID NO: 1735539 - protein, 8 aa, Staphylococcus epidermidis
SSISHDGW

SEQ ID NO: 1735540 - protein, 6 aa, Staphylococcus epidermidis
SSISTY

SEQ ID NO: 1735541 - protein, 4 aa, Staphylococcus epidermidis
SSKI

SEQ ID NO: 1735542 - protein, 8 aa, Staphylococcus epidermidis
SSKTKKTR

SEQ ID NO: 1735543 - protein, 8 aa, Staphylococcus epidermidis
SSNHASKE

SEQ ID NO: 1735544 - protein, 14 aa, Staphylococcus epidermidis
SSNNQKLKDVTNKL

SEQ ID NO: 1735545 - protein, 22 aa, Staphylococcus epidermidis
SSPYTSLESNGEDVYSPFKRLL

SEQ ID NO: 1735546 - protein, 4 aa, Staphylococcus epidermidis
SSQT

SEQ ID NO: 1735547 - protein, 20 aa, Staphylococcus epidermidis
SSQTDSRTIIGSGGAEKLLG

SEQ ID NO: 1735548 - protein, 13 aa, Staphylococcus epidermidis
SSSANNGSGFEGL

SEQ ID NO: 1735549 - protein, 14 aa, Staphylococcus epidermidis
SSSANNGSGFEGLG

SEQ ID NO: 1735550 - protein, 8 aa, Staphylococcus epidermidis
SSSDQSSF

SEQ ID NO: 1735551 - protein, 6 aa, Staphylococcus epidermidis
SSSEDG

SEQ ID NO: 1735552 - protein, 121 aa, Staphylococcus epidermidis
SSSHEAKAAEEKQVDPITQANQNDSSERSLENTNQPTVNNEAPQMSSTLQAEEGSNAEAPNVPTIKANSDNDTQTQFSEAPTRNDLARKEDIPAVSKNEELQSSQPNTDSKIEPTTSEPVN

SEQ ID NO: 1735553 - protein, 281 aa, Staphylococcus epidermidis
SSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGNAEAPQSEPTKTEEGGNAEAPNVPTIKANSDNDTQTQFSEAPTRNDLARKEDIPAVSKNEELQSSQPNTDSKIEPTTSEPVN

SEQ ID NO: 1735554 - protein, 8 aa, Staphylococcus epidermidis
SSSKNIRD

SEQ ID NO: 1735555 - protein, 12 aa, Staphylococcus epidermidis
SSSTPADAGVKG

SEQ ID NO: 1735556 - protein, 5 aa, Staphylococcus epidermidis
SSTGN

SEQ ID NO: 1735557 - protein, 29 aa, Staphylococcus epidermidis
SSTGRVSVQRSSREHGFGDNSSYYHGGSV

SEQ ID NO: 1735558 - protein, 9 aa, Staphylococcus epidermidis
SSTTLRDTT

SEQ ID NO: 1735559 - protein, 7 aa, Staphylococcus epidermidis
SSVAYGP

SEQ ID NO: 1735560 - protein, 7 aa, Staphylococcus epidermidis
SSVKQMD

SEQ ID NO: 1735561 - protein, 13 aa, Staphylococcus epidermidis
SSYEYKEGDKIGV

SEQ ID NO: 1735562 - protein, 8 aa, Staphylococcus epidermidis
SSYKSITP

SEQ ID NO: 1735563 - protein, 7 aa, Staphylococcus epidermidis
STAGASS

SEQ ID NO: 1735564 - protein, 7 aa, Staphylococcus epidermidis
STAGDAA

SEQ ID NO: 1735565 - protein, 9 aa, Staphylococcus epidermidis
STAGGNSEI

SEQ ID NO: 1735566 - protein, 184 aa, Staphylococcus epidermidis
STAQSPIVENNQQDNNTNKVVETTNQNKDEVNGKEQNQANTSVTNTQITKNEKDEDTKTLKKDKDEKESKDKKTPKKDKEKKDKKTPKKDREEKKPVIPSNGKVEKDEDTKTPKKDKEKKITKTLKKDREEKSPVIPKSGKDEKDTKITKKDKEDKITTTSKKDNNNDVQDKLPETGKTKDIQN

SEQ ID NO: 1735567 - protein, 146 aa, Staphylococcus epidermidis
STAQSPIVENNQQDNNTNKVVETTNQNKDEVNGKEQNQANTSVTNTQITKNEKDEDTKTLKKDKDEKESKDTKTPKKDKEKKDIKTPKKDREEKKPVIPKSGKDEKDTKITKKDKEDEITTTSKKDNNNDVQDKLPETGKTNDIQN

SEQ ID NO: 1735568 - protein, 184 aa, Staphylococcus epidermidis
STAQSPIVENNQQDNNTNKVVETTNQNKDEVNGKEQNQANTSVTNTQITKNEKDEDTKTLKKDKDEKESKDTKTPKKDKEKKDIKTPKKDREEKKPVIPSNGKVEKDEDTKTPKKDKEKKITKTLKKDREEKNPVIPKSGKDEKDTKITKKDKEDEITTTSKKDNNNDVQDKLPETGKTKDIQN

SEQ ID NO: 1735569 - protein, 234 aa, Staphylococcus epidermidis
STAQSPIVENNQQNNNTNNVVETTNQNKDEVNGKEQNQANTSVTNTQITKNEKDEDTKTLQKDKDEKESKDTKTPKKDKENKDTKTPKKDKENKDTKTPKKDREEKKPVITSNGKDEKDEDRKTPKKDKEEKITKTPKKDREEKKPVIPSNGKVEKDEDRKTSKKDKEEKITKTSKKEREEKSPAIPKSDIDEKDTKITKKDKVDEITTTSKKDNNNDVQDKLPETGKSNDIQN

SEQ ID NO: 1735570 - protein, 8 aa, Staphylococcus epidermidis
STATGTIS

SEQ ID NO: 1735571 - protein, 7 aa, Staphylococcus epidermidis
STAVKTN

SEQ ID NO: 1735572 - protein, 7 aa, Staphylococcus epidermidis
STDAELK

SEQ ID NO: 1735573 - protein, 6 aa, Staphylococcus epidermidis
STDDPI

SEQ ID NO: 1735574 - protein, 8 aa, Staphylococcus epidermidis
STGPNDGM

SEQ ID NO: 1735575 - protein, 9 aa, Staphylococcus epidermidis
STGPNDGME

SEQ ID NO: 1735576 - protein, 8 aa, Staphylococcus epidermidis
STIKPQTL

SEQ ID NO: 1735577 - protein, 8 aa, Staphylococcus epidermidis
STINGTGT

SEQ ID NO: 1735578 - protein, 12 aa, Staphylococcus epidermidis
STIQNEESQDNR

SEQ ID NO: 1735579 - protein, 5 aa, Staphylococcus epidermidis
STISN

SEQ ID NO: 1735580 - protein, 10 aa, Staphylococcus epidermidis
STKEEEIQSI

SEQ ID NO: 1735581 - protein, 12 aa, Staphylococcus epidermidis
STKEEEVESIKS

SEQ ID NO: 1735582 - protein, 14 aa, Staphylococcus epidermidis
STKNKKVDDAEAQQ

SEQ ID NO: 1735583 - protein, 10 aa, Staphylococcus epidermidis
STLNKNGSVH

SEQ ID NO: 1735584 - protein, 12 aa, Staphylococcus epidermidis
STLRSQGAKDMD

SEQ ID NO: 1735585 - protein, 6 aa, Staphylococcus epidermidis
STNFNG

SEQ ID NO: 1735586 - protein, 8 aa, Staphylococcus epidermidis
STNTQTEI

SEQ ID NO: 1735587 - protein, 7 aa, Staphylococcus epidermidis
STNYDEP

SEQ ID NO: 1735588 - protein, 7 aa, Staphylococcus epidermidis
STPDEVA

SEQ ID NO: 1735589 - protein, 5 aa, Staphylococcus epidermidis
STPLS

SEQ ID NO: 1735590 - protein, 4 aa, Staphylococcus epidermidis
STQQ

SEQ ID NO: 1735591 - protein, 7 aa, Staphylococcus epidermidis
STQTDNL

SEQ ID NO: 1735592 - protein, 7 aa, Staphylococcus epidermidis
STQTSHS

SEQ ID NO: 1735593 - protein, 10 aa, Staphylococcus epidermidis
STREESIKAK

SEQ ID NO: 1735594 - protein, 16 aa, Staphylococcus epidermidis
STRNQVGEKIASAKQL

SEQ ID NO: 1735595 - protein, 119 aa, Staphylococcus epidermidis
STSISNSTSLSDSVKASQSLSTKESTSKSLSGSLSASTSNSASIKASESASTSKKLSESASTSMSDSASIKASESASTSKKLSESASTSTSDSASIKASESASTSKKLSESASTSMSDS

SEQ ID NO: 1735596 - protein, 939 aa, Staphylococcus epidermidis
STSISNSTSLSDSVKASQSLSTKESTSKSLSGSLSASTSNSASIKASESASTSKKLSESASTSMSDSASIKASESASTSKKLSESASTSTSDSASIKASESASTSKKLSESASTSMSDSASIKASESASTSKKLSESASTSTSDSASTSMSESDSTSESTSLSDSTSASLSESTSTSTSDSASTSTSESDSNSTSTSLSESTSTSLSESTSTSTSDSASTSASVSDSNSASTSLRESTSTSTSDSASTSTSESDSDSASTSLSGSSSTSVSDSTSASTSESASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSTSISESLSTSDSDSKSMSTSESASTSTSVSDSESASTSISESTSTSVSDSTSTSTSESASTSTSESESASTSKKLSESASTSMSDSASASTSESNSTSTSLSGSTSTSLSGSTSTSTSESASTSTSVSDSNSASTSLSESTSTSLSDSTSTSTSDSASESASESESTSTSVSDSTSASTSTSESESNSTSTSLSESTSTSLSDSTSTSTSDSASTSASESDSNSASTSLSGSLSTSVSDSTSASTSDSTSTSTSVSDSNSTSTSLSESTSTSLSDSTSTSTSDSASTSTSVSDSNSASTSLSESSSTSVSDSTSTSTSESASTSTSVSDSNSTSTSLSESTSTSLSNSTSTSTSDSASTSTSVSDSNSASTSLSGSLSTNVSDSTSTSTSDSASTSTSESDSNSASTSLSGSLSTSISDSTSTSTSDSASTSTSDSASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQ

SEQ ID NO: 1735597 - protein, 1393 aa, Staphylococcus epidermidis
STSISNSTSLSDSVKASQSLSTKESTSKSLSGSLSASTSNSTSIQASESVSTSKKLSESASTSMSDSASIKASESASTSKKLSESASTSTSDSASIKASESASTSKKLSESASTSTSDSASTQASESASTSKKLSESASTSMSDSASIKASESASTSKKLSESASTSTSDSASTQASESASTSKKLSESTSTSTSDSASTSTSESDSTSESTSLSDSTSASLSESTSTSTSDSASTSTSESDSNSTSTSLSESTSTSLSESTSTSTSDSASTSASVSDSNSASTSLRESTSTSLSDSTSTSTSDSASTSTSESDSDSASTSLSGSSSTSVSDSTSASTSESASTSTSISDSNSTSTSLSESTSTSLSESTSTSTSDSASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSTSISESLSTSDSDSKSMSTSESASTSTSVSDSESASTSISESTSTSLSDSTSTSTSDSTSASTSESDSNSTSTSMSESLSTSVSDSTSTSTSDSASTSTSVSDSNSASTSLSDSTSTSISDSTSASTSTSVSDSNSASTSLSESTSTSLSDSTSVSTSDSTSTSTSESDSNSTSTSLSESISTSLSDSTSTSTSDSASTSASESDSNSASTSLSDSTSTSISDSTSTSTSESASTSTSESESASTSKKLSESASTSTSESASTSTSTSTSDSASTSTSESDSNSASTSMSESLSTSVSDSTSMSTSESASTSTSESESNSESTSLSDSTSTSVSDSTRTSTSDSASTSMSVSYSNSASTSLSDSTSTSISDSTSTSTSDSASTSTSVSDSNSASTSLSESTSTSVSDSTSTSTSESASTSTSESESASTSKKLSESASTSMSDSASASTSESNSTSTSLSGSTSTSLSGSTSTSTSESASTSTSVSDSNSASTSLSESTSTSLSGSTSTSTSDSASESASESESTSTSVSDSTSASTSTSESESNSTSTSLSESTSTSLSDSTSTSTSDSASTSASESDSNSASTSLSGSLSTSVSDSTSASTSDSTSTSTSESESNSTSTSLSESTSTSLSDSTSTSTSDSASTSTSVSDSNSASTSLSESSSTSVSDSTSTSTSESASTSTSVSDSNSTSTSLSESTSTSLSNSTSTSTSESASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQ

SEQ ID NO: 1735598 - protein, 16 aa, Staphylococcus epidermidis
STSTKKDEREKSELNQ

SEQ ID NO: 1735599 - protein, 4 aa, Staphylococcus epidermidis
STTI

SEQ ID NO: 1735600 - protein, 10 aa, Staphylococcus epidermidis
STTPKANRKK

SEQ ID NO: 1735601 - protein, 4 aa, Staphylococcus epidermidis
STVT

SEQ ID NO: 1735602 - protein, 4 aa, Staphylococcus epidermidis
STYE

SEQ ID NO: 1735603 - protein, 4 aa, Staphylococcus epidermidis
STYN

SEQ ID NO: 1735604 - protein, 13 aa, Staphylococcus epidermidis
SVDDGQKVKQGDR

SEQ ID NO: 1735605 - protein, 15 aa, Staphylococcus epidermidis
SVDQDKSVDTNKPIR

SEQ ID NO: 1735606 - protein, 6 aa, Staphylococcus epidermidis
SVEEKE

SEQ ID NO: 1735607 - protein, 7 aa, Staphylococcus epidermidis
SVEGQGT

SEQ ID NO: 1735608 - protein, 10 aa, Staphylococcus epidermidis
SVGDKYDGNA

SEQ ID NO: 1735609 - protein, 7 aa, Staphylococcus epidermidis
SVKNPNL

SEQ ID NO: 1735610 - protein, 9 aa, Staphylococcus epidermidis
SVKPSDGEA

SEQ ID NO: 1735611 - protein, 8 aa, Staphylococcus epidermidis
SVKRRKSV

SEQ ID NO: 1735612 - protein, 11 aa, Staphylococcus epidermidis
SVKTKDEIGDL

SEQ ID NO: 1735613 - protein, 28 aa, Staphylococcus epidermidis
SVNDVNNVKANSNYINEDNGPKEAYNQA

SEQ ID NO: 1735614 - protein, 9 aa, Staphylococcus epidermidis
SVNSSSGRA

SEQ ID NO: 1735615 - protein, 44 aa, Staphylococcus epidermidis
SVQNVGQVKQSSNYVNEDQPEQHNYDNAVNEAQATINNNAQPVL

SEQ ID NO: 1735616 - protein, 11 aa, Staphylococcus epidermidis
SVRGINKDKRE

SEQ ID NO: 1735617 - protein, 4 aa, Staphylococcus epidermidis
SVSS

SEQ ID NO: 1735618 - protein, 9 aa, Staphylococcus epidermidis
SVTGLEKTP

SEQ ID NO: 1735619 - protein, 8 aa, Staphylococcus epidermidis
SVTPDANK

SEQ ID NO: 1735620 - protein, 13 aa, Staphylococcus epidermidis
SVTTKRDKKNHGV

SEQ ID NO: 1735621 - protein, 9 aa, Staphylococcus epidermidis
SYAYPSSKE

SEQ ID NO: 1735622 - protein, 9 aa, Staphylococcus epidermidis
SYDDERHHY

SEQ ID NO: 1735623 - protein, 8 aa, Staphylococcus epidermidis
SYDNTINS

SEQ ID NO: 1735624 - protein, 10 aa, Staphylococcus epidermidis
SYDSGAPNKR

SEQ ID NO: 1735625 - protein, 10 aa, Staphylococcus epidermidis
SYDSGTPNKR

SEQ ID NO: 1735626 - protein, 18 aa, Staphylococcus epidermidis
SYEDARDKKENYFDDEYD

SEQ ID NO: 1735627 - protein, 5 aa, Staphylococcus epidermidis
SYGEA

SEQ ID NO: 1735628 - protein, 5 aa, Staphylococcus epidermidis
SYGIN

SEQ ID NO: 1735629 - protein, 14 aa, Staphylococcus epidermidis
SYISREERQHHDST

SEQ ID NO: 1735630 - protein, 5 aa, Staphylococcus epidermidis
SYNDA

SEQ ID NO: 1735631 - protein, 14 aa, Staphylococcus epidermidis
SYNETKDTKLDKPS

SEQ ID NO: 1735632 - protein, 13 aa, Staphylococcus epidermidis
SYNTTKETKLDKK

SEQ ID NO: 1735633 - protein, 6 aa, Staphylococcus epidermidis
SYPQEV

SEQ ID NO: 1735634 - protein, 18 aa, Staphylococcus epidermidis
SYVGESGNRLSGGEKQRI

SEQ ID NO: 1735635 - protein, 12 aa, Staphylococcus epidermidis
SYVGSGAAQFKN

SEQ ID NO: 1735636 - protein, 26 aa, Staphylococcus epidermidis
SYVTTDNAKVDGDQIKISSPASGEIK

SEQ ID NO: 1735637 - protein, 39 aa, Staphylococcus epidermidis
TAANTVASTDPLSKNETDASIKNGNFRQVSGGNLPTRSN

SEQ ID NO: 1735638 - protein, 14 aa, Staphylococcus epidermidis
TAARENRELNTKEI

SEQ ID NO: 1735639 - protein, 13 aa, Staphylococcus epidermidis
TADETKQFNEGVS

SEQ ID NO: 1735640 - protein, 22 aa, Staphylococcus epidermidis
TAEALKNNSQNPELDKANIEQA

SEQ ID NO: 1735641 - protein, 19 aa, Staphylococcus epidermidis
TAEGSAQYKADLKSATAAL

SEQ ID NO: 1735642 - protein, 12 aa, Staphylococcus epidermidis
TAFSDAENEYKI

SEQ ID NO: 1735643 - protein, 29 aa, Staphylococcus epidermidis
TAGAGEATQTQVDQPAISKEQSNHQITEQ

SEQ ID NO: 1735644 - protein, 15 aa, Staphylococcus epidermidis
TAGETKDPEKTIPKA

SEQ ID NO: 1735645 - protein, 28 aa, Staphylococcus epidermidis
TAGKSLKGSYPNVDNEKDRKYYEDNPKK

SEQ ID NO: 1735646 - protein, 4 aa, Staphylococcus epidermidis
TAGY

SEQ ID NO: 1735647 - protein, 8 aa, Staphylococcus epidermidis
TAHSKTET

SEQ ID NO: 1735648 - protein, 11 aa, Staphylococcus epidermidis
TAKNVDTSDAF

SEQ ID NO: 1735649 - protein, 29 aa, Staphylococcus epidermidis
TAKSSNLRSNINSNEKQLAERGANGYSKS

SEQ ID NO: 1735650 - protein, 31 aa, Staphylococcus epidermidis
TALEEAKANINNAQTNDEVDNLKATNTQKIE

SEQ ID NO: 1735651 - protein, 22 aa, Staphylococcus epidermidis
TALNGENKLHTDQESTNRQIEG

SEQ ID NO: 1735652 - protein, 18 aa, Staphylococcus epidermidis
TALQQSLDNQPNTTGMTE

SEQ ID NO: 1735653 - protein, 11 aa, Staphylococcus epidermidis
TANKTSAGFAD

SEQ ID NO: 1735654 - protein, 12 aa, Staphylococcus epidermidis
TANLDSESEVKI

SEQ ID NO: 1735655 - protein, 4 aa, Staphylococcus epidermidis
TAPD

SEQ ID NO: 1735656 - protein, 5 aa, Staphylococcus epidermidis
TAPGI

SEQ ID NO: 1735657 - protein, 4 aa, Staphylococcus epidermidis
TAPM

SEQ ID NO: 1735658 - protein, 10 aa, Staphylococcus epidermidis
TAPNKTGTYG

SEQ ID NO: 1735659 - protein, 29 aa, Staphylococcus epidermidis
TAPTKQPIIKPKEKTKYEFKAGGKSKTVI

SEQ ID NO: 1735660 - protein, 4 aa, Staphylococcus epidermidis
TAPV

SEQ ID NO: 1735661 - protein, 28 aa, Staphylococcus epidermidis
TAQAESKKADIRNNKDATTEEKNTAIQS

SEQ ID NO: 1735662 - protein, 12 aa, Staphylococcus epidermidis
TAQSAKNNQKIY

SEQ ID NO: 1735663 - protein, 11 aa, Staphylococcus epidermidis
TARESNPKHQD

SEQ ID NO: 1735664 - protein, 15 aa, Staphylococcus epidermidis
TATETTGNSADSELS

SEQ ID NO: 1735665 - protein, 9 aa, Staphylococcus epidermidis
TATNQNGKV

SEQ ID NO: 1735666 - protein, 17 aa, Staphylococcus epidermidis
TAVGQKEDVAKKTEKVV

SEQ ID NO: 1735667 - protein, 16 aa, Staphylococcus epidermidis
TAVGQKESIAKETEKV

SEQ ID NO: 1735668 - protein, 10 aa, Staphylococcus epidermidis
TDAEGNETTT

SEQ ID NO: 1735669 - protein, 18 aa, Staphylococcus epidermidis
TDAKDENGELLPDEQRMT

SEQ ID NO: 1735670 - protein, 26 aa, Staphylococcus epidermidis
TDALKAPNYTETSGTPTLKLTNSSQT

SEQ ID NO: 1735671 - protein, 23 aa, Staphylococcus epidermidis
TDAQRNSEKGLVNSSQTRTEVAS

SEQ ID NO: 1735672 - protein, 4 aa, Staphylococcus epidermidis
TDDM

SEQ ID NO: 1735673 - protein, 5 aa, Staphylococcus epidermidis
TDDPL

SEQ ID NO: 1735674 - protein, 4 aa, Staphylococcus epidermidis
TDED

SEQ ID NO: 1735675 - protein, 10 aa, Staphylococcus epidermidis
TDEDQKEIVE

SEQ ID NO: 1735676 - protein, 6 aa, Staphylococcus epidermidis
TDEEIT

SEQ ID NO: 1735677 - protein, 7 aa, Staphylococcus epidermidis
TDEEVTS

SEQ ID NO: 1735678 - protein, 6 aa, Staphylococcus epidermidis
TDETIS

SEQ ID NO: 1735679 - protein, 27 aa, Staphylococcus epidermidis
TDFSNDSNDLKEATDKVINKTKSFGEE

SEQ ID NO: 1735680 - protein, 38 aa, Staphylococcus epidermidis
TDHSRINNTSRNSNEDVTSSNNESNNTKAHSFSNSEYK

SEQ ID NO: 1735681 - protein, 38 aa, Staphylococcus epidermidis
TDHSRINNTSRNSSEDVTSSNNESNNTKAHSFSNSEYK

SEQ ID NO: 1735682 - protein, 14 aa, Staphylococcus epidermidis
TDKEAEKGSAKYGN

SEQ ID NO: 1735683 - protein, 5 aa, Staphylococcus epidermidis
TDKSI

SEQ ID NO: 1735684 - protein, 6 aa, Staphylococcus epidermidis
TDLANK

SEQ ID NO: 1735685 - protein, 5 aa, Staphylococcus epidermidis
TDMPN

SEQ ID NO: 1735686 - protein, 10 aa, Staphylococcus epidermidis
TDNAGGSGLR

SEQ ID NO: 1735687 - protein, 9 aa, Staphylococcus epidermidis
TDNKNGKLT

SEQ ID NO: 1735688 - protein, 5 aa, Staphylococcus epidermidis
TDPNF

SEQ ID NO: 1735689 - protein, 6 aa, Staphylococcus epidermidis
TDPNFD

SEQ ID NO: 1735690 - protein, 9 aa, Staphylococcus epidermidis
TDPSRQSDA

SEQ ID NO: 1735691 - protein, 5 aa, Staphylococcus epidermidis
TDQLG

SEQ ID NO: 1735692 - protein, 5 aa, Staphylococcus epidermidis
TDQLT

SEQ ID NO: 1735693 - protein, 7 aa, Staphylococcus epidermidis
TDQPKEV

SEQ ID NO: 1735694 - protein, 7 aa, Staphylococcus epidermidis
TDRFNGK

SEQ ID NO: 1735695 - protein, 6 aa, Staphylococcus epidermidis
TDRMNR

SEQ ID NO: 1735696 - protein, 26 aa, Staphylococcus epidermidis
TDRNGMATTEASSAAKLNVQPTDNSF

SEQ ID NO: 1735697 - protein, 14 aa, Staphylococcus epidermidis
TDRPDLGQQFKETL

SEQ ID NO: 1735698 - protein, 8 aa, Staphylococcus epidermidis
TDVDTTPR

SEQ ID NO: 1735699 - protein, 7 aa, Staphylococcus epidermidis
TEEYPEE

SEQ ID NO: 1735700 - protein, 5 aa, Staphylococcus epidermidis
TEFRT

SEQ ID NO: 1735701 - protein, 12 aa, Staphylococcus epidermidis
TEGTDSTHALQA

SEQ ID NO: 1735702 - protein, 6 aa, Staphylococcus epidermidis
TEISGQ

SEQ ID NO: 1735703 - protein, 9 aa, Staphylococcus epidermidis
TEKDKHNRY

SEQ ID NO: 1735704 - protein, 6 aa, Staphylococcus epidermidis
TEKTSR

SEQ ID NO: 1735705 - protein, 9 aa, Staphylococcus epidermidis
TELKKKYNI

SEQ ID NO: 1735706 - protein, 16 aa, Staphylococcus epidermidis
TENKTNLNPNYDAEPL

SEQ ID NO: 1735707 - protein, 18 aa, Staphylococcus epidermidis
TENNKGIPDVKDKKYPVK

SEQ ID NO: 1735708 - protein, 6 aa, Staphylococcus epidermidis
TEPALG

SEQ ID NO: 1735709 - protein, 26 aa, Staphylococcus epidermidis
TEPHSSGLGGGGATLSYNGKDGEVPK

SEQ ID NO: 1735710 - protein, 5 aa, Staphylococcus epidermidis
TEQHD

SEQ ID NO: 1735711 - protein, 7 aa, Staphylococcus epidermidis
TEQKSTS

SEQ ID NO: 1735712 - protein, 5 aa, Staphylococcus epidermidis
TEQQW

SEQ ID NO: 1735713 - protein, 6 aa, Staphylococcus epidermidis
TEQTFS

SEQ ID NO: 1735714 - protein, 10 aa, Staphylococcus epidermidis
TERENDLKQR

SEQ ID NO: 1735715 - protein, 8 aa, Staphylococcus epidermidis
TERGNQLT

SEQ ID NO: 1735716 - protein, 14 aa, Staphylococcus epidermidis
TESGQTAAKLSGMA

SEQ ID NO: 1735717 - protein, 4 aa, Staphylococcus epidermidis
TETV

SEQ ID NO: 1735718 - protein, 10 aa, Staphylococcus epidermidis
TEVSKKGGTP

SEQ ID NO: 1735719 - protein, 13 aa, Staphylococcus epidermidis
TEYAIKEDAKRIS

SEQ ID NO: 1735720 - protein, 6 aa, Staphylococcus epidermidis
TEYPKI

SEQ ID NO: 1735721 - protein, 8 aa, Staphylococcus epidermidis
TFESQENE

SEQ ID NO: 1735722 - protein, 29 aa, Staphylococcus epidermidis
TFKTESKEPVSTTYKNNKVYSASNPLGGT

SEQ ID NO: 1735723 - protein, 8 aa, Staphylococcus epidermidis
TFQSPREI

SEQ ID NO: 1735724 - protein, 12 aa, Staphylococcus epidermidis
TFRTKSKNHLQS

SEQ ID NO: 1735725 - protein, 16 aa, Staphylococcus epidermidis
TGAAKSELAKGVEIDG

SEQ ID NO: 1735726 - protein, 14 aa, Staphylococcus epidermidis
TGAKTTGDLRLKKL

SEQ ID NO: 1735727 - protein, 8 aa, Staphylococcus epidermidis
TGATGAVA

SEQ ID NO: 1735728 - protein, 13 aa, Staphylococcus epidermidis
TGDANDKHKEILF

SEQ ID NO: 1735729 - protein, 8 aa, Staphylococcus epidermidis
TGDAPFGS

SEQ ID NO: 1735730 - protein, 6 aa, Staphylococcus epidermidis
TGDNDL

SEQ ID NO: 1735731 - protein, 10 aa, Staphylococcus epidermidis
TGEQIPNDGQ

SEQ ID NO: 1735732 - protein, 9 aa, Staphylococcus epidermidis
TGGAINPSL

SEQ ID NO: 1735733 - protein, 15 aa, Staphylococcus epidermidis
TGGKGDENKSKSISH

SEQ ID NO: 1735734 - protein, 7 aa, Staphylococcus epidermidis
TGGSTDL

SEQ ID NO: 1735735 - protein, 7 aa, Staphylococcus epidermidis
TGHESQG

SEQ ID NO: 1735736 - protein, 26 aa, Staphylococcus epidermidis
TGIPTKNLSANGNASSFTDSARNAVQ

SEQ ID NO: 1735737 - protein, 7 aa, Staphylococcus epidermidis
TGIPTKR

SEQ ID NO: 1735738 - protein, 4 aa, Staphylococcus epidermidis
TGKA

SEQ ID NO: 1735739 - protein, 6 aa, Staphylococcus epidermidis
TGKDLA

SEQ ID NO: 1735740 - protein, 33 aa, Staphylococcus epidermidis
TGKEDSAHPAPTTTVKKGANPNDTHSDSSQGDS

SEQ ID NO: 1735741 - protein, 33 aa, Staphylococcus epidermidis
TGKEDSEHPAPTTTVKKGANPNDTHSDSSQGDS

SEQ ID NO: 1735742 - protein, 36 aa, Staphylococcus epidermidis
TGKEDSEHPAPTTTVKKGASANDNKSDESASTGGGS

SEQ ID NO: 1735743 - protein, 4 aa, Staphylococcus epidermidis
TGLK

SEQ ID NO: 1735744 - protein, 5 aa, Staphylococcus epidermidis
TGNNK

SEQ ID NO: 1735745 - protein, 11 aa, Staphylococcus epidermidis
TGPATKRFGEK

SEQ ID NO: 1735746 - protein, 5 aa, Staphylococcus epidermidis
TGQDY

SEQ ID NO: 1735747 - protein, 12 aa, Staphylococcus epidermidis
TGQGKTSDAEFT

SEQ ID NO: 1735748 - protein, 5 aa, Staphylococcus epidermidis
TGRSY

SEQ ID NO: 1735749 - protein, 4 aa, Staphylococcus epidermidis
TGSS

SEQ ID NO: 1735750 - protein, 5 aa, Staphylococcus epidermidis
TGTGY

SEQ ID NO: 1735751 - protein, 17 aa, Staphylococcus epidermidis
TGTITNGKPKVTDYAGD

SEQ ID NO: 1735752 - protein, 22 aa, Staphylococcus epidermidis
TGTTKYPENVNNPSKGRDQAHD

SEQ ID NO: 1735753 - protein, 4 aa, Staphylococcus epidermidis
TGVA

SEQ ID NO: 1735754 - protein, 9 aa, Staphylococcus epidermidis
TGVKGAANG

SEQ ID NO: 1735755 - protein, 4 aa, Staphylococcus epidermidis
THDT

SEQ ID NO: 1735756 - protein, 13 aa, Staphylococcus epidermidis
THEDKLSKKTGGL

SEQ ID NO: 1735757 - protein, 74 aa, Staphylococcus epidermidis
THEKSTKGSQKSKNSGNKTNATNKKKNTNKKTTNKKQSNTPKQNNRNQKQQTQSDNNQQKVEKANSKIEKRTFN

SEQ ID NO: 1735758 - protein, 7 aa, Staphylococcus epidermidis
THENEED

SEQ ID NO: 1735759 - protein, 4 aa, Staphylococcus epidermidis
THEP

SEQ ID NO: 1735760 - protein, 5 aa, Staphylococcus epidermidis
THNGE

SEQ ID NO: 1735761 - protein, 4 aa, Staphylococcus epidermidis
THNV

SEQ ID NO: 1735762 - protein, 4 aa, Staphylococcus epidermidis
THQK

SEQ ID NO: 1735763 - protein, 7 aa, Staphylococcus epidermidis
THQPKVD

SEQ ID NO: 1735764 - protein, 4 aa, Staphylococcus epidermidis
THQV

SEQ ID NO: 1735765 - protein, 5 aa, Staphylococcus epidermidis
THVNP

SEQ ID NO: 1735766 - protein, 4 aa, Staphylococcus epidermidis
TIAE

SEQ ID NO: 1735767 - protein, 8 aa, Staphylococcus epidermidis
TIDEVKSK

SEQ ID NO: 1735768 - protein, 9 aa, Staphylococcus epidermidis
TIDPGPMEG

SEQ ID NO: 1735769 - protein, 240 aa, Staphylococcus epidermidis
TIEDPEPTTPQEQPKQNDTTQDQQPATDKTESSTPEKPSTSVSNTETQKQDTKVDAQSKQDETSKNQQPATDKTESSTPEKPTTSVNNTETQKQDVKAETPSETGKKDDNKVEKPTTTQTDTTSKQNKSTTNPSEKDRKDKKDKQPKKDKKVKQPKKDVKNPVTGGKTGKDSGKGSKNGKGDDKDRKGVKKEKGNDKDYKNNQVSKTDTVKDSKVNKNDSDSKSTNELPQTGSHKESNNG

SEQ ID NO: 1735770 - protein, 12 aa, Staphylococcus epidermidis
TIEETNAPGFEV

SEQ ID NO: 1735771 - protein, 9 aa, Staphylococcus epidermidis
TIENDHTGF

SEQ ID NO: 1735772 - protein, 5 aa, Staphylococcus epidermidis
TIEPY

SEQ ID NO: 1735773 - protein, 19 aa, Staphylococcus epidermidis
TIGHKKDELYKKSGKNPII

SEQ ID NO: 1735774 - protein, 5 aa, Staphylococcus epidermidis
TIKNA

SEQ ID NO: 1735775 - protein, 5 aa, Staphylococcus epidermidis
TIQKI

SEQ ID NO: 1735776 - protein, 6 aa, Staphylococcus epidermidis
TIQYPS

SEQ ID NO: 1735777 - protein, 10 aa, Staphylococcus epidermidis
TISDSSYRSK

SEQ ID NO: 1735778 - protein, 10 aa, Staphylococcus epidermidis
TISKKQSELV

SEQ ID NO: 1735779 - protein, 4 aa, Staphylococcus epidermidis
TISN

SEQ ID NO: 1735780 - protein, 14 aa, Staphylococcus epidermidis
TKALGKRNKVNQPT

SEQ ID NO: 1735781 - protein, 8 aa, Staphylococcus epidermidis
TKAPRIYE

SEQ ID NO: 1735782 - protein, 12 aa, Staphylococcus epidermidis
TKDATNSDNIKK

SEQ ID NO: 1735783 - protein, 14 aa, Staphylococcus epidermidis
TKDGGSKKDIQQDL

SEQ ID NO: 1735784 - protein, 14 aa, Staphylococcus epidermidis
TKDGKVSVIENVDQ

SEQ ID NO: 1735785 - protein, 5 aa, Staphylococcus epidermidis
TKDGV

SEQ ID NO: 1735786 - protein, 5 aa, Staphylococcus epidermidis
TKDNT

SEQ ID NO: 1735787 - protein, 9 aa, Staphylococcus epidermidis
TKDPVTGNY

SEQ ID NO: 1735788 - protein, 16 aa, Staphylococcus epidermidis
TKDQKEKTSSNEGSFA

SEQ ID NO: 1735789 - protein, 24 aa, Staphylococcus epidermidis
TKDTQADSTETPTHHYQSPNESLS

SEQ ID NO: 1735790 - protein, 15 aa, Staphylococcus epidermidis
TKEDEISALRGEEDD

SEQ ID NO: 1735791 - protein, 24 aa, Staphylococcus epidermidis
TKEDLKSKKEKDVYQQAKSSLEKK

SEQ ID NO: 1735792 - protein, 24 aa, Staphylococcus epidermidis
TKEDLKSKKEPAVYNQAKTSLEKK

SEQ ID NO: 1735793 - protein, 11 aa, Staphylococcus epidermidis
TKEEPPEPPIL

SEQ ID NO: 1735794 - protein, 5 aa, Staphylococcus epidermidis
TKEEQ

SEQ ID NO: 1735795 - protein, 13 aa, Staphylococcus epidermidis
TKEFDNKSPSDAI

SEQ ID NO: 1735796 - protein, 4 aa, Staphylococcus epidermidis
TKEL

SEQ ID NO: 1735797 - protein, 12 aa, Staphylococcus epidermidis
TKELKKEIENQS

SEQ ID NO: 1735798 - protein, 16 aa, Staphylococcus epidermidis
TKEMGAEQKKTNQQII

SEQ ID NO: 1735799 - protein, 8 aa, Staphylococcus epidermidis
TKENKDTV

SEQ ID NO: 1735800 - protein, 9 aa, Staphylococcus epidermidis
TKEQKGSIV

SEQ ID NO: 1735801 - protein, 5 aa, Staphylococcus epidermidis
TKETI

SEQ ID NO: 1735802 - protein, 8 aa, Staphylococcus epidermidis
TKEVPKSE

SEQ ID NO: 1735803 - protein, 25 aa, Staphylococcus epidermidis
TKFATTIDNATTNESVENAKNQSIE

SEQ ID NO: 1735804 - protein, 39 aa, Staphylococcus epidermidis
TKFNDEPTQDVEHTTTKLKTPSISTDSSVNDKQDYTRSA

SEQ ID NO: 1735805 - protein, 39 aa, Staphylococcus epidermidis
TKFNDEPTQDVEYTTTKLKTPSISTDSSVNDKQDYTRSA

SEQ ID NO: 1735806 - protein, 10 aa, Staphylococcus epidermidis
TKFNEEKKQT

SEQ ID NO: 1735807 - protein, 10 aa, Staphylococcus epidermidis
TKGATLATKG

SEQ ID NO: 1735808 - protein, 12 aa, Staphylococcus epidermidis
TKIEGTMGKIKG

SEQ ID NO: 1735809 - protein, 6 aa, Staphylococcus epidermidis
TKKPDD

SEQ ID NO: 1735810 - protein, 7 aa, Staphylococcus epidermidis
TKKPGAF

SEQ ID NO: 1735811 - protein, 68 aa, Staphylococcus epidermidis
TKKQQARAQINDKFNAKEAEINNTPNATQEEKNEAITRLTQSKDNALQQINQAQSNDNVDAAQTGGIQ

SEQ ID NO: 1735812 - protein, 12 aa, Staphylococcus epidermidis
TKKSKEPRLEPR

SEQ ID NO: 1735813 - protein, 7 aa, Staphylococcus epidermidis
TKKYNGG

SEQ ID NO: 1735814 - protein, 6 aa, Staphylococcus epidermidis
TKLDGP

SEQ ID NO: 1735815 - protein, 28 aa, Staphylococcus epidermidis
TKLPESVAETTKTTSETANKEAQGEQSV

SEQ ID NO: 1735816 - protein, 21 aa, Staphylococcus epidermidis
TKNEKIEKNVELPKDANISVK

SEQ ID NO: 1735817 - protein, 22 aa, Staphylococcus epidermidis
TKNEKIEKNVELPKDANVSVNK

SEQ ID NO: 1735818 - protein, 9 aa, Staphylococcus epidermidis
TKNGLADPS

SEQ ID NO: 1735819 - protein, 18 aa, Staphylococcus epidermidis
TKNKDAVATNDNNDFKLK

SEQ ID NO: 1735820 - protein, 10 aa, Staphylococcus epidermidis
TKNKTQDQIP

SEQ ID NO: 1735821 - protein, 8 aa, Staphylococcus epidermidis
TKNPIAEP

SEQ ID NO: 1735822 - protein, 8 aa, Staphylococcus epidermidis
TKPGTYTY

SEQ ID NO: 1735823 - protein, 5 aa, Staphylococcus epidermidis
TKPLR

SEQ ID NO: 1735824 - protein, 13 aa, Staphylococcus epidermidis
TKQKQLANSSRVY

SEQ ID NO: 1735825 - protein, 14 aa, Staphylococcus epidermidis
TKQKRTEPNKEYYG

SEQ ID NO: 1735826 - protein, 7 aa, Staphylococcus epidermidis
TKQQRKM

SEQ ID NO: 1735827 - protein, 9 aa, Staphylococcus epidermidis
TKQSNRGLI

SEQ ID NO: 1735828 - protein, 10 aa, Staphylococcus epidermidis
TKREERKESY

SEQ ID NO: 1735829 - protein, 5 aa, Staphylococcus epidermidis
TKSLN

SEQ ID NO: 1735830 - protein, 6 aa, Staphylococcus epidermidis
TKSNKN

SEQ ID NO: 1735831 - protein, 8 aa, Staphylococcus epidermidis
TKTGSTWS

SEQ ID NO: 1735832 - protein, 6 aa, Staphylococcus epidermidis
TKTKAN

SEQ ID NO: 1735833 - protein, 20 aa, Staphylococcus epidermidis
TKTLGTRNYVNESNNDVRSQ

SEQ ID NO: 1735834 - protein, 6 aa, Staphylococcus epidermidis
TKTNQF

SEQ ID NO: 1735835 - protein, 31 aa, Staphylococcus epidermidis
TKVEDNNTLSDDKKQALKKEIDKTKQSIDRQ

SEQ ID NO: 1735836 - protein, 8 aa, Staphylococcus epidermidis
TKVGRDTA

SEQ ID NO: 1735837 - protein, 13 aa, Staphylococcus epidermidis
TKVNGKSVVGKPL

SEQ ID NO: 1735838 - protein, 7 aa, Staphylococcus epidermidis
TKVSRNT

SEQ ID NO: 1735839 - protein, 4 aa, Staphylococcus epidermidis
TKYT

SEQ ID NO: 1735840 - protein, 10 aa, Staphylococcus epidermidis
TLAGRGAKGI

SEQ ID NO: 1735841 - protein, 17 aa, Staphylococcus epidermidis
TLDDDLSSDVTSPQNSW

SEQ ID NO: 1735842 - protein, 7 aa, Staphylococcus epidermidis
TLHTTNS

SEQ ID NO: 1735843 - protein, 7 aa, Staphylococcus epidermidis
TLIDGPG

SEQ ID NO: 1735844 - protein, 9 aa, Staphylococcus epidermidis
TLKPGERNM

SEQ ID NO: 1735845 - protein, 9 aa, Staphylococcus epidermidis
TLNIKTKER

SEQ ID NO: 1735846 - protein, 14 aa, Staphylococcus epidermidis
TLNYQQKKQQLDDI

SEQ ID NO: 1735847 - protein, 31 aa, Staphylococcus epidermidis
TLPQQSTTEKRGRRSTRSVVENRSSRSDYLD

SEQ ID NO: 1735848 - protein, 20 aa, Staphylococcus epidermidis
TLPSDNQENTSNNEFNNRNH

SEQ ID NO: 1735849 - protein, 10 aa, Staphylococcus epidermidis
TLRHSNGSKV

SEQ ID NO: 1735850 - protein, 8 aa, Staphylococcus epidermidis
TLRTGSLS

SEQ ID NO: 1735851 - protein, 6 aa, Staphylococcus epidermidis
TLTDRA

SEQ ID NO: 1735852 - protein, 13 aa, Staphylococcus epidermidis
TLTPGKSKDIKTN

SEQ ID NO: 1735853 - protein, 13 aa, Staphylococcus epidermidis
TMKPNQKLGEGNY

SEQ ID NO: 1735854 - protein, 22 aa, Staphylococcus epidermidis
TMPGATPQSTQDEISSKIDSQV

SEQ ID NO: 1735855 - protein, 22 aa, Staphylococcus epidermidis
TMPRKESTPDAPTVNANEAQAN

SEQ ID NO: 1735856 - protein, 14 aa, Staphylococcus epidermidis
TMQKETSTNISNKT

SEQ ID NO: 1735857 - protein, 17 aa, Staphylococcus epidermidis
TNAKSSLRADKNELQTA

SEQ ID NO: 1735858 - protein, 5 aa, Staphylococcus epidermidis
TNDLG

SEQ ID NO: 1735859 - protein, 7 aa, Staphylococcus epidermidis
TNDNTVI

SEQ ID NO: 1735860 - protein, 16 aa, Staphylococcus epidermidis
TNEAVNRAKEIATSEI

SEQ ID NO: 1735861 - protein, 11 aa, Staphylococcus epidermidis
TNEDPSKSNQI

SEQ ID NO: 1735862 - protein, 6 aa, Staphylococcus epidermidis
TNENQT

SEQ ID NO: 1735863 - protein, 57 aa, Staphylococcus epidermidis
TNGASDAAGSQTKIQDATKKTGETYKKMTERLKKQNTDVQETLKTGWDGYEKRIEKT

SEQ ID NO: 1735864 - protein, 10 aa, Staphylococcus epidermidis
TNGDFSKEQL

SEQ ID NO: 1735865 - protein, 9 aa, Staphylococcus epidermidis
TNGEFTKNQ

SEQ ID NO: 1735866 - protein, 26 aa, Staphylococcus epidermidis
TNGKINKGTMATVGDKGKGNGPNGFR

SEQ ID NO: 1735867 - protein, 18 aa, Staphylococcus epidermidis
TNGSNGGKGKNLYATNTG

SEQ ID NO: 1735868 - protein, 9 aa, Staphylococcus epidermidis
TNHLPSSNL

SEQ ID NO: 1735869 - protein, 8 aa, Staphylococcus epidermidis
TNISKERH

SEQ ID NO: 1735870 - protein, 6 aa, Staphylococcus epidermidis
TNISKK

SEQ ID NO: 1735871 - protein, 24 aa, Staphylococcus epidermidis
TNKAPKLTMSGDSSLNGDSAGSKE

SEQ ID NO: 1735872 - protein, 9 aa, Staphylococcus epidermidis
TNKDGQASA

SEQ ID NO: 1735873 - protein, 10 aa, Staphylococcus epidermidis
TNKEGQTTTV

SEQ ID NO: 1735874 - protein, 7 aa, Staphylococcus epidermidis
TNKFPYG

SEQ ID NO: 1735875 - protein, 7 aa, Staphylococcus epidermidis
TNKNGVP

SEQ ID NO: 1735876 - protein, 17 aa, Staphylococcus epidermidis
TNLDDQVSKLSERSTSL

SEQ ID NO: 1735877 - protein, 9 aa, Staphylococcus epidermidis
TNNNGKKDI

SEQ ID NO: 1735878 - protein, 5 aa, Staphylococcus epidermidis
TNNPL

SEQ ID NO: 1735879 - protein, 8 aa, Staphylococcus epidermidis
TNNYGHSA

SEQ ID NO: 1735880 - protein, 6 aa, Staphylococcus epidermidis
TNNYQF

SEQ ID NO: 1735881 - protein, 13 aa, Staphylococcus epidermidis
TNPFGQESGTGYH

SEQ ID NO: 1735882 - protein, 4 aa, Staphylococcus epidermidis
TNPK

SEQ ID NO: 1735883 - protein, 9 aa, Staphylococcus epidermidis
TNPKEALGS

SEQ ID NO: 1735884 - protein, 12 aa, Staphylococcus epidermidis
TNPNTKGVSDAG

SEQ ID NO: 1735885 - protein, 9 aa, Staphylococcus epidermidis
TNPSGASND

SEQ ID NO: 1735886 - protein, 5 aa, Staphylococcus epidermidis
TNPSI

SEQ ID NO: 1735887 - protein, 5 aa, Staphylococcus epidermidis
TNPVK

SEQ ID NO: 1735888 - protein, 6 aa, Staphylococcus epidermidis
TNQSFK

SEQ ID NO: 1735889 - protein, 5 aa, Staphylococcus epidermidis
TNRAY

SEQ ID NO: 1735890 - protein, 6 aa, Staphylococcus epidermidis
TNSDMS

SEQ ID NO: 1735891 - protein, 7 aa, Staphylococcus epidermidis
TNSSQVT

SEQ ID NO: 1735892 - protein, 6 aa, Staphylococcus epidermidis
TNTEGQ

SEQ ID NO: 1735893 - protein, 4 aa, Staphylococcus epidermidis
TNTI

SEQ ID NO: 1735894 - protein, 11 aa, Staphylococcus epidermidis
TNTIKTDSISF

SEQ ID NO: 1735895 - protein, 6 aa, Staphylococcus epidermidis
TNTYGD

SEQ ID NO: 1735896 - protein, 6 aa, Staphylococcus epidermidis
TNVTIG

SEQ ID NO: 1735897 - protein, 4 aa, Staphylococcus epidermidis
TNYK

SEQ ID NO: 1735898 - protein, 23 aa, Staphylococcus epidermidis
TNYSNTNNHIEKEATESINFTEE

SEQ ID NO: 1735899 - protein, 31 aa, Staphylococcus epidermidis
TPAIAKSNNGNDTSVGTENVFSDDQSINHSK

SEQ ID NO: 1735900 - protein, 9 aa, Staphylococcus epidermidis
TPDKEHSIG

SEQ ID NO: 1735901 - protein, 9 aa, Staphylococcus epidermidis
TPDKPKVKV

SEQ ID NO: 1735902 - protein, 8 aa, Staphylococcus epidermidis
TPDSPKVK

SEQ ID NO: 1735903 - protein, 13 aa, Staphylococcus epidermidis
TPDVTDEERNDAI

SEQ ID NO: 1735904 - protein, 40 aa, Staphylococcus epidermidis
TPEGYTPTKQNLGSDEGKDSNGTKTTVTVKDADNKTIDSG

SEQ ID NO: 1735905 - protein, 19 aa, Staphylococcus epidermidis
TPETKAEPIGNQPSKSKKF

SEQ ID NO: 1735906 - protein, 21 aa, Staphylococcus epidermidis
TPETKDPRKPVQKYGPEASAF

SEQ ID NO: 1735907 - protein, 27 aa, Staphylococcus epidermidis
TPETVKPNTPVQPYGKEASNYTKKALT

SEQ ID NO: 1735908 - protein, 12 aa, Staphylococcus epidermidis
TPIKQTRQDEIG

SEQ ID NO: 1735909 - protein, 11 aa, Staphylococcus epidermidis
TPKHKHDESTL

SEQ ID NO: 1735910 - protein, 10 aa, Staphylococcus epidermidis
TPKPGETEKA

SEQ ID NO: 1735911 - protein, 16 aa, Staphylococcus epidermidis
TPKPGETQKSITQHAE

SEQ ID NO: 1735912 - protein, 9 aa, Staphylococcus epidermidis
TPLEDGATE

SEQ ID NO: 1735913 - protein, 11 aa, Staphylococcus epidermidis
TPLNSREKMRG

SEQ ID NO: 1735914 - protein, 5 aa, Staphylococcus epidermidis
TPLSD

SEQ ID NO: 1735915 - protein, 8 aa, Staphylococcus epidermidis
TPPNFNQP

SEQ ID NO: 1735916 - protein, 6 aa, Staphylococcus epidermidis
TPRSVI

SEQ ID NO: 1735917 - protein, 8 aa, Staphylococcus epidermidis
TPSDDSTK

SEQ ID NO: 1735918 - protein, 7 aa, Staphylococcus epidermidis
TPSDGIE

SEQ ID NO: 1735919 - protein, 10 aa, Staphylococcus epidermidis
TPSESRKQDH

SEQ ID NO: 1735920 - protein, 4 aa, Staphylococcus epidermidis
TPST

SEQ ID NO: 1735921 - protein, 4 aa, Staphylococcus epidermidis
TQDD

SEQ ID NO: 1735922 - protein, 11 aa, Staphylococcus epidermidis
TQDDRKSQRKV

SEQ ID NO: 1735923 - protein, 5 aa, Staphylococcus epidermidis
TQDIT

SEQ ID NO: 1735924 - protein, 8 aa, Staphylococcus epidermidis
TQDLTRNE

SEQ ID NO: 1735925 - protein, 9 aa, Staphylococcus epidermidis
TQDPNKAKY

SEQ ID NO: 1735926 - protein, 8 aa, Staphylococcus epidermidis
TQEEIQQQ

SEQ ID NO: 1735927 - protein, 13 aa, Staphylococcus epidermidis
TQITSAKDNANAV

SEQ ID NO: 1735928 - protein, 8 aa, Staphylococcus epidermidis
TQKDKVVE

SEQ ID NO: 1735929 - protein, 9 aa, Staphylococcus epidermidis
TQKELPGQL

SEQ ID NO: 1735930 - protein, 10 aa, Staphylococcus epidermidis
TQKETKSQNY

SEQ ID NO: 1735931 - protein, 4 aa, Staphylococcus epidermidis
TQKR

SEQ ID NO: 1735932 - protein, 10 aa, Staphylococcus epidermidis
TQLKNGKSHK

SEQ ID NO: 1735933 - protein, 21 aa, Staphylococcus epidermidis
TQNISNAPTNRDVDQAQTMGS

SEQ ID NO: 1735934 - protein, 5 aa, Staphylococcus epidermidis
TQPSI

SEQ ID NO: 1735935 - protein, 5 aa, Staphylococcus epidermidis
TQQGH

SEQ ID NO: 1735936 - protein, 20 aa, Staphylococcus epidermidis
TQQLDENNVTYKSTSQNVGY

SEQ ID NO: 1735937 - protein, 6 aa, Staphylococcus epidermidis
TQQLNT

SEQ ID NO: 1735938 - protein, 8 aa, Staphylococcus epidermidis
TQRENEGI

SEQ ID NO: 1735939 - protein, 17 aa, Staphylococcus epidermidis
TQREYTTRPNSSNDTFA

SEQ ID NO: 1735940 - protein, 17 aa, Staphylococcus epidermidis
TQRVNTTKNDLNGNDKL

SEQ ID NO: 1735941 - protein, 31 aa, Staphylococcus epidermidis
TQSNKQSSNAKQKDTTQKGTTTQSQASATFE

SEQ ID NO: 1735942 - protein, 8 aa, Staphylococcus epidermidis
TQSNPNFG

SEQ ID NO: 1735943 - protein, 5 aa, Staphylococcus epidermidis
TQSRS

SEQ ID NO: 1735944 - protein, 39 aa, Staphylococcus epidermidis
TQTKTQAKADIAQAIGQQRSTIDQNQNATTEEKQEALER

SEQ ID NO: 1735945 - protein, 8 aa, Staphylococcus epidermidis
TQTQRLGV

SEQ ID NO: 1735946 - protein, 10 aa, Staphylococcus epidermidis
TQVDKSPLYS

SEQ ID NO: 1735947 - protein, 11 aa, Staphylococcus epidermidis
TQYNNTKSEAH

SEQ ID NO: 1735948 - protein, 12 aa, Staphylococcus epidermidis
TRAFDPSTKVGK

SEQ ID NO: 1735949 - protein, 6 aa, Staphylococcus epidermidis
TRDENR

SEQ ID NO: 1735950 - protein, 16 aa, Staphylococcus epidermidis
TRDGEAALEFVKKQFE

SEQ ID NO: 1735951 - protein, 9 aa, Staphylococcus epidermidis
TREAGESKW

SEQ ID NO: 1735952 - protein, 6 aa, Staphylococcus epidermidis
TREDYM

SEQ ID NO: 1735953 - protein, 8 aa, Staphylococcus epidermidis
TREESLHA

SEQ ID NO: 1735954 - protein, 18 aa, Staphylococcus epidermidis
TREEVEDKFGTSNGSVES

SEQ ID NO: 1735955 - protein, 8 aa, Staphylococcus epidermidis
TREHTIKS

SEQ ID NO: 1735956 - protein, 16 aa, Staphylococcus epidermidis
TRELSQAVKESKANVA

SEQ ID NO: 1735957 - protein, 4 aa, Staphylococcus epidermidis
TREN

SEQ ID NO: 1735958 - protein, 5 aa, Staphylococcus epidermidis
TRGPA

SEQ ID NO: 1735959 - protein, 52 aa, Staphylococcus epidermidis
TRKDSRDKLKNEYNKYKENPESYKANAKDLANQIGSKANETIQEVRNNPKDY

SEQ ID NO: 1735960 - protein, 26 aa, Staphylococcus epidermidis
TRKEVEDKFGKSNGNVEGSNYNYETY

SEQ ID NO: 1735961 - protein, 7 aa, Staphylococcus epidermidis
TRLDSNR

SEQ ID NO: 1735962 - protein, 6 aa, Staphylococcus epidermidis
TRLPDG

SEQ ID NO: 1735963 - protein, 11 aa, Staphylococcus epidermidis
TRNRKTTQQEM

SEQ ID NO: 1735964 - protein, 8 aa, Staphylococcus epidermidis
TRNTTPHI

SEQ ID NO: 1735965 - protein, 9 aa, Staphylococcus epidermidis
TRPGQYGKP

SEQ ID NO: 1735966 - protein, 8 aa, Staphylococcus epidermidis
TRQTSKVG

SEQ ID NO: 1735967 - protein, 6 aa, Staphylococcus epidermidis
TRTGAI

SEQ ID NO: 1735968 - protein, 8 aa, Staphylococcus epidermidis
TRVQGEGI

SEQ ID NO: 1735969 - protein, 5 aa, Staphylococcus epidermidis
TSALD

SEQ ID NO: 1735970 - protein, 9 aa, Staphylococcus epidermidis
TSALDSLTE

SEQ ID NO: 1735971 - protein, 5 aa, Staphylococcus epidermidis
TSASA

SEQ ID NO: 1735972 - protein, 7 aa, Staphylococcus epidermidis
TSASAYV

SEQ ID NO: 1735973 - protein, 10 aa, Staphylococcus epidermidis
TSELYEDSKP

SEQ ID NO: 1735974 - protein, 7 aa, Staphylococcus epidermidis
TSEPGHS

SEQ ID NO: 1735975 - protein, 8 aa, Staphylococcus epidermidis
TSEPGQSF

SEQ ID NO: 1735976 - protein, 4 aa, Staphylococcus epidermidis
TSGG

SEQ ID NO: 1735977 - protein, 19 aa, Staphylococcus epidermidis
TSGIPSDITEEDHYSEDYN

SEQ ID NO: 1735978 - protein, 6 aa, Staphylococcus epidermidis
TSGKQM

SEQ ID NO: 1735979 - protein, 5 aa, Staphylococcus epidermidis
TSGNN

SEQ ID NO: 1735980 - protein, 6 aa, Staphylococcus epidermidis
TSIATH

SEQ ID NO: 1735981 - protein, 5 aa, Staphylococcus epidermidis
TSISD

SEQ ID NO: 1735982 - protein, 10 aa, Staphylococcus epidermidis
TSKGESYHSK

SEQ ID NO: 1735983 - protein, 5 aa, Staphylococcus epidermidis
TSKHL

SEQ ID NO: 1735984 - protein, 5 aa, Staphylococcus epidermidis
TSKRM

SEQ ID NO: 1735985 - protein, 10 aa, Staphylococcus epidermidis
TSKSETRPQF

SEQ ID NO: 1735986 - protein, 7 aa, Staphylococcus epidermidis
TSKTLST

SEQ ID NO: 1735987 - protein, 6 aa, Staphylococcus epidermidis
TSLTGD

SEQ ID NO: 1735988 - protein, 9 aa, Staphylococcus epidermidis
TSMTSTTGI

SEQ ID NO: 1735989 - protein, 6 aa, Staphylococcus epidermidis
TSNDLL

SEQ ID NO: 1735990 - protein, 5 aa, Staphylococcus epidermidis
TSNEI

SEQ ID NO: 1735991 - protein, 9 aa, Staphylococcus epidermidis
TSNFSKENT

SEQ ID NO: 1735992 - protein, 5 aa, Staphylococcus epidermidis
TSNKK

SEQ ID NO: 1735993 - protein, 15 aa, Staphylococcus epidermidis
TSNQHDLKDVTKDLN

SEQ ID NO: 1735994 - protein, 13 aa, Staphylococcus epidermidis
TSNQIKSLDSEAR

SEQ ID NO: 1735995 - protein, 9 aa, Staphylococcus epidermidis
TSPDDFNIS

SEQ ID NO: 1735996 - protein, 6 aa, Staphylococcus epidermidis
TSPEQI

SEQ ID NO: 1735997 - protein, 6 aa, Staphylococcus epidermidis
TSQREP

SEQ ID NO: 1735998 - protein, 29 aa, Staphylococcus epidermidis
TSQVSTNGDASPKGDTVLSDNDVKSMNTA

SEQ ID NO: 1735999 - protein, 6 aa, Staphylococcus epidermidis
TSSEDT

SEQ ID NO: 1736000 - protein, 4 aa, Staphylococcus epidermidis
TSSG

SEQ ID NO: 1736001 - protein, 16 aa, Staphylococcus epidermidis
TSSRRIPGYSENITNS

SEQ ID NO: 1736002 - protein, 10 aa, Staphylococcus epidermidis
TSTDNTSNGL

SEQ ID NO: 1736003 - protein, 14 aa, Staphylococcus epidermidis
TSTMNRNETASSGM

SEQ ID NO: 1736004 - protein, 12 aa, Staphylococcus epidermidis
TSTSGGNGNLSN

SEQ ID NO: 1736005 - protein, 11 aa, Staphylococcus epidermidis
TSYQTGAPVSK

SEQ ID NO: 1736006 - protein, 5 aa, Staphylococcus epidermidis
TTAKS

SEQ ID NO: 1736007 - protein, 10 aa, Staphylococcus epidermidis
TTAKSLTDSF

SEQ ID NO: 1736008 - protein, 28 aa, Staphylococcus epidermidis
TTAPPAPAINPIKEGAKEISGKAEPGST

SEQ ID NO: 1736009 - protein, 28 aa, Staphylococcus epidermidis
TTAPPAPTINPIKEGAKEISGKAEPGST

SEQ ID NO: 1736010 - protein, 12 aa, Staphylococcus epidermidis
TTDAEGNATTTN

SEQ ID NO: 1736011 - protein, 9 aa, Staphylococcus epidermidis
TTDESGNVT

SEQ ID NO: 1736012 - protein, 6 aa, Staphylococcus epidermidis
TTDGWN

SEQ ID NO: 1736013 - protein, 6 aa, Staphylococcus epidermidis
TTDNAE

SEQ ID NO: 1736014 - protein, 6 aa, Staphylococcus epidermidis
TTDVNT

SEQ ID NO: 1736015 - protein, 6 aa, Staphylococcus epidermidis
TTIGQS

SEQ ID NO: 1736016 - protein, 6 aa, Staphylococcus epidermidis
TTINQA

SEQ ID NO: 1736017 - protein, 8 aa, Staphylococcus epidermidis
TTKCKEKE

SEQ ID NO: 1736018 - protein, 4 aa, Staphylococcus epidermidis
TTKN

SEQ ID NO: 1736019 - protein, 33 aa, Staphylococcus epidermidis
TTKPMKHTPKDYEDESNIYKTTGYDDNGNSKKI

SEQ ID NO: 1736020 - protein, 19 aa, Staphylococcus epidermidis
TTKPTVTAIKDQTKEINTA

SEQ ID NO: 1736021 - protein, 19 aa, Staphylococcus epidermidis
TTKPTVTSIANQTKEVNTA

SEQ ID NO: 1736022 - protein, 21 aa, Staphylococcus epidermidis
TTKPTVTSIANQTKEVNTPID

SEQ ID NO: 1736023 - protein, 12 aa, Staphylococcus epidermidis
TTKQSLEEVEPN

SEQ ID NO: 1736024 - protein, 10 aa, Staphylococcus epidermidis
TTKSEKIDGD

SEQ ID NO: 1736025 - protein, 9 aa, Staphylococcus epidermidis
TTLSKQQIK

SEQ ID NO: 1736026 - protein, 5 aa, Staphylococcus epidermidis
TTLTQ

SEQ ID NO: 1736027 - protein, 6 aa, Staphylococcus epidermidis
TTNGWD

SEQ ID NO: 1736028 - protein, 8 aa, Staphylococcus epidermidis
TTNYEETD

SEQ ID NO: 1736029 - protein, 5 aa, Staphylococcus epidermidis
TTPPV

SEQ ID NO: 1736030 - protein, 11 aa, Staphylococcus epidermidis
TTPTNKKNRQL

SEQ ID NO: 1736031 - protein, 9 aa, Staphylococcus epidermidis
TTPTQERDL

SEQ ID NO: 1736032 - protein, 9 aa, Staphylococcus epidermidis
TTQNSKQLT

SEQ ID NO: 1736033 - protein, 8 aa, Staphylococcus epidermidis
TTQTYDNG

SEQ ID NO: 1736034 - protein, 8 aa, Staphylococcus epidermidis
TTREFDDG

SEQ ID NO: 1736035 - protein, 4 aa, Staphylococcus epidermidis
TTRQ

SEQ ID NO: 1736036 - protein, 6 aa, Staphylococcus epidermidis
TTSQTI

SEQ ID NO: 1736037 - protein, 13 aa, Staphylococcus epidermidis
TTTDAEGNATTTN

SEQ ID NO: 1736038 - protein, 11 aa, Staphylococcus epidermidis
TTTDAEGNETI

SEQ ID NO: 1736039 - protein, 13 aa, Staphylococcus epidermidis
TTTDAEGNETTTK

SEQ ID NO: 1736040 - protein, 13 aa, Staphylococcus epidermidis
TTTDASGNETTSN

SEQ ID NO: 1736041 - protein, 13 aa, Staphylococcus epidermidis
TTTDASGNETTTS

SEQ ID NO: 1736042 - protein, 13 aa, Staphylococcus epidermidis
TTTDESGNATETT

SEQ ID NO: 1736043 - protein, 9 aa, Staphylococcus epidermidis
TTTQPPELN

SEQ ID NO: 1736044 - protein, 21 aa, Staphylococcus epidermidis
TTTTTSYIESTSGVAVGARTG

SEQ ID NO: 1736045 - protein, 15 aa, Staphylococcus epidermidis
TTTVNGETTVHSAEA

SEQ ID NO: 1736046 - protein, 33 aa, Staphylococcus epidermidis
TTVGDDKTTTTNIKKEKTELPDTGVSSEAAYTT

SEQ ID NO: 1736047 - protein, 4 aa, Staphylococcus epidermidis
TTYG

SEQ ID NO: 1736048 - protein, 29 aa, Staphylococcus epidermidis
TVASTSDSAITMTRNNNELVGQAPNVTNS

SEQ ID NO: 1736049 - protein, 11 aa, Staphylococcus epidermidis
TVEELEKAGAF

SEQ ID NO: 1736050 - protein, 10 aa, Staphylococcus epidermidis
TVGTTNMDNR

SEQ ID NO: 1736051 - protein, 12 aa, Staphylococcus epidermidis
TVKDTAKQAVSE

SEQ ID NO: 1736052 - protein, 24 aa, Staphylococcus epidermidis
TVKGKSKETVKVTDKDDSKVYPSE

SEQ ID NO: 1736053 - protein, 8 aa, Staphylococcus epidermidis
TVKNTALE

SEQ ID NO: 1736054 - protein, 10 aa, Staphylococcus epidermidis
TVKPDKGKVI

SEQ ID NO: 1736055 - protein, 23 aa, Staphylococcus epidermidis
TVNHNSEHNLNSSKSRTTHVTQP

SEQ ID NO: 1736056 - protein, 5 aa, Staphylococcus epidermidis
TVNPN

SEQ ID NO: 1736057 - protein, 6 aa, Staphylococcus epidermidis
TVPKEV

SEQ ID NO: 1736058 - protein, 11 aa, Staphylococcus epidermidis
TVREKTQSNEK

SEQ ID NO: 1736059 - protein, 9 aa, Staphylococcus epidermidis
TVSPDNMSG

SEQ ID NO: 1736060 - protein, 17 aa, Staphylococcus epidermidis
TVTDSDGEKTTIKGTNV

SEQ ID NO: 1736061 - protein, 6 aa, Staphylococcus epidermidis
TWSDET

SEQ ID NO: 1736062 - protein, 5 aa, Staphylococcus epidermidis
TYDNG

SEQ ID NO: 1736063 - protein, 7 aa, Staphylococcus epidermidis
TYEEGRL

SEQ ID NO: 1736064 - protein, 21 aa, Staphylococcus epidermidis
TYEPERKSIFSENGNTNKKEA

SEQ ID NO: 1736065 - protein, 7 aa, Staphylococcus epidermidis
TYKLPGG

SEQ ID NO: 1736066 - protein, 15 aa, Staphylococcus epidermidis
TYLNETAKKVGPRMG

SEQ ID NO: 1736067 - protein, 6 aa, Staphylococcus epidermidis
TYLPNK

SEQ ID NO: 1736068 - protein, 29 aa, Staphylococcus epidermidis
TYNIPTNKAPKLTLDGTGKLSGSSTGNKD

SEQ ID NO: 1736069 - protein, 12 aa, Staphylococcus epidermidis
TYPEKAKNEMQA

SEQ ID NO: 1736070 - protein, 6 aa, Staphylococcus epidermidis
TYRKPG

SEQ ID NO: 1736071 - protein, 20 aa, Staphylococcus epidermidis
TYSDTYASNYSQEEGFKERV

SEQ ID NO: 1736072 - protein, 8 aa, Staphylococcus epidermidis
TYTPSLPK

SEQ ID NO: 1736073 - protein, 4 aa, Staphylococcus epidermidis
TYVP

SEQ ID NO: 1736074 - protein, 6 aa, Staphylococcus epidermidis
VAGNTI

SEQ ID NO: 1736075 - protein, 10 aa, Staphylococcus epidermidis
VAKKPSARME

SEQ ID NO: 1736076 - protein, 42 aa, Staphylococcus epidermidis
VAKNEASQQINQVTQQKLDEIDKDQSLTAKQKEQAKAEVQKL

SEQ ID NO: 1736077 - protein, 9 aa, Staphylococcus epidermidis
VAKNGGITN

SEQ ID NO: 1736078 - protein, 5 aa, Staphylococcus epidermidis
VAPGM

SEQ ID NO: 1736079 - protein, 10 aa, Staphylococcus epidermidis
VAPPAKKPQA

SEQ ID NO: 1736080 - protein, 7 aa, Staphylococcus epidermidis
VAQNGEV

SEQ ID NO: 1736081 - protein, 7 aa, Staphylococcus epidermidis
VASGDDF

SEQ ID NO: 1736082 - protein, 11 aa, Staphylococcus epidermidis
VASTPTSNVAR

SEQ ID NO: 1736083 - protein, 7 aa, Staphylococcus epidermidis
VATADNG

SEQ ID NO: 1736084 - protein, 14 aa, Staphylococcus epidermidis
VATGTAWGSASTAG

SEQ ID NO: 1736085 - protein, 7 aa, Staphylococcus epidermidis
VDANGNN

SEQ ID NO: 1736086 - protein, 11 aa, Staphylococcus epidermidis
VDDDHQGQLQG

SEQ ID NO: 1736087 - protein, 14 aa, Staphylococcus epidermidis
VDEKENQNNADRTN

SEQ ID NO: 1736088 - protein, 6 aa, Staphylococcus epidermidis
VDEKGN

SEQ ID NO: 1736089 - protein, 10 aa, Staphylococcus epidermidis
VDEKHTNNYN

SEQ ID NO: 1736090 - protein, 22 aa, Staphylococcus epidermidis
VDESAITGESAPVIKESGGDFN

SEQ ID NO: 1736091 - protein, 9 aa, Staphylococcus epidermidis
VDFSKQTLA

SEQ ID NO: 1736092 - protein, 10 aa, Staphylococcus epidermidis
VDGSNQNGEF

SEQ ID NO: 1736093 - protein, 21 aa, Staphylococcus epidermidis
VDLPNETPGQIEPLTNNPGNY

SEQ ID NO: 1736094 - protein, 13 aa, Staphylococcus epidermidis
VDNESNKFDSDLE

SEQ ID NO: 1736095 - protein, 17 aa, Staphylococcus epidermidis
VDQEEKENVNKDLNQYD

SEQ ID NO: 1736096 - protein, 8 aa, Staphylococcus epidermidis
VDQNAVSD

SEQ ID NO: 1736097 - protein, 29 aa, Staphylococcus epidermidis
VDRQKGEGVINTKEKDGEFVNAQDSDVAR

SEQ ID NO: 1736098 - protein, 4 aa, Staphylococcus epidermidis
VDSE

SEQ ID NO: 1736099 - protein, 24 aa, Staphylococcus epidermidis
VDSGKGDKTALNYKDEKRKESYTY

SEQ ID NO: 1736100 - protein, 14 aa, Staphylococcus epidermidis
VDSKGENFESHTPN

SEQ ID NO: 1736101 - protein, 8 aa, Staphylococcus epidermidis
VDSKHTIN

SEQ ID NO: 1736102 - protein, 13 aa, Staphylococcus epidermidis
VDTNDKKTASIQQ

SEQ ID NO: 1736103 - protein, 7 aa, Staphylococcus epidermidis
VDVTSNA

SEQ ID NO: 1736104 - protein, 36 aa, Staphylococcus epidermidis
VEAKPSALSEIQQQATNQKAQINQNSEATKEEKEAA

SEQ ID NO: 1736105 - protein, 12 aa, Staphylococcus epidermidis
VEAKRDANTTID

SEQ ID NO: 1736106 - protein, 16 aa, Staphylococcus epidermidis
VEDAKTPESERGPVKI

SEQ ID NO: 1736107 - protein, 25 aa, Staphylococcus epidermidis
VEDATNALNEAKQHLTADTTSLKTE

SEQ ID NO: 1736108 - protein, 23 aa, Staphylococcus epidermidis
VEDEERISESSDDKIPHEQNPNQ

SEQ ID NO: 1736109 - protein, 8 aa, Staphylococcus epidermidis
VEDKDDGK

SEQ ID NO: 1736110 - protein, 10 aa, Staphylococcus epidermidis
VEDKSKVDVQ

SEQ ID NO: 1736111 - protein, 11 aa, Staphylococcus epidermidis
VEEKTKDDNYT

SEQ ID NO: 1736112 - protein, 9 aa, Staphylococcus epidermidis
VEENGDKYS

SEQ ID NO: 1736113 - protein, 5 aa, Staphylococcus epidermidis
VEGPI

SEQ ID NO: 1736114 - protein, 4 aa, Staphylococcus epidermidis
VEKG

SEQ ID NO: 1736115 - protein, 7 aa, Staphylococcus epidermidis
VEKNPMG

SEQ ID NO: 1736116 - protein, 10 aa, Staphylococcus epidermidis
VEKNTERTAD

SEQ ID NO: 1736117 - protein, 13 aa, Staphylococcus epidermidis
VEPEEDESSKERY

SEQ ID NO: 1736118 - protein, 8 aa, Staphylococcus epidermidis
VEQDDNTV

SEQ ID NO: 1736119 - protein, 28 aa, Staphylococcus epidermidis
VEQLKNDSKDNIHADELQAQKAAIQRET

SEQ ID NO: 1736120 - protein, 21 aa, Staphylococcus epidermidis
VERTKKERQVNGNEKDTEYDS

SEQ ID NO: 1736121 - protein, 4 aa, Staphylococcus epidermidis
VESD

SEQ ID NO: 1736122 - protein, 12 aa, Staphylococcus epidermidis
VESGQKVTTIGG

SEQ ID NO: 1736123 - protein, 7 aa, Staphylococcus epidermidis
VETEEYA

SEQ ID NO: 1736124 - protein, 6 aa, Staphylococcus epidermidis
VETGTH

SEQ ID NO: 1736125 - protein, 7 aa, Staphylococcus epidermidis
VETNEER

SEQ ID NO: 1736126 - protein, 21 aa, Staphylococcus epidermidis
VETNGSSGVKNHLTEQDIERA

SEQ ID NO: 1736127 - protein, 14 aa, Staphylococcus epidermidis
VEVTSEKFGKTNRL

SEQ ID NO: 1736128 - protein, 11 aa, Staphylococcus epidermidis
VFSPQSSIESA

SEQ ID NO: 1736129 - protein, 7 aa, Staphylococcus epidermidis
VGANSNS

SEQ ID NO: 1736130 - protein, 8 aa, Staphylococcus epidermidis
VGAQFGQD

SEQ ID NO: 1736131 - protein, 21 aa, Staphylococcus epidermidis
VGDKEKQKVTYSNNKSVEGKV

SEQ ID NO: 1736132 - protein, 8 aa, Staphylococcus epidermidis
VGEDGTTR

SEQ ID NO: 1736133 - protein, 10 aa, Staphylococcus epidermidis
VGEGETYNSH

SEQ ID NO: 1736134 - protein, 4 aa, Staphylococcus epidermidis
VGEN

SEQ ID NO: 1736135 - protein, 10 aa, Staphylococcus epidermidis
VGGATDDINT

SEQ ID NO: 1736136 - protein, 15 aa, Staphylococcus epidermidis
VGGPTPQDPTGSTNS

SEQ ID NO: 1736137 - protein, 4 aa, Staphylococcus epidermidis
VGKG

SEQ ID NO: 1736138 - protein, 7 aa, Staphylococcus epidermidis
VGLEPDQ

SEQ ID NO: 1736139 - protein, 4 aa, Staphylococcus epidermidis
VGNK

SEQ ID NO: 1736140 - protein, 21 aa, Staphylococcus epidermidis
VGNQEKQKVTYGNDKSVTGKV

SEQ ID NO: 1736141 - protein, 10 aa, Staphylococcus epidermidis
VGPSGAGKTT

SEQ ID NO: 1736142 - protein, 10 aa, Staphylococcus epidermidis
VGPSGSGKTT

SEQ ID NO: 1736143 - protein, 9 aa, Staphylococcus epidermidis
VGRGTTEKI

SEQ ID NO: 1736144 - protein, 6 aa, Staphylococcus epidermidis
VGRQRP

SEQ ID NO: 1736145 - protein, 6 aa, Staphylococcus epidermidis
VGSHTY

SEQ ID NO: 1736146 - protein, 6 aa, Staphylococcus epidermidis
VGSKKV

SEQ ID NO: 1736147 - protein, 9 aa, Staphylococcus epidermidis
VGSSVKGGT

SEQ ID NO: 1736148 - protein, 5 aa, Staphylococcus epidermidis
VGTNV

SEQ ID NO: 1736149 - protein, 8 aa, Staphylococcus epidermidis
VGYNPKTL

SEQ ID NO: 1736150 - protein, 18 aa, Staphylococcus epidermidis
VHPETSIKRNAKQEIEQV

SEQ ID NO: 1736151 - protein, 5 aa, Staphylococcus epidermidis
VHTNN

SEQ ID NO: 1736152 - protein, 4 aa, Staphylococcus epidermidis
VIDD

SEQ ID NO: 1736153 - protein, 6 aa, Staphylococcus epidermidis
VIEEGR

SEQ ID NO: 1736154 - protein, 22 aa, Staphylococcus epidermidis
VIENAQPSVQQVSAEKSKVEQA

SEQ ID NO: 1736155 - protein, 7 aa, Staphylococcus epidermidis
VIENGKH

SEQ ID NO: 1736156 - protein, 21 aa, Staphylococcus epidermidis
VIGPQKGSKPRQILVDLDNDE

SEQ ID NO: 1736157 - protein, 21 aa, Staphylococcus epidermidis
VINNGDASAKQISDEKSKVEQ

SEQ ID NO: 1736158 - protein, 16 aa, Staphylococcus epidermidis
VISNKEDSQLNSGEQT

SEQ ID NO: 1736159 - protein, 5 aa, Staphylococcus epidermidis
VITPG

SEQ ID NO: 1736160 - protein, 11 aa, Staphylococcus epidermidis
VIYPKNKSNIS

SEQ ID NO: 1736161 - protein, 221 aa, Staphylococcus epidermidis
VKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFT

SEQ ID NO: 1736162 - protein, 167 aa, Staphylococcus epidermidis
VKAAETDNIVSQNGDNKTNDSESSDKELVKSKDDKTSSTSTDTNLESEFDQNNKPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKT

SEQ ID NO: 1736163 - protein, 14 aa, Staphylococcus epidermidis
VKATSGATGDEFNQ

SEQ ID NO: 1736164 - protein, 13 aa, Staphylococcus epidermidis
VKDDKKVPSGAEY

SEQ ID NO: 1736165 - protein, 14 aa, Staphylococcus epidermidis
VKDDKKVPSGAEYR

SEQ ID NO: 1736166 - protein, 11 aa, Staphylococcus epidermidis
VKDHKGTSSVI

SEQ ID NO: 1736167 - protein, 9 aa, Staphylococcus epidermidis
VKDKSNSIN

SEQ ID NO: 1736168 - protein, 33 aa, Staphylococcus epidermidis
VKDNKEGKAVKSKLKEVENAKSSDTQGDKLSEL

SEQ ID NO: 1736169 - protein, 13 aa, Staphylococcus epidermidis
VKDVDPGKVIMTI

SEQ ID NO: 1736170 - protein, 9 aa, Staphylococcus epidermidis
VKENKVRKI

SEQ ID NO: 1736171 - protein, 22 aa, Staphylococcus epidermidis
VKGPSTDDIKGTVEKVEKTMKD

SEQ ID NO: 1736172 - protein, 18 aa, Staphylococcus epidermidis
VKKERNGYTMTKNKNDSG

SEQ ID NO: 1736173 - protein, 9 aa, Staphylococcus epidermidis
VKKGRGYQI

SEQ ID NO: 1736174 - protein, 10 aa, Staphylococcus epidermidis
VKLSGGQKQR

SEQ ID NO: 1736175 - protein, 11 aa, Staphylococcus epidermidis
VKNREQKGGLG

SEQ ID NO: 1736176 - protein, 12 aa, Staphylococcus epidermidis
VKNTNGFVPNED

SEQ ID NO: 1736177 - protein, 4 aa, Staphylococcus epidermidis
VKPG

SEQ ID NO: 1736178 - protein, 10 aa, Staphylococcus epidermidis
VKPGAGQKAA

SEQ ID NO: 1736179 - protein, 11 aa, Staphylococcus epidermidis
VKPHETINSPN

SEQ ID NO: 1736180 - protein, 29 aa, Staphylococcus epidermidis
VKQETSTEMPKQHEDNEDERQGLNGYRKT

SEQ ID NO: 1736181 - protein, 25 aa, Staphylococcus epidermidis
VKQTKDNLHGDQKLANDKTNAQATL

SEQ ID NO: 1736182 - protein, 7 aa, Staphylococcus epidermidis
VKSALNQ

SEQ ID NO: 1736183 - protein, 6 aa, Staphylococcus epidermidis
VKSDYT

SEQ ID NO: 1736184 - protein, 18 aa, Staphylococcus epidermidis
VKSENGTTVVVTIPRGEL

SEQ ID NO: 1736185 - protein, 22 aa, Staphylococcus epidermidis
VKSNYEKYSQVRSTSGKTGREV

SEQ ID NO: 1736186 - protein, 7 aa, Staphylococcus epidermidis
VKSPAIA

SEQ ID NO: 1736187 - protein, 10 aa, Staphylococcus epidermidis
VKTKRQHEGL

SEQ ID NO: 1736188 - protein, 20 aa, Staphylococcus epidermidis
VKVDNQKVNKVKDHQGGGNA

SEQ ID NO: 1736189 - protein, 5 aa, Staphylococcus epidermidis
VLKQT

SEQ ID NO: 1736190 - protein, 4 aa, Staphylococcus epidermidis
VNAH

SEQ ID NO: 1736191 - protein, 6 aa, Staphylococcus epidermidis
VNAPSV

SEQ ID NO: 1736192 - protein, 12 aa, Staphylococcus epidermidis
VNDDGKVTGDAD

SEQ ID NO: 1736193 - protein, 12 aa, Staphylococcus epidermidis
VNDDGKVTGDAE

SEQ ID NO: 1736194 - protein, 7 aa, Staphylococcus epidermidis
VNEDNES

SEQ ID NO: 1736195 - protein, 6 aa, Staphylococcus epidermidis
VNEEGI

SEQ ID NO: 1736196 - protein, 6 aa, Staphylococcus epidermidis
VNELDQ

SEQ ID NO: 1736197 - protein, 6 aa, Staphylococcus epidermidis
VNELGD

SEQ ID NO: 1736198 - protein, 14 aa, Staphylococcus epidermidis
VNGSEASNEESLSD

SEQ ID NO: 1736199 - protein, 15 aa, Staphylococcus epidermidis
VNGSGKKDSEGYDTY

SEQ ID NO: 1736200 - protein, 5 aa, Staphylococcus epidermidis
VNHTK

SEQ ID NO: 1736201 - protein, 6 aa, Staphylococcus epidermidis
VNKNDK

SEQ ID NO: 1736202 - protein, 9 aa, Staphylococcus epidermidis
VNKNNKTIT

SEQ ID NO: 1736203 - protein, 10 aa, Staphylococcus epidermidis
VNKNNQSMPQ

SEQ ID NO: 1736204 - protein, 20 aa, Staphylococcus epidermidis
VNLTTEKATIEYDADQYDSK

SEQ ID NO: 1736205 - protein, 12 aa, Staphylococcus epidermidis
VNNSENEIKEVQ

SEQ ID NO: 1736206 - protein, 6 aa, Staphylococcus epidermidis
VNPHDS

SEQ ID NO: 1736207 - protein, 8 aa, Staphylococcus epidermidis
VNPNDTEF

SEQ ID NO: 1736208 - protein, 11 aa, Staphylococcus epidermidis
VNQAKTRTDVA

SEQ ID NO: 1736209 - protein, 5 aa, Staphylococcus epidermidis
VNSNT

SEQ ID NO: 1736210 - protein, 10 aa, Staphylococcus epidermidis
VNSVGDSSPY

SEQ ID NO: 1736211 - protein, 34 aa, Staphylococcus epidermidis
VNTDGKKPSSIQNYKSARRNIENQYNTAKDEAHN

SEQ ID NO: 1736212 - protein, 4 aa, Staphylococcus epidermidis
VNTE

SEQ ID NO: 1736213 - protein, 17 aa, Staphylococcus epidermidis
VNTNIDNANTNDQVDNA

SEQ ID NO: 1736214 - protein, 5 aa, Staphylococcus epidermidis
VNTSI

SEQ ID NO: 1736215 - protein, 7 aa, Staphylococcus epidermidis
VNVGTQN

SEQ ID NO: 1736216 - protein, 15 aa, Staphylococcus epidermidis
VNVKGNNNVSTSKIK

SEQ ID NO: 1736217 - protein, 15 aa, Staphylococcus epidermidis
VNVKGNNNVSTSKIN

SEQ ID NO: 1736218 - protein, 4 aa, Staphylococcus epidermidis
VNVN

SEQ ID NO: 1736219 - protein, 17 aa, Staphylococcus epidermidis
VPAQRAENNQKNNKKDN

SEQ ID NO: 1736220 - protein, 6 aa, Staphylococcus epidermidis
VPASQI

SEQ ID NO: 1736221 - protein, 14 aa, Staphylococcus epidermidis
VPDNPKKGKSTITG

SEQ ID NO: 1736222 - protein, 11 aa, Staphylococcus epidermidis
VPEDRKGEGIG

SEQ ID NO: 1736223 - protein, 5 aa, Staphylococcus epidermidis
VPFGP

SEQ ID NO: 1736224 - protein, 4 aa, Staphylococcus epidermidis
VPHS

SEQ ID NO: 1736225 - protein, 7 aa, Staphylococcus epidermidis
VPKNYDE

SEQ ID NO: 1736226 - protein, 6 aa, Staphylococcus epidermidis
VPMSEA

SEQ ID NO: 1736227 - protein, 4 aa, Staphylococcus epidermidis
VPND

SEQ ID NO: 1736228 - protein, 8 aa, Staphylococcus epidermidis
VPNDDSTK

SEQ ID NO: 1736229 - protein, 6 aa, Staphylococcus epidermidis
VPRSYE

SEQ ID NO: 1736230 - protein, 7 aa, Staphylococcus epidermidis
VPRSYEG

SEQ ID NO: 1736231 - protein, 11 aa, Staphylococcus epidermidis
VPSAGKTGTAE

SEQ ID NO: 1736232 - protein, 5 aa, Staphylococcus epidermidis
VPSGD

SEQ ID NO: 1736233 - protein, 17 aa, Staphylococcus epidermidis
VPSTNTKTNAKNDIDTA

SEQ ID NO: 1736234 - protein, 14 aa, Staphylococcus epidermidis
VPVSQSGENQPVYS

SEQ ID NO: 1736235 - protein, 6 aa, Staphylococcus epidermidis
VPYTPG

SEQ ID NO: 1736236 - protein, 22 aa, Staphylococcus epidermidis
VQAESEVTASETKGNSDSSGLN

SEQ ID NO: 1736237 - protein, 19 aa, Staphylococcus epidermidis
VQDGTHSDERVSNSSSKSL

SEQ ID NO: 1736238 - protein, 7 aa, Staphylococcus epidermidis
VQGDSVD

SEQ ID NO: 1736239 - protein, 4 aa, Staphylococcus epidermidis
VQGT

SEQ ID NO: 1736240 - protein, 91 aa, Staphylococcus epidermidis
VQKGEPGTKTITTPTTKNPLTGEKVGEGEPTEKITKQPVDEITEYGGEEIKPGHKDEFDPNAPKGSQEDVPGKPGVKNPDTGEVVTPPVDD

SEQ ID NO: 1736241 - protein, 40 aa, Staphylococcus epidermidis
VQKGEPGTKTITTPTTKNPLTGEKVGEGKSTEKVTKQPVD

SEQ ID NO: 1736242 - protein, 4 aa, Staphylococcus epidermidis
VQNL

SEQ ID NO: 1736243 - protein, 6 aa, Staphylococcus epidermidis
VQPELD

SEQ ID NO: 1736244 - protein, 37 aa, Staphylococcus epidermidis
VQPESEITASETKGNSEASQTSKVTMPRKEQTPPAPT

SEQ ID NO: 1736245 - protein, 7 aa, Staphylococcus epidermidis
VQPESEV

SEQ ID NO: 1736246 - protein, 57 aa, Staphylococcus epidermidis
VQPESEVTASETKGNSDASESSKVTMPRKEATPEPPIVSANDKEATVTVKPNDGATK

SEQ ID NO: 1736247 - protein, 9 aa, Staphylococcus epidermidis
VQQPKQYRP

SEQ ID NO: 1736248 - protein, 5 aa, Staphylococcus epidermidis
VQSES

SEQ ID NO: 1736249 - protein, 16 aa, Staphylococcus epidermidis
VQTNKQGLEKDKKENL

SEQ ID NO: 1736250 - protein, 5 aa, Staphylococcus epidermidis
VRADA

SEQ ID NO: 1736251 - protein, 19 aa, Staphylococcus epidermidis
VRANARKALNEKAQEQNVA

SEQ ID NO: 1736252 - protein, 6 aa, Staphylococcus epidermidis
VRGKDD

SEQ ID NO: 1736253 - protein, 7 aa, Staphylococcus epidermidis
VRPEQTQ

SEQ ID NO: 1736254 - protein, 26 aa, Staphylococcus epidermidis
VRSSQSGATTYNNNTGVANYDGKSEM

SEQ ID NO: 1736255 - protein, 12 aa, Staphylococcus epidermidis
VSDLPEVGQTND

SEQ ID NO: 1736256 - protein, 7 aa, Staphylococcus epidermidis
VSDNETT

SEQ ID NO: 1736257 - protein, 5 aa, Staphylococcus epidermidis
VSEEW

SEQ ID NO: 1736258 - protein, 8 aa, Staphylococcus epidermidis
VSEKDKEH

SEQ ID NO: 1736259 - protein, 7 aa, Staphylococcus epidermidis
VSENGGI

SEQ ID NO: 1736260 - protein, 19 aa, Staphylococcus epidermidis
VSESRDDAHFESEKTKTEL

SEQ ID NO: 1736261 - protein, 12 aa, Staphylococcus epidermidis
VSGESMHPTFED

SEQ ID NO: 1736262 - protein, 14 aa, Staphylococcus epidermidis
VSGISINSNSGQVT

SEQ ID NO: 1736263 - protein, 14 aa, Staphylococcus epidermidis
VSGKKEGREDEKEV

SEQ ID NO: 1736264 - protein, 27 aa, Staphylococcus epidermidis
VSGLPDGVSFDNETNTISGTPTKVGSY

SEQ ID NO: 1736265 - protein, 4 aa, Staphylococcus epidermidis
VSGR

SEQ ID NO: 1736266 - protein, 12 aa, Staphylococcus epidermidis
VSGVGSKVDTVA

SEQ ID NO: 1736267 - protein, 11 aa, Staphylococcus epidermidis
VSKASGKVNGT

SEQ ID NO: 1736268 - protein, 8 aa, Staphylococcus epidermidis
VSKKGGTP

SEQ ID NO: 1736269 - protein, 6 aa, Staphylococcus epidermidis
VSKKRD

SEQ ID NO: 1736270 - protein, 5 aa, Staphylococcus epidermidis
VSNQD

SEQ ID NO: 1736271 - protein, 7 aa, Staphylococcus epidermidis
VSNQNGK

SEQ ID NO: 1736272 - protein, 8 aa, Staphylococcus epidermidis
VSNQNGKV

SEQ ID NO: 1736273 - protein, 12 aa, Staphylococcus epidermidis
VSNTPGLVSNEN

SEQ ID NO: 1736274 - protein, 16 aa, Staphylococcus epidermidis
VSPNRGEVIRDDDNNK

SEQ ID NO: 1736275 - protein, 10 aa, Staphylococcus epidermidis
VSPSTKYGLA

SEQ ID NO: 1736276 - protein, 6 aa, Staphylococcus epidermidis
VSQSDF

SEQ ID NO: 1736277 - protein, 4 aa, Staphylococcus epidermidis
VSRI

SEQ ID NO: 1736278 - protein, 4 aa, Staphylococcus epidermidis
VSRL

SEQ ID NO: 1736279 - protein, 10 aa, Staphylococcus epidermidis
VSSAAGASSF

SEQ ID NO: 1736280 - protein, 7 aa, Staphylococcus epidermidis
VSSIGSA

SEQ ID NO: 1736281 - protein, 5 aa, Staphylococcus epidermidis
VSSNI

SEQ ID NO: 1736282 - protein, 4 aa, Staphylococcus epidermidis
VSSS

SEQ ID NO: 1736283 - protein, 11 aa, Staphylococcus epidermidis
VSSYYSSPSDL

SEQ ID NO: 1736284 - protein, 23 aa, Staphylococcus epidermidis
VSTKKPPKLSSQRSSSKLATTVP

SEQ ID NO: 1736285 - protein, 12 aa, Staphylococcus epidermidis
VSTSSEGIPKEL

SEQ ID NO: 1736286 - protein, 7 aa, Staphylococcus epidermidis
VSTTQEV

SEQ ID NO: 1736287 - protein, 19 aa, Staphylococcus epidermidis
VSVGDERTSISKTNGKDAV

SEQ ID NO: 1736288 - protein, 21 aa, Staphylococcus epidermidis
VTAATTRNEVSNIRQEATTLD

SEQ ID NO: 1736289 - protein, 14 aa, Staphylococcus epidermidis
VTAKDVDTSSPFYE

SEQ ID NO: 1736290 - protein, 9 aa, Staphylococcus epidermidis
VTASGSHFG

SEQ ID NO: 1736291 - protein, 17 aa, Staphylococcus epidermidis
VTATDTSGNISKPSDAI

SEQ ID NO: 1736292 - protein, 5 aa, Staphylococcus epidermidis
VTERL

SEQ ID NO: 1736293 - protein, 6 aa, Staphylococcus epidermidis
VTGGAV

SEQ ID NO: 1736294 - protein, 13 aa, Staphylococcus epidermidis
VTLGKASDKPEFN

SEQ ID NO: 1736295 - protein, 23 aa, Staphylococcus epidermidis
VTMPRKESTPEAPTVNANEAQAN

SEQ ID NO: 1736296 - protein, 24 aa, Staphylococcus epidermidis
VTNAFSPDLNTDLTSDLTGGLNSD

SEQ ID NO: 1736297 - protein, 5 aa, Staphylococcus epidermidis
VTPGS

SEQ ID NO: 1736298 - protein, 11 aa, Staphylococcus epidermidis
VTPPTRKSEGI

SEQ ID NO: 1736299 - protein, 37 aa, Staphylococcus epidermidis
VTPQTKPNAKAEITNAVNKQREAINSNQNATTEEKEA

SEQ ID NO: 1736300 - protein, 13 aa, Staphylococcus epidermidis
VTRKGIEKDQEEY

SEQ ID NO: 1736301 - protein, 13 aa, Staphylococcus epidermidis
VTRKGIEKDQQEY

SEQ ID NO: 1736302 - protein, 33 aa, Staphylococcus epidermidis
VTSDGNTHNIKGSSKKDGKHYKDDYKYSGDVDY

SEQ ID NO: 1736303 - protein, 749 aa, Staphylococcus epidermidis
VTTGTVDTGGQPARADQGQEGPQAGADTHNTASQPGATGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQSGATVKPSTTPNQDAEVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDY

SEQ ID NO: 1736304 - protein, 708 aa, Staphylococcus epidermidis
VTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTGQSTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNTEQNNQNAEPSAPGTTDQAGATVKPGSAPNQDTEVKPNPDQNNNSPTGQDADQTGQGTQVKPNNDQTATGTQGATGDQNTQQGNTEQNSQNAEQGNTGQEGSNPNQSGQLGATVKPGSATNQDTEVKPNPDQNNKPTTGQDADQTGQSTHVKPNNNQTATGTQDAIGDQNTQQGNAGNKGNAGNKGNAGNKGNTDKDAKVNTNDDETKTDVKNGTELPETGLSNEHDYTT

SEQ ID NO: 1736305 - protein, 14 aa, Staphylococcus epidermidis
VTTNNKSGVGGAGI

SEQ ID NO: 1736306 - protein, 14 aa, Staphylococcus epidermidis
VTTTDESGNETETT

SEQ ID NO: 1736307 - protein, 15 aa, Staphylococcus epidermidis
VTTTDESGNSETTTF

SEQ ID NO: 1736308 - protein, 14 aa, Staphylococcus epidermidis
VTTTDESGNVTETT

SEQ ID NO: 1736309 - protein, 15 aa, Staphylococcus epidermidis
VTTTDESSNATETTF

SEQ ID NO: 1736310 - protein, 15 aa, Staphylococcus epidermidis
VTTTDKNGNSETTTF

SEQ ID NO: 1736311 - protein, 6 aa, Staphylococcus epidermidis
VTTTED

SEQ ID NO: 1736312 - protein, 6 aa, Staphylococcus epidermidis
VTTTNG

SEQ ID NO: 1736313 - protein, 13 aa, Staphylococcus epidermidis
VTVNSTGKKGEGK

SEQ ID NO: 1736314 - protein, 29 aa, Staphylococcus epidermidis
VVETTNQAIEDAPDTNQVNVEKNKGIGTI

SEQ ID NO: 1736315 - protein, 89 aa, Staphylococcus epidermidis
VVKDEDTDYSDGKYGKSYDDIRKEQLEEGHKEEEQDRKEDREIDKERRQQEDRDRSGSESDHDSDSEATGHEQSPNIDKPYDPSNPDNR

SEQ ID NO: 1736316 - protein, 5 aa, Staphylococcus epidermidis
VVKPE

SEQ ID NO: 1736317 - protein, 13 aa, Staphylococcus epidermidis
VVKTDKKGTAYVG

SEQ ID NO: 1736318 - protein, 4 aa, Staphylococcus epidermidis
VVNK

SEQ ID NO: 1736319 - protein, 10 aa, Staphylococcus epidermidis
VVNPGKRGHD

SEQ ID NO: 1736320 - protein, 11 aa, Staphylococcus epidermidis
VVNQNDTHEHI

SEQ ID NO: 1736321 - protein, 7 aa, Staphylococcus epidermidis
VYGSKTF

SEQ ID NO: 1736322 - protein, 9 aa, Staphylococcus epidermidis
VYGSKTFGK

SEQ ID NO: 1736323 - protein, 4 aa, Staphylococcus epidermidis
VYST

SEQ ID NO: 1736324 - protein, 9 aa, Staphylococcus epidermidis
VYTDGQQKF

SEQ ID NO: 1736325 - protein, 7 aa, Staphylococcus epidermidis
WASEGKT

SEQ ID NO: 1736326 - protein, 6 aa, Staphylococcus epidermidis
WDKDNS

SEQ ID NO: 1736327 - protein, 16 aa, Staphylococcus epidermidis
WDKDTFESNHYGELSS

SEQ ID NO: 1736328 - protein, 19 aa, Staphylococcus epidermidis
WDTEDQAITDLTSPGAEKL

SEQ ID NO: 1736329 - protein, 8 aa, Staphylococcus epidermidis
WEEKIKKK

SEQ ID NO: 1736330 - protein, 5 aa, Staphylococcus epidermidis
WGGSG

SEQ ID NO: 1736331 - protein, 22 aa, Staphylococcus epidermidis
WNAAKGALNAAKSALDSHSPSR

SEQ ID NO: 1736332 - protein, 6 aa, Staphylococcus epidermidis
WNGKNN

SEQ ID NO: 1736333 - protein, 10 aa, Staphylococcus epidermidis
WNPTGSSPEY

SEQ ID NO: 1736334 - protein, 7 aa, Staphylococcus epidermidis
WQESREE

SEQ ID NO: 1736335 - protein, 5 aa, Staphylococcus epidermidis
WSPKA

SEQ ID NO: 1736336 - protein, 4 aa, Staphylococcus epidermidis
WTGE

SEQ ID NO: 1736337 - protein, 16 aa, Staphylococcus epidermidis
YAEGGNIQSHSVPGTY

SEQ ID NO: 1736338 - protein, 10 aa, Staphylococcus epidermidis
YAEGKSKREI

SEQ ID NO: 1736339 - protein, 4 aa, Staphylococcus epidermidis
YAEM

SEQ ID NO: 1736340 - protein, 7 aa, Staphylococcus epidermidis
YAGETDL

SEQ ID NO: 1736341 - protein, 6 aa, Staphylococcus epidermidis
YAGETG

SEQ ID NO: 1736342 - protein, 8 aa, Staphylococcus epidermidis
YAGNAEPV

SEQ ID NO: 1736343 - protein, 8 aa, Staphylococcus epidermidis
YAKPGHGN

SEQ ID NO: 1736344 - protein, 9 aa, Staphylococcus epidermidis
YAKTDKLGT

SEQ ID NO: 1736345 - protein, 10 aa, Staphylococcus epidermidis
YAPAKNKQNR

SEQ ID NO: 1736346 - protein, 9 aa, Staphylococcus epidermidis
YAPKEMTIK

SEQ ID NO: 1736347 - protein, 7 aa, Staphylococcus epidermidis
YAPTKAS

SEQ ID NO: 1736348 - protein, 7 aa, Staphylococcus epidermidis
YAQTKAS

SEQ ID NO: 1736349 - protein, 4 aa, Staphylococcus epidermidis
YARG

SEQ ID NO: 1736350 - protein, 8 aa, Staphylococcus epidermidis
YASGDSSI

SEQ ID NO: 1736351 - protein, 26 aa, Staphylococcus epidermidis
YDAEPINNDDDQQTSRKEQELKAKRT

SEQ ID NO: 1736352 - protein, 6 aa, Staphylococcus epidermidis
YDEMGG

SEQ ID NO: 1736353 - protein, 9 aa, Staphylococcus epidermidis
YDFQETTKD

SEQ ID NO: 1736354 - protein, 11 aa, Staphylococcus epidermidis
YDGDNDGNQAF

SEQ ID NO: 1736355 - protein, 12 aa, Staphylococcus epidermidis
YDKEKGQEYLKT

SEQ ID NO: 1736356 - protein, 12 aa, Staphylococcus epidermidis
YDKEKGRNYLNS

SEQ ID NO: 1736357 - protein, 10 aa, Staphylococcus epidermidis
YDKTTNTTTY

SEQ ID NO: 1736358 - protein, 11 aa, Staphylococcus epidermidis
YDKTTNTTTYT

SEQ ID NO: 1736359 - protein, 7 aa, Staphylococcus epidermidis
YDTKYGK

SEQ ID NO: 1736360 - protein, 17 aa, Staphylococcus epidermidis
YEAFARPKKPENVDKKS

SEQ ID NO: 1736361 - protein, 6 aa, Staphylococcus epidermidis
YEDGTV

SEQ ID NO: 1736362 - protein, 41 aa, Staphylococcus epidermidis
YEDTSSHNQNTPQAATQHTETSQHDTTDQTLPETGQSHTGI

SEQ ID NO: 1736363 - protein, 14 aa, Staphylococcus epidermidis
YEEINEANHDATVD

SEQ ID NO: 1736364 - protein, 11 aa, Staphylococcus epidermidis
YEKPPQKDKDP

SEQ ID NO: 1736365 - protein, 17 aa, Staphylococcus epidermidis
YENKDYSTAKKELESKG

SEQ ID NO: 1736366 - protein, 5 aa, Staphylococcus epidermidis
YENSH

SEQ ID NO: 1736367 - protein, 8 aa, Staphylococcus epidermidis
YEPVENQY

SEQ ID NO: 1736368 - protein, 14 aa, Staphylococcus epidermidis
YESSIADDTPEGRS

SEQ ID NO: 1736369 - protein, 15 aa, Staphylococcus epidermidis
YESSVEDDTPEGSSI

SEQ ID NO: 1736370 - protein, 6 aa, Staphylococcus epidermidis
YETGET

SEQ ID NO: 1736371 - protein, 5 aa, Staphylococcus epidermidis
YETLK

SEQ ID NO: 1736372 - protein, 4 aa, Staphylococcus epidermidis
YGAE

SEQ ID NO: 1736373 - protein, 5 aa, Staphylococcus epidermidis
YGDEV

SEQ ID NO: 1736374 - protein, 6 aa, Staphylococcus epidermidis
YGDEVK

SEQ ID NO: 1736375 - protein, 4 aa, Staphylococcus epidermidis
YGDK

SEQ ID NO: 1736376 - protein, 4 aa, Staphylococcus epidermidis
YGEN

SEQ ID NO: 1736377 - protein, 4 aa, Staphylococcus epidermidis
YGER

SEQ ID NO: 1736378 - protein, 6 aa, Staphylococcus epidermidis
YGESIN

SEQ ID NO: 1736379 - protein, 5 aa, Staphylococcus epidermidis
YGETM

SEQ ID NO: 1736380 - protein, 10 aa, Staphylococcus epidermidis
YGGDKQLPRL

SEQ ID NO: 1736381 - protein, 18 aa, Staphylococcus epidermidis
YGGITSQNSDLNDTINSD

SEQ ID NO: 1736382 - protein, 6 aa, Staphylococcus epidermidis
YGGPTM

SEQ ID NO: 1736383 - protein, 6 aa, Staphylococcus epidermidis
YGGTDA

SEQ ID NO: 1736384 - protein, 9 aa, Staphylococcus epidermidis
YGLGEKDTV

SEQ ID NO: 1736385 - protein, 17 aa, Staphylococcus epidermidis
YGNQAENHTKNETKDYK

SEQ ID NO: 1736386 - protein, 5 aa, Staphylococcus epidermidis
YGNTG

SEQ ID NO: 1736387 - protein, 10 aa, Staphylococcus epidermidis
YGNTSSASIP

SEQ ID NO: 1736388 - protein, 10 aa, Staphylococcus epidermidis
YGNTSSATIP

SEQ ID NO: 1736389 - protein, 4 aa, Staphylococcus epidermidis
YGPR

SEQ ID NO: 1736390 - protein, 155 aa, Staphylococcus epidermidis
YGPTKAEPGKPAEPGKPAEPGKPAEPGKPAEPGTPAEPGKPAEPGKPAEPGKPAEPGKPAEPGKPAEPGTPAEPGKPAEPGKPAEPGKPAEPGTPAEPGKPAEPGTPAEPGKPAEPGTPTQSGAPEQPNRSMHSTDNKNQLPDTGENRQANEGTL

SEQ ID NO: 1736391 - protein, 155 aa, Staphylococcus epidermidis
YGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGTPAQSGAPEQPNRSMHSTDNKNQLPDTGENRQANEGTL

SEQ ID NO: 1736392 - protein, 119 aa, Staphylococcus epidermidis
YGPTKAEPGKPAEPGTPAEPGKPAEPGKPAEPGKPAEPGTPAEPGTPAEPGKPAEPGTPAEPGKPAESGKPVEPGKPVEPGTPAQSGAPEQPNRSMHSTDNKNQLPDTGENRQANEGTL

SEQ ID NO: 1736393 - protein, 4 aa, Staphylococcus epidermidis
YGQA

SEQ ID NO: 1736394 - protein, 9 aa, Staphylococcus epidermidis
YGRGISKRD

SEQ ID NO: 1736395 - protein, 5 aa, Staphylococcus epidermidis
YGSKI

SEQ ID NO: 1736396 - protein, 5 aa, Staphylococcus epidermidis
YGTNY

SEQ ID NO: 1736397 - protein, 8 aa, Staphylococcus epidermidis
YGTQALRP

SEQ ID NO: 1736398 - protein, 4 aa, Staphylococcus epidermidis
YGVK

SEQ ID NO: 1736399 - protein, 15 aa, Staphylococcus epidermidis
YHDERKKLNSSQGKN

SEQ ID NO: 1736400 - protein, 23 aa, Staphylococcus epidermidis
YHGSDSDAYAQSNDAEDDEHKSG

SEQ ID NO: 1736401 - protein, 18 aa, Staphylococcus epidermidis
YHNSEVETALNDAKPKIE

SEQ ID NO: 1736402 - protein, 25 aa, Staphylococcus epidermidis
YHNTSPPKSDAKAKADPRNVGGGGA

SEQ ID NO: 1736403 - protein, 25 aa, Staphylococcus epidermidis
YHNTSTPKSDAKAKADPRNVGGGGA

SEQ ID NO: 1736404 - protein, 25 aa, Staphylococcus epidermidis
YHNTSTPRSDAKAKADPRNVGGGGA

SEQ ID NO: 1736405 - protein, 20 aa, Staphylococcus epidermidis
YINAEPSKKQAYNDAVQNAQ

SEQ ID NO: 1736406 - protein, 9 aa, Staphylococcus epidermidis
YIPDQSTAD

SEQ ID NO: 1736407 - protein, 5 aa, Staphylococcus epidermidis
YIPNK

SEQ ID NO: 1736408 - protein, 5 aa, Staphylococcus epidermidis
YIQSN

SEQ ID NO: 1736409 - protein, 7 aa, Staphylococcus epidermidis
YKAEQSP

SEQ ID NO: 1736410 - protein, 14 aa, Staphylococcus epidermidis
YKDENFDKQDKGTW

SEQ ID NO: 1736411 - protein, 15 aa, Staphylococcus epidermidis
YKDGRIEAQTPRDAN

SEQ ID NO: 1736412 - protein, 14 aa, Staphylococcus epidermidis
YKDNITDAQDKLNA

SEQ ID NO: 1736413 - protein, 10 aa, Staphylococcus epidermidis
YKDNKDDTEI

SEQ ID NO: 1736414 - protein, 9 aa, Staphylococcus epidermidis
YKEEKEKAR

SEQ ID NO: 1736415 - protein, 12 aa, Staphylococcus epidermidis
YKEKKSNDEKIL

SEQ ID NO: 1736416 - protein, 13 aa, Staphylococcus epidermidis
YKEREKEKKFENH

SEQ ID NO: 1736417 - protein, 8 aa, Staphylococcus epidermidis
YKGAPNSM

SEQ ID NO: 1736418 - protein, 28 aa, Staphylococcus epidermidis
YKKTDELKEKEQDLRSKVEDYKQRAEDT

SEQ ID NO: 1736419 - protein, 15 aa, Staphylococcus epidermidis
YKKTDELRDKERDLR

SEQ ID NO: 1736420 - protein, 7 aa, Staphylococcus epidermidis
YKNSPTN

SEQ ID NO: 1736421 - protein, 10 aa, Staphylococcus epidermidis
YKPASNDINN

SEQ ID NO: 1736422 - protein, 13 aa, Staphylococcus epidermidis
YKPPRSHKKFPSQ

SEQ ID NO: 1736423 - protein, 17 aa, Staphylococcus epidermidis
YKSRMTSFGTGKDYEEG

SEQ ID NO: 1736424 - protein, 7 aa, Staphylococcus epidermidis
YNDDKSF

SEQ ID NO: 1736425 - protein, 15 aa, Staphylococcus epidermidis
YNDNDKGTVNAQKDI

SEQ ID NO: 1736426 - protein, 11 aa, Staphylococcus epidermidis
YNEPDERKTNQ

SEQ ID NO: 1736427 - protein, 16 aa, Staphylococcus epidermidis
YNEPESKQRYSPNSTY

SEQ ID NO: 1736428 - protein, 9 aa, Staphylococcus epidermidis
YNKETGKTV

SEQ ID NO: 1736429 - protein, 10 aa, Staphylococcus epidermidis
YNKNAESGKM

SEQ ID NO: 1736430 - protein, 12 aa, Staphylococcus epidermidis
YNKTAKEKYDFN

SEQ ID NO: 1736431 - protein, 4 aa, Staphylococcus epidermidis
YNQR

SEQ ID NO: 1736432 - protein, 9 aa, Staphylococcus epidermidis
YNRETNDAV

SEQ ID NO: 1736433 - protein, 10 aa, Staphylococcus epidermidis
YNSEGSHTYT

SEQ ID NO: 1736434 - protein, 15 aa, Staphylococcus epidermidis
YNSRMTSYGTQTEYK

SEQ ID NO: 1736435 - protein, 12 aa, Staphylococcus epidermidis
YNTEDVDAHDYS

SEQ ID NO: 1736436 - protein, 8 aa, Staphylococcus epidermidis
YPKDQRTT

SEQ ID NO: 1736437 - protein, 7 aa, Staphylococcus epidermidis
YPNNTNE

SEQ ID NO: 1736438 - protein, 9 aa, Staphylococcus epidermidis
YPSGPNTMS

SEQ ID NO: 1736439 - protein, 10 aa, Staphylococcus epidermidis
YPSKQEQQRL

SEQ ID NO: 1736440 - protein, 8 aa, Staphylococcus epidermidis
YPTSDGIT

SEQ ID NO: 1736441 - protein, 6 aa, Staphylococcus epidermidis
YQGADS

SEQ ID NO: 1736442 - protein, 9 aa, Staphylococcus epidermidis
YQGATNAQS

SEQ ID NO: 1736443 - protein, 7 aa, Staphylococcus epidermidis
YQLTGGK

SEQ ID NO: 1736444 - protein, 8 aa, Staphylococcus epidermidis
YQNGQTEN

SEQ ID NO: 1736445 - protein, 25 aa, Staphylococcus epidermidis
YQNQSNQKNYSKKNKEKKCLNVKLD

SEQ ID NO: 1736446 - protein, 13 aa, Staphylococcus epidermidis
YQNSKDEDSKNKF

SEQ ID NO: 1736447 - protein, 7 aa, Staphylococcus epidermidis
YQNTDAS

SEQ ID NO: 1736448 - protein, 11 aa, Staphylococcus epidermidis
YQNTDNESASI

SEQ ID NO: 1736449 - protein, 18 aa, Staphylococcus epidermidis
YQPSTFKNAGPLTWPGKK

SEQ ID NO: 1736450 - protein, 15 aa, Staphylococcus epidermidis
YQQQRKEGKKPVFKP

SEQ ID NO: 1736451 - protein, 11 aa, Staphylococcus epidermidis
YQRPNENRTAN

SEQ ID NO: 1736452 - protein, 9 aa, Staphylococcus epidermidis
YQSQRDNVD

SEQ ID NO: 1736453 - protein, 20 aa, Staphylococcus epidermidis
YQSQSNQKSYSKEKKNKEKE

SEQ ID NO: 1736454 - protein, 6 aa, Staphylococcus epidermidis
YQTNNG

SEQ ID NO: 1736455 - protein, 10 aa, Staphylococcus epidermidis
YQTTTKDNYI

SEQ ID NO: 1736456 - protein, 9 aa, Staphylococcus epidermidis
YRGNSDRSK

SEQ ID NO: 1736457 - protein, 13 aa, Staphylococcus epidermidis
YRNGSEKNIKIKL

SEQ ID NO: 1736458 - protein, 6 aa, Staphylococcus epidermidis
YRNHND

SEQ ID NO: 1736459 - protein, 8 aa, Staphylococcus epidermidis
YRPNHPQG

SEQ ID NO: 1736460 - protein, 37 aa, Staphylococcus epidermidis
YRRGSANYKTNTVADDAKHGYTHSDHNADHSYTTRVN

SEQ ID NO: 1736461 - protein, 20 aa, Staphylococcus epidermidis
YRRHTGTTSTPSRRRKNKRL

SEQ ID NO: 1736462 - protein, 6 aa, Staphylococcus epidermidis
YRSENK

SEQ ID NO: 1736463 - protein, 10 aa, Staphylococcus epidermidis
YRTPDGQEAT

SEQ ID NO: 1736464 - protein, 11 aa, Staphylococcus epidermidis
YRTQPDKNSDI

SEQ ID NO: 1736465 - protein, 9 aa, Staphylococcus epidermidis
YRYPGSEQY

SEQ ID NO: 1736466 - protein, 9 aa, Staphylococcus epidermidis
YSAKEDACS

SEQ ID NO: 1736467 - protein, 8 aa, Staphylococcus epidermidis
YSDTQNEM

SEQ ID NO: 1736468 - protein, 7 aa, Staphylococcus epidermidis
YSEGSDQ

SEQ ID NO: 1736469 - protein, 11 aa, Staphylococcus epidermidis
YSEKVQHPQTV

SEQ ID NO: 1736470 - protein, 7 aa, Staphylococcus epidermidis
YSESNSF

SEQ ID NO: 1736471 - protein, 4 aa, Staphylococcus epidermidis
YSFG

SEQ ID NO: 1736472 - protein, 9 aa, Staphylococcus epidermidis
YSKKENQTG

SEQ ID NO: 1736473 - protein, 6 aa, Staphylococcus epidermidis
YSKNYA

SEQ ID NO: 1736474 - protein, 8 aa, Staphylococcus epidermidis
YSKPEKQD

SEQ ID NO: 1736475 - protein, 6 aa, Staphylococcus epidermidis
YSPQQG

SEQ ID NO: 1736476 - protein, 9 aa, Staphylococcus epidermidis
YSTDPNPEY

SEQ ID NO: 1736477 - protein, 9 aa, Staphylococcus epidermidis
YSVKNSELL

SEQ ID NO: 1736478 - protein, 7 aa, Staphylococcus epidermidis
YTASHAT

SEQ ID NO: 1736479 - protein, 9 aa, Staphylococcus epidermidis
YTESHDQKE

SEQ ID NO: 1736480 - protein, 16 aa, Staphylococcus epidermidis
YTGAATHTGPLGNEVP

SEQ ID NO: 1736481 - protein, 9 aa, Staphylococcus epidermidis
YTNKDGQAS

SEQ ID NO: 1736482 - protein, 7 aa, Staphylococcus epidermidis
YTNNKQY

SEQ ID NO: 1736483 - protein, 8 aa, Staphylococcus epidermidis
YTSITEEN

SEQ ID NO: 1736484 - protein, 12 aa, Staphylococcus epidermidis
YTSITQENIEAA

SEQ ID NO: 1736485 - protein, 13 aa, Staphylococcus epidermidis
YVTGGNKPKKKPT

SEQ ID NO: 1736486 - protein, 18 aa, Staphylococcus epidermidis
WDSIDNICTVIWIVLVII

SEQ ID NO: 1736487 - protein, 17 aa, Staphylococcus epidermidis
FIIASGFIADTTSLPLI

SEQ ID NO: 1736488 - protein, 19 aa, Staphylococcus epidermidis
LSLVWPTFMKMGGHVIALP

SEQ ID NO: 1736489 - protein, 20 aa, Staphylococcus epidermidis
ADIDLPFERGAAIDLAGRDV

SEQ ID NO: 1736490 - protein, 18 aa, Staphylococcus epidermidis
ADIRKPLYSKRIYQNLTF

SEQ ID NO: 1736491 - protein, 22 aa, Staphylococcus epidermidis
AESYRAAILFHQWYFIDHWKLM

SEQ ID NO: 1736492 - protein, 17 aa, Staphylococcus epidermidis
AFFLVLAFRTYKELGTD

SEQ ID NO: 1736493 - protein, 20 aa, Staphylococcus epidermidis
AIDMGGPFNKAAYVFATAAL

SEQ ID NO: 1736494 - protein, 18 aa, Staphylococcus epidermidis
AKARITVRANIARLVGGA

SEQ ID NO: 1736495 - protein, 22 aa, Staphylococcus epidermidis
AKKNAPCIIFIDEIDAVGRQRG

SEQ ID NO: 1736496 - protein, 18 aa, Staphylococcus epidermidis
ANQPWKNIFNFKKIISVA

SEQ ID NO: 1736497 - protein, 20 aa, Staphylococcus epidermidis
AQPTLLFAVELDETGRTRPT

SEQ ID NO: 1736498 - protein, 25 aa, Staphylococcus epidermidis
ATSKLFDIVIQWGVLALIVIFQPEI

SEQ ID NO: 1736499 - protein, 24 aa, Staphylococcus epidermidis
AYGSCIGWGAFILPGDWIKQSGPI

SEQ ID NO: 1736500 - protein, 17 aa, Staphylococcus epidermidis
DDLYIEGITSYDDERHH

SEQ ID NO: 1736501 - protein, 24 aa, Staphylococcus epidermidis
DFIGFASAWGYWFSAFLGNVAYAT

SEQ ID NO: 1736502 - protein, 23 aa, Staphylococcus epidermidis
DKEGGFRGGPAYYITKGLNQKWL

SEQ ID NO: 1736503 - protein, 20 aa, Staphylococcus epidermidis
DLMVSMGIFCFIISGLYMLF

SEQ ID NO: 1736504 - protein, 19 aa, Staphylococcus epidermidis
DTGAYIFGRLMGKHKLWPV

SEQ ID NO: 1736505 - protein, 24 aa, Staphylococcus epidermidis
DTIIKKLFRLPAIKRFEEDEELLE

SEQ ID NO: 1736506 - protein, 20 aa, Staphylococcus epidermidis
DVVIGASFLIMFTAIGHFTG

SEQ ID NO: 1736507 - protein, 22 aa, Staphylococcus epidermidis
EEKQELIEIVDFLKDNKKFKQM

SEQ ID NO: 1736508 - protein, 23 aa, Staphylococcus epidermidis
EKFSHLGVAIGIALFIFLIVRPP

SEQ ID NO: 1736509 - protein, 17 aa, Staphylococcus epidermidis
EKRRLDSVITHMSDGIL

SEQ ID NO: 1736510 - protein, 21 aa, Staphylococcus epidermidis
ELLDKICGLLGGRVSEDINFG

SEQ ID NO: 1736511 - protein, 18 aa, Staphylococcus epidermidis
EMLIIFTALMIIANFYYI

SEQ ID NO: 1736512 - protein, 18 aa, Staphylococcus epidermidis
ESEYWFALIKVVTVIIFI

SEQ ID NO: 1736513 - protein, 17 aa, Staphylococcus epidermidis
FACLAGLIFWYPKMMGY

SEQ ID NO: 1736514 - protein, 26 aa, Staphylococcus epidermidis
FANTVLRSMFSLGFLFGPFIGAQLIE

SEQ ID NO: 1736515 - protein, 24 aa, Staphylococcus epidermidis
FATIGVGMPLMFAIAEFIGIKKND

SEQ ID NO: 1736516 - protein, 17 aa, Staphylococcus epidermidis
FFFHVVLVIVRRYNPYI

SEQ ID NO: 1736517 - protein, 19 aa, Staphylococcus epidermidis
FFGISWGPVLWVMLPELFP

SEQ ID NO: 1736518 - protein, 18 aa, Staphylococcus epidermidis
FIGTEGYVNMQLIIGIIF

SEQ ID NO: 1736519 - protein, 17 aa, Staphylococcus epidermidis
FIILPIVLPPTVLGFIL

SEQ ID NO: 1736520 - protein, 27 aa, Staphylococcus epidermidis
FLFGFIKRLLIPFGLHHIFHAPFWFEF

SEQ ID NO: 1736521 - protein, 25 aa, Staphylococcus epidermidis
FLLPRTLTLFFPKAEWAQNIADTAN

SEQ ID NO: 1736522 - protein, 20 aa, Staphylococcus epidermidis
FLRLYILTLMFFSANAILNV

SEQ ID NO: 1736523 - protein, 23 aa, Staphylococcus epidermidis
FNLYVMFEIMLLASFVLVTLGQS

SEQ ID NO: 1736524 - protein, 26 aa, Staphylococcus epidermidis
FNNKPLRMMIYLGMFTFSISILYIIY

SEQ ID NO: 1736525 - protein, 21 aa, Staphylococcus epidermidis
FPILRKFKVATPIFKPLFAWQ

SEQ ID NO: 1736526 - protein, 18 aa, Staphylococcus epidermidis
FQQIEAIEVKKCDFKDDL

SEQ ID NO: 1736527 - protein, 19 aa, Staphylococcus epidermidis
FVWAIAYGSCIGWGAFILP

SEQ ID NO: 1736528 - protein, 25 aa, Staphylococcus epidermidis
GFVTGWTYWLCWIITGMAEVTAVAK

SEQ ID NO: 1736529 - protein, 19 aa, Staphylococcus epidermidis
GGALKRFSIFAMGIMPYIT

SEQ ID NO: 1736530 - protein, 27 aa, Staphylococcus epidermidis
GILATDRRGRVRIANDMALKMLGLAKE

SEQ ID NO: 1736531 - protein, 19 aa, Staphylococcus epidermidis
GINIPGYFTTIAAILLLGG

SEQ ID NO: 1736532 - protein, 18 aa, Staphylococcus epidermidis
GKSYLEYQYEDVLKGTKK

SEQ ID NO: 1736533 - protein, 19 aa, Staphylococcus epidermidis
GLMKPNISNIVGRLYPEND

SEQ ID NO: 1736534 - protein, 24 aa, Staphylococcus epidermidis
GMGIPKADLEFIFDRFYRVDKSRA

SEQ ID NO: 1736535 - protein, 17 aa, Staphylococcus epidermidis
GNLAVFILFGFYSVIGG

SEQ ID NO: 1736536 - protein, 26 aa, Staphylococcus epidermidis
GQMRRIELSRLLLLKPDIVIFDEPAI

SEQ ID NO: 1736537 - protein, 25 aa, Staphylococcus epidermidis
GRITFESPMLFSLAFIPNFLLGGVT

SEQ ID NO: 1736538 - protein, 23 aa, Staphylococcus epidermidis
GTAVGGWKIIKTVGGNIMKIRPA

SEQ ID NO: 1736539 - protein, 24 aa, Staphylococcus epidermidis
GTGLPIVLGCTFTAVAPMILIGQT

SEQ ID NO: 1736540 - protein, 18 aa, Staphylococcus epidermidis
GVGAEYILGAFLAGVVVS

SEQ ID NO: 1736541 - protein, 20 aa, Staphylococcus epidermidis
GYVNMQLIIGIIFVFITGPL

SEQ ID NO: 1736542 - protein, 26 aa, Staphylococcus epidermidis
IDSQLLKGHVYNGISGAQFKELPTMS

SEQ ID NO: 1736543 - protein, 17 aa, Staphylococcus epidermidis
IEDHLFRITQEAISNTL

SEQ ID NO: 1736544 - protein, 17 aa, Staphylococcus epidermidis
IIGKLLYESLETIDPGP

SEQ ID NO: 1736545 - protein, 25 aa, Staphylococcus epidermidis
IIIVACLKTAIGLITAFSETFTELF

SEQ ID NO: 1736546 - protein, 17 aa, Staphylococcus epidermidis
IILPQAIRVSIPALGNT

SEQ ID NO: 1736547 - protein, 30 aa, Staphylococcus epidermidis
IIVVALLILFSFVPVGLWISALAAGVHVGI

SEQ ID NO: 1736548 - protein, 23 aa, Staphylococcus epidermidis
IKDELRIGRTLKQAYSKANKSSF

SEQ ID NO: 1736549 - protein, 26 aa, Staphylococcus epidermidis
IKELSRTGVYFKWQMLVTLLFVIPCH

SEQ ID NO: 1736550 - protein, 25 aa, Staphylococcus epidermidis
IKQVFWRILLFYILAIFIIGMLIPY

SEQ ID NO: 1736551 - protein, 25 aa, Staphylococcus epidermidis
IKQVFWRILLFYVLSIAVIAAIIPY

SEQ ID NO: 1736552 - protein, 19 aa, Staphylococcus epidermidis
ILAGIPTIVFGFFALTFVT

SEQ ID NO: 1736553 - protein, 19 aa, Staphylococcus epidermidis
ILRSIPFIILLIAIVPFTK

SEQ ID NO: 1736554 - protein, 17 aa, Staphylococcus epidermidis
INIGLTIGVFGTIIFLI

SEQ ID NO: 1736555 - protein, 18 aa, Staphylococcus epidermidis
INSVPIRILIFYVGALAV

SEQ ID NO: 1736556 - protein, 17 aa, Staphylococcus epidermidis
IPAQPTLLFAVELDETG

SEQ ID NO: 1736557 - protein, 25 aa, Staphylococcus epidermidis
IPLSKWRTKIGYVMQSNSMMSGTIR

SEQ ID NO: 1736558 - protein, 20 aa, Staphylococcus epidermidis
IPVLIIALLFIFFLSQAQGG

SEQ ID NO: 1736559 - protein, 29 aa, Staphylococcus epidermidis
IQFLVESVVLCLIGGIIGLILGIIIATLI

SEQ ID NO: 1736560 - protein, 23 aa, Staphylococcus epidermidis
IQLNEMPHLLVAGSTGSGKSVCI

SEQ ID NO: 1736561 - protein, 23 aa, Staphylococcus epidermidis
ITFVDIWHFFSLVNRYENEDKYD

SEQ ID NO: 1736562 - protein, 19 aa, Staphylococcus epidermidis
IWLIAMAFFISRGFVKTGL

SEQ ID NO: 1736563 - protein, 19 aa, Staphylococcus epidermidis
IYSDLLRYNKCILMTQSFI

SEQ ID NO: 1736564 - protein, 24 aa, Staphylococcus epidermidis
KAIGRASVVPTFFGVNEPILFGAP

SEQ ID NO: 1736565 - protein, 21 aa, Staphylococcus epidermidis
KANILKFMAPLSFVLASLAIY

SEQ ID NO: 1736566 - protein, 24 aa, Staphylococcus epidermidis
KARTRKMGGTGLGLAISKEIVEAH

SEQ ID NO: 1736567 - protein, 20 aa, Staphylococcus epidermidis
KDIITGFFIIFENQFDVGDY

SEQ ID NO: 1736568 - protein, 21 aa, Staphylococcus epidermidis
KEIKVGKLIQFISFFPTISSG

SEQ ID NO: 1736569 - protein, 17 aa, Staphylococcus epidermidis
KFFSEFVASAVVISIAA

SEQ ID NO: 1736570 - protein, 20 aa, Staphylococcus epidermidis
KHVQWAMLIAAFIVGIALFF

SEQ ID NO: 1736571 - protein, 20 aa, Staphylococcus epidermidis
KKKHGLAFIMVILQMLFAFF

SEQ ID NO: 1736572 - protein, 23 aa, Staphylococcus epidermidis
KVFPIMGLFGFILLIPVIYKGIL

SEQ ID NO: 1736573 - protein, 18 aa, Staphylococcus epidermidis
LAALFAALMTKVGAYALI

SEQ ID NO: 1736574 - protein, 24 aa, Staphylococcus epidermidis
LALGALYLPLLFKIVQLQLNLSKG

SEQ ID NO: 1736575 - protein, 21 aa, Staphylococcus epidermidis
LAQGIGRWGNFMNHEAHGGPV

SEQ ID NO: 1736576 - protein, 17 aa, Staphylococcus epidermidis
LGTAILILFGGGVCANV

SEQ ID NO: 1736577 - protein, 18 aa, Staphylococcus epidermidis
LNYWSVKLLTSFTSLISV

SEQ ID NO: 1736578 - protein, 21 aa, Staphylococcus epidermidis
LPALIIGAAPFYARLVEIAFK

SEQ ID NO: 1736579 - protein, 25 aa, Staphylococcus epidermidis
LPPWKRFLSHFSFYAIALQYFVVQF

SEQ ID NO: 1736580 - protein, 20 aa, Staphylococcus epidermidis
LPVLGGAMIAMFGMVMAYGV

SEQ ID NO: 1736581 - protein, 24 aa, Staphylococcus epidermidis
LTAGTAFLIWLGDQITQFGVGNGI

SEQ ID NO: 1736582 - protein, 17 aa, Staphylococcus epidermidis
LVFVSGSVGEMFRPFAL

SEQ ID NO: 1736583 - protein, 25 aa, Staphylococcus epidermidis
LVGMRLRRVSPRKVIAPLIKAHKAG

SEQ ID NO: 1736584 - protein, 17 aa, Staphylococcus epidermidis
LVPGILITNAIRDLLAG

SEQ ID NO: 1736585 - protein, 19 aa, Staphylococcus epidermidis
LYYLSLWYFITFGAFVAFG

SEQ ID NO: 1736586 - protein, 35 aa, Staphylococcus epidermidis
MAFFISRGFVKTGLGRRIALQFVKLFGKKTLGLAY

SEQ ID NO: 1736587 - protein, 23 aa, Staphylococcus epidermidis
MGSRIPKGVLLVGPPGTGKTLLA

SEQ ID NO: 1736588 - protein, 23 aa, Staphylococcus epidermidis
MLVIFKIGTYIPAPGVNPEAFNH

SEQ ID NO: 1736589 - protein, 22 aa, Staphylococcus epidermidis
MQRTRFCLAGGFRDMYVQKSNK

SEQ ID NO: 1736590 - protein, 18 aa, Staphylococcus epidermidis
NICTVIWIVLVIILSFKF

SEQ ID NO: 1736591 - protein, 20 aa, Staphylococcus epidermidis
NINGSKSWINLGFMNLQASE

SEQ ID NO: 1736592 - protein, 21 aa, Staphylococcus epidermidis
NNIPSRIAFAVSSQTDSRTII

SEQ ID NO: 1736593 - protein, 23 aa, Staphylococcus epidermidis
NRMKRGQFSPREMGFNLFINLLN

SEQ ID NO: 1736594 - protein, 23 aa, Staphylococcus epidermidis
NTLKGALPVGFLGIGEPLIYGVT

SEQ ID NO: 1736595 - protein, 20 aa, Staphylococcus epidermidis
NVFGFTWSKTMEGILMKPYN

SEQ ID NO: 1736596 - protein, 27 aa, Staphylococcus epidermidis
NVKRTIIKIIGFMIIAFFVLLLLGILL

SEQ ID NO: 1736597 - protein, 23 aa, Staphylococcus epidermidis
NYVPEKWILGLLGLIPIYLGIKV

SEQ ID NO: 1736598 - protein, 18 aa, Staphylococcus epidermidis
PASMLAIEFGWFLTEMGR

SEQ ID NO: 1736599 - protein, 21 aa, Staphylococcus epidermidis
PELRDRLAVRHGRYIEQDADD

SEQ ID NO: 1736600 - protein, 25 aa, Staphylococcus epidermidis
PFDKKREFDPNLAPGTEKVVQKGEP

SEQ ID NO: 1736601 - protein, 23 aa, Staphylococcus epidermidis
PFNGETAVSIAIKHIQDSIPNIT

SEQ ID NO: 1736602 - protein, 21 aa, Staphylococcus epidermidis
PGVALSFLFNIPMFIGALVTG

SEQ ID NO: 1736603 - protein, 18 aa, Staphylococcus epidermidis
PINEVTYATSLLADGYYH

SEQ ID NO: 1736604 - protein, 27 aa, Staphylococcus epidermidis
PKNELPPMIVHYFFDLMVSMGIFCFII

SEQ ID NO: 1736605 - protein, 25 aa, Staphylococcus epidermidis
PLRANRLFWAFALCLLPFSLMLVGG

SEQ ID NO: 1736606 - protein, 17 aa, Staphylococcus epidermidis
PNYSGQIAYEIDKEVQR

SEQ ID NO: 1736607 - protein, 29 aa, Staphylococcus epidermidis
PSLGFALGWNYWFNWVITVAADVTIAAQV

SEQ ID NO: 1736608 - protein, 17 aa, Staphylococcus epidermidis
PTMLKLAIPGSISAFIG

SEQ ID NO: 1736609 - protein, 19 aa, Staphylococcus epidermidis
QNFIEWVFDFVRGIIESNM

SEQ ID NO: 1736610 - protein, 18 aa, Staphylococcus epidermidis
QTELAYMQNIFSFDERHA

SEQ ID NO: 1736611 - protein, 17 aa, Staphylococcus epidermidis
QVPFYIWLPDAMEAPTP

SEQ ID NO: 1736612 - protein, 18 aa, Staphylococcus epidermidis
RDRAKFANTVLRSMFSLG

SEQ ID NO: 1736613 - protein, 23 aa, Staphylococcus epidermidis
RGQAGGYAMMLPKQDRFLMTEPE

SEQ ID NO: 1736614 - protein, 22 aa, Staphylococcus epidermidis
RNKIFFTLAMLVIFKIGTYIPA

SEQ ID NO: 1736615 - protein, 27 aa, Staphylococcus epidermidis
RPDILDPALLRPGRFDRQIQVGRPDVK

SEQ ID NO: 1736616 - protein, 22 aa, Staphylococcus epidermidis
RQRALSYWSIGSWGGSGVCTLF

SEQ ID NO: 1736617 - protein, 19 aa, Staphylococcus epidermidis
RQYDLKGILAYSTISQLGM

SEQ ID NO: 1736618 - protein, 20 aa, Staphylococcus epidermidis
RTAGALGCGIFAIVAQLIMI

SEQ ID NO: 1736619 - protein, 20 aa, Staphylococcus epidermidis
RWYFAIGFFFIGVIAYMDRS

SEQ ID NO: 1736620 - protein, 25 aa, Staphylococcus epidermidis
SGALEIPGLLSFLADNSFNTKVKGL

SEQ ID NO: 1736621 - protein, 17 aa, Staphylococcus epidermidis
SIIGGFFMALTYSLDDF

SEQ ID NO: 1736622 - protein, 17 aa, Staphylococcus epidermidis
SIKEIKVGKLIQFISFF

SEQ ID NO: 1736623 - protein, 23 aa, Staphylococcus epidermidis
SKHLPVGTVYAFFVGIGAVGTVL

SEQ ID NO: 1736624 - protein, 25 aa, Staphylococcus epidermidis
SKWTFRKLLNYGIDGLISFNNKPLR

SEQ ID NO: 1736625 - protein, 19 aa, Staphylococcus epidermidis
SLLSILGVFLVAGFSFQGT

SEQ ID NO: 1736626 - protein, 26 aa, Staphylococcus epidermidis
SVDLIRWLPELDLPLMDGLYLHMLLW

SEQ ID NO: 1736627 - protein, 26 aa, Staphylococcus epidermidis
TAISLFITVILGFFIARTITKPITDM

SEQ ID NO: 1736628 - protein, 17 aa, Staphylococcus epidermidis
TALLLLIPIFISYKEGL

SEQ ID NO: 1736629 - protein, 17 aa, Staphylococcus epidermidis
TGGLVAISGGRNYKNVV

SEQ ID NO: 1736630 - protein, 19 aa, Staphylococcus epidermidis
TGIFFIMLFILIKLFMEVH

SEQ ID NO: 1736631 - protein, 18 aa, Staphylococcus epidermidis
TGLSAIWITIGLTLGAYI

SEQ ID NO: 1736632 - protein, 17 aa, Staphylococcus epidermidis
TKLPWIVLYGLTGLLIP

SEQ ID NO: 1736633 - protein, 20 aa, Staphylococcus epidermidis
TLAKRWSKGYTITVAVGVVT

SEQ ID NO: 1736634 - protein, 25 aa, Staphylococcus epidermidis
TLYTIRLLPVGGYVRMAGDGLEEPP

SEQ ID NO: 1736635 - protein, 18 aa, Staphylococcus epidermidis
TQHFLKDDVDTYINRSEL

SEQ ID NO: 1736636 - protein, 19 aa, Staphylococcus epidermidis
TQIARSMVTEYGMSKKLGP

SEQ ID NO: 1736637 - protein, 23 aa, Staphylococcus epidermidis
TRKSEGISLFSLSLVLGTAIGPF

SEQ ID NO: 1736638 - protein, 19 aa, Staphylococcus epidermidis
TRQWHIFWGPPMIVISLFV

SEQ ID NO: 1736639 - protein, 18 aa, Staphylococcus epidermidis
TSTGFILASAGSAIGLGA

SEQ ID NO: 1736640 - protein, 26 aa, Staphylococcus epidermidis
TTDVFPVKDYGSGMTPFYTALSIWVG

SEQ ID NO: 1736641 - protein, 17 aa, Staphylococcus epidermidis
TVILFSFLIGIWLGHPI

SEQ ID NO: 1736642 - protein, 17 aa, Staphylococcus epidermidis
VDPSLGFALGWNYWFNW

SEQ ID NO: 1736643 - protein, 20 aa, Staphylococcus epidermidis
VGIPRFVIVTTYQFGQYAML

SEQ ID NO: 1736644 - protein, 27 aa, Staphylococcus epidermidis
VITWKGVEKKIPWGTIIVFGVGISLGN

SEQ ID NO: 1736645 - protein, 17 aa, Staphylococcus epidermidis
VIVYVLLIIIGMQIIGL

SEQ ID NO: 1736646 - protein, 17 aa, Staphylococcus epidermidis
VKLFNWLLTLYKGRITF

SEQ ID NO: 1736647 - protein, 25 aa, Staphylococcus epidermidis
VLSKGLDSGTAFEILSIDIADVDIS

SEQ ID NO: 1736648 - protein, 17 aa, Staphylococcus epidermidis
VLSLKYGIYTSIGEGGE

SEQ ID NO: 1736649 - protein, 23 aa, Staphylococcus epidermidis
VNALQLRFILDWNSQSTRDNLTY

SEQ ID NO: 1736650 - protein, 26 aa, Staphylococcus epidermidis
VNSAGVIPVIFAMAFFLLPRTLTLFF

SEQ ID NO: 1736651 - protein, 25 aa, Staphylococcus epidermidis
VPRGRILDRNGKVLVDNASKMSITY

SEQ ID NO: 1736652 - protein, 17 aa, Staphylococcus epidermidis
VQYVSIPSNGRWYDHIG

SEQ ID NO: 1736653 - protein, 27 aa, Staphylococcus epidermidis
VSGSVGEMFRPFALAITFSLLASLLVS

SEQ ID NO: 1736654 - protein, 28 aa, Staphylococcus epidermidis
VYLFMGLAIFCFVLYIAFGKYGNVTLGK

SEQ ID NO: 1736655 - protein, 18 aa, Staphylococcus epidermidis
VYPYEINIGLTIGVFGTI

SEQ ID NO: 1736656 - protein, 25 aa, Staphylococcus epidermidis
WAFGQIITFKAFELVGSSRAMPITT

SEQ ID NO: 1736657 - protein, 24 aa, Staphylococcus epidermidis
WGQYFKIGIIITIPVLFITLLGLY

SEQ ID NO: 1736658 - protein, 24 aa, Staphylococcus epidermidis
WIISIPGLIVWQAFSIFVGTIQAY

SEQ ID NO: 1736659 - protein, 17 aa, Staphylococcus epidermidis
WLQNGVWAIIVYFIVCL

SEQ ID NO: 1736660 - protein, 17 aa, Staphylococcus epidermidis
YEINIGLTIGVFGTIIF

SEQ ID NO: 1736661 - protein, 20 aa, Staphylococcus epidermidis
YGFFNRLLIPTGLHHALNNV

SEQ ID NO: 1736662 - protein, 22 aa, Staphylococcus epidermidis
YKNEILGGITTFLSMAYILAVN

SEQ ID NO: 1736663 - protein, 20 aa, Staphylococcus epidermidis
YLARKWQLVTNMGKFLDPLA

SEQ ID NO: 1736664 - protein, 18 aa, Staphylococcus epidermidis
AACSNRIEKKLNRMNHVQ

SEQ ID NO: 1736665 - protein, 22 aa, Staphylococcus epidermidis
AAGATRWKAFNYGQASAIVEPI

SEQ ID NO: 1736666 - protein, 24 aa, Staphylococcus epidermidis
AAGKAATLGAMFLLFGAFLYFIGT

SEQ ID NO: 1736667 - protein, 19 aa, Staphylococcus epidermidis
AAKGIGMKPLRRLTKVELP

SEQ ID NO: 1736668 - protein, 25 aa, Staphylococcus epidermidis
ADHEIKMGKYYAGIYIPKKFTHEIT

SEQ ID NO: 1736669 - protein, 18 aa, Staphylococcus epidermidis
ADIAQAIGQQRSTIDQNQ

SEQ ID NO: 1736670 - protein, 25 aa, Staphylococcus epidermidis
ADIEGWRWMLGLAVVPSVILLVGIY

SEQ ID NO: 1736671 - protein, 21 aa, Staphylococcus epidermidis
ADTLMKLNPFWTIVLSLIFLH

SEQ ID NO: 1736672 - protein, 20 aa, Staphylococcus epidermidis
AFGETEFWLSLIKVITIIVF

SEQ ID NO: 1736673 - protein, 22 aa, Staphylococcus epidermidis
AFGWRPVKKRFKHAIYNIIQEL

SEQ ID NO: 1736674 - protein, 21 aa, Staphylococcus epidermidis
AFIRHFKRTLILTLILTILSG

SEQ ID NO: 1736675 - protein, 18 aa, Staphylococcus epidermidis
AFLSYAIGGVFHVKFFQE

SEQ ID NO: 1736676 - protein, 19 aa, Staphylococcus epidermidis
AFNVKIGWLVLRVLAVFFS

SEQ ID NO: 1736677 - protein, 24 aa, Staphylococcus epidermidis
AFVVNCLLLTLGAALFFGTKTEDL

SEQ ID NO: 1736678 - protein, 21 aa, Staphylococcus epidermidis
AGFEVFKGNLLSSNDRIYSDL

SEQ ID NO: 1736679 - protein, 25 aa, Staphylococcus epidermidis
AGGTRIRPILMTAIATIGALVPLLF

SEQ ID NO: 1736680 - protein, 25 aa, Staphylococcus epidermidis
AGIKGALVGSIWLILSIIPISIILG

SEQ ID NO: 1736681 - protein, 21 aa, Staphylococcus epidermidis
AGLIGGFLLARKYMKDYLKKN

SEQ ID NO: 1736682 - protein, 20 aa, Staphylococcus epidermidis
AGSFEILGVVLLNELSRTKN

SEQ ID NO: 1736683 - protein, 18 aa, Staphylococcus epidermidis
AGVSMIFLAYIGFDSIAA

SEQ ID NO: 1736684 - protein, 18 aa, Staphylococcus epidermidis
AGVSYIFSSQITKPIVTM

SEQ ID NO: 1736685 - protein, 19 aa, Staphylococcus epidermidis
AHCATRLRLVLNDESKVDE

SEQ ID NO: 1736686 - protein, 19 aa, Staphylococcus epidermidis
AIAMWPGFSRSGSTISTGV

SEQ ID NO: 1736687 - protein, 23 aa, Staphylococcus epidermidis
AIGMALGLVWYLLFNRKTLGSIG

SEQ ID NO: 1736688 - protein, 18 aa, Staphylococcus epidermidis
AIIVILLFLRNIRTTAIS

SEQ ID NO: 1736689 - protein, 22 aa, Staphylococcus epidermidis
AIQPKLTEAINMLQNKENNTEL

SEQ ID NO: 1736690 - protein, 19 aa, Staphylococcus epidermidis
AIVTIPLVLLIVTLIIPIL

SEQ ID NO: 1736691 - protein, 21 aa, Staphylococcus epidermidis
AIWPSKGMIYFGMVDIGGAII

SEQ ID NO: 1736692 - protein, 20 aa, Staphylococcus epidermidis
AKIPAYLGSSFAFITPIITG

SEQ ID NO: 1736693 - protein, 18 aa, Staphylococcus epidermidis
AKKHGWDTPQKAIYGGAD

SEQ ID NO: 1736694 - protein, 21 aa, Staphylococcus epidermidis
AKKLLLPYVIFFAFFSLYYYF

SEQ ID NO: 1736695 - protein, 18 aa, Staphylococcus epidermidis
ALAGIFGMVDIKQVGDAH

SEQ ID NO: 1736696 - protein, 25 aa, Staphylococcus epidermidis
ALAPGMGLNAFFAFTVVLTMGIPWQ

SEQ ID NO: 1736697 - protein, 17 aa, Staphylococcus epidermidis
ALGLAIPLVTARSTSIG

SEQ ID NO: 1736698 - protein, 24 aa, Staphylococcus epidermidis
ALGSFAINGVRLFTSFKKVRDEYD

SEQ ID NO: 1736699 - protein, 18 aa, Staphylococcus epidermidis
ALIAGLIGGFLLARKYMK

SEQ ID NO: 1736700 - protein, 28 aa, Staphylococcus epidermidis
ALIFLKERFNKFEWLAIIFALVGVLYMT

SEQ ID NO: 1736701 - protein, 23 aa, Staphylococcus epidermidis
ALLAEYFIAVAFVASGFSANLRG

SEQ ID NO: 1736702 - protein, 23 aa, Staphylococcus epidermidis
ANAIPGMIFIGALLVPISGLIFF

SEQ ID NO: 1736703 - protein, 30 aa, Staphylococcus epidermidis
ANIFIIMICCVLLGSLLGFLFYNFHPAKIF

SEQ ID NO: 1736704 - protein, 18 aa, Staphylococcus epidermidis
ANIIDKRFIFFFFVAVTL

SEQ ID NO: 1736705 - protein, 19 aa, Staphylococcus epidermidis
ANLKKRYAQRLLQFPHAHN

SEQ ID NO: 1736706 - protein, 25 aa, Staphylococcus epidermidis
ANVSHELRTPISLLQGYTESIVDGI

SEQ ID NO: 1736707 - protein, 21 aa, Staphylococcus epidermidis
APAQHTLTINEIVKEQGQNVT

SEQ ID NO: 1736708 - protein, 27 aa, Staphylococcus epidermidis
APKKLKGKEVLFAWSPFIILTVIVMIW

SEQ ID NO: 1736709 - protein, 17 aa, Staphylococcus epidermidis
AQLSRIVNQAFDLNDAM

SEQ ID NO: 1736710 - protein, 21 aa, Staphylococcus epidermidis
ARQRRRRRIDNQSKEKDATST

SEQ ID NO: 1736711 - protein, 19 aa, Staphylococcus epidermidis
ASAIVGSAVGLYYKNKIYK

SEQ ID NO: 1736712 - protein, 24 aa, Staphylococcus epidermidis
ASIICIPFAFLGAKNMMKLRPVTG

SEQ ID NO: 1736713 - protein, 17 aa, Staphylococcus epidermidis
ASKRLLTSIGMGIITSV

SEQ ID NO: 1736714 - protein, 17 aa, Staphylococcus epidermidis
ASLFIPFGASIGLDTMA

SEQ ID NO: 1736715 - protein, 26 aa, Staphylococcus epidermidis
ASLHSAAALGLYWSISAAFLIVQMHF

SEQ ID NO: 1736716 - protein, 17 aa, Staphylococcus epidermidis
ASMNNLEAFIVLNDSDI

SEQ ID NO: 1736717 - protein, 24 aa, Staphylococcus epidermidis
ASSQKFLIIYSIIFMLVIVAVVLS

SEQ ID NO: 1736718 - protein, 21 aa, Staphylococcus epidermidis
ATFLPQAFLSYAIGGVFHVKF

SEQ ID NO: 1736719 - protein, 27 aa, Staphylococcus epidermidis
ATIKNIRQNLFWAFGYNVAGIPIAACG

SEQ ID NO: 1736720 - protein, 19 aa, Staphylococcus epidermidis
ATLFIKRARKYGLVISHIY

SEQ ID NO: 1736721 - protein, 17 aa, Staphylococcus epidermidis
ATLIPGFLAKEVIISSM

SEQ ID NO: 1736722 - protein, 24 aa, Staphylococcus epidermidis
AVITCVFVPVIFKKMFPIPNEVGR

SEQ ID NO: 1736723 - protein, 24 aa, Staphylococcus epidermidis
AVVLSMFAIFIFKYSYKKNSESGK

SEQ ID NO: 1736724 - protein, 18 aa, Staphylococcus epidermidis
AWALIPLLLFVLLFLGVG

SEQ ID NO: 1736725 - protein, 28 aa, Staphylococcus epidermidis
AYAALIAHRVGLKWKDLEEGITHRLSTA

SEQ ID NO: 1736726 - protein, 20 aa, Staphylococcus epidermidis
AYAKVWLYFMYYWMIFGIGC

SEQ ID NO: 1736727 - protein, 25 aa, Staphylococcus epidermidis
AYDVLSALILAWSLMVSWNQLVAFS

SEQ ID NO: 1736728 - protein, 18 aa, Staphylococcus epidermidis
AYGHGVSGVNMGAKTGTG

SEQ ID NO: 1736729 - protein, 20 aa, Staphylococcus epidermidis
CAMFAICWIAYIQWETTIAS

SEQ ID NO: 1736730 - protein, 18 aa, Staphylococcus epidermidis
CGLLGGRVSEDINFGEVS

SEQ ID NO: 1736731 - protein, 20 aa, Staphylococcus epidermidis
CLFATIPGIVLWNRSIQSFG

SEQ ID NO: 1736732 - protein, 17 aa, Staphylococcus epidermidis
CQLKRNLNLTIQLMELN

SEQ ID NO: 1736733 - protein, 19 aa, Staphylococcus epidermidis
DALAKLSGILMDEKIREKL

SEQ ID NO: 1736734 - protein, 19 aa, Staphylococcus epidermidis
DALSTEWVFLIFAFIGVLA

SEQ ID NO: 1736735 - protein, 24 aa, Staphylococcus epidermidis
DDKKGVSILNILSLLLFVIFIILI

SEQ ID NO: 1736736 - protein, 26 aa, Staphylococcus epidermidis
DEFIIYKFGDDYIRVYNTEFEMNEDL

SEQ ID NO: 1736737 - protein, 22 aa, Staphylococcus epidermidis
DEISWVRWILYIVALFLPIFIF

SEQ ID NO: 1736738 - protein, 22 aa, Staphylococcus epidermidis
DEQSLDMFLNIILKESNRIESL

SEQ ID NO: 1736739 - protein, 22 aa, Staphylococcus epidermidis
DFIRYSLISGLLIGFIAPLIGA

SEQ ID NO: 1736740 - protein, 18 aa, Staphylococcus epidermidis
DFLVIVIVALIFYQLGTT

SEQ ID NO: 1736741 - protein, 18 aa, Staphylococcus epidermidis
DFSLIAIGFLCIFIFSFI

SEQ ID NO: 1736742 - protein, 25 aa, Staphylococcus epidermidis
DHLQYRFEKVIAFIIIFGMCKLILY

SEQ ID NO: 1736743 - protein, 22 aa, Staphylococcus epidermidis
DHSYVSWIIVVGISLILVAIVS

SEQ ID NO: 1736744 - protein, 21 aa, Staphylococcus epidermidis
DIGGFKAFLPQAIGMVIVAVI

SEQ ID NO: 1736745 - protein, 19 aa, Staphylococcus epidermidis
DIKGLIIFYIFIALLMFGL

SEQ ID NO: 1736746 - protein, 27 aa, Staphylococcus epidermidis
DILPDNSRNSLNPTERVEINYTEKLNG

SEQ ID NO: 1736747 - protein, 19 aa, Staphylococcus epidermidis
DILSFKLEVIMQFPYILSS

SEQ ID NO: 1736748 - protein, 22 aa, Staphylococcus epidermidis
DIPLSFAYVIFIVFWQVGFSNA

SEQ ID NO: 1736749 - protein, 19 aa, Staphylococcus epidermidis
DIYTFLNFSSIYRWQTTPL

SEQ ID NO: 1736750 - protein, 31 aa, Staphylococcus epidermidis
DKHGIKVLVIPGFILLISMTFLYSFLTTGTP

SEQ ID NO: 1736751 - protein, 25 aa, Staphylococcus epidermidis
DKKTRIIKALSEMSPKVRNLIAEVS

SEQ ID NO: 1736752 - protein, 26 aa, Staphylococcus epidermidis
DKLGRRRLVMLIAIVFIIGALILAAS

SEQ ID NO: 1736753 - protein, 18 aa, Staphylococcus epidermidis
DKPSEFITTILIGNNVAN

SEQ ID NO: 1736754 - protein, 21 aa, Staphylococcus epidermidis
DKTINIPLKIKKGSDAGYTIR

SEQ ID NO: 1736755 - protein, 20 aa, Staphylococcus epidermidis
DKYMPRMFTVRGDRLGYSNS

SEQ ID NO: 1736756 - protein, 29 aa, Staphylococcus epidermidis
DLFKPRYIKRIILATAISTLQGMQYYGVG

SEQ ID NO: 1736757 - protein, 23 aa, Staphylococcus epidermidis
DLKYGCRDLKVEGYDLDHVKVDG

SEQ ID NO: 1736758 - protein, 18 aa, Staphylococcus epidermidis
DLMLHKSGLYKYEASTNI

SEQ ID NO: 1736759 - protein, 28 aa, Staphylococcus epidermidis
DMSKGLKLKVIFNFGLPLIIALLHAYFA

SEQ ID NO: 1736760 - protein, 25 aa, Staphylococcus epidermidis
DMTPWKYRYVAGIIVLALVVVSYII

SEQ ID NO: 1736761 - protein, 22 aa, Staphylococcus epidermidis
DNAKELLLKGLEKLEYRGYDSA

SEQ ID NO: 1736762 - protein, 26 aa, Staphylococcus epidermidis
DNDSLFKHLVDNFGKTVGVITLTGLL

SEQ ID NO: 1736763 - protein, 17 aa, Staphylococcus epidermidis
DNFKILRRIGFTYTDMS

SEQ ID NO: 1736764 - protein, 29 aa, Staphylococcus epidermidis
DQFFIWAIPCYLCAFIAIIYGFTGIGIKK

SEQ ID NO: 1736765 - protein, 17 aa, Staphylococcus epidermidis
DSHHLKVGDISRNYSDK

SEQ ID NO: 1736766 - protein, 19 aa, Staphylococcus epidermidis
DSLISLVFPIEFDVYTNLI

SEQ ID NO: 1736767 - protein, 31 aa, Staphylococcus epidermidis
DTIIYKVHLMKECLERGIELISSMGAANKTD

SEQ ID NO: 1736768 - protein, 19 aa, Staphylococcus epidermidis
DTLLIKPGEKIPVDGKVTK

SEQ ID NO: 1736769 - protein, 21 aa, Staphylococcus epidermidis
DTRRAIYCTPIWFILLGLMYL

SEQ ID NO: 1736770 - protein, 30 aa, Staphylococcus epidermidis
DVDPRKSASILDIFGGCFQGLLPYSPQVIS

SEQ ID NO: 1736771 - protein, 23 aa, Staphylococcus epidermidis
DVLGRKKMALILLIGYLIASLLS

SEQ ID NO: 1736772 - protein, 18 aa, Staphylococcus epidermidis
DVMFTSPIIYRVKKNAFS

SEQ ID NO: 1736773 - protein, 24 aa, Staphylococcus epidermidis
DVPGHLKLALTVFAFIMMISVVLA

SEQ ID NO: 1736774 - protein, 21 aa, Staphylococcus epidermidis
DWMSTWTLYYWGWWLSWSPFV

SEQ ID NO: 1736775 - protein, 18 aa, Staphylococcus epidermidis
DYIDRLLLLRIMSTIQVI

SEQ ID NO: 1736776 - protein, 22 aa, Staphylococcus epidermidis
DYYLSNKGEVIFRLPDDKKSSQ

SEQ ID NO: 1736777 - protein, 18 aa, Staphylococcus epidermidis
EAGNKGWGSTEIVTMFIV

SEQ ID NO: 1736778 - protein, 22 aa, Staphylococcus epidermidis
EAGRSMGMTNFQLMKDVELPLA

SEQ ID NO: 1736779 - protein, 24 aa, Staphylococcus epidermidis
EAPIPGRSAVGIEVPNDKISLVTL

SEQ ID NO: 1736780 - protein, 23 aa, Staphylococcus epidermidis
EDDCFYIVMEYIEGPTLAEYIHS

SEQ ID NO: 1736781 - protein, 24 aa, Staphylococcus epidermidis
EDEFKFTTFFAGFLIGLIVIYILH

SEQ ID NO: 1736782 - protein, 33 aa, Staphylococcus epidermidis
EDNRFYQHGALDYKRLFGAIGKNLTGGFGSQGA

SEQ ID NO: 1736783 - protein, 28 aa, Staphylococcus epidermidis
EEFYLKKIWVAIKFLAVYLYQLITSSIS

SEQ ID NO: 1736784 - protein, 24 aa, Staphylococcus epidermidis
EEYRKSAQVDPFFLTDEHAVVLGS

SEQ ID NO: 1736785 - protein, 28 aa, Staphylococcus epidermidis
EGFLKLSIPNWLRRLITRSLAVIPVIIC

SEQ ID NO: 1736786 - protein, 19 aa, Staphylococcus epidermidis
EGGSTIWLTGILVVFTVVF

SEQ ID NO: 1736787 - protein, 19 aa, Staphylococcus epidermidis
EGLRYILFAFLIVWLTDTG

SEQ ID NO: 1736788 - protein, 17 aa, Staphylococcus epidermidis
EIAIRRAFGAKGRDIEI

SEQ ID NO: 1736789 - protein, 24 aa, Staphylococcus epidermidis
EIHEQPAVMRRIIQEYQDEKGNLK

SEQ ID NO: 1736790 - protein, 21 aa, Staphylococcus epidermidis
EIIDFNMFINKIINRHEMAAK

SEQ ID NO: 1736791 - protein, 19 aa, Staphylococcus epidermidis
EKRYHPFVAGIAIGFIALL

SEQ ID NO: 1736792 - protein, 25 aa, Staphylococcus epidermidis
EKVFKLSSYYLFNWFFFVYHLGVLI

SEQ ID NO: 1736793 - protein, 30 aa, Staphylococcus epidermidis
ELFKTPRFVLPMLIQGVSFVLLFTYISASP

SEQ ID NO: 1736794 - protein, 24 aa, Staphylococcus epidermidis
ELGSWKAPYSIVFVVDIFSALLII

SEQ ID NO: 1736795 - protein, 25 aa, Staphylococcus epidermidis
ELLGPIFRPIMRPLFTLPGRSTVDN

SEQ ID NO: 1736796 - protein, 18 aa, Staphylococcus epidermidis
ELNFIAWSLLYSAIVLVM

SEQ ID NO: 1736797 - protein, 29 aa, Staphylococcus epidermidis
ENEKSSKTKKWLIAIIVILLIIVAIFITR

SEQ ID NO: 1736798 - protein, 22 aa, Staphylococcus epidermidis
EQRANLKKIEYVYQTLNKDYYK

SEQ ID NO: 1736799 - protein, 22 aa, Staphylococcus epidermidis
EQSKFKIALREAGSGLLSGIVC

SEQ ID NO: 1736800 - protein, 20 aa, Staphylococcus epidermidis
ERTLSMILMSILFILVGIIL

SEQ ID NO: 1736801 - protein, 22 aa, Staphylococcus epidermidis
ESARVAMGYTFFHWGISQWSIF

SEQ ID NO: 1736802 - protein, 23 aa, Staphylococcus epidermidis
ESFKQKRFNVDTEGGYILDNVKI

SEQ ID NO: 1736803 - protein, 23 aa, Staphylococcus epidermidis
ESNDLLGRIDFKISKKDKQFQVQ

SEQ ID NO: 1736804 - protein, 19 aa, Staphylococcus epidermidis
ESYFLTWVHQIKTPITASQ

SEQ ID NO: 1736805 - protein, 20 aa, Staphylococcus epidermidis
ETYPRVKRVTAISFISTSFM

SEQ ID NO: 1736806 - protein, 20 aa, Staphylococcus epidermidis
EVFPSNPFLDFTGQRTTSTI

SEQ ID NO: 1736807 - protein, 25 aa, Staphylococcus epidermidis
EVLNPALQIMVYWLVFGLGIRSNAP

SEQ ID NO: 1736808 - protein, 20 aa, Staphylococcus epidermidis
EVQEGFKMAFNEKQGTGYAS

SEQ ID NO: 1736809 - protein, 31 aa, Staphylococcus epidermidis
EVSQKMKTILPRVDTKAVARSVLNALAKQLI

SEQ ID NO: 1736810 - protein, 17 aa, Staphylococcus epidermidis
FAAAWVFRERFLEILHI

SEQ ID NO: 1736811 - protein, 17 aa, Staphylococcus epidermidis
FADINWKQFEVAVPAFI

SEQ ID NO: 1736812 - protein, 18 aa, Staphylococcus epidermidis
FADMAILLGLNWLAILLY

SEQ ID NO: 1736813 - protein, 31 aa, Staphylococcus epidermidis
FAGIIATFIGWRWIFVLSIIFSIIALILLRG

SEQ ID NO: 1736814 - protein, 17 aa, Staphylococcus epidermidis
FAIAVIGTFIASIICIP

SEQ ID NO: 1736815 - protein, 22 aa, Staphylococcus epidermidis
FAPEHPFKLILPIITLVGGTVG

SEQ ID NO: 1736816 - protein, 25 aa, Staphylococcus epidermidis
FAVKLEWFPVAGWEGFSTAILPSLA

SEQ ID NO: 1736817 - protein, 21 aa, Staphylococcus epidermidis
FCMLLNLTPIFAILTAIVTIE

SEQ ID NO: 1736818 - protein, 18 aa, Staphylococcus epidermidis
FDDVPTLIHSWINSDIHR

SEQ ID NO: 1736819 - protein, 17 aa, Staphylococcus epidermidis
FDGGNQWIGGLKFLGLH

SEQ ID NO: 1736820 - protein, 18 aa, Staphylococcus epidermidis
FDGSRLLFYYAPVAILIS

SEQ ID NO: 1736821 - protein, 17 aa, Staphylococcus epidermidis
FDKYRKERMLKYLRELS

SEQ ID NO: 1736822 - protein, 24 aa, Staphylococcus epidermidis
FDQVSKWLITISMKVGDSYEIIPN

SEQ ID NO: 1736823 - protein, 24 aa, Staphylococcus epidermidis
FEISSRISKIYGYLFTIGLYLVIG

SEQ ID NO: 1736824 - protein, 20 aa, Staphylococcus epidermidis
FEMLGEYILDGFKVAVIVGA

SEQ ID NO: 1736825 - protein, 17 aa, Staphylococcus epidermidis
FENEIQSLISVYDDILK

SEQ ID NO: 1736826 - protein, 26 aa, Staphylococcus epidermidis
FENNNRLGGTASWKDNRQPDKNIAGV

SEQ ID NO: 1736827 - protein, 18 aa, Staphylococcus epidermidis
FENYKQFILDSGIPSTKF

SEQ ID NO: 1736828 - protein, 17 aa, Staphylococcus epidermidis
FEQLLLIFIDNAMKYDT

SEQ ID NO: 1736829 - protein, 20 aa, Staphylococcus epidermidis
FFGHIVWMMVIEMVRRYFYN

SEQ ID NO: 1736830 - protein, 17 aa, Staphylococcus epidermidis
FFHESRLGKWIDNEVYE

SEQ ID NO: 1736831 - protein, 17 aa, Staphylococcus epidermidis
FFHMATWMEPFGGIKGR

SEQ ID NO: 1736832 - protein, 18 aa, Staphylococcus epidermidis
FFILRLFLEPTRFNYLII

SEQ ID NO: 1736833 - protein, 18 aa, Staphylococcus epidermidis
FFKQMIPPDWGYLDHITQ

SEQ ID NO: 1736834 - protein, 29 aa, Staphylococcus epidermidis
FFLDVKLTFAAIFIFPFYILTVYFFFGRL

SEQ ID NO: 1736835 - protein, 22 aa, Staphylococcus epidermidis
FFPCILVVLFSVVTRSKWIGTL

SEQ ID NO: 1736836 - protein, 19 aa, Staphylococcus epidermidis
FFQAISPYLPFTYSIDALR

SEQ ID NO: 1736837 - protein, 17 aa, Staphylococcus epidermidis
FFSDTFIWLPLLLLGIE

SEQ ID NO: 1736838 - protein, 23 aa, Staphylococcus epidermidis
FGGTCVGLGIGIIVLAGGTTAGT

SEQ ID NO: 1736839 - protein, 23 aa, Staphylococcus epidermidis
FGIFSIPITVIWIVAITNAINLI

SEQ ID NO: 1736840 - protein, 18 aa, Staphylococcus epidermidis
FGIPTWLGALIMTVLIYL

SEQ ID NO: 1736841 - protein, 17 aa, Staphylococcus epidermidis
FGKDKFNLFLPWYYLIK

SEQ ID NO: 1736842 - protein, 25 aa, Staphylococcus epidermidis
FGPRKMITVALVWWSAFTILTGMIK

SEQ ID NO: 1736843 - protein, 24 aa, Staphylococcus epidermidis
FGVNLKLRYPFIGAVAGSGIGAAY

SEQ ID NO: 1736844 - protein, 17 aa, Staphylococcus epidermidis
FIACADLGISLGGVLMG

SEQ ID NO: 1736845 - protein, 19 aa, Staphylococcus epidermidis
FIDHWKLMLYNVIIILLFF

SEQ ID NO: 1736846 - protein, 19 aa, Staphylococcus epidermidis
FIGGFPITSAIVIIVFGIL

SEQ ID NO: 1736847 - protein, 21 aa, Staphylococcus epidermidis
FIGIEGAVVFSGRAKNKKDVG

SEQ ID NO: 1736848 - protein, 26 aa, Staphylococcus epidermidis
FIINAILIIVGWKFLSRTTAIYTAIT

SEQ ID NO: 1736849 - protein, 20 aa, Staphylococcus epidermidis
FILFFLMKYAHVMTPEMTDS

SEQ ID NO: 1736850 - protein, 17 aa, Staphylococcus epidermidis
FILKLLAAILIGFGAAF

SEQ ID NO: 1736851 - protein, 17 aa, Staphylococcus epidermidis
FILLGLLKFFKKRTTMI

SEQ ID NO: 1736852 - protein, 28 aa, Staphylococcus epidermidis
FINILKSFKWRIIGFLAFLIIAILFLTL

SEQ ID NO: 1736853 - protein, 21 aa, Staphylococcus epidermidis
FIRQRLTMVVLNGMIGFAVTL

SEQ ID NO: 1736854 - protein, 26 aa, Staphylococcus epidermidis
FIVAKDGLFPKWFAKENKNGAPMNAL

SEQ ID NO: 1736855 - protein, 23 aa, Staphylococcus epidermidis
FIVNLFRAIPFIILILLLIPFTS

SEQ ID NO: 1736856 - protein, 22 aa, Staphylococcus epidermidis
FIVSLYWHFLDVVWVFIFTAVY

SEQ ID NO: 1736857 - protein, 29 aa, Staphylococcus epidermidis
FKDNLKVFYCLFISLTLLIMFISMYDILN

SEQ ID NO: 1736858 - protein, 25 aa, Staphylococcus epidermidis
FKGFITVFFPLWFPVHADGVISTFF

SEQ ID NO: 1736859 - protein, 17 aa, Staphylococcus epidermidis
FKLFIYIGKRSYSLYLW

SEQ ID NO: 1736860 - protein, 19 aa, Staphylococcus epidermidis
FKLPLYPILPAITFILVLL

SEQ ID NO: 1736861 - protein, 19 aa, Staphylococcus epidermidis
FKNKWTHFFISIPVIIGGS

SEQ ID NO: 1736862 - protein, 22 aa, Staphylococcus epidermidis
FKNPHILIVIAIIVFGYSGVFT

SEQ ID NO: 1736863 - protein, 22 aa, Staphylococcus epidermidis
FKVATPIFKPLFAWQMSRNLLW

SEQ ID NO: 1736864 - protein, 20 aa, Staphylococcus epidermidis
FKVLIACLLVLFILMMNLRG

SEQ ID NO: 1736865 - protein, 26 aa, Staphylococcus epidermidis
FLFKRLSWPYGLIIAAVIITSLGSLS

SEQ ID NO: 1736866 - protein, 21 aa, Staphylococcus epidermidis
FLFLPASWFTGLVTNKTLADN

SEQ ID NO: 1736867 - protein, 19 aa, Staphylococcus epidermidis
FLFYICLPFQNILEKWGFP

SEQ ID NO: 1736868 - protein, 25 aa, Staphylococcus epidermidis
FLGNWIGQVGLNWFVLTTYHNAVYL

SEQ ID NO: 1736869 - protein, 22 aa, Staphylococcus epidermidis
FLHVLGDLFGSVGAIVASLLIW

SEQ ID NO: 1736870 - protein, 19 aa, Staphylococcus epidermidis
FLIARFIKIFTPLATTQEE

SEQ ID NO: 1736871 - protein, 19 aa, Staphylococcus epidermidis
FLNAFFAEIIKVMSKFIGG

SEQ ID NO: 1736872 - protein, 21 aa, Staphylococcus epidermidis
FLTLYLLNVHLGYTFSGGFID

SEQ ID NO: 1736873 - protein, 17 aa, Staphylococcus epidermidis
FMLVEIIGGFLANSLAL

SEQ ID NO: 1736874 - protein, 22 aa, Staphylococcus epidermidis
FMQGEFPVMMFGLPAAALAIYQ

SEQ ID NO: 1736875 - protein, 21 aa, Staphylococcus epidermidis
FNLTKPDIWITVIAGVLYFIQ

SEQ ID NO: 1736876 - protein, 21 aa, Staphylococcus epidermidis
FNNRNALFLTGEWELSQTQYV

SEQ ID NO: 1736877 - protein, 21 aa, Staphylococcus epidermidis
FPFGGDIIFVRIIRDNDSIVP

SEQ ID NO: 1736878 - protein, 17 aa, Staphylococcus epidermidis
FPFHIWLPKAMAAPTPV

SEQ ID NO: 1736879 - protein, 27 aa, Staphylococcus epidermidis
FPFYILTVYFFFGRLRKLTRVRSQALA

SEQ ID NO: 1736880 - protein, 19 aa, Staphylococcus epidermidis
FPGYASTLFANAMVIGQLG

SEQ ID NO: 1736881 - protein, 18 aa, Staphylococcus epidermidis
FPKSIIFIAPMIVFVFVF

SEQ ID NO: 1736882 - protein, 24 aa, Staphylococcus epidermidis
FPQDWTIFYWSWWLVYAPFIGLFI

SEQ ID NO: 1736883 - protein, 19 aa, Staphylococcus epidermidis
FPSGHAMGSTSFFGSAIYV

SEQ ID NO: 1736884 - protein, 17 aa, Staphylococcus epidermidis
FQMPVAYKGISLTSKRF

SEQ ID NO: 1736885 - protein, 29 aa, Staphylococcus epidermidis
FQSSSKITLWLSLVITMIFTVVEFVGGIV

SEQ ID NO: 1736886 - protein, 26 aa, Staphylococcus epidermidis
FSAPQKRWHFILAFNSSILIGLFVKY

SEQ ID NO: 1736887 - protein, 20 aa, Staphylococcus epidermidis
FSEKMMGDGIGFVPDSGEIV

SEQ ID NO: 1736888 - protein, 24 aa, Staphylococcus epidermidis
FSETNLPMALSFFSGKRLVPIMTA

SEQ ID NO: 1736889 - protein, 27 aa, Staphylococcus epidermidis
FSLIASILVLWLYFRKSIPRKFDAVNI

SEQ ID NO: 1736890 - protein, 21 aa, Staphylococcus epidermidis
FSLISGAGWAFGQIITFKAFE

SEQ ID NO: 1736891 - protein, 24 aa, Staphylococcus epidermidis
FSLPQRRWVYFLALSTSVLIALFI

SEQ ID NO: 1736892 - protein, 25 aa, Staphylococcus epidermidis
FSSKAALVIFMWLPKAYAVLNTELA

SEQ ID NO: 1736893 - protein, 18 aa, Staphylococcus epidermidis
FTDRAIRSIAFLLTALPS

SEQ ID NO: 1736894 - protein, 23 aa, Staphylococcus epidermidis
FTFTKAVLFTLIFIVIGFYDGFL

SEQ ID NO: 1736895 - protein, 20 aa, Staphylococcus epidermidis
FTGVMFNALIALLAFLSILF

SEQ ID NO: 1736896 - protein, 26 aa, Staphylococcus epidermidis
FTLGSLVCAISFNFPIMMSGRVLQAI

SEQ ID NO: 1736897 - protein, 19 aa, Staphylococcus epidermidis
FTLILQVFFYKNLPVKNQI

SEQ ID NO: 1736898 - protein, 21 aa, Staphylococcus epidermidis
FTNIYYHFHLKASNDAKIMRT

SEQ ID NO: 1736899 - protein, 17 aa, Staphylococcus epidermidis
FTSKRWLIISISIFIIM

SEQ ID NO: 1736900 - protein, 17 aa, Staphylococcus epidermidis
FTTGLMLKQLEVENKVN

SEQ ID NO: 1736901 - protein, 21 aa, Staphylococcus epidermidis
FTVFACWPFTRLVHVWSVPLS

SEQ ID NO: 1736902 - protein, 19 aa, Staphylococcus epidermidis
FVAMFIPLFFIYKYRQPMF

SEQ ID NO: 1736903 - protein, 18 aa, Staphylococcus epidermidis
FVARGVIAIAGFVVFSIS

SEQ ID NO: 1736904 - protein, 26 aa, Staphylococcus epidermidis
FVDLFSWRMPFYLVSAIAAVAFILGF

SEQ ID NO: 1736905 - protein, 26 aa, Staphylococcus epidermidis
FVILLIGLFSFVAMAVFGNKYEEMPD

SEQ ID NO: 1736906 - protein, 23 aa, Staphylococcus epidermidis
FVLASLAIYWAMWPTTAEVILII

SEQ ID NO: 1736907 - protein, 17 aa, Staphylococcus epidermidis
FWYVFLIIYSLLIGFIL

SEQ ID NO: 1736908 - protein, 17 aa, Staphylococcus epidermidis
FYGIPFLGGSVILSFGW

SEQ ID NO: 1736909 - protein, 20 aa, Staphylococcus epidermidis
FYLFFPFILLGLLKFFKKRT

SEQ ID NO: 1736910 - protein, 22 aa, Staphylococcus epidermidis
FYNELPGFLGVLVSISPVTLTI

SEQ ID NO: 1736911 - protein, 19 aa, Staphylococcus epidermidis
GAIQWNFQTLIGFIFAPFA

SEQ ID NO: 1736912 - protein, 23 aa, Staphylococcus epidermidis
GASAGAFGWLIFEYILKKTTSLL

SEQ ID NO: 1736913 - protein, 17 aa, Staphylococcus epidermidis
GAYILWGILPIYWRLID

SEQ ID NO: 1736914 - protein, 24 aa, Staphylococcus epidermidis
GCLLAFIWPPFSFRKDISKGAKAS

SEQ ID NO: 1736915 - protein, 20 aa, Staphylococcus epidermidis
GCSNIEVFNAKGPVASSQKF

SEQ ID NO: 1736916 - protein, 20 aa, Staphylococcus epidermidis
GCYFGQYLPMSWRKPLSLGL

SEQ ID NO: 1736917 - protein, 21 aa, Staphylococcus epidermidis
GDLKFIDWGVLLVLGIFIGSY

SEQ ID NO: 1736918 - protein, 21 aa, Staphylococcus epidermidis
GDVVARFGIKLLFGATLVSFI

SEQ ID NO: 1736919 - protein, 20 aa, Staphylococcus epidermidis
GEGFSRQTFKVHSVSQNDFD

SEQ ID NO: 1736920 - protein, 20 aa, Staphylococcus epidermidis
GEMAIGLGLILGIFAYAASF

SEQ ID NO: 1736921 - protein, 28 aa, Staphylococcus epidermidis
GEWYRLISSMFLHFNFEHILMNMLSLFI

SEQ ID NO: 1736922 - protein, 19 aa, Staphylococcus epidermidis
GFFAGYIVGYMMKYTEKYV

SEQ ID NO: 1736923 - protein, 23 aa, Staphylococcus epidermidis
GFFSVRLLLSLVFINLTSPVGMH

SEQ ID NO: 1736924 - protein, 22 aa, Staphylococcus epidermidis
GFGVAMSLAFFFGIVTDLYFGS

SEQ ID NO: 1736925 - protein, 18 aa, Staphylococcus epidermidis
GFIAAIPIILFSSIFILI

SEQ ID NO: 1736926 - protein, 18 aa, Staphylococcus epidermidis
GFIGIIIFFIIFGLFINK

SEQ ID NO: 1736927 - protein, 25 aa, Staphylococcus epidermidis
GFMVGWTYWLTWIISGMAEVTAVAK

SEQ ID NO: 1736928 - protein, 18 aa, Staphylococcus epidermidis
GFSLSFDGGNQWIGGLKF

SEQ ID NO: 1736929 - protein, 17 aa, Staphylococcus epidermidis
GFTHMWLYMYAYSLYLF

SEQ ID NO: 1736930 - protein, 20 aa, Staphylococcus epidermidis
GFVAEFSFNYIFMANLIMYV

SEQ ID NO: 1736931 - protein, 24 aa, Staphylococcus epidermidis
GGAFYFSIGVFKNFHMMLVGQICL

SEQ ID NO: 1736932 - protein, 25 aa, Staphylococcus epidermidis
GGFMPNGFIGFFFALSIVIGSYQGV

SEQ ID NO: 1736933 - protein, 23 aa, Staphylococcus epidermidis
GGHAGGLAIIIGWLITAIGMISL

SEQ ID NO: 1736934 - protein, 24 aa, Staphylococcus epidermidis
GGIGDLALVYGYQRFDTIVIVITV

SEQ ID NO: 1736935 - protein, 27 aa, Staphylococcus epidermidis
GGLAPFTILFSLPFTVIGVVLALIITG

SEQ ID NO: 1736936 - protein, 18 aa, Staphylococcus epidermidis
GGLIGGPIVKYLIKRYDL

SEQ ID NO: 1736937 - protein, 17 aa, Staphylococcus epidermidis
GGLKFLGLHHVGFETSK

SEQ ID NO: 1736938 - protein, 19 aa, Staphylococcus epidermidis
GGWLGWLVTILLWGTTLWG

SEQ ID NO: 1736939 - protein, 22 aa, Staphylococcus epidermidis
GHLTEAPVLLAIFGIIVTVILY

SEQ ID NO: 1736940 - protein, 18 aa, Staphylococcus epidermidis
GIIGVIFAVWLLSMVEKR

SEQ ID NO: 1736941 - protein, 24 aa, Staphylococcus epidermidis
GIISFKIAVGVLITGTFSIFDAIQ

SEQ ID NO: 1736942 - protein, 25 aa, Staphylococcus epidermidis
GILGVEWTRHLELKKQTLSQESGNT

SEQ ID NO: 1736943 - protein, 30 aa, Staphylococcus epidermidis
GILTCLKLEVSPVFAVIVGLVLHDSKLLPA

SEQ ID NO: 1736944 - protein, 24 aa, Staphylococcus epidermidis
GISLTSKRFIQWLNLNNIVPGYYG

SEQ ID NO: 1736945 - protein, 23 aa, Staphylococcus epidermidis
GIVAKIIVIWFFRKYDNHMRGSV

SEQ ID NO: 1736946 - protein, 24 aa, Staphylococcus epidermidis
GIVMGTGFAFWSFVLAILLIVVDV

SEQ ID NO: 1736947 - protein, 34 aa, Staphylococcus epidermidis
GKGTSPNDFFSLRTGGPVDARIVWVNNQGPDINS

SEQ ID NO: 1736948 - protein, 24 aa, Staphylococcus epidermidis
GKKKRSWVSLIIQVFVLVLTAITG

SEQ ID NO: 1736949 - protein, 25 aa, Staphylococcus epidermidis
GKKNYRSGTVFAILCWFVISVAIFL

SEQ ID NO: 1736950 - protein, 28 aa, Staphylococcus epidermidis
GKYQFDGLKNGLTYKITFETPEGYTPTL

SEQ ID NO: 1736951 - protein, 30 aa, Staphylococcus epidermidis
GLHHIFHAPFWFEFGSWKNAAGEIIRGDQR

SEQ ID NO: 1736952 - protein, 20 aa, Staphylococcus epidermidis
GLKSIICFNRERRMNVKQLS

SEQ ID NO: 1736953 - protein, 19 aa, Staphylococcus epidermidis
GLLILYYICRLISEEKLYR

SEQ ID NO: 1736954 - protein, 28 aa, Staphylococcus epidermidis
GLLSGIVCAVILFLIIVVIFRQPLLALI

SEQ ID NO: 1736955 - protein, 24 aa, Staphylococcus epidermidis
GLSIPEFVIMIALASFFHPSLWNL

SEQ ID NO: 1736956 - protein, 23 aa, Staphylococcus epidermidis
GLYAGMMFFNMDGLSWLGVLKNI

SEQ ID NO: 1736957 - protein, 20 aa, Staphylococcus epidermidis
GMDLLPGFFAGYIVGYMMKY

SEQ ID NO: 1736958 - protein, 39 aa, Staphylococcus epidermidis
GMNFEFMPELKWHYAYFVCLTLMLIITIILIIFFKKKKW

SEQ ID NO: 1736959 - protein, 18 aa, Staphylococcus epidermidis
GNASEILTLIDFNTTMKG

SEQ ID NO: 1736960 - protein, 22 aa, Staphylococcus epidermidis
GNMGGGVLDFIATNWIPLGKAH

SEQ ID NO: 1736961 - protein, 19 aa, Staphylococcus epidermidis
GNPLGLEFANSVTSGIISA

SEQ ID NO: 1736962 - protein, 18 aa, Staphylococcus epidermidis
GPIVKYLIKRYDLKPEHR

SEQ ID NO: 1736963 - protein, 24 aa, Staphylococcus epidermidis
GQGFANLIAPLGFGSWQAGATLIP

SEQ ID NO: 1736964 - protein, 24 aa, Staphylococcus epidermidis
GQIPWFVYICEVILMFVMAEVSYK

SEQ ID NO: 1736965 - protein, 17 aa, Staphylococcus epidermidis
GQMAIWNFLFLRRSLPL

SEQ ID NO: 1736966 - protein, 21 aa, Staphylococcus epidermidis
GQSMGMTKFQLMKDVEMPLAL

SEQ ID NO: 1736967 - protein, 30 aa, Staphylococcus epidermidis
GRKAQEAYLSYRLEQEYSKDEIFQVYMNKI

SEQ ID NO: 1736968 - protein, 19 aa, Staphylococcus epidermidis
GRSIREFISGVLLVPALVS

SEQ ID NO: 1736969 - protein, 17 aa, Staphylococcus epidermidis
GRTTVVIAHRLSTIKKA

SEQ ID NO: 1736970 - protein, 21 aa, Staphylococcus epidermidis
GSAHGDVKIYLKDGTIRDEVW

SEQ ID NO: 1736971 - protein, 24 aa, Staphylococcus epidermidis
GSAIFSLLGQHAFVLGLIVLLFIP

SEQ ID NO: 1736972 - protein, 19 aa, Staphylococcus epidermidis
GSILFFKFLTEFINIMVHG

SEQ ID NO: 1736973 - protein, 21 aa, Staphylococcus epidermidis
GSKEFRWRLPDIKTIRNSALG

SEQ ID NO: 1736974 - protein, 17 aa, Staphylococcus epidermidis
GSLVMLFIMDWKLTLLT

SEQ ID NO: 1736975 - protein, 21 aa, Staphylococcus epidermidis
GSSPEFGIWALIIGTLKITVI

SEQ ID NO: 1736976 - protein, 24 aa, Staphylococcus epidermidis
GSSVKGGTLLAGYQNKAINVGETM

SEQ ID NO: 1736977 - protein, 21 aa, Staphylococcus epidermidis
GSTSHIPVVIYYSDGSSEEAT

SEQ ID NO: 1736978 - protein, 20 aa, Staphylococcus epidermidis
GSVFLPFLISGFLFYICLPF

SEQ ID NO: 1736979 - protein, 18 aa, Staphylococcus epidermidis
GSVYSTGLSAIWITIGLT

SEQ ID NO: 1736980 - protein, 17 aa, Staphylococcus epidermidis
GTARLTNHWDKKTFDSN

SEQ ID NO: 1736981 - protein, 18 aa, Staphylococcus epidermidis
GTNYNFNDFNSFISNIPA

SEQ ID NO: 1736982 - protein, 18 aa, Staphylococcus epidermidis
GTPMLVQVFIVFFGTTAA

SEQ ID NO: 1736983 - protein, 30 aa, Staphylococcus epidermidis
GTSYHAGLVGKEFIEKWAGVPTEVHVASEF

SEQ ID NO: 1736984 - protein, 20 aa, Staphylococcus epidermidis
GTTSDQWQSLAYTRTPFVKT

SEQ ID NO: 1736985 - protein, 18 aa, Staphylococcus epidermidis
GVCLFLVGLLSLIGHFVN

SEQ ID NO: 1736986 - protein, 21 aa, Staphylococcus epidermidis
GVSGLIGGPWVAIIVGIISGL

SEQ ID NO: 1736987 - protein, 20 aa, Staphylococcus epidermidis
GYLKGFEGVFIYPALLAIII

SEQ ID NO: 1736988 - protein, 19 aa, Staphylococcus epidermidis
GYVYFSWLLGLLVGMVIMN

SEQ ID NO: 1736989 - protein, 26 aa, Staphylococcus epidermidis
HAQFIPEFIGSLVIGIISVIGHAFVP

SEQ ID NO: 1736990 - protein, 24 aa, Staphylococcus epidermidis
HDVSWGEWFLYAAPWSIIMSIALY

SEQ ID NO: 1736991 - protein, 25 aa, Staphylococcus epidermidis
HFIGDLLNSLGIIVAFVLIHFTGWN

SEQ ID NO: 1736992 - protein, 23 aa, Staphylococcus epidermidis
HGKIERPSIGIGLINLSDIPENY

SEQ ID NO: 1736993 - protein, 22 aa, Staphylococcus epidermidis
HGVNLPLILSIVVIIIGLILAL

SEQ ID NO: 1736994 - protein, 27 aa, Staphylococcus epidermidis
HISKEVKARSAIHYASYKPTLANIVRA

SEQ ID NO: 1736995 - protein, 24 aa, Staphylococcus epidermidis
HKAMKDYTSYMLAEILKGTFKAYG

SEQ ID NO: 1736996 - protein, 19 aa, Staphylococcus epidermidis
HLILFPGILLQGAAIAALV

SEQ ID NO: 1736997 - protein, 28 aa, Staphylococcus epidermidis
HNFILLIGIFCFLKGLIGFFIGGDSNLL

SEQ ID NO: 1736998 - protein, 38 aa, Staphylococcus epidermidis
HPKGLGVLFFVEFWERFSYYGMRAMLIFYMYFALQENG

SEQ ID NO: 1736999 - protein, 26 aa, Staphylococcus epidermidis
HRLSLIVYLVMGWVGIIFLPIIIMRT

SEQ ID NO: 1737000 - protein, 26 aa, Staphylococcus epidermidis
HSKIVYRFTTLFTMVAAFVDGVKASP

SEQ ID NO: 1737001 - protein, 23 aa, Staphylococcus epidermidis
IAAFVACGFFLFMFGGVASDAWI

SEQ ID NO: 1737002 - protein, 20 aa, Staphylococcus epidermidis
IAALSLMITFVFIKNQIFFQ

SEQ ID NO: 1737003 - protein, 20 aa, Staphylococcus epidermidis
IAAYVVAFGIKFVEKKVPEG

SEQ ID NO: 1737004 - protein, 23 aa, Staphylococcus epidermidis
IAFLAGLLKDWLGGIMPILIVTI

SEQ ID NO: 1737005 - protein, 21 aa, Staphylococcus epidermidis
IAISHFRFRRAFDKQNYDKSK

SEQ ID NO: 1737006 - protein, 17 aa, Staphylococcus epidermidis
IAIYAITVILFSALMSF

SEQ ID NO: 1737007 - protein, 25 aa, Staphylococcus epidermidis
IANDGYRIQPHIGLSIYESTNKDET

SEQ ID NO: 1737008 - protein, 19 aa, Staphylococcus epidermidis
IANFSGLLGRVLTEMRLVK

SEQ ID NO: 1737009 - protein, 20 aa, Staphylococcus epidermidis
IAPWLGRTALTWIVDMSSTG

SEQ ID NO: 1737010 - protein, 19 aa, Staphylococcus epidermidis
IASTIFAFFLSNRITKPLR

SEQ ID NO: 1737011 - protein, 24 aa, Staphylococcus epidermidis
IAYKDIKKIAAYQVILSIGFIILG

SEQ ID NO: 1737012 - protein, 17 aa, Staphylococcus epidermidis
ICLAIFLAILLGLGISY

SEQ ID NO: 1737013 - protein, 17 aa, Staphylococcus epidermidis
IDDHSYVSWIIVVGISL

SEQ ID NO: 1737014 - protein, 19 aa, Staphylococcus epidermidis
IDGSFGWNGLLNAISKGII

SEQ ID NO: 1737015 - protein, 18 aa, Staphylococcus epidermidis
IDISGFSFPSGHAMGSTS

SEQ ID NO: 1737016 - protein, 20 aa, Staphylococcus epidermidis
IDSFFNYLFGMSRYLTYILV

SEQ ID NO: 1737017 - protein, 29 aa, Staphylococcus epidermidis
IEVQRNCELIPRWFVEYDGNWYAYKDGRL

SEQ ID NO: 1737018 - protein, 24 aa, Staphylococcus epidermidis
IFDNLPIIFALGVAIGLAGGDGVA

SEQ ID NO: 1737019 - protein, 26 aa, Staphylococcus epidermidis
IFGIGRLPAIIALVVYALLPILRNTY

SEQ ID NO: 1737020 - protein, 17 aa, Staphylococcus epidermidis
IFLMVVLIILGGVYSSA

SEQ ID NO: 1737021 - protein, 17 aa, Staphylococcus epidermidis
IFMCLVLGAQQIHDGQL

SEQ ID NO: 1737022 - protein, 24 aa, Staphylococcus epidermidis
IFNLVRIVIPLIIIFIIFTVLYSV

SEQ ID NO: 1737023 - protein, 18 aa, Staphylococcus epidermidis
IFTCIIFIGFLYQLYSKR

SEQ ID NO: 1737024 - protein, 21 aa, Staphylococcus epidermidis
IGALAAWCYNKFYNITLPSYL

SEQ ID NO: 1737025 - protein, 17 aa, Staphylococcus epidermidis
IGFLCIFIFSFIGLTIA

SEQ ID NO: 1737026 - protein, 24 aa, Staphylococcus epidermidis
IGGIGCAFSMLFLSKIIDNNSKGF

SEQ ID NO: 1737027 - protein, 17 aa, Staphylococcus epidermidis
IGGVFHVKFFQEIGDLA

SEQ ID NO: 1737028 - protein, 25 aa, Staphylococcus epidermidis
IGHICLSLPFAMVGLFTSMFFIIVG

SEQ ID NO: 1737029 - protein, 17 aa, Staphylococcus epidermidis
IGLILTMICLIDIGHLF

SEQ ID NO: 1737030 - protein, 25 aa, Staphylococcus epidermidis
IGRRFRLTSFFVRILFGHRTFTHSL

SEQ ID NO: 1737031 - protein, 19 aa, Staphylococcus epidermidis
IGSAQKFTTGLMLKQLEVE

SEQ ID NO: 1737032 - protein, 25 aa, Staphylococcus epidermidis
IGSDILYWGVIEWAFYYQVPPNGAK

SEQ ID NO: 1737033 - protein, 18 aa, Staphylococcus epidermidis
IGSKEFKGLNWIHYPWDF

SEQ ID NO: 1737034 - protein, 25 aa, Staphylococcus epidermidis
IGSLMCIPLAWFLGLQDFFIKPLML

SEQ ID NO: 1737035 - protein, 24 aa, Staphylococcus epidermidis
IGSWRMLIIYIISGLYGNFVSLSF

SEQ ID NO: 1737036 - protein, 18 aa, Staphylococcus epidermidis
IGTSLSFIKLIKIDPIEA

SEQ ID NO: 1737037 - protein, 20 aa, Staphylococcus epidermidis
IGVGLFIHWIWPELPIGAAF

SEQ ID NO: 1737038 - protein, 17 aa, Staphylococcus epidermidis
IGVILLVTFLIYLFYSP

SEQ ID NO: 1737039 - protein, 18 aa, Staphylococcus epidermidis
IGVLFYMRSNKRNLIEKT

SEQ ID NO: 1737040 - protein, 19 aa, Staphylococcus epidermidis
IHGKGIRPDVSISTPKYQS

SEQ ID NO: 1737041 - protein, 26 aa, Staphylococcus epidermidis
IHWIWPELPIGAAFAIAAILCPTDAV

SEQ ID NO: 1737042 - protein, 28 aa, Staphylococcus epidermidis
IIAFILTRWAWFCRVIRTSVMQYIEADH

SEQ ID NO: 1737043 - protein, 22 aa, Staphylococcus epidermidis
IIAGLIAAIALVFIYISLGYIG

SEQ ID NO: 1737044 - protein, 17 aa, Staphylococcus epidermidis
IIASLFIPFGASIGLDT

SEQ ID NO: 1737045 - protein, 24 aa, Staphylococcus epidermidis
IIDGPSTFIWVCVVTLIAQQLEGN

SEQ ID NO: 1737046 - protein, 17 aa, Staphylococcus epidermidis
IIFSYIIGIVSLFTGLI

SEQ ID NO: 1737047 - protein, 18 aa, Staphylococcus epidermidis
IIGIVIIVVLIIAAFILK

SEQ ID NO: 1737048 - protein, 19 aa, Staphylococcus epidermidis
IIHCMTRVRIKVHNDAKVN

SEQ ID NO: 1737049 - protein, 23 aa, Staphylococcus epidermidis
IIIPEVVTDLGIHHHAVITNYYV

SEQ ID NO: 1737050 - protein, 18 aa, Staphylococcus epidermidis
IIISGVIFIIFLFLPASW

SEQ ID NO: 1737051 - protein, 18 aa, Staphylococcus epidermidis
IILFCLCMINLFFLTHFR

SEQ ID NO: 1737052 - protein, 26 aa, Staphylococcus epidermidis
IILFLLCLTVFKMKGIYAAITTLVVT

SEQ ID NO: 1737053 - protein, 19 aa, Staphylococcus epidermidis
IILGLFGIGFMVVGYCLKP

SEQ ID NO: 1737054 - protein, 26 aa, Staphylococcus epidermidis
IILILQRFTKGFLKSIAILIGLAIGT

SEQ ID NO: 1737055 - protein, 27 aa, Staphylococcus epidermidis
IILNYGPWRIVFVILTMFGIVMLIGTL

SEQ ID NO: 1737056 - protein, 17 aa, Staphylococcus epidermidis
IILTILSMFLIKHTPET

SEQ ID NO: 1737057 - protein, 18 aa, Staphylococcus epidermidis
IIMSGLVGAILLTFGDGL

SEQ ID NO: 1737058 - protein, 17 aa, Staphylococcus epidermidis
IINICRSIGPAIAGGLI

SEQ ID NO: 1737059 - protein, 18 aa, Staphylococcus epidermidis
IISIIFVLLFRRLRHIIK

SEQ ID NO: 1737060 - protein, 26 aa, Staphylococcus epidermidis
IISILISLIILRGGYKIIKNASKVLM

SEQ ID NO: 1737061 - protein, 17 aa, Staphylococcus epidermidis
IIVLSFIVVLPITNVLY

SEQ ID NO: 1737062 - protein, 20 aa, Staphylococcus epidermidis
IIVVIFRQPLLALIVGGSLT

SEQ ID NO: 1737063 - protein, 19 aa, Staphylococcus epidermidis
IIVVILIILGAFQLGIIGR

SEQ ID NO: 1737064 - protein, 21 aa, Staphylococcus epidermidis
IKAAAKYYFNKDMKDLNLAEE

SEQ ID NO: 1737065 - protein, 18 aa, Staphylococcus epidermidis
IKDDAITSLSRINAQVVE

SEQ ID NO: 1737066 - protein, 20 aa, Staphylococcus epidermidis
IKKAKSLAFRDVKNHFVRNE

SEQ ID NO: 1737067 - protein, 17 aa, Staphylococcus epidermidis
IKKNSSYERIYDKAKKQ

SEQ ID NO: 1737068 - protein, 27 aa, Staphylococcus epidermidis
IKLLFSRPRFKAIFDYIVGFVLIGLSI

SEQ ID NO: 1737069 - protein, 21 aa, Staphylococcus epidermidis
IKLWLTIILIVATVLILLSVS

SEQ ID NO: 1737070 - protein, 37 aa, Staphylococcus epidermidis
IKMLFHPFKPYYIFRFRIPFTPGLIPKRREEIARKIG

SEQ ID NO: 1737071 - protein, 18 aa, Staphylococcus epidermidis
IKPLMLMFIVSSFIGALI

SEQ ID NO: 1737072 - protein, 23 aa, Staphylococcus epidermidis
IKRPASWLKKGINLFLLAVFPAN

SEQ ID NO: 1737073 - protein, 26 aa, Staphylococcus epidermidis
IKYTEMKWLTPDGHYIHGKGIRPDVS

SEQ ID NO: 1737074 - protein, 23 aa, Staphylococcus epidermidis
ILALIICFLFGFGTFGTTPLLNS

SEQ ID NO: 1737075 - protein, 18 aa, Staphylococcus epidermidis
ILFFGVAWLFSRKPSKIL

SEQ ID NO: 1737076 - protein, 19 aa, Staphylococcus epidermidis
ILFFIIAMMMFARRDRIET

SEQ ID NO: 1737077 - protein, 17 aa, Staphylococcus epidermidis
ILFFINIILALYYIYPI

SEQ ID NO: 1737078 - protein, 19 aa, Staphylococcus epidermidis
ILFTYKWAYQTTHIIEQNL

SEQ ID NO: 1737079 - protein, 23 aa, Staphylococcus epidermidis
ILGSMLLRMGGFKSSIARGLTYG

SEQ ID NO: 1737080 - protein, 23 aa, Staphylococcus epidermidis
ILHEFIHRILFIIFSKGEKPSLK

SEQ ID NO: 1737081 - protein, 18 aa, Staphylococcus epidermidis
ILLAWIVAAVLRISLGSA

SEQ ID NO: 1737082 - protein, 22 aa, Staphylococcus epidermidis
ILLCAGNLMGIVGVIIGIPLYA

SEQ ID NO: 1737083 - protein, 18 aa, Staphylococcus epidermidis
ILLKGGLILMLFAFLLAL

SEQ ID NO: 1737084 - protein, 17 aa, Staphylococcus epidermidis
ILLSGCSNIEVFNAKGP

SEQ ID NO: 1737085 - protein, 17 aa, Staphylococcus epidermidis
ILMAIVFLFGANSFKPD

SEQ ID NO: 1737086 - protein, 17 aa, Staphylococcus epidermidis
ILPGMIPWFMILFSHLR

SEQ ID NO: 1737087 - protein, 26 aa, Staphylococcus epidermidis
ILPIYWRLIDEIGAFEILAFRIIFSV

SEQ ID NO: 1737088 - protein, 26 aa, Staphylococcus epidermidis
IMMISVVLAFAFKWLGLVNDVLLMVI

SEQ ID NO: 1737089 - protein, 25 aa, Staphylococcus epidermidis
INISLCLIGTLLIAIAVNSFVIPGN

SEQ ID NO: 1737090 - protein, 24 aa, Staphylococcus epidermidis
INLKFHSRFALEILTTIANHYNRN

SEQ ID NO: 1737091 - protein, 24 aa, Staphylococcus epidermidis
IPALNERAKLILALDSYMPNIERI

SEQ ID NO: 1737092 - protein, 17 aa, Staphylococcus epidermidis
IPFLLIFIVDGFKGIKE

SEQ ID NO: 1737093 - protein, 17 aa, Staphylococcus epidermidis
IPLSIFFGGVKMMMPNM

SEQ ID NO: 1737094 - protein, 17 aa, Staphylococcus epidermidis
IPLYAVGVFIPFTLAQF

SEQ ID NO: 1737095 - protein, 19 aa, Staphylococcus epidermidis
IPMSILIALIALKLSNVSL

SEQ ID NO: 1737096 - protein, 23 aa, Staphylococcus epidermidis
IPTFARKRLFGHQSMIWATAGIA

SEQ ID NO: 1737097 - protein, 23 aa, Staphylococcus epidermidis
IPTKRIAQQIPLIIVAIESILSL

SEQ ID NO: 1737098 - protein, 37 aa, Staphylococcus epidermidis
IQGRNTDGGLEWSPDHKSLIYKYDATLGRQINTNDVL

SEQ ID NO: 1737099 - protein, 19 aa, Staphylococcus epidermidis
IQLSIAFVVNCLLLTLGAA

SEQ ID NO: 1737100 - protein, 17 aa, Staphylococcus epidermidis
IQSLISVYDDILKETSK

SEQ ID NO: 1737101 - protein, 17 aa, Staphylococcus epidermidis
IRHKIKPFKIFDKPKYA

SEQ ID NO: 1737102 - protein, 25 aa, Staphylococcus epidermidis
IRVFPEIVMALIFIKAVGPGSFSGV

SEQ ID NO: 1737103 - protein, 18 aa, Staphylococcus epidermidis
ISAFIGAGVLTFIHGDYI

SEQ ID NO: 1737104 - protein, 17 aa, Staphylococcus epidermidis
ISFGTGSAFAFPGSMIG

SEQ ID NO: 1737105 - protein, 21 aa, Staphylococcus epidermidis
ISFLLCVMGILTFGIFPNLMP

SEQ ID NO: 1737106 - protein, 17 aa, Staphylococcus epidermidis
ISFTFAIIIVIFIQSFI

SEQ ID NO: 1737107 - protein, 20 aa, Staphylococcus epidermidis
ISGIRLSSVYVISWATLASY

SEQ ID NO: 1737108 - protein, 17 aa, Staphylococcus epidermidis
ISIFKLNLGIDFSSGTR

SEQ ID NO: 1737109 - protein, 26 aa, Staphylococcus epidermidis
ISLILAIAFFFGLKAYQGHKNLELID

SEQ ID NO: 1737110 - protein, 25 aa, Staphylococcus epidermidis
ISNIPAHSTLTWNEEPNSWKNNIGT

SEQ ID NO: 1737111 - protein, 22 aa, Staphylococcus epidermidis
ISPYLPFTYSIDALRETVGGIV

SEQ ID NO: 1737112 - protein, 26 aa, Staphylococcus epidermidis
ISTMMAAICGFLFLAADPVKDGGFSS

SEQ ID NO: 1737113 - protein, 19 aa, Staphylococcus epidermidis
ISTPYALLFFDLIVVLISL

SEQ ID NO: 1737114 - protein, 18 aa, Staphylococcus epidermidis
ISTVPSMLISSISALVIG

SEQ ID NO: 1737115 - protein, 19 aa, Staphylococcus epidermidis
ISVIGHAFVPSGDLATIII

SEQ ID NO: 1737116 - protein, 49 aa, Staphylococcus epidermidis
ITDLKRVAKTPGVWVILAGLAILPSFYAWFNLWAMWDPYGHTGHIKVAV

SEQ ID NO: 1737117 - protein, 26 aa, Staphylococcus epidermidis
ITGAGCLLGGVLASFLFRNTQPSIDL

SEQ ID NO: 1737118 - protein, 20 aa, Staphylococcus epidermidis
ITIILCYLGFQFGLKKRDEM

SEQ ID NO: 1737119 - protein, 29 aa, Staphylococcus epidermidis
ITIIVLVVIGVLGFWFWHNTTSYVTTDNA

SEQ ID NO: 1737120 - protein, 17 aa, Staphylococcus epidermidis
ITIYPTVTAKNPVRDQK

SEQ ID NO: 1737121 - protein, 17 aa, Staphylococcus epidermidis
ITTFLSMAYILAVNPQI

SEQ ID NO: 1737122 - protein, 21 aa, Staphylococcus epidermidis
IVAACVTFLFGSLRVNSLGVN

SEQ ID NO: 1737123 - protein, 19 aa, Staphylococcus epidermidis
IVAVLNHKAGVEWESLDES

SEQ ID NO: 1737124 - protein, 18 aa, Staphylococcus epidermidis
IVFVVTGFIFFSMISDQI

SEQ ID NO: 1737125 - protein, 21 aa, Staphylococcus epidermidis
IVGGIIGWIAGLILGKDVPGG

SEQ ID NO: 1737126 - protein, 26 aa, Staphylococcus epidermidis
IVGIISGLCRLYIGGADAYTYLISSI

SEQ ID NO: 1737127 - protein, 20 aa, Staphylococcus epidermidis
IVIVSGVIPFNLIKGIIISI

SEQ ID NO: 1737128 - protein, 18 aa, Staphylococcus epidermidis
IVKPEFSSSVIPSIAGLL

SEQ ID NO: 1737129 - protein, 25 aa, Staphylococcus epidermidis
IVLGGPGAVFWMWIIAFIGAASAFM

SEQ ID NO: 1737130 - protein, 20 aa, Staphylococcus epidermidis
IVNIWIFKFFVDVLNMNSFS

SEQ ID NO: 1737131 - protein, 17 aa, Staphylococcus epidermidis
IVVGGLLIAIALTLGGH

SEQ ID NO: 1737132 - protein, 17 aa, Staphylococcus epidermidis
IVVGISLILVAIVSIFL

SEQ ID NO: 1737133 - protein, 20 aa, Staphylococcus epidermidis
IVVLIIAAFILKQVNGSGSK

SEQ ID NO: 1737134 - protein, 18 aa, Staphylococcus epidermidis
IWFVVPILIVIALAIPTV

SEQ ID NO: 1737135 - protein, 23 aa, Staphylococcus epidermidis
IYAIRPSLLYVFVALIISVVIGA

SEQ ID NO: 1737136 - protein, 18 aa, Staphylococcus epidermidis
KAFIPLFILGMLFWSIQE

SEQ ID NO: 1737137 - protein, 19 aa, Staphylococcus epidermidis
KALMLPVAILPAAGLLLAI

SEQ ID NO: 1737138 - protein, 37 aa, Staphylococcus epidermidis; identical to SEQ ID NO: 1573116

SEQ ID NO: 1737139 - protein, 24 aa, Staphylococcus epidermidis
KDKPKPAQWAFLSLQHLFAMFGST

SEQ ID NO: 1737140 - protein, 21 aa, Staphylococcus epidermidis
KDNVLANEKILFGAEKLSYDK

SEQ ID NO: 1737141 - protein, 23 aa, Staphylococcus epidermidis
KDQRKTYYFMMVFSPIFITYASL

SEQ ID NO: 1737142 - protein, 23 aa, Staphylococcus epidermidis
KDVELPLALPLILSGIRLSSVYV

SEQ ID NO: 1737143 - protein, 23 aa, Staphylococcus epidermidis
KDVEMPLALPLIISGIRLSSVYV

SEQ ID NO: 1737144 - protein, 21 aa, Staphylococcus epidermidis
KDVTSFVIPIGYSFNLDGSAL

SEQ ID NO: 1737145 - protein, 22 aa, Staphylococcus epidermidis
KDYGSGKERVWVYNIPVKVDKQ

SEQ ID NO: 1737146 - protein, 19 aa, Staphylococcus epidermidis
KEELFKYTIIVVSTVIFFL

SEQ ID NO: 1737147 - protein, 18 aa, Staphylococcus epidermidis
KEGLHIIKDLVIATIRAT

SEQ ID NO: 1737148 - protein, 20 aa, Staphylococcus epidermidis
KEGSNLWFDNMVIPKTAQNK

SEQ ID NO: 1737149 - protein, 17 aa, Staphylococcus epidermidis
KEIIAYSIPFVIVSLNF

SEQ ID NO: 1737150 - protein, 19 aa, Staphylococcus epidermidis
KESYLGFTVIFLIFGFAIL

SEQ ID NO: 1737151 - protein, 23 aa, Staphylococcus epidermidis
KEVVARGAYPCMISMEGLNKEGD

SEQ ID NO: 1737152 - protein, 28 aa, Staphylococcus epidermidis
KFILPATILFSWISLFIAQWVVENLFEA

SEQ ID NO: 1737153 - protein, 26 aa, Staphylococcus epidermidis
KFKVNFKIVLPGAIITIIILFFLTNG

SEQ ID NO: 1737154 - protein, 25 aa, Staphylococcus epidermidis
KFPSKYKLEVGIGRDISGDPISIQL

SEQ ID NO: 1737155 - protein, 24 aa, Staphylococcus epidermidis
KFYKFRFILIMFIIFLMAIMVLFI

SEQ ID NO: 1737156 - protein, 27 aa, Staphylococcus epidermidis
KGIFCNFFINIGIFISMQFKEGLAKAF

SEQ ID NO: 1737157 - protein, 25 aa, Staphylococcus epidermidis
KGITRGKILAAMLFGMFIAILNQTL

SEQ ID NO: 1737158 - protein, 24 aa, Staphylococcus epidermidis
KGKKFTFIISPQWFTNHGLTNQNF

SEQ ID NO: 1737159 - protein, 18 aa, Staphylococcus epidermidis
KGNKDIYTFLNFSSIYRW

SEQ ID NO: 1737160 - protein, 26 aa, Staphylococcus epidermidis
KHHGLLYFIRFLFGVGEAPMYPSNAV

SEQ ID NO: 1737161 - protein, 18 aa, Staphylococcus epidermidis
KHLLPKVLPSIFVIMIVD

SEQ ID NO: 1737162 - protein, 20 aa, Staphylococcus epidermidis
KHNGIMPKALLRAMLQDITN

SEQ ID NO: 1737163 - protein, 17 aa, Staphylococcus epidermidis
KIEFNRQFTEIFGENEA

SEQ ID NO: 1737164 - protein, 17 aa, Staphylococcus epidermidis
KIFCFSTITSMIIMLSM

SEQ ID NO: 1737165 - protein, 20 aa, Staphylococcus epidermidis
KIHLESFQTFLINKKVNGKE

SEQ ID NO: 1737166 - protein, 26 aa, Staphylococcus epidermidis
KIKNRGELRVGLSADYAPLEFEKTIH

SEQ ID NO: 1737167 - protein, 19 aa, Staphylococcus epidermidis
KISKFKGLAILSSDALSSV

SEQ ID NO: 1737168 - protein, 22 aa, Staphylococcus epidermidis
KIVHLLFFLPYYKSFKIHKLSS

SEQ ID NO: 1737169 - protein, 17 aa, Staphylococcus epidermidis
KIVKEVFLIIDVKALLF

SEQ ID NO: 1737170 - protein, 19 aa, Staphylococcus epidermidis
KKDFIANVSHELRTPISLL

SEQ ID NO: 1737171 - protein, 24 aa, Staphylococcus epidermidis
KKEFKKYENYVADSVVKQHKESNH

SEQ ID NO: 1737172 - protein, 22 aa, Staphylococcus epidermidis
KKETFKIIVSLVMALTVVSLIF

SEQ ID NO: 1737173 - protein, 20 aa, Staphylococcus epidermidis
KKGQMPKVFTKVMKNGVPFY

SEQ ID NO: 1737174 - protein, 20 aa, Staphylococcus epidermidis
KKILSFKLFIYIGKRSYSLY

SEQ ID NO: 1737175 - protein, 23 aa, Staphylococcus epidermidis
KKIYRLGLKQAKISAVVQPISGV

SEQ ID NO: 1737176 - protein, 26 aa, Staphylococcus epidermidis
KKKRFNFRMPGAFMILFILTVVAVIA

SEQ ID NO: 1737177 - protein, 18 aa, Staphylococcus epidermidis
KKVPEGLDLIVVILLAPA

SEQ ID NO: 1737178 - protein, 19 aa, Staphylococcus epidermidis
KKYGAWAVFLCRFVPVLRV

SEQ ID NO: 1737179 - protein, 23 aa, Staphylococcus epidermidis
KLIPVFYIRRWFDTKTTIASAFL

SEQ ID NO: 1737180 - protein, 24 aa, Staphylococcus epidermidis
KLKHPLLNMRVFKNKVFTLSAVSS

SEQ ID NO: 1737181 - protein, 30 aa, Staphylococcus epidermidis
KLKYKAKLFPFGPIFAGILCVIVIIGQDVD

SEQ ID NO: 1737182 - protein, 21 aa, Staphylococcus epidermidis
KLLPKARRLGISWMAVGLLGA

SEQ ID NO: 1737183 - protein, 20 aa, Staphylococcus epidermidis
KLQEVLKKAIAKIDKGQTND

SEQ ID NO: 1737184 - protein, 17 aa, Staphylococcus epidermidis
KLYRFVDRHGKWMKLKS

SEQ ID NO: 1737185 - protein, 20 aa, Staphylococcus epidermidis
KMFIPGVCLFLVGLLSLIGH

SEQ ID NO: 1737186 - protein, 28 aa, Staphylococcus epidermidis
KMKMRVVRRRIALFGGILLAIILILLVL

SEQ ID NO: 1737187 - protein, 18 aa, Staphylococcus epidermidis
KNGVPFYTVFAVSMGILI

SEQ ID NO: 1737188 - protein, 21 aa, Staphylococcus epidermidis
KNLPHLFSFCTQRLKQTWKWF

SEQ ID NO: 1737189 - protein, 17 aa, Staphylococcus epidermidis
KNRLNDIAKDWASLSYM

SEQ ID NO: 1737190 - protein, 18 aa, Staphylococcus epidermidis
KPEFKLPLYPILPAITFI

SEQ ID NO: 1737191 - protein, 19 aa, Staphylococcus epidermidis
KPHYLPGLDGLRAIAVIGI

SEQ ID NO: 1737192 - protein, 24 aa, Staphylococcus epidermidis
KPIRFSNEYLKKFIFNHKKKSTSH

SEQ ID NO: 1737193 - protein, 23 aa, Staphylococcus epidermidis
KPLDLLPIISFLKLRGQSRCCNQ

SEQ ID NO: 1737194 - protein, 20 aa, Staphylococcus epidermidis
KPLYSKRIYQNLTFDSIVFR

SEQ ID NO: 1737195 - protein, 23 aa, Staphylococcus epidermidis
KQAKDMKVSILVNEGSASASEVF

SEQ ID NO: 1737196 - protein, 18 aa, Staphylococcus epidermidis
KQDGFFFNTFVQPMKHLL

SEQ ID NO: 1737197 - protein, 28 aa, Staphylococcus epidermidis
KQIKDKRLPQVINEAVSIFKNLTNGTYN

SEQ ID NO: 1737198 - protein, 24 aa, Staphylococcus epidermidis
KQQSDVVLVSAHWGNEGKHQPNAT

SEQ ID NO: 1737199 - protein, 39 aa, Staphylococcus epidermidis
KRGTYSAVHALGFNLAELLARFGIILGVFLTSMEMGIYM

SEQ ID NO: 1737200 - protein, 20 aa, Staphylococcus epidermidis
KRLPATVIGALFAVVFTYVF

SEQ ID NO: 1737201 - protein, 21 aa, Staphylococcus epidermidis
KSPWLGRILIVGCIFAIFQQF

SEQ ID NO: 1737202 - protein, 19 aa, Staphylococcus epidermidis
KSRRERLGMTLSELEQRTQ

SEQ ID NO: 1737203 - protein, 24 aa, Staphylococcus epidermidis
KSVIDKRLKYIILHEYAHAKNRDT

SEQ ID NO: 1737204 - protein, 26 aa, Staphylococcus epidermidis
KTYGYKRFEILAALFNGVTLFIISII

SEQ ID NO: 1737205 - protein, 28 aa, Staphylococcus epidermidis
KVIRNRLKRLGIRKGVKVVFSDESPIVI

SEQ ID NO: 1737206 - protein, 24 aa, Staphylococcus epidermidis
KVLYRLTFVGSIFLAAIAILPIIA

SEQ ID NO: 1737207 - protein, 17 aa, Staphylococcus epidermidis
KVPLAFIQIFLGMILYL

SEQ ID NO: 1737208 - protein, 19 aa, Staphylococcus epidermidis
KWIPISIIILITFFIGYTI

SEQ ID NO: 1737209 - protein, 18 aa, Staphylococcus epidermidis
KWVWAIAFTNIFVYFVRY

SEQ ID NO: 1737210 - protein, 19 aa, Staphylococcus epidermidis
KYLRELSEHYQILYFTCTK

SEQ ID NO: 1737211 - protein, 19 aa, Staphylococcus epidermidis
KYLSKRSTYLTIFATVLIS

SEQ ID NO: 1737212 - protein, 22 aa, Staphylococcus epidermidis
LAAQMTYHFVLALFPMLIFLLT

SEQ ID NO: 1737213 - protein, 17 aa, Staphylococcus epidermidis
LAEISHRLPFYVAGTLG

SEQ ID NO: 1737214 - protein, 24 aa, Staphylococcus epidermidis
LAELKRLDAGYHFTDINNQTPYRG

SEQ ID NO: 1737215 - protein, 17 aa, Staphylococcus epidermidis
LAFRIIFSVIFMIFVLI

SEQ ID NO: 1737216 - protein, 18 aa, Staphylococcus epidermidis
LAGGIAFLTFSFVQKYIQ

SEQ ID NO: 1737217 - protein, 23 aa, Staphylococcus epidermidis
LAGIKWQQIIFILPFLLLAIFVT

SEQ ID NO: 1737218 - protein, 30 aa, Staphylococcus epidermidis
LAGSRLLYSFGRDGLLPSWLSQLNHKHLPN

SEQ ID NO: 1737219 - protein, 26 aa, Staphylococcus epidermidis
LALLYSRPLFYFGNFMKPLIWLMNGS

SEQ ID NO: 1737220 - protein, 19 aa, Staphylococcus epidermidis
LAPRIAHAILPIHGKGKSN

SEQ ID NO: 1737221 - protein, 24 aa, Staphylococcus epidermidis
LATGVSILACIFANVGLTKIIMYS

SEQ ID NO: 1737222 - protein, 24 aa, Staphylococcus epidermidis
LATIEKWLRKVIPTVLDNLLTPLL

SEQ ID NO: 1737223 - protein, 24 aa, Staphylococcus epidermidis
LAVIPVIICLIVFKGNTEKIEQLL

SEQ ID NO: 1737224 - protein, 19 aa, Staphylococcus epidermidis
LCYMFVSLFIVITITFFLM

SEQ ID NO: 1737225 - protein, 22 aa, Staphylococcus epidermidis
LDGLRAIAVIGIIIYHLNTKWL

SEQ ID NO: 1737226 - protein, 20 aa, Staphylococcus epidermidis
LDGLSFLTLYLLNVHLGYTF

SEQ ID NO: 1737227 - protein, 24 aa, Staphylococcus epidermidis
LDLSFIIDMLISFGSFIASYFPTQ

SEQ ID NO: 1737228 - protein, 20 aa, Staphylococcus epidermidis
LDNKGGLLSDLFDDDGNISL

SEQ ID NO: 1737229 - protein, 23 aa, Staphylococcus epidermidis
LDQAHSLFTWIFTLFFIALSFFL

SEQ ID NO: 1737230 - protein, 23 aa, Staphylococcus epidermidis
LEDGKQKLQRIVLSTQTKTQAKA

SEQ ID NO: 1737231 - protein, 17 aa, Staphylococcus epidermidis
LEENRFKMVPSHKRGTY

SEQ ID NO: 1737232 - protein, 22 aa, Staphylococcus epidermidis
LEMIGNSILNHFVPMIITIILC

SEQ ID NO: 1737233 - protein, 17 aa, Staphylococcus epidermidis
LENEVALENSVKKLSDF

SEQ ID NO: 1737234 - protein, 25 aa, Staphylococcus epidermidis
LEQARYPNRFNIHYRIDDQCQDALI

SEQ ID NO: 1737235 - protein, 24 aa, Staphylococcus epidermidis
LESGHFFWPAILAFALTGIGLPLL

SEQ ID NO: 1737236 - protein, 23 aa, Staphylococcus epidermidis
LFGIGFMVVGYCLKPVTDPIIRK

SEQ ID NO: 1737237 - protein, 22 aa, Staphylococcus epidermidis
LFGLNELNSIFINITQKPTARK

SEQ ID NO: 1737238 - protein, 18 aa, Staphylococcus epidermidis
LFGWKTHFGEAIFQTINP

SEQ ID NO: 1737239 - protein, 17 aa, Staphylococcus epidermidis
LFIFVFILVNIFLVIVY

SEQ ID NO: 1737240 - protein, 25 aa, Staphylococcus epidermidis
LFKGRRGPAGFFFMLGVTIFILIYW

SEQ ID NO: 1737241 - protein, 18 aa, Staphylococcus epidermidis
LFLGIMIFLAGCDYSTPE

SEQ ID NO: 1737242 - protein, 19 aa, Staphylococcus epidermidis
LFMEVHEVFAPIATIIGSV

SEQ ID NO: 1737243 - protein, 25 aa, Staphylococcus epidermidis
LFSMGRSGIMPTVFSKLHSKHKTPY

SEQ ID NO: 1737244 - protein, 25 aa, Staphylococcus epidermidis
LFSSDRKNIRWRYVGLLLVIQLIFA

SEQ ID NO: 1737245 - protein, 24 aa, Staphylococcus epidermidis
LFWELTSFSSFLLISFWREKKASI

SEQ ID NO: 1737246 - protein, 17 aa, Staphylococcus epidermidis
LGALMMFILIVFTIELI

SEQ ID NO: 1737247 - protein, 30 aa, Staphylococcus epidermidis
LGDYGIPVSTLRAGLIIGAKGSSYPILKRL

SEQ ID NO: 1737248 - protein, 24 aa, Staphylococcus epidermidis
LGNQYGGKLSLIFDDGIEAEVERI

SEQ ID NO: 1737249 - protein, 24 aa, Staphylococcus epidermidis
LGSIFDVFFSLTWIIISISLILNL

SEQ ID NO: 1737250 - protein, 18 aa, Staphylococcus epidermidis
LGTTSVIVFLLLVATGLP

SEQ ID NO: 1737251 - protein, 18 aa, Staphylococcus epidermidis
LGVPEGIANFSATFGLSI

SEQ ID NO: 1737252 - protein, 23 aa, Staphylococcus epidermidis
LGYFLKRMNYLKATDSQVLSTLV

SEQ ID NO: 1737253 - protein, 22 aa, Staphylococcus epidermidis
LHEHGWSGINFNSPFADMAILL

SEQ ID NO: 1737254 - protein, 21 aa, Staphylococcus epidermidis
LIAAFIVGIALFFEVGLVLLI

SEQ ID NO: 1737255 - protein, 18 aa, Staphylococcus epidermidis
LIALVIGFGLCFPYVLLP

SEQ ID NO: 1737256 - protein, 42 aa, Staphylococcus epidermidis
LIALVLSVFLFFKGKKAFWFIFIGGFLLTFLLYANVVYFRFF

SEQ ID NO: 1737257 - protein, 17 aa, Staphylococcus epidermidis
LIFWYPKMMGYKLNETL

SEQ ID NO: 1737258 - protein, 24 aa, Staphylococcus epidermidis
LIIGKLFFKKDIRQYGSGNTGATN

SEQ ID NO: 1737259 - protein, 19 aa, Staphylococcus epidermidis
LIITFPILRKFKVATPIFK

SEQ ID NO: 1737260 - protein, 24 aa, Staphylococcus epidermidis
LIIVGLFIICMFVSISMGTSVGTV

SEQ ID NO: 1737261 - protein, 24 aa, Staphylococcus epidermidis
LINARRRLDEEISKENKTPSSIRN

SEQ ID NO: 1737262 - protein, 18 aa, Staphylococcus epidermidis
LIPLFKLLVVVVFAMVFF

SEQ ID NO: 1737263 - protein, 27 aa, Staphylococcus epidermidis
LIRKFYWRYQIGLQMLLNIIIGAVVMI

SEQ ID NO: 1737264 - protein, 20 aa, Staphylococcus epidermidis
LKAKILHIPGDELINHNNQI

SEQ ID NO: 1737265 - protein, 17 aa, Staphylococcus epidermidis
LKEISYIQAEGFAGGEL

SEQ ID NO: 1737266 - protein, 17 aa, Staphylococcus epidermidis
LKEIYSNSVGAQFGQDA

SEQ ID NO: 1737267 - protein, 18 aa, Staphylococcus epidermidis
LKGILAYSTISQLGMIMT

SEQ ID NO: 1737268 - protein, 17 aa, Staphylococcus epidermidis
LKGLIAMSFIVLSYTVL

SEQ ID NO: 1737269 - protein, 19 aa, Staphylococcus epidermidis
LKHLWSLAIEEQFYLFFPF

SEQ ID NO: 1737270 - protein, 25 aa, Staphylococcus epidermidis
LKIKGTALSAGFGYTGLVGPINALN

SEQ ID NO: 1737271 - protein, 18 aa, Staphylococcus epidermidis
LKPGFTLEFNDRPDGYKA

SEQ ID NO: 1737272 - protein, 18 aa, Staphylococcus epidermidis
LKRGIEAIYSIVMAIVTF

SEQ ID NO: 1737273 - protein, 20 aa, Staphylococcus epidermidis
LKTEVRKLSRRGDTNNKKPS

SEQ ID NO: 1737274 - protein, 22 aa, Staphylococcus epidermidis
LKVREIKGLITTKIIQAQEKRI

SEQ ID NO: 1737275 - protein, 17 aa, Staphylococcus epidermidis
LLASLLVSITLVPSLGA

SEQ ID NO: 1737276 - protein, 24 aa, Staphylococcus epidermidis
LLGILLFAYYAWKAPAFSESKLDD

SEQ ID NO: 1737277 - protein, 28 aa, Staphylococcus epidermidis
LLHYIFEINEKWLLVLCVLVIIINASWN

SEQ ID NO: 1737278 - protein, 20 aa, Staphylococcus epidermidis
LLIIPTWINLLLKTYAFIGL

SEQ ID NO: 1737279 - protein, 17 aa, Staphylococcus epidermidis
LLIVFTLIFGIIAFFHE

SEQ ID NO: 1737280 - protein, 17 aa, Staphylococcus epidermidis
LLIVILMFLNGLGIYIG

SEQ ID NO: 1737281 - protein, 21 aa, Staphylococcus epidermidis
LLIVWYVLYLLITVFKGTKAI

SEQ ID NO: 1737282 - protein, 25 aa, Staphylococcus epidermidis
LLKFFKKRTTMIILLIISLLSLTAM

SEQ ID NO: 1737283 - protein, 25 aa, Staphylococcus epidermidis
LLLACGFVGAVAWTIYQMTVGMDLG

SEQ ID NO: 1737284 - protein, 18 aa, Staphylococcus epidermidis
LLLGIALFFFIIFIHNFD

SEQ ID NO: 1737285 - protein, 17 aa, Staphylococcus epidermidis
LLLHLRPIGLKDKSLGE

SEQ ID NO: 1737286 - protein, 27 aa, Staphylococcus epidermidis
LLLICGCIPKLGALANIIPLPVLGGAM

SEQ ID NO: 1737287 - protein, 18 aa, Staphylococcus epidermidis
LLLISTITIISFIGLGAI

SEQ ID NO: 1737288 - protein, 18 aa, Staphylococcus epidermidis
LLPLIFALIIPFLYRFVK

SEQ ID NO: 1737289 - protein, 18 aa, Staphylococcus epidermidis
LLTSIGMGIITSVALIII

SEQ ID NO: 1737290 - protein, 18 aa, Staphylococcus epidermidis
LLVLFILMMNLRGLTESA

SEQ ID NO: 1737291 - protein, 17 aa, Staphylococcus epidermidis
LLVSFIIMFVGIQVIIE

SEQ ID NO: 1737292 - protein, 40 aa, Staphylococcus epidermidis
LLYVALRISLIKVLKPYYPFPVIVDDAFVHFDKYRKERML

SEQ ID NO: 1737293 - protein, 27 aa, Staphylococcus epidermidis
LMATNLGWRSIFIVSIILTILSMFLIK

SEQ ID NO: 1737294 - protein, 21 aa, Staphylococcus epidermidis
LMGLKHLPIIATIALITLFNI

SEQ ID NO: 1737295 - protein, 17 aa, Staphylococcus epidermidis
LMLSGFFLGIGGAIFSV

SEQ ID NO: 1737296 - protein, 27 aa, Staphylococcus epidermidis
LMSDLKGRIAIAIAFQNIMLIVTTFIM

SEQ ID NO: 1737297 - protein, 19 aa, Staphylococcus epidermidis
LNDAMKAMRDSIMNQEQIR

SEQ ID NO: 1737298 - protein, 35 aa, Staphylococcus epidermidis; identical to SEQ ID NO: 1573151

SEQ ID NO: 1737299 - protein, 23 aa, Staphylococcus epidermidis
LNGKELLGYARFRHDPEGDFGRV

SEQ ID NO: 1737300 - protein, 19 aa, Staphylococcus epidermidis
LNHKWIVLIVSIFILVGSV

SEQ ID NO: 1737301 - protein, 22 aa, Staphylococcus epidermidis
LNIDRIDWILIIVAIGLVLSFE

SEQ ID NO: 1737302 - protein, 20 aa, Staphylococcus epidermidis
LNIIGSMVIVVWGSSIWSQI

SEQ ID NO: 1737303 - protein, 18 aa, Staphylococcus epidermidis
LNISSFWLLFSGAITAIP

SEQ ID NO: 1737304 - protein, 19 aa, Staphylococcus epidermidis
LNKSRIRIERELKNNITNK

SEQ ID NO: 1737305 - protein, 18 aa, Staphylococcus epidermidis
LNKVCHVQGITALNVNDL

SEQ ID NO: 1737306 - protein, 29 aa, Staphylococcus epidermidis
LNLIKMIIIPIVFCSLALSISNLGDSKKV

SEQ ID NO: 1737307 - protein, 18 aa, Staphylococcus epidermidis
LNPFWTIVLSLIFLHEKV

SEQ ID NO: 1737308 - protein, 19 aa, Staphylococcus epidermidis
LPFDVLKAMGGKENIKHLD

SEQ ID NO: 1737309 - protein, 26 aa, Staphylococcus epidermidis
LPIIIMRTSWWFIFFIFLGGLSYTIG

SEQ ID NO: 1737310 - protein, 19 aa, Staphylococcus epidermidis
LPLLLVMVVHISPISIPSI

SEQ ID NO: 1737311 - protein, 35 aa, Staphylococcus epidermidis
LQMLNMRYSHWLRFVWPVVAFVLIFGGGLLITQVL

SEQ ID NO: 1737312 - protein, 19 aa, Staphylococcus epidermidis
LQSMTVRLGIATGMDLAQM

SEQ ID NO: 1737313 - protein, 17 aa, Staphylococcus epidermidis
LQYYFCVAMVLVVALMF

SEQ ID NO: 1737314 - protein, 27 aa, Staphylococcus epidermidis
LRKRLKLGETFFGYLIWYSVGRFFVEA

SEQ ID NO: 1737315 - protein, 21 aa, Staphylococcus epidermidis
LRLDGLSLMFGLIISLIGVGV

SEQ ID NO: 1737316 - protein, 24 aa, Staphylococcus epidermidis
LRQSFNIPALKTWQQVKSQAGNDA

SEQ ID NO: 1737317 - protein, 20 aa, Staphylococcus epidermidis
LRYWPFNRWGGSFNPGTFPN

SEQ ID NO: 1737318 - protein, 18 aa, Staphylococcus epidermidis
LSEFFGHIVWMMVIEMVR

SEQ ID NO: 1737319 - protein, 20 aa, Staphylococcus epidermidis
LSEIPKIWHGGIAIHGGLIG

SEQ ID NO: 1737320 - protein, 20 aa, Staphylococcus epidermidis
LSGIRLSSVYVISWATLASY

SEQ ID NO: 1737321 - protein, 23 aa, Staphylococcus epidermidis
LSKDRTTLIVAHRLSTITHADRI

SEQ ID NO: 1737322 - protein, 20 aa, Staphylococcus epidermidis
LSLKCFKYTNNGTYPLQLSD

SEQ ID NO: 1737323 - protein, 17 aa, Staphylococcus epidermidis
LSPILGWIGVFMTGSVV

SEQ ID NO: 1737324 - protein, 20 aa, Staphylococcus epidermidis
LTKKRIFKMSPIHHHFELSG

SEQ ID NO: 1737325 - protein, 30 aa, Staphylococcus epidermidis
LTLLNHWTFWILSCGFVILVAPVTGIATLG

SEQ ID NO: 1737326 - protein, 20 aa, Staphylococcus epidermidis
LTLMIPLLIVVTFMTFMMTY

SEQ ID NO: 1737327 - protein, 25 aa, Staphylococcus epidermidis
LTLMRRGIENINMFTFIQLLTPFVT

SEQ ID NO: 1737328 - protein, 18 aa, Staphylococcus epidermidis
LTSISSFLLISYWYNNGE

SEQ ID NO: 1737329 - protein, 25 aa, Staphylococcus epidermidis
LTVIGSYFFFRSTVSLIFKAIQRLR

SEQ ID NO: 1737330 - protein, 19 aa, Staphylococcus epidermidis
LVALMYWVVCFVISIIQGW

SEQ ID NO: 1737331 - protein, 22 aa, Staphylococcus epidermidis
LVDNASKMSITYTRNRKTSQKE

SEQ ID NO: 1737332 - protein, 26 aa, Staphylococcus epidermidis
LVGIFFKRIEFVGVGLLFCQKTIDAM

SEQ ID NO: 1737333 - protein, 29 aa, Staphylococcus epidermidis
LVGIPLGIIIARFGKLSGVIITIANIIQT

SEQ ID NO: 1737334 - protein, 20 aa, Staphylococcus epidermidis
LVHLTFVPLLFLGRYTNMIY

SEQ ID NO: 1737335 - protein, 20 aa, Staphylococcus epidermidis
LVIACPCALGLATPTSIMVG

SEQ ID NO: 1737336 - protein, 23 aa, Staphylococcus epidermidis
LVISVVLYFSFVTLKYAHHLHGN

SEQ ID NO: 1737337 - protein, 21 aa, Staphylococcus epidermidis
LVNFCRLIPILLLSVWAGSIA

SEQ ID NO: 1737338 - protein, 23 aa, Staphylococcus epidermidis
LVQNIVKYIVWFVVITTILSKFG

SEQ ID NO: 1737339 - protein, 20 aa, Staphylococcus epidermidis
LVVPFMFMWLTKSKRNKAIG

SEQ ID NO: 1737340 - protein, 28 aa, Staphylococcus epidermidis
LVVYAVSAGYKWFFAYPDQHIETVNTLT

SEQ ID NO: 1737341 - protein, 18 aa, Staphylococcus epidermidis
LWLIPGLAICGFALFSSL

SEQ ID NO: 1737342 - protein, 17 aa, Staphylococcus epidermidis
LYIPIFFLMIYSFNSAG

SEQ ID NO: 1737343 - protein, 19 aa, Staphylococcus epidermidis
LYLQNLRGFSALDSGLLLL

SEQ ID NO: 1737344 - protein, 20 aa, Staphylococcus epidermidis
LYTWERFKNKWTHFFISIPV

SEQ ID NO: 1737345 - protein, 28 aa, Staphylococcus epidermidis
MATTSFILAFPMAIIWPTIQNGLNAFSE

SEQ ID NO: 1737346 - protein, 34 aa, Staphylococcus epidermidis
MFFAKRAGIMCPEFAIGMGPKIFSFRKDETLYTI

SEQ ID NO: 1737347 - protein, 19 aa, Staphylococcus epidermidis
MFINKIINRHEMAAKDTTF

SEQ ID NO: 1737348 - protein, 27 aa, Staphylococcus epidermidis
MIDKAEFMSVSGLERMGFNDEYLAGQQ

SEQ ID NO: 1737349 - protein, 21 aa, Staphylococcus epidermidis
MIGVILMRFAATWFVELLNKY

SEQ ID NO: 1737350 - protein, 27 aa, Staphylococcus epidermidis
MILFIFRCFVVLLVFVGAVAKTETVWS

SEQ ID NO: 1737351 - protein, 20 aa, Staphylococcus epidermidis
MKHLLQWLGNDVFHNNFGLA

SEQ ID NO: 1737352 - protein, 31 aa, Staphylococcus epidermidis
MKPLRRLTKVELPIAMPVIMAGIRTAMVLII

SEQ ID NO: 1737353 - protein, 17 aa, Staphylococcus epidermidis
MKYAHVMTPEMTDSLTA

SEQ ID NO: 1737354 - protein, 21 aa, Staphylococcus epidermidis
MLFIMDWKLTLLTFITIPVFI

SEQ ID NO: 1737355 - protein, 23 aa, Staphylococcus epidermidis
MLGCLPILIQMPIIMGLYFVLKD

SEQ ID NO: 1737356 - protein, 35 aa, Staphylococcus epidermidis
MLGVPFGSFLGGFANWRVVFGFMIVLAIITMLGMI

SEQ ID NO: 1737357 - protein, 26 aa, Staphylococcus epidermidis
MLILVYSMLIAFLFIDKVFVNIIFFQ

SEQ ID NO: 1737358 - protein, 18 aa, Staphylococcus epidermidis
MMKIEFYQNLLVNLLIIL

SEQ ID NO: 1737359 - protein, 17 aa, Staphylococcus epidermidis
MNGNVRFYGGKTDPMEK

SEQ ID NO: 1737360 - protein, 27 aa, Staphylococcus epidermidis
MNIWLDCITIIIALSIMFFLDVKLTFA

SEQ ID NO: 1737361 - protein, 19 aa, Staphylococcus epidermidis
MPLLSEKPLFIYISQSGET

SEQ ID NO: 1737362 - protein, 21 aa, Staphylococcus epidermidis
MPMLWANFFWVWGHPEVYIVI

SEQ ID NO: 1737363 - protein, 20 aa, Staphylococcus epidermidis
MQDQFFYFYLTVVISCLIAA

SEQ ID NO: 1737364 - protein, 17 aa, Staphylococcus epidermidis
MQPAHLFFMIAAPEGGA

SEQ ID NO: 1737365 - protein, 17 aa, Staphylococcus epidermidis
MRLCINLLIVLAVIIPA

SEQ ID NO: 1737366 - protein, 19 aa, Staphylococcus epidermidis
MRLYATLRGMFKVNQTSLI

SEQ ID NO: 1737367 - protein, 19 aa, Staphylococcus epidermidis
MRTGIIIGIIALILVIMQG

SEQ ID NO: 1737368 - protein, 24 aa, Staphylococcus epidermidis
MSCSARLPVYALFVGAFFSAHQSL

SEQ ID NO: 1737369 - protein, 27 aa, Staphylococcus epidermidis
MSKGLLLKIAFNFGLPLLIALLHALFA

SEQ ID NO: 1737370 - protein, 20 aa, Staphylococcus epidermidis
MTAFLLVLIYRTYRVTKEDE

SEQ ID NO: 1737371 - protein, 26 aa, Staphylococcus epidermidis
MVLKWLRERPERWGIKLTINLIGGTI

SEQ ID NO: 1737372 - protein, 22 aa, Staphylococcus epidermidis
NAFVPSVVGLICASYVVNDILK

SEQ ID NO: 1737373 - protein, 17 aa, Staphylococcus epidermidis
NAIELLRITQFPIDIYQ

SEQ ID NO: 1737374 - protein, 19 aa, Staphylococcus epidermidis
NAPHPFVRVKAVEPDEDAT

SEQ ID NO: 1737375 - protein, 24 aa, Staphylococcus epidermidis
NDAKDKRQAIETILQTRINKDKAK

SEQ ID NO: 1737376 - protein, 24 aa, Staphylococcus epidermidis
NDIGSIISEVPWLVIILVSVVAMI

SEQ ID NO: 1737377 - protein, 17 aa, Staphylococcus epidermidis
NDVVKNFTANGLLSLGA

SEQ ID NO: 1737378 - protein, 24 aa, Staphylococcus epidermidis
NELFKSGIFIPFAFVLIVIVGPIV

SEQ ID NO: 1737379 - protein, 18 aa, Staphylococcus epidermidis
NFLQRAFQHTRWNAYSFA

SEQ ID NO: 1737380 - protein, 18 aa, Staphylococcus epidermidis
NHQIIWVNLNYEFNSGRP

SEQ ID NO: 1737381 - protein, 18 aa, Staphylococcus epidermidis
NIDYKLWLIPGLAICGFA

SEQ ID NO: 1737382 - protein, 22 aa, Staphylococcus epidermidis
NIPEGLSIGVAFGGVVSGNSHA

SEQ ID NO: 1737383 - protein, 19 aa, Staphylococcus epidermidis
NKANTAWRDASGTEIKEAM

SEQ ID NO: 1737384 - protein, 23 aa, Staphylococcus epidermidis
NKDKAKIIADVIARVQKDKSDIM

SEQ ID NO: 1737385 - protein, 23 aa, Staphylococcus epidermidis
NKEVIKLSVSIGVGYLTQEDRKS

SEQ ID NO: 1737386 - protein, 24 aa, Staphylococcus epidermidis
NKFFKCYFDRHLLQSSSFVKTIIL

SEQ ID NO: 1737387 - protein, 22 aa, Staphylococcus epidermidis
NKKFSSVFIYSSIIAAIVVIIG

SEQ ID NO: 1737388 - protein, 18 aa, Staphylococcus epidermidis
NLEINLFGIETWGQHAKM

SEQ ID NO: 1737389 - protein, 17 aa, Staphylococcus epidermidis
NLFLAYVPFELCLLLKL

SEQ ID NO: 1737390 - protein, 30 aa, Staphylococcus epidermidis
NLLGARLFGELEFWFSIIKVVTIITMVIVG

SEQ ID NO: 1737391 - protein, 18 aa, Staphylococcus epidermidis
NLLMLSFGMMLIGEACLF

SEQ ID NO: 1737392 - protein, 19 aa, Staphylococcus epidermidis
NLLNRCFEKLFEKNIGLAM

SEQ ID NO: 1737393 - protein, 22 aa, Staphylococcus epidermidis
NLNKRLTGLFGTTSALNIQSSQ

SEQ ID NO: 1737394 - protein, 24 aa, Staphylococcus epidermidis
NLRKNIKHYGMFLFSLLISIILYF

SEQ ID NO: 1737395 - protein, 17 aa, Staphylococcus epidermidis
NLTRTNRNFRFFQIFTA

SEQ ID NO: 1737396 - protein, 30 aa, Staphylococcus epidermidis
NLVNFWLRRFKRLIPAMMFVVTVVLIYTLL

SEQ ID NO: 1737397 - protein, 19 aa, Staphylococcus epidermidis
NMNFKDYFTSLKVIDSIKR

SEQ ID NO: 1737398 - protein, 25 aa, Staphylococcus epidermidis
NMYPTERLRFIAIQYLIDNVQIYQE

SEQ ID NO: 1737399 - protein, 19 aa, Staphylococcus epidermidis
NNDGRWTVETGSPDINGIG

SEQ ID NO: 1737400 - protein, 24 aa, Staphylococcus epidermidis
NNSYWTWWLTYGVIALLLITLFYV

SEQ ID NO: 1737401 - protein, 17 aa, Staphylococcus epidermidis
NNVPIRILLFYIGGLLV

SEQ ID NO: 1737402 - protein, 21 aa, Staphylococcus epidermidis
NPAKTFILNVGKLADDLNPVG

SEQ ID NO: 1737403 - protein, 19 aa, Staphylococcus epidermidis
NPLGGTLMLQGLKIDEKEN

SEQ ID NO: 1737404 - protein, 20 aa, Staphylococcus epidermidis
NQKIPSLFSRYDNAVDLLNE

SEQ ID NO: 1737405 - protein, 22 aa, Staphylococcus epidermidis
NQLKSVHLIGVSKTMPISTGMQ

SEQ ID NO: 1737406 - protein, 20 aa, Staphylococcus epidermidis
NREIDALKLFSKNHSEYVTD

SEQ ID NO: 1737407 - protein, 20 aa, Staphylococcus epidermidis
NRPSLLDRINKGVGDSNSIF

SEQ ID NO: 1737408 - protein, 20 aa, Staphylococcus epidermidis
NRTLVAYSLGNFLNGQSTGN

SEQ ID NO: 1737409 - protein, 27 aa, Staphylococcus epidermidis
NSAMPWLPAAIGFILGGVFIRVLDYII

SEQ ID NO: 1737410 - protein, 26 aa, Staphylococcus epidermidis
NSSQKRHTFPWIKTIIVAIIAGIIGA

SEQ ID NO: 1737411 - protein, 21 aa, Staphylococcus epidermidis
NTGLAVFLFGFIKRLLIPFGL

SEQ ID NO: 1737412 - protein, 18 aa, Staphylococcus epidermidis
NVGKYNFYTFEGLRKSNN

SEQ ID NO: 1737413 - protein, 22 aa, Staphylococcus epidermidis
NWAFLLELFFKHLLMSVYGVLF

SEQ ID NO: 1737414 - protein, 17 aa, Staphylococcus epidermidis
NYVIPKEGSNLWFDNMV

SEQ ID NO: 1737415 - protein, 17 aa, Staphylococcus epidermidis
PATICFAIPLYRKREVL

SEQ ID NO: 1737416 - protein, 23 aa, Staphylococcus epidermidis
PEANGASAFNIDKVVKANAANNG

SEQ ID NO: 1737417 - protein, 20 aa, Staphylococcus epidermidis
PEFQDLKLLVQTLHAAGADV

SEQ ID NO: 1737418 - protein, 25 aa, Staphylococcus epidermidis
PEKTGDGKWGFSFLDKDGDLAGSYT

SEQ ID NO: 1737419 - protein, 23 aa, Staphylococcus epidermidis
PELFTKINWKVFITPVILTLVLA

SEQ ID NO: 1737420 - protein, 24 aa, Staphylococcus epidermidis
PERNINRIILMFSLTNDLKITING

SEQ ID NO: 1737421 - protein, 21 aa, Staphylococcus epidermidis
PFLGGSVILSFGWQPLLFNAL

SEQ ID NO: 1737422 - protein, 18 aa, Staphylococcus epidermidis
PFTPLLVAALLYFLLTFA

SEQ ID NO: 1737423 - protein, 18 aa, Staphylococcus epidermidis
PFVSLIFTCIIFIGFLYQ

SEQ ID NO: 1737424 - protein, 26 aa, Staphylococcus epidermidis
PGMHFPGQRLLRKEVIQYFSEEGIHI

SEQ ID NO: 1737425 - protein, 32 aa, Staphylococcus epidermidis
PHKAPRSFISPSVIVGPNFYMGIGTPGGNKIP

SEQ ID NO: 1737426 - protein, 18 aa, Staphylococcus epidermidis
PIIMGLYFVLKDKLVNGL

SEQ ID NO: 1737427 - protein, 19 aa, Staphylococcus epidermidis
PIIVHRFNINFLPVVVAEI

SEQ ID NO: 1737428 - protein, 18 aa, Staphylococcus epidermidis
PISKAFILSFTFMPGDII

SEQ ID NO: 1737429 - protein, 23 aa, Staphylococcus epidermidis
PKLAFEIPLRYKIMGIVGSVWGI

SEQ ID NO: 1737430 - protein, 25 aa, Staphylococcus epidermidis
PKRNWLRKVDWILVLVISLLALTSV

SEQ ID NO: 1737431 - protein, 18 aa, Staphylococcus epidermidis
PLFFIYKYRQPMFGKLSS

SEQ ID NO: 1737432 - protein, 17 aa, Staphylococcus epidermidis
PLIPAFIGAGLIGGIAA

SEQ ID NO: 1737433 - protein, 22 aa, Staphylococcus epidermidis
PLKEQFPYGFMLQGNGKVFGCL

SEQ ID NO: 1737434 - protein, 19 aa, Staphylococcus epidermidis
PLLGIIITVSIKWEAVGKH

SEQ ID NO: 1737435 - protein, 20 aa, Staphylococcus epidermidis
PLWFIFLFFYYKKYKNNAES

SEQ ID NO: 1737436 - protein, 26 aa, Staphylococcus epidermidis
PNDTTAKIKLVMGGTDGDHDPEINPY

SEQ ID NO: 1737437 - protein, 23 aa, Staphylococcus epidermidis
PNKTAWWLVIPVGIIYAVIYYFV

SEQ ID NO: 1737438 - protein, 20 aa, Staphylococcus epidermidis
PPLMFLTGLVSIHYQYPSIF

SEQ ID NO: 1737439 - protein, 18 aa, Staphylococcus epidermidis
PRAGRALFSDSLATIVGS

SEQ ID NO: 1737440 - protein, 22 aa, Staphylococcus epidermidis
PSILVNPWVQLILSTPVQFIIG

SEQ ID NO: 1737441 - protein, 28 aa, Staphylococcus epidermidis
PSLLDKLHSRGSILDKLDHSAPENGLSL

SEQ ID NO: 1737442 - protein, 19 aa, Staphylococcus epidermidis
PSLPIKFAIGTILAGASYI

SEQ ID NO: 1737443 - protein, 23 aa, Staphylococcus epidermidis
PSVKKSYGWLVFGRLLAILIAII

SEQ ID NO: 1737444 - protein, 25 aa, Staphylococcus epidermidis
PTGSSLKPFLAYGPAIENMKWSTNH

SEQ ID NO: 1737445 - protein, 23 aa, Staphylococcus epidermidis
PTIFNFSLALLIGLLSGVFSSIF

SEQ ID NO: 1737446 - protein, 24 aa, Staphylococcus epidermidis
PTLKRMKFGQSIREEGPQSHMKKT

SEQ ID NO: 1737447 - protein, 18 aa, Staphylococcus epidermidis
PTTAEVILIIILGLPIYF

SEQ ID NO: 1737448 - protein, 18 aa, Staphylococcus epidermidis
PVLLELKAYIKNRVTNFR

SEQ ID NO: 1737449 - protein, 29 aa, Staphylococcus epidermidis
PYYKPLHMALRLFMLLTLISGFWELIEEF

SEQ ID NO: 1737450 - protein, 18 aa, Staphylococcus epidermidis
QAEKVLDSHHLKVGDISR

SEQ ID NO: 1737451 - protein, 18 aa, Staphylococcus epidermidis
QALIAFVLLLAGGGDGSK

SEQ ID NO: 1737452 - protein, 18 aa, Staphylococcus epidermidis
QALLPIFSILFFGVAWLF

SEQ ID NO: 1737453 - protein, 18 aa, Staphylococcus epidermidis
QEIFQFFTSHGIYSIGGI

SEQ ID NO: 1737454 - protein, 22 aa, Staphylococcus epidermidis
QEYEPTLPWVVYKLTQAKAHKT

SEQ ID NO: 1737455 - protein, 24 aa, Staphylococcus epidermidis
QFDPKRFTLNKAKKDIITDVNTQI

SEQ ID NO: 1737456 - protein, 24 aa, Staphylococcus epidermidis
QFLNRLMIIIAITFTIVYVIKHHE

SEQ ID NO: 1737457 - protein, 24 aa, Staphylococcus epidermidis
QFTFSNYMRLIWFVSSLGLLAGAM

SEQ ID NO: 1737458 - protein, 19 aa, Staphylococcus epidermidis
QGVKHIVYMSGLIPENDEL

SEQ ID NO: 1737459 - protein, 24 aa, Staphylococcus epidermidis
QHTYRKLTCVHVNHGLREQSYEEE

SEQ ID NO: 1737460 - protein, 24 aa, Staphylococcus epidermidis
QINIWRILVVTGLRGQEISNKVLP

SEQ ID NO: 1737461 - protein, 21 aa, Staphylococcus epidermidis
QKELQQVAAYLSLEQARYPNR

SEQ ID NO: 1737462 - protein, 25 aa, Staphylococcus epidermidis
QKKKKRTTLTFIVGVCLLFISVYLN

SEQ ID NO: 1737463 - protein, 18 aa, Staphylococcus epidermidis
QKNHFKPLINNADTRDEV

SEQ ID NO: 1737464 - protein, 19 aa, Staphylococcus epidermidis
QLIMRRSAVEILFATIGLI

SEQ ID NO: 1737465 - protein, 23 aa, Staphylococcus epidermidis
QLLGASLWGVFALGNWPGITNKI

SEQ ID NO: 1737466 - protein, 30 aa, Staphylococcus epidermidis
QLPHYPSMMIPRFVAILGIISAAITIRDKE

SEQ ID NO: 1737467 - protein, 26 aa, Staphylococcus epidermidis
QNETPLRYIFSIIVVILIILGAFQLG

SEQ ID NO: 1737468 - protein, 23 aa, Staphylococcus epidermidis
QNQFLKSNFKVMMLDDYNDKDAT

SEQ ID NO: 1737469 - protein, 20 aa, Staphylococcus epidermidis
QNRYNRRGSANYKTNTVADD

SEQ ID NO: 1737470 - protein, 32 aa, Staphylococcus epidermidis
QNSLKMIFDLVPRIAIGSIIAYIIGQHIDVFI

SEQ ID NO: 1737471 - protein, 19 aa, Staphylococcus epidermidis
QPEIRRALEQLGRGSFLKR

SEQ ID NO: 1737472 - protein, 18 aa, Staphylococcus epidermidis
QPISGVVMLLTIAIILGF

SEQ ID NO: 1737473 - protein, 25 aa, Staphylococcus epidermidis
QPPFFFSVLLPIVFISALIGILQYT

SEQ ID NO: 1737474 - protein, 19 aa, Staphylococcus epidermidis
QPVFMSMLISMVFSFIIIS

SEQ ID NO: 1737475 - protein, 18 aa, Staphylococcus epidermidis
QRPAMFFKVESFFYSHLD

SEQ ID NO: 1737476 - protein, 17 aa, Staphylococcus epidermidis
QRRAFKINYGTEIETAI

SEQ ID NO: 1737477 - protein, 25 aa, Staphylococcus epidermidis
QSYQDYFLQFNWFQPLLIGLAGLLI

SEQ ID NO: 1737478 - protein, 19 aa, Staphylococcus epidermidis
QTDIPAVLLELGYISNPTD

SEQ ID NO: 1737479 - protein, 30 aa, Staphylococcus epidermidis
QTHFPNFGGGLIGFYLLKLFIPLISIVGVI

SEQ ID NO: 1737480 - protein, 25 aa, Staphylococcus epidermidis
QTILFQVRLPRLLEAMLTGAVLTLA

SEQ ID NO: 1737481 - protein, 22 aa, Staphylococcus epidermidis
QTNGRSGIVMVIRDMTNEHNLD

SEQ ID NO: 1737482 - protein, 17 aa, Staphylococcus epidermidis
QVIQLKGLIAMSFIVLS

SEQ ID NO: 1737483 - protein, 21 aa, Staphylococcus epidermidis
QVYGFFAIVFIIPFTVHIGYI

SEQ ID NO: 1737484 - protein, 26 aa, Staphylococcus epidermidis
QWLASRIKWPSIVVMAIVGLLVGPIF

SEQ ID NO: 1737485 - protein, 19 aa, Staphylococcus epidermidis
QWQSLAYTRTPFVKTGTYD

SEQ ID NO: 1737486 - protein, 26 aa, Staphylococcus epidermidis
QYLPMSWRKPLSLGLLILILATLFIK

SEQ ID NO: 1737487 - protein, 24 aa, Staphylococcus epidermidis
QYMAKRRIGALIVFEKETGLQDYI

SEQ ID NO: 1737488 - protein, 20 aa, Staphylococcus epidermidis
RAGAVVPILLGMIAAFNVSK

SEQ ID NO: 1737489 - protein, 29 aa, Staphylococcus epidermidis
RALTPRRAILLAAVMNFIGALTFTGVAGT

SEQ ID NO: 1737490 - protein, 20 aa, Staphylococcus epidermidis
RASPVMHHVFWISFVAIFVG

SEQ ID NO: 1737491 - protein, 25 aa, Staphylococcus epidermidis
RDAFLNILSTLGFIFLMFLSGLEID

SEQ ID NO: 1737492 - protein, 17 aa, Staphylococcus epidermidis
RDNVMVVWLDFEKGDSY

SEQ ID NO: 1737493 - protein, 23 aa, Staphylococcus epidermidis
REFELYSARGIRALMNNKLNYYI

SEQ ID NO: 1737494 - protein, 18 aa, Staphylococcus epidermidis
REGNRTLVAYSLGNFLNG

SEQ ID NO: 1737495 - protein, 24 aa, Staphylococcus epidermidis
RELEALQSNIGWQEVFYDTDSTEA

SEQ ID NO: 1737496 - protein, 26 aa, Staphylococcus epidermidis
RFNSSGDAYPGNFVQAVNQYWPEHMD

SEQ ID NO: 1737497 - protein, 22 aa, Staphylococcus epidermidis
RGESFISNPLLVYMEPYASSTA

SEQ ID NO: 1737498 - protein, 18 aa, Staphylococcus epidermidis
RGLLSLLVSSNFFKKQYW

SEQ ID NO: 1737499 - protein, 25 aa, Staphylococcus epidermidis
RGSIVPNYVMGLSFITEGAIPFAAA

SEQ ID NO: 1737500 - protein, 18 aa, Staphylococcus epidermidis
RHHFTIAKKAFFVENGSL

SEQ ID NO: 1737501 - protein, 20 aa, Staphylococcus epidermidis
RKDGNYHFLLFNKINDRYLS

SEQ ID NO: 1737502 - protein, 18 aa, Staphylococcus epidermidis
RKMGAFLIFTEFQGNLIT

SEQ ID NO: 1737503 - protein, 20 aa, Staphylococcus epidermidis
RLESTVMYAGIIVDTRNFTL

SEQ ID NO: 1737504 - protein, 17 aa, Staphylococcus epidermidis
RLITILVAPFMSCSARL

SEQ ID NO: 1737505 - protein, 24 aa, Staphylococcus epidermidis
RLTGMEMLESLILGVLFSTVLIWT

SEQ ID NO: 1737506 - protein, 23 aa, Staphylococcus epidermidis
RMIELPLSLSVIIGGVRIALVVA

SEQ ID NO: 1737507 - protein, 32 aa, Staphylococcus epidermidis
RPANRLTEKILGWFSWVFLLILTIVSMFIALV

SEQ ID NO: 1737508 - protein, 21 aa, Staphylococcus epidermidis
RPVESGIMILIAFIGLIANIV

SEQ ID NO: 1737509 - protein, 17 aa, Staphylococcus epidermidis
RQGWEKFTGDFTLNGLV

SEQ ID NO: 1737510 - protein, 17 aa, Staphylococcus epidermidis
RSILAGIMMSFARAIGE

SEQ ID NO: 1737511 - protein, 26 aa, Staphylococcus epidermidis
RSLLWEHIIQLKMPFFDKNESGQLMS

SEQ ID NO: 1737512 - protein, 19 aa, Staphylococcus epidermidis
RSTVSLIFKAIQRLRNGTV

SEQ ID NO: 1737513 - protein, 27 aa, Staphylococcus epidermidis
RTIFIIEFIGALLLAFYFYRDNPDLKN

SEQ ID NO: 1737514 - protein, 21 aa, Staphylococcus epidermidis
RTVDIPITIYPTVTAKNPVRD

SEQ ID NO: 1737515 - protein, 17 aa, Staphylococcus epidermidis
RVRIKVHNDAKVNYDEL

SEQ ID NO: 1737516 - protein, 26 aa, Staphylococcus epidermidis
SAAYFYSIYEMMMWLTHQTHHPHLYF

SEQ ID NO: 1737517 - protein, 24 aa, Staphylococcus epidermidis
SAFITVIVYNFFVKRNITIKMPKE

SEQ ID NO: 1737518 - protein, 19 aa, Staphylococcus epidermidis
SAFTFKVVIQLGSVFAAAW

SEQ ID NO: 1737519 - protein, 17 aa, Staphylococcus epidermidis
SAMIVPVLMFAFFGIVL

SEQ ID NO: 1737520 - protein, 29 aa, Staphylococcus epidermidis
SDKKRSKMKIAILSIIFVILLIGLFSFVA

SEQ ID NO: 1737521 - protein, 24 aa, Staphylococcus epidermidis
SDLPNRDFTSISAIGSLPSSSEIS

SEQ ID NO: 1737522 - protein, 24 aa, Staphylococcus epidermidis
SDNPEFKKAMGILLLSTIGYVGYV

SEQ ID NO: 1737523 - protein, 21 aa, Staphylococcus epidermidis
SDTVGFKWMYILCALLVTIAM

SEQ ID NO: 1737524 - protein, 21 aa, Staphylococcus epidermidis
SEDYSRLAGVSDIDSTSDSVF

SEQ ID NO: 1737525 - protein, 17 aa, Staphylococcus epidermidis
SEIKKNSSYERIYDKAK

SEQ ID NO: 1737526 - protein, 18 aa, Staphylococcus epidermidis
SELVQLFPYEVTEHKVEQ

SEQ ID NO: 1737527 - protein, 18 aa, Staphylococcus epidermidis
SENPLVICYTNDVVKNFT

SEQ ID NO: 1737528 - protein, 24 aa, Staphylococcus epidermidis
SETTRISDALVRMQREHVHISLII

SEQ ID NO: 1737529 - protein, 19 aa, Staphylococcus epidermidis
SFAVFTMASLITFISMIII

SEQ ID NO: 1737530 - protein, 21 aa, Staphylococcus epidermidis
SFCAPVLAGAIGWQNTVRSYL

SEQ ID NO: 1737531 - protein, 30 aa, Staphylococcus epidermidis
SFCTQRLKQTWKWFAISLIIGLVIILALEG

SEQ ID NO: 1737532 - protein, 18 aa, Staphylococcus epidermidis
SFFSSWFLTFGYVCVVAL

SEQ ID NO: 1737533 - protein, 18 aa, Staphylococcus epidermidis
SFISLILYRFELNLRSAS

SEQ ID NO: 1737534 - protein, 18 aa, Staphylococcus epidermidis
SFLSRYLTLDSFNLYFGV

SEQ ID NO: 1737535 - protein, 26 aa, Staphylococcus epidermidis
SFNKISPRFSLIFLIIIYLTIGPLFA

SEQ ID NO: 1737536 - protein, 18 aa, Staphylococcus epidermidis
SFQTFLINKKVNGKEVTP

SEQ ID NO: 1737537 - protein, 29 aa, Staphylococcus epidermidis
SFWFPDIPNWISALFCVLILMSFNLLSAK

SEQ ID NO: 1737538 - protein, 27 aa, Staphylococcus epidermidis
SFWKSIENIGSLSFKFMVPILAGYIAV

SEQ ID NO: 1737539 - protein, 23 aa, Staphylococcus epidermidis
SGGFYAISFLTLFVIASVVHPSS

SEQ ID NO: 1737540 - protein, 21 aa, Staphylococcus epidermidis
SGLVMLCVFAINYRLSKRTKS

SEQ ID NO: 1737541 - protein, 17 aa, Staphylococcus epidermidis
SGLYKYEASTNIKNLEQ

SEQ ID NO: 1737542 - protein, 23 aa, Staphylococcus epidermidis
SGTKESAGFGFIGMVGPINAFKF

SEQ ID NO: 1737543 - protein, 21 aa, Staphylococcus epidermidis
SGVEVLIHIGIDTVKLNGEGF

SEQ ID NO: 1737544 - protein, 24 aa, Staphylococcus epidermidis
SGWGEWKVVTVFWTVGLITGLIGL

SEQ ID NO: 1737545 - protein, 24 aa, Staphylococcus epidermidis
SHGGFLNEDYRLFKTDNRTGKLTY

SEQ ID NO: 1737546 - protein, 19 aa, Staphylococcus epidermidis
SHIAFCIPIVVIIVLPQLY

SEQ ID NO: 1737547 - protein, 17 aa, Staphylococcus epidermidis
SHIKFNRLLLITIGGII

SEQ ID NO: 1737548 - protein, 25 aa, Staphylococcus epidermidis
SIATGIACGFIFYPITMIITKKYKE

SEQ ID NO: 1737549 - protein, 34 aa, Staphylococcus epidermidis
SIGIIIYVSLRFEWRMGLSSVLALLHDVFIIIAI

SEQ ID NO: 1737550 - protein, 23 aa, Staphylococcus epidermidis
SIGMCAYYIRFIRSTLLEQYQTP

SEQ ID NO: 1737551 - protein, 21 aa, Staphylococcus epidermidis
SINLIRIVIGISIYTHAGNLI

SEQ ID NO: 1737552 - protein, 23 aa, Staphylococcus epidermidis
SINNRILFMITWNIDEPGGVIKL

SEQ ID NO: 1737553 - protein, 24 aa, Staphylococcus epidermidis
SIQPSEFMKIILILALAKTISKHN

SEQ ID NO: 1737554 - protein, 28 aa, Staphylococcus epidermidis
SIVPALICLAGIFITMIWRSFQIDHGYH

SEQ ID NO: 1737555 - protein, 22 aa, Staphylococcus epidermidis
SIWSQIRLRQAIKKQGKNPDKL

SEQ ID NO: 1737556 - protein, 23 aa, Staphylococcus epidermidis
SKKFRLKVSLRKGINKVYFMSDV

SEQ ID NO: 1737557 - protein, 22 aa, Staphylococcus epidermidis
SKKTYQGIFSFDVLGLQDIHKN

SEQ ID NO: 1737558 - protein, 23 aa, Staphylococcus epidermidis
SKLIEFVGFLGISYVTFKSVQLI

SEQ ID NO: 1737559 - protein, 19 aa, Staphylococcus epidermidis
SKPKRSLYALIMTLCGVHG

SEQ ID NO: 1737560 - protein, 21 aa, Staphylococcus epidermidis
SKRNAIVTVMLISAFVSMLNQ

SEQ ID NO: 1737561 - protein, 21 aa, Staphylococcus epidermidis
SKVIGIPKWIQFLFIVIVAMV

SEQ ID NO: 1737562 - protein, 17 aa, Staphylococcus epidermidis
SKYGSFFIKGIKNTILI

SEQ ID NO: 1737563 - protein, 18 aa, Staphylococcus epidermidis
SLAWLKILGLIVALILLT

SEQ ID NO: 1737564 - protein, 23 aa, Staphylococcus epidermidis
SLFYCLVIFPITLILYVRIAKKN

SEQ ID NO: 1737565 - protein, 26 aa, Staphylococcus epidermidis
SLGFDKKAVFPFIIASGFIADTTSLP

SEQ ID NO: 1737566 - protein, 24 aa, Staphylococcus epidermidis
SLIPFVIATYFYKKTNGFFLLAPL

SEQ ID NO: 1737567 - protein, 17 aa, Staphylococcus epidermidis
SLLPNYKAMVLAKQQGQ

SEQ ID NO: 1737568 - protein, 17 aa, Staphylococcus epidermidis
SLSALFSGLFIVGAGDI

SEQ ID NO: 1737569 - protein, 24 aa, Staphylococcus epidermidis
SLSHLRFGAGTIFDNMDFIVSNIL

SEQ ID NO: 1737570 - protein, 24 aa, Staphylococcus epidermidis
SMAKGELLPIIFFAVFFGLGLAAI

SEQ ID NO: 1737571 - protein, 19 aa, Staphylococcus epidermidis
SMMFIGMIILLSFALLFLS

SEQ ID NO: 1737572 - protein, 21 aa, Staphylococcus epidermidis
SNDLYKLSSFYKVKTYSDTYA

SEQ ID NO: 1737573 - protein, 29 aa, Staphylococcus epidermidis
SNLKHPFKIKRLVGQSGMSYGALGKNAIT

SEQ ID NO: 1737574 - protein, 18 aa, Staphylococcus epidermidis
SPFVKLFTLIGVPFAAGI

SEQ ID NO: 1737575 - protein, 19 aa, Staphylococcus epidermidis
SPFVRLFALIGIPFAAGII

SEQ ID NO: 1737576 - protein, 17 aa, Staphylococcus epidermidis
SPITFWYGKYIILIPSS

SEQ ID NO: 1737577 - protein, 26 aa, Staphylococcus epidermidis
SPIYELVEILVLIPISFIITIASAIT

SEQ ID NO: 1737578 - protein, 25 aa, Staphylococcus epidermidis
SPLMLLKLAVVWTLVQFFEGHFISP

SEQ ID NO: 1737579 - protein, 29 aa, Staphylococcus epidermidis
SQSNSLKRKDFVVSFIASAIVGSAVGLYY

SEQ ID NO: 1737580 - protein, 20 aa, Staphylococcus epidermidis
SRISLPFILLIVFFPLFYKL

SEQ ID NO: 1737581 - protein, 26 aa, Staphylococcus epidermidis
SRPFTKRYYILIVMMAIITFACTFVG

SEQ ID NO: 1737582 - protein, 23 aa, Staphylococcus epidermidis
SRSRGMFRLVSGMTFANNPLNMM

SEQ ID NO: 1737583 - protein, 20 aa, Staphylococcus epidermidis
SRVIERFPKSIIFIAPMIVF

SEQ ID NO: 1737584 - protein, 24 aa, Staphylococcus epidermidis
SSIFLDLTHTFGLGIHDNFINSIF

SEQ ID NO: 1737585 - protein, 20 aa, Staphylococcus epidermidis
SSLLGLFQFILGGLISPLVG

SEQ ID NO: 1737586 - protein, 36 aa, Staphylococcus epidermidis
SSNLNNMNFLRWVNIRDDYTISWTSSKIQGRNTDGG

SEQ ID NO: 1737587 - protein, 22 aa, Staphylococcus epidermidis
SSTSDLAKWVQLQIHPTSKSQA

SEQ ID NO: 1737588 - protein, 21 aa, Staphylococcus epidermidis
SSWFLTFGYVCVVALNATAFS

SEQ ID NO: 1737589 - protein, 24 aa, Staphylococcus epidermidis
STEAMKSHMSDLVLGKQEQIAYIN

SEQ ID NO: 1737590 - protein, 17 aa, Staphylococcus epidermidis
STMPFAGSAYSWINVLF

SEQ ID NO: 1737591 - protein, 17 aa, Staphylococcus epidermidis
SVFKTIYFIVIFIVILV

SEQ ID NO: 1737592 - protein, 24 aa, Staphylococcus epidermidis
SVGYRAQLTLSIGVGEGTENLIDL

SEQ ID NO: 1737593 - protein, 27 aa, Staphylococcus epidermidis
SVTVTIRKGDLIKEFSSNLNNMNFLRW

SEQ ID NO: 1737594 - protein, 25 aa, Staphylococcus epidermidis
SWSPFIGGFVARVSRGRTIREFVVG

SEQ ID NO: 1737595 - protein, 19 aa, Staphylococcus epidermidis
SYCSNLFARYLNMNFKDYF

SEQ ID NO: 1737596 - protein, 26 aa, Staphylococcus epidermidis
SYDPNNRYSIPYFFGTVGILYDKEKY

SEQ ID NO: 1737597 - protein, 23 aa, Staphylococcus epidermidis
SYRFKDIVWRDFSLIAIGFLCIF

SEQ ID NO: 1737598 - protein, 25 aa, Staphylococcus epidermidis
TAIALLFAICCNFYILKKYANFKFS

SEQ ID NO: 1737599 - protein, 30 aa, Staphylococcus epidermidis
TAISLSRLAVRPGDSIEAIATEGSGETIST

SEQ ID NO: 1737600 - protein, 17 aa, Staphylococcus epidermidis
TALTWIVDMSSTGVSIA

SEQ ID NO: 1737601 - protein, 18 aa, Staphylococcus epidermidis
TAVFEIFITTYLLKLVST

SEQ ID NO: 1737602 - protein, 25 aa, Staphylococcus epidermidis
TDGLYWRIGACIIGAIFVISYLFWY

SEQ ID NO: 1737603 - protein, 25 aa, Staphylococcus epidermidis
TDNLPRFFIYLLLFMFSMIGIVIAN

SEQ ID NO: 1737604 - protein, 25 aa, Staphylococcus epidermidis
TDQQPLVFELPELSLQNALVTSEVV

SEQ ID NO: 1737605 - protein, 23 aa, Staphylococcus epidermidis
TEPDEIRDSLAIVLDESKRLNRL

SEQ ID NO: 1737606 - protein, 20 aa, Staphylococcus epidermidis
TEPHNLLFLIVITLLVALAV

SEQ ID NO: 1737607 - protein, 26 aa, Staphylococcus epidermidis
TFLLYANVVYFRFFSDFLTFSTLNQA

SEQ ID NO: 1737608 - protein, 18 aa, Staphylococcus epidermidis
TGFWLKVPGKSGGVNKEY

SEQ ID NO: 1737609 - protein, 18 aa, Staphylococcus epidermidis
THFGEAIFQTINPLFILL

SEQ ID NO: 1737610 - protein, 23 aa, Staphylococcus epidermidis
THPHVIQPVKWVDGREGNRTLVA

SEQ ID NO: 1737611 - protein, 20 aa, Staphylococcus epidermidis
TIILRPYLDVLLLGRAQAIN

SEQ ID NO: 1737612 - protein, 19 aa, Staphylococcus epidermidis
TILICTKLNLQVGTTVAVL

SEQ ID NO: 1737613 - protein, 18 aa, Staphylococcus epidermidis
TITFLTLPPKDVFLASVL

SEQ ID NO: 1737614 - protein, 18 aa, Staphylococcus epidermidis
TIVFFPIFFIGHLVTQSH

SEQ ID NO: 1737615 - protein, 17 aa, Staphylococcus epidermidis
TIVFGFFALTFVTPILR

SEQ ID NO: 1737616 - protein, 23 aa, Staphylococcus epidermidis
TKIEAIKSLFSFTKPPLAEVKPA

SEQ ID NO: 1737617 - protein, 23 aa, Staphylococcus epidermidis
TLIFGAFAFFWFVGIHGPSIVEP

SEQ ID NO: 1737618 - protein, 30 aa, Staphylococcus epidermidis
TLITFTTILLFCLIIIFFLKDTLRSSEIDE

SEQ ID NO: 1737619 - protein, 21 aa, Staphylococcus epidermidis
TLKIGEIIHKLILKYLLWYIK

SEQ ID NO: 1737620 - protein, 17 aa, Staphylococcus epidermidis
TLLAARLDKALSVYHSQ

SEQ ID NO: 1737621 - protein, 20 aa, Staphylococcus epidermidis
TLLFKPELIISIKHDAIAAL

SEQ ID NO: 1737622 - protein, 24 aa, Staphylococcus epidermidis
TLNIWQIIILFSMVGIIYIGMSKI

SEQ ID NO: 1737623 - protein, 19 aa, Staphylococcus epidermidis
TLPLGRPFFTACIGGGVGG

SEQ ID NO: 1737624 - protein, 23 aa, Staphylococcus epidermidis
TLSRCYYKLINAFVEDIQFEDGV

SEQ ID NO: 1737625 - protein, 24 aa, Staphylococcus epidermidis
TLTIPKDRPVVFKLQSMDTMTSFW

SEQ ID NO: 1737626 - protein, 17 aa, Staphylococcus epidermidis
TLVTIVVFLPLVFVSGS

SEQ ID NO: 1737627 - protein, 24 aa, Staphylococcus epidermidis
TMIELPLSLSVIIGGIRIALVVAI

SEQ ID NO: 1737628 - protein, 35 aa, Staphylococcus epidermidis
TMRILKSAFLSGLMLEFISMLGIGLVALEAALSLV

SEQ ID NO: 1737629 - protein, 26 aa, Staphylococcus epidermidis
TNIVGAKWVFFWSFIVLLLPIFLLGQ

SEQ ID NO: 1737630 - protein, 25 aa, Staphylococcus epidermidis
TNKMREMKNLKSLKVNNDIARIAAI

SEQ ID NO: 1737631 - protein, 19 aa, Staphylococcus epidermidis
TPFCSCSTIPILAGLLNSK

SEQ ID NO: 1737632 - protein, 20 aa, Staphylococcus epidermidis
TPPIGLGLATFVRKHQFNKA

SEQ ID NO: 1737633 - protein, 17 aa, Staphylococcus epidermidis
TQEWKRLEQSLNIEPIN

SEQ ID NO: 1737634 - protein, 20 aa, Staphylococcus epidermidis
TRMASALLINIGTLTRENEE

SEQ ID NO: 1737635 - protein, 20 aa, Staphylococcus epidermidis
TRVAIFISPLWFIFLFFYYK

SEQ ID NO: 1737636 - protein, 18 aa, Staphylococcus epidermidis
TRVMFRLQCIGFIVFILL

SEQ ID NO: 1737637 - protein, 25 aa, Staphylococcus epidermidis
TSILSRFGISVSAILAGAGVVGVAV

SEQ ID NO: 1737638 - protein, 24 aa, Staphylococcus epidermidis
TSIQWKQLFISISIFALSQLIVIL

SEQ ID NO: 1737639 - protein, 33 aa, Staphylococcus epidermidis
TSKYKVIIGDLDIPVRSGFSMDAKIPLKTKKLP

SEQ ID NO: 1737640 - protein, 22 aa, Staphylococcus epidermidis
TSLPVIVTFVLGIAIIIIFTTR

SEQ ID NO: 1737641 - protein, 21 aa, Staphylococcus epidermidis
TSLRLKLHLIYQKNVTLCTIP

SEQ ID NO: 1737642 - protein, 19 aa, Staphylococcus epidermidis
TTFCAFVLVYLLMQSIMPH

SEQ ID NO: 1737643 - protein, 32 aa, Staphylococcus epidermidis
TTMWQMAYNFSMWRLFGISIIAIIGMLIWIMM

SEQ ID NO: 1737644 - protein, 28 aa, Staphylococcus epidermidis
TVGGIVPEILITKVIILGLFGIGFMVVG

SEQ ID NO: 1737645 - protein, 25 aa, Staphylococcus epidermidis
TVILFSALMSFLFTNIYYHFHLKAS

SEQ ID NO: 1737646 - protein, 23 aa, Staphylococcus epidermidis
TVKLILEIVRTIFIIEFIGALLL

SEQ ID NO: 1737647 - protein, 19 aa, Staphylococcus epidermidis
TVYFNDRYIVILGTNVSNT

SEQ ID NO: 1737648 - protein, 25 aa, Staphylococcus epidermidis
TYGFLRLEIIVAFLNGLALIVISLG

SEQ ID NO: 1737649 - protein, 18 aa, Staphylococcus epidermidis
VAFWNRHPYLWWFMFAVY

SEQ ID NO: 1737650 - protein, 24 aa, Staphylococcus epidermidis
VAGFLAGYIAKWIKQIKVPKAMAP

SEQ ID NO: 1737651 - protein, 18 aa, Staphylococcus epidermidis
VAITFQFGNQIIASMLPQ

SEQ ID NO: 1737652 - protein, 24 aa, Staphylococcus epidermidis
VALILIGFINFFLIKRKRKNKDKR

SEQ ID NO: 1737653 - protein, 18 aa, Staphylococcus epidermidis
VALLAAFIPIISGMSGNS

SEQ ID NO: 1737654 - protein, 23 aa, Staphylococcus epidermidis
VALLQMIVMPLIFISIVAAFSKI

SEQ ID NO: 1737655 - protein, 18 aa, Staphylococcus epidermidis
VAVFIVELVQGFNFQQAI

SEQ ID NO: 1737656 - protein, 18 aa, Staphylococcus epidermidis
VAVGDNLIHPVVYKDAQI

SEQ ID NO: 1737657 - protein, 24 aa, Staphylococcus epidermidis
VCAHKRWLFISSTLIKQTVRRSLF

SEQ ID NO: 1737658 - protein, 22 aa, Staphylococcus epidermidis
VCGVSYKGYMKGGTWINHVLNA

SEQ ID NO: 1737659 - protein, 22 aa, Staphylococcus epidermidis
VDIFMCGVATFLQANKVTGTGL

SEQ ID NO: 1737660 - protein, 17 aa, Staphylococcus epidermidis
VDKFSVSSINWGMIAIF

SEQ ID NO: 1737661 - protein, 24 aa, Staphylococcus epidermidis
VDLFLHRLTIILAILFFVLMFCIS

SEQ ID NO: 1737662 - protein, 25 aa, Staphylococcus epidermidis
VDSSLGFTMGWLYWGMWSLVTSVDI

SEQ ID NO: 1737663 - protein, 23 aa, Staphylococcus epidermidis
VEQLRAAIVYVVLNILGSWLLLL

SEQ ID NO: 1737664 - protein, 17 aa, Staphylococcus epidermidis
VFFIIVLLTLVVSIGIL

SEQ ID NO: 1737665 - protein, 19 aa, Staphylococcus epidermidis
VFFSISFTGLGIMFIVITL

SEQ ID NO: 1737666 - protein, 29 aa, Staphylococcus epidermidis
VFKTASKRLPWLIVLTFLGMITATILGSF

SEQ ID NO: 1737667 - protein, 18 aa, Staphylococcus epidermidis
VFVNIIFFQGMFYTQIFG

SEQ ID NO: 1737668 - protein, 23 aa, Staphylococcus epidermidis
VGDFRLLSRRAVQALTTLDEYNR

SEQ ID NO: 1737669 - protein, 23 aa, Staphylococcus epidermidis
VGESEFSFHLGINLRDHGIPVMM

SEQ ID NO: 1737670 - protein, 17 aa, Staphylococcus epidermidis
VGIIFLPIIIMRTSWWF

SEQ ID NO: 1737671 - protein, 30 aa, Staphylococcus epidermidis
VGIIKFGIPMLIPLLIKYAIDGVINNHSLT

SEQ ID NO: 1737672 - protein, 19 aa, Staphylococcus epidermidis
VGLILGFIVYRKPRVYEQR

SEQ ID NO: 1737673 - protein, 18 aa, Staphylococcus epidermidis
VGTSLKFSAEEIAYLVTV

SEQ ID NO: 1737674 - protein, 19 aa, Staphylococcus epidermidis
VGVNFVFGGFKFIDPKQPP

SEQ ID NO: 1737675 - protein, 23 aa, Staphylococcus epidermidis
VGVSTLIGIIFGWIPARSASKKE

SEQ ID NO: 1737676 - protein, 22 aa, Staphylococcus epidermidis
VHIGWKGWVYVDQQIARHMDGH

SEQ ID NO: 1737677 - protein, 24 aa, Staphylococcus epidermidis
VHKHKNIMLWAAFFALTFFIIYAA

SEQ ID NO: 1737678 - protein, 25 aa, Staphylococcus epidermidis
VIGALFAVVFTYVFGDQSPLSYALS

SEQ ID NO: 1737679 - protein, 17 aa, Staphylococcus epidermidis
VIGELCLSPTGSSAAVK

SEQ ID NO: 1737680 - protein, 21 aa, Staphylococcus epidermidis
VIGFGLCFPYVLLPYGFGQIF

SEQ ID NO: 1737681 - protein, 18 aa, Staphylococcus epidermidis
VIIGGSFSAFFITSVNSF

SEQ ID NO: 1737682 - protein, 18 aa, Staphylococcus epidermidis
VILIPFFILFALVDFGFG

SEQ ID NO: 1737683 - protein, 23 aa, Staphylococcus epidermidis
VILLFLRNIRTTAISIVSIPMSI

SEQ ID NO: 1737684 - protein, 25 aa, Staphylococcus epidermidis
VILLIIVAIFITRAIINHNNDKVSN

SEQ ID NO: 1737685 - protein, 19 aa, Staphylococcus epidermidis
VILSFGWQPLLFNALLYLV

SEQ ID NO: 1737686 - protein, 22 aa, Staphylococcus epidermidis
VIQRLKYYGSKVFDTQDNGELT

SEQ ID NO: 1737687 - protein, 20 aa, Staphylococcus epidermidis
VISGGILMAIVFLFGANSFK

SEQ ID NO: 1737688 - protein, 25 aa, Staphylococcus epidermidis
VKAFEWPLFIVFGLIFLLLVPNTFY

SEQ ID NO: 1737689 - protein, 20 aa, Staphylococcus epidermidis
VKPYRYRIIATIIVGIIKFG

SEQ ID NO: 1737690 - protein, 26 aa, Staphylococcus epidermidis
VKTKLRSVIPGAIFTSIIWLLGSFAF

SEQ ID NO: 1737691 - protein, 19 aa, Staphylococcus epidermidis
VLFFFGESSVKGFATMLLL

SEQ ID NO: 1737692 - protein, 23 aa, Staphylococcus epidermidis
VLFGELFGWVAGWALLAEYFIAV

SEQ ID NO: 1737693 - protein, 19 aa, Staphylococcus epidermidis
VLMSIVLTYMVWNFSPDLS

SEQ ID NO: 1737694 - protein, 17 aa, Staphylococcus epidermidis
VLPIMMKKMERFGSPKD

SEQ ID NO: 1737695 - protein, 18 aa, Staphylococcus epidermidis
VLVSHIFMLFKRRYNRYY

SEQ ID NO: 1737696 - protein, 18 aa, Staphylococcus epidermidis
VMNYKTLIQRTANVLDKR

SEQ ID NO: 1737697 - protein, 17 aa, Staphylococcus epidermidis
VNAFNWQAVFYIFGVVG

SEQ ID NO: 1737698 - protein, 18 aa, Staphylococcus epidermidis
VNAKNAYHKTQQELNLKL

SEQ ID NO: 1737699 - protein, 25 aa, Staphylococcus epidermidis
VNIDMVFNLANWLFLFAGLLFIIKT

SEQ ID NO: 1737700 - protein, 20 aa, Staphylococcus epidermidis
VNIIVAILMFKGGDTSHNLN

SEQ ID NO: 1737701 - protein, 19 aa, Staphylococcus epidermidis
VNLEFPLYMAIAVSLSGII

SEQ ID NO: 1737702 - protein, 20 aa, Staphylococcus epidermidis
VNVLFKVKPNKPVIDSNSVI

SEQ ID NO: 1737703 - protein, 23 aa, Staphylococcus epidermidis
VPIYLVTFIFCFIIAAINLFVLN

SEQ ID NO: 1737704 - protein, 22 aa, Staphylococcus epidermidis
VPKDMKNAVLATEDNRFYQHGA

SEQ ID NO: 1737705 - protein, 23 aa, Staphylococcus epidermidis
VPVVMATSVALFFLNLAFAETDR

SEQ ID NO: 1737706 - protein, 19 aa, Staphylococcus epidermidis
VPWSFKLHILLGFTVFACW

SEQ ID NO: 1737707 - protein, 27 aa, Staphylococcus epidermidis
VPYGNDWFAYFMRRLAERPQNLSLAIK

SEQ ID NO: 1737708 - protein, 22 aa, Staphylococcus epidermidis
VREVMTLPSIKVVEHPDLFVES

SEQ ID NO: 1737709 - protein, 19 aa, Staphylococcus epidermidis
VRKETPISLEGKASPESVK

SEQ ID NO: 1737710 - protein, 22 aa, Staphylococcus epidermidis
VSFCIGLLLFIGYSIIGLKYAL

SEQ ID NO: 1737711 - protein, 19 aa, Staphylococcus epidermidis
VSGITWRILAPLFIVAFVS

SEQ ID NO: 1737712 - protein, 17 aa, Staphylococcus epidermidis
VSHLKREHNLVIPELSN

SEQ ID NO: 1737713 - protein, 27 aa, Staphylococcus epidermidis
VSHLVLTRTGLYIIDSQLLKGHVYNGI

SEQ ID NO: 1737714 - protein, 19 aa, Staphylococcus epidermidis
VSIPGMMTGLIIGGVDPLQ

SEQ ID NO: 1737715 - protein, 17 aa, Staphylococcus epidermidis
VSNKANTAWRDASGTEI

SEQ ID NO: 1737716 - protein, 18 aa, Staphylococcus epidermidis
VSQKFYKSSFVVMSITGI

SEQ ID NO: 1737717 - protein, 27 aa, Staphylococcus epidermidis
VSVKAFGEFEFWFALIKVVTIVLMIIA

SEQ ID NO: 1737718 - protein, 21 aa, Staphylococcus epidermidis
VSVVLPWKEFGGIFATFPAVF

SEQ ID NO: 1737719 - protein, 23 aa, Staphylococcus epidermidis
VTIFCGYAFAGIVEKAGCLDVIL

SEQ ID NO: 1737720 - protein, 20 aa, Staphylococcus epidermidis
VTNQIPIFIVMAVYTATYAV

SEQ ID NO: 1737721 - protein, 18 aa, Staphylococcus epidermidis
VTSSLAIVLIFIFIVTSA

SEQ ID NO: 1737722 - protein, 18 aa, Staphylococcus epidermidis
VVFFIIYYVIFRVVIQVF

SEQ ID NO: 1737723 - protein, 17 aa, Staphylococcus epidermidis
VVFLPLVFVSGSVGEMF

SEQ ID NO: 1737724 - protein, 17 aa, Staphylococcus epidermidis
VVGSRATLFVTLLTLLF

SEQ ID NO: 1737725 - protein, 18 aa, Staphylococcus epidermidis
VVILACFIYMFLEGKLGS

SEQ ID NO: 1737726 - protein, 29 aa, Staphylococcus epidermidis
VVISCLIAAMIMPRIWPLKNIPDEYAKEV

SEQ ID NO: 1737727 - protein, 28 aa, Staphylococcus epidermidis
VVVAEILMGIVIGHSFLNLVERDAFLNI

SEQ ID NO: 1737728 - protein, 21 aa, Staphylococcus epidermidis
VWDLVKPRLIPSMEMGITAMV

SEQ ID NO: 1737729 - protein, 21 aa, Staphylococcus epidermidis
VYAEKLIQYGNRYRKDHHHVD

SEQ ID NO: 1737730 - protein, 24 aa, Staphylococcus epidermidis
VYLGKSGFFFLLGIIQALIVSIGD

SEQ ID NO: 1737731 - protein, 17 aa, Staphylococcus epidermidis
WFQGMGWPPSGRVLVHW

SEQ ID NO: 1737732 - protein, 18 aa, Staphylococcus epidermidis
WIDFPHIYLPFKDYTPSF

SEQ ID NO: 1737733 - protein, 18 aa, Staphylococcus epidermidis
WIGVTLIFGAFAFFWFVG

SEQ ID NO: 1737734 - protein, 19 aa, Staphylococcus epidermidis
WKLTLLTFITIPVFILIIV

SEQ ID NO: 1737735 - protein, 21 aa, Staphylococcus epidermidis
WKNIFNFKKIISVAFATGTYV

SEQ ID NO: 1737736 - protein, 19 aa, Staphylococcus epidermidis
WLNILIKGIFCNFFINIGI

SEQ ID NO: 1737737 - protein, 18 aa, Staphylococcus epidermidis
WMGDSNLAPMLKMASFSF

SEQ ID NO: 1737738 - protein, 18 aa, Staphylococcus epidermidis
WMKKPKWVKPMYVQLFCG

SEQ ID NO: 1737739 - protein, 17 aa, Staphylococcus epidermidis
WMLVFGIIAVIVTIMTG

SEQ ID NO: 1737740 - protein, 20 aa, Staphylococcus epidermidis
WPGFSRSGSTISTGVLMKLN

SEQ ID NO: 1737741 - protein, 23 aa, Staphylococcus epidermidis
WRSKFQLIIIFGIFSMISNFTGI

SEQ ID NO: 1737742 - protein, 17 aa, Staphylococcus epidermidis
WSFWGIKYGLFIQSIID

SEQ ID NO: 1737743 - protein, 18 aa, Staphylococcus epidermidis
WYFITFGAFVAFGIFLPN

SEQ ID NO: 1737744 - protein, 28 aa, Staphylococcus epidermidis
YANFLFLKRRGRELSLLQIIGLTKKDIM

SEQ ID NO: 1737745 - protein, 17 aa, Staphylococcus epidermidis
YAPLRFRTALVPLANIG

SEQ ID NO: 1737746 - protein, 24 aa, Staphylococcus epidermidis
YASLQIAAAFSFLTVMGGKLRYQS

SEQ ID NO: 1737747 - protein, 26 aa, Staphylococcus epidermidis
YDKYGPRPLIFTGFILLISCTFLLCF

SEQ ID NO: 1737748 - protein, 21 aa, Staphylococcus epidermidis
YDLRPYLKLAGQIVAALIVTF

SEQ ID NO: 1737749 - protein, 21 aa, Staphylococcus epidermidis
YDMMKRLNFDYYFIDIENLET

SEQ ID NO: 1737750 - protein, 24 aa, Staphylococcus epidermidis
YEELKAEYLSDVTFSSETDTEVIV

SEQ ID NO: 1737751 - protein, 19 aa, Staphylococcus epidermidis
YEKIIKIALFITATLTALV

SEQ ID NO: 1737752 - protein, 21 aa, Staphylococcus epidermidis
YEMTGRGATLLSGKGAYQKSD

SEQ ID NO: 1737753 - protein, 25 aa, Staphylococcus epidermidis
YENIKAHLKLTSYIDKSKVPNNNTK

SEQ ID NO: 1737754 - protein, 22 aa, Staphylococcus epidermidis
YEYLTIYLLVALMYWVVCFVIS

SEQ ID NO: 1737755 - protein, 24 aa, Staphylococcus epidermidis
YFLLPEALGSLILAITTAIIGLIG

SEQ ID NO: 1737756 - protein, 19 aa, Staphylococcus epidermidis
YFSKMIIPNIFSLIASILV

SEQ ID NO: 1737757 - protein, 28 aa, Staphylococcus epidermidis
YGLLGAFIFRFIALFLISIIANFWWIQA

SEQ ID NO: 1737758 - protein, 18 aa, Staphylococcus epidermidis
YIFFEKIGFLLVLLLGCV

SEQ ID NO: 1737759 - protein, 20 aa, Staphylococcus epidermidis
YIHLAHIPFYILGFLAAFIV

SEQ ID NO: 1737760 - protein, 20 aa, Staphylococcus epidermidis
YIQAEGFAGGELKHGTIALI

SEQ ID NO: 1737761 - protein, 17 aa, Staphylococcus epidermidis
YIYLTLVAFNFISGVLT

SEQ ID NO: 1737762 - protein, 17 aa, Staphylococcus epidermidis
YKLFEPMMKIEFYQNLL

SEQ ID NO: 1737763 - protein, 18 aa, Staphylococcus epidermidis
YKQASLLRRIIVGLRGML

SEQ ID NO: 1737764 - protein, 20 aa, Staphylococcus epidermidis
YKWMLITTLITFTTILLFCL

SEQ ID NO: 1737765 - protein, 19 aa, Staphylococcus epidermidis
YLFGMSRYLTYILVLIATI

SEQ ID NO: 1737766 - protein, 20 aa, Staphylococcus epidermidis
YLTLDSFNLYFGVFMIFVSI

SEQ ID NO: 1737767 - protein, 20 aa, Staphylococcus epidermidis
YNLIKVIPYLLVLILALVGI

SEQ ID NO: 1737768 - protein, 24 aa, Staphylococcus epidermidis
YNRFSKGLFEWIGYETKVFQYENV

SEQ ID NO: 1737769 - protein, 25 aa, Staphylococcus epidermidis
YPEEYRYGFYITPYLNRVNGVFFGQ

SEQ ID NO: 1737770 - protein, 23 aa, Staphylococcus epidermidis
YQKSWFIILTLLFIFPLGLFLMW

SEQ ID NO: 1737771 - protein, 23 aa, Staphylococcus epidermidis
YQMNFGYLWELFVNHLLMSVYGV

SEQ ID NO: 1737772 - protein, 20 aa, Staphylococcus epidermidis
YRIIATIIVGIIKFGIPMLI

SEQ ID NO: 1737773 - protein, 21 aa, Staphylococcus epidermidis
YRKERMLKYLRELSEHYQILY

SEQ ID NO: 1737774 - protein, 20 aa, Staphylococcus epidermidis
YRYLNNRANLMSLWDVQDRL

SEQ ID NO: 1737775 - protein, 17 aa, Staphylococcus epidermidis
YSQPKVGVATSFSLSQL

SEQ ID NO: 1737776 - protein, 18 aa, Staphylococcus epidermidis
YTALIGVIVGCFVFPPFG

SEQ ID NO: 1737777 - protein, 18 aa, Staphylococcus epidermidis
YVFWELTSISSFLLISYW

SEQ ID NO: 1737778 - protein, 19 aa, Staphylococcus epidermidis
YWDVFKVLNPLTWSLIFLT

SEQ ID NO: 1737779 - protein, 30 aa, Staphylococcus epidermidis
YWSPMQGIPAWVWSCIFLIIIFALNSLSVR

SEQ ID NO: 1737780 - protein, 17 aa, Staphylococcus epidermidis
YYFCVAMVLVVALMFIG

SEQ ID NO: 1737781 - protein, 19 aa, Staphylococcus epidermidis
YYFNKDMKDLNLAEEAYLA

SEQ ID NO: 1737782 - protein, 17 aa, Staphylococcus epidermidis
YYLHPTIAKLFDIILTV

SEQ ID NO: 1737783 - protein, 18 aa, Staphylococcus epidermidis
YYLLRKNFSLAMPSLIEQ

SEQ ID NO: 1737784 - protein, 28 aa, Staphylococcus epidermidis
AAILIGFGAAFLFNWLIGQDKIPQSLMP

SEQ ID NO: 1737785 - protein, 17 aa, Staphylococcus epidermidis
AAVLRISLGSATVAAVS

SEQ ID NO: 1737786 - protein, 19 aa, Staphylococcus epidermidis
AERLFKNNRYKRAIEIAEE

SEQ ID NO: 1737787 - protein, 25 aa, Staphylococcus epidermidis
AETIPGEGFSGARIIRKEAQKMFRQ

SEQ ID NO: 1737788 - protein, 18 aa, Staphylococcus epidermidis
AFITFLFVGPVTRQLGYW

SEQ ID NO: 1737789 - protein, 18 aa, Staphylococcus epidermidis
AFTGYAILQLAQEGKINL

SEQ ID NO: 1737790 - protein, 19 aa, Staphylococcus epidermidis
AFTYIEALFALFVTTLILA

SEQ ID NO: 1737791 - protein, 18 aa, Staphylococcus epidermidis
AFVVRMTLIPALTKLFGK

SEQ ID NO: 1737792 - protein, 26 aa, Staphylococcus epidermidis
AGAHLWRYAVGFGALIAFVLYILRIK

SEQ ID NO: 1737793 - protein, 19 aa, Staphylococcus epidermidis
AGATVKPGTTPNQDAEVKP

SEQ ID NO: 1737794 - protein, 26 aa, Staphylococcus epidermidis
AGIFLLFRFTPLLGLSNVYIYTVTFV

SEQ ID NO: 1737795 - protein, 20 aa, Staphylococcus epidermidis
AGLASLAAACFLIRDGQMKG

SEQ ID NO: 1737796 - protein, 25 aa, Staphylococcus epidermidis
AGLVHKYYRGDHVEITLPVTDNTGG

SEQ ID NO: 1737797 - protein, 20 aa, Staphylococcus epidermidis
AGNGADWIVIAFGWGLAVTM

SEQ ID NO: 1737798 - protein, 19 aa, Staphylococcus epidermidis
AGPLFNFILALVLFIGLAY

SEQ ID NO: 1737799 - protein, 19 aa, Staphylococcus epidermidis
AGQIKTVFNMIDKAEFMSV

SEQ ID NO: 1737800 - protein, 25 aa, Staphylococcus epidermidis
AGTFSIMFPLTFKFGSENSNVIVMT

SEQ ID NO: 1737801 - protein, 22 aa, Staphylococcus epidermidis
AGYFKPFWPLAIINVFEEFTST

SEQ ID NO: 1737802 - protein, 24 aa, Staphylococcus epidermidis
AHQFGRKRILSIALLTLTVTSLGA

SEQ ID NO: 1737803 - protein, 25 aa, Staphylococcus epidermidis
AHWFGFPVPFRFSGFGFDVSSILVF

SEQ ID NO: 1737804 - protein, 18 aa, Staphylococcus epidermidis
AIAVIGIIIYHLNKQWLT

SEQ ID NO: 1737805 - protein, 20 aa, Staphylococcus epidermidis
AILVAIGWALIWKRQVHKHK

SEQ ID NO: 1737806 - protein, 23 aa, Staphylococcus epidermidis
AIMGGAWFVRYHYFKNNQLSLYQ

SEQ ID NO: 1737807 - protein, 25 aa, Staphylococcus epidermidis
AKELNEAMKALKTEINKKEQIKADS

SEQ ID NO: 1737808 - protein, 17 aa, Staphylococcus epidermidis
AKFLNGKMEELKVAVAK

SEQ ID NO: 1737809 - protein, 21 aa, Staphylococcus epidermidis
AKSNGIHEIELVMPDAHKKSD

SEQ ID NO: 1737810 - protein, 18 aa, Staphylococcus epidermidis
ALFSDSLATIVGSVFGTT

SEQ ID NO: 1737811 - protein, 25 aa, Staphylococcus epidermidis
ALIMFSVFIAFVFQDDSAIKSMGIA

SEQ ID NO: 1737812 - protein, 18 aa, Staphylococcus epidermidis
ALLIPFILMVLTAIALVV

SEQ ID NO: 1737813 - protein, 19 aa, Staphylococcus epidermidis
ALLVPISGLIFFFESNAFK

SEQ ID NO: 1737814 - protein, 25 aa, Staphylococcus epidermidis
ALMRKLKVPVFPIVARKAKGTHSLL

SEQ ID NO: 1737815 - protein, 23 aa, Staphylococcus epidermidis
ALSLVVFNHINFVTAAIAIILAP

SEQ ID NO: 1737816 - protein, 18 aa, Staphylococcus epidermidis
ALVSFIWFSVFGVLGIEA

SEQ ID NO: 1737817 - protein, 26 aa, Staphylococcus epidermidis
AMEMRRYLMRFVHHIGGLADFSALKF

SEQ ID NO: 1737818 - protein, 18 aa, Staphylococcus epidermidis
AMMTEAFVASNYAFAVIF

SEQ ID NO: 1737819 - protein, 17 aa, Staphylococcus epidermidis
ANEGYFFTVYVPYGNDW

SEQ ID NO: 1737820 - protein, 19 aa, Staphylococcus epidermidis
ANKGLPLPVILMNLKCFQN

SEQ ID NO: 1737821 - protein, 17 aa, Staphylococcus epidermidis
ANMITRWMGDSNLAPML

SEQ ID NO: 1737822 - protein, 20 aa, Staphylococcus epidermidis
ANPNNLGWFFILPPLVGMIV

SEQ ID NO: 1737823 - protein, 25 aa, Staphylococcus epidermidis
AQTKLKRIPTLITESKKHSNNPHSQ

SEQ ID NO: 1737824 - protein, 31 aa, Staphylococcus epidermidis
ARKRGKQGTGLGLFICKMIIEEHGGRIDVES

SEQ ID NO: 1737825 - protein, 19 aa, Staphylococcus epidermidis
ASAIDKLIKTAARIAEAID

SEQ ID NO: 1737826 - protein, 22 aa, Staphylococcus epidermidis
ASGRKTLPILLGKRASVIFMAI

SEQ ID NO: 1737827 - protein, 20 aa, Staphylococcus epidermidis
ASIESPILFVSIAVFSSLVF

SEQ ID NO: 1737828 - protein, 66 aa, Staphylococcus epidermidis
ASTDIQGGGVYRLFKLPDNVHRLKVQFLPMNEIHSDFKRIQQLHDGYRYYSFIDTIGVNSGSHLYV

SEQ ID NO: 1737829 - protein, 24 aa, Staphylococcus epidermidis
ATELNHAMEALRNSVQNVDQVKQS

SEQ ID NO: 1737830 - protein, 19 aa, Staphylococcus epidermidis
ATNEEKQIFVSKLKALINR

SEQ ID NO: 1737831 - protein, 23 aa, Staphylococcus epidermidis
ATPIAGFLVMFGFNSLTKVIIYG

SEQ ID NO: 1737832 - protein, 24 aa, Staphylococcus epidermidis
AVIIRNATDFIGWDIVDLKMSEQI

SEQ ID NO: 1737833 - protein, 22 aa, Staphylococcus epidermidis
AVITFIIWIIFVHPGQFEPALV

SEQ ID NO: 1737834 - protein, 31 aa, Staphylococcus epidermidis
AVNQYWPEHMDFRWAQGSGTPSSRNAGSFTK

SEQ ID NO: 1737835 - protein, 20 aa, Staphylococcus epidermidis
AVSITDFFQGVIMLIAMVMV

SEQ ID NO: 1737836 - protein, 20 aa, Staphylococcus epidermidis
CPLEGAIVVPLYIHNEVAGT

SEQ ID NO: 1737837 - protein, 27 aa, Staphylococcus epidermidis
CPVTSIAPLCFSMAMAERTGGSGNASS

SEQ ID NO: 1737838 - protein, 26 aa, Staphylococcus epidermidis
DAINHVKEQLSLVFNAIEKDRKDIQV

SEQ ID NO: 1737839 - protein, 20 aa, Staphylococcus epidermidis
DAKNEAERILGNDNPQVSQV

SEQ ID NO: 1737840 - protein, 44 aa, Staphylococcus epidermidis
DDDDSGFPPGTFFHASNRRWPYNLPRSRNILRASDVQGNAYITT

SEQ ID NO: 1737841 - protein, 20 aa, Staphylococcus epidermidis
DDKFCINCGHSLQQTLSNSN

SEQ ID NO: 1737842 - protein, 23 aa, Staphylococcus epidermidis
DDLFCGECGHKISRHPQSVRNAE

SEQ ID NO: 1737843 - protein, 26 aa, Staphylococcus epidermidis
DDTSQCPNCGQLLTKKKKRKIKDQSS

SEQ ID NO: 1737844 - protein, 24 aa, Staphylococcus epidermidis
DEHGKVKPYHLLKLSMKRQQYVLK

SEQ ID NO: 1737845 - protein, 22 aa, Staphylococcus epidermidis
DFGGWKAPFGIQFLGDSLSLLM

SEQ ID NO: 1737846 - protein, 19 aa, Staphylococcus epidermidis
DFLKFLGDYLFKEANKGLP

SEQ ID NO: 1737847 - protein, 22 aa, Staphylococcus epidermidis
DGAREIIGMGLNKLGYSLNDKN

SEQ ID NO: 1737848 - protein, 17 aa, Staphylococcus epidermidis
DGIALLVVMGVVLILLV

SEQ ID NO: 1737849 - protein, 19 aa, Staphylococcus epidermidis
DIPNFTLTLAVMIGLAVGI

SEQ ID NO: 1737850 - protein, 24 aa, Staphylococcus epidermidis
DITHLKHYIVWSIEPTMMRLGLHG

SEQ ID NO: 1737851 - protein, 27 aa, Staphylococcus epidermidis
DITKAVLMILMFIGRVGLISFIIMLAG

SEQ ID NO: 1737852 - protein, 27 aa, Staphylococcus epidermidis
DITLPYLKKAVIFSITFGFFGVNMAFA

SEQ ID NO: 1737853 - protein, 20 aa, Staphylococcus epidermidis
DLFSEILFFINIILALYYIY

SEQ ID NO: 1737854 - protein, 18 aa, Staphylococcus epidermidis
DLLQRLQQLLSHGFTLYQ

SEQ ID NO: 1737855 - protein, 30 aa, Staphylococcus epidermidis
DNVKAQAITAIKLINANAHKRQDAINILTN

SEQ ID NO: 1737856 - protein, 18 aa, Staphylococcus epidermidis
DQTPTGPVTFTIINRDGS

SEQ ID NO: 1737857 - protein, 19 aa, Staphylococcus epidermidis
DRLKGEFKNVGTVVQAYLY

SEQ ID NO: 1737858 - protein, 19 aa, Staphylococcus epidermidis
DSEKKLAYDNAVSQAEQLI

SEQ ID NO: 1737859 - protein, 20 aa, Staphylococcus epidermidis
DSIYRTGISKVLYRSLPDKN

SEQ ID NO: 1737860 - protein, 17 aa, Staphylococcus epidermidis
DTFKSIPGHGIKATIHQ

SEQ ID NO: 1737861 - protein, 26 aa, Staphylococcus epidermidis
DTYKRLRFQVFLGIFIGYAGYYLLRK

SEQ ID NO: 1737862 - protein, 22 aa, Staphylococcus epidermidis
DVLFKALMLYARENNKGVYDRY

SEQ ID NO: 1737863 - protein, 17 aa, Staphylococcus epidermidis
DVRLVILHSEYRSIIRP

SEQ ID NO: 1737864 - protein, 21 aa, Staphylococcus epidermidis
EADQIFLLPFERHMKNYINAS

SEQ ID NO: 1737865 - protein, 17 aa, Staphylococcus epidermidis
EAEDLIHNHPDTLDHKA

SEQ ID NO: 1737866 - protein, 20 aa, Staphylococcus epidermidis
EARNRLESKINETVQTDGMT

SEQ ID NO: 1737867 - protein, 24 aa, Staphylococcus epidermidis
EEERQIALNKVKAIVDDANEKIRE

SEQ ID NO: 1737868 - protein, 23 aa, Staphylococcus epidermidis
EEHQWDYVVCLTDLPSISDNKVV

SEQ ID NO: 1737869 - protein, 20 aa, Staphylococcus epidermidis
EELLELYPNMYINVDLKDAP

SEQ ID NO: 1737870 - protein, 21 aa, Staphylococcus epidermidis
EFDLNLAYENMREILLKADKN

SEQ ID NO: 1737871 - protein, 21 aa, Staphylococcus epidermidis
EFSDGSLIKYTEMKWLTPDGH

SEQ ID NO: 1737872 - protein, 20 aa, Staphylococcus epidermidis
EGTWPNLLFKSLSLSMIIVF

SEQ ID NO: 1737873 - protein, 20 aa, Staphylococcus epidermidis
EGYFFTVYVPYGNDWFAYFM

SEQ ID NO: 1737874 - protein, 26 aa, Staphylococcus epidermidis
EHHPELKISAIIGIVFMTMLLFIFLI

SEQ ID NO: 1737875 - protein, 19 aa, Staphylococcus epidermidis
EHLKQVFDRFYKVDAARKR

SEQ ID NO: 1737876 - protein, 20 aa, Staphylococcus epidermidis
EIHQKAEVIRGLINDNEEAT

SEQ ID NO: 1737877 - protein, 20 aa, Staphylococcus epidermidis
EIIQMGCILLFTNNLHHAIT

SEQ ID NO: 1737878 - protein, 20 aa, Staphylococcus epidermidis
EINSAMSNLRDGIQNKEDIK

SEQ ID NO: 1737879 - protein, 21 aa, Staphylococcus epidermidis
EIQAHKKLEAKAYIDGYSDDK

SEQ ID NO: 1737880 - protein, 25 aa, Staphylococcus epidermidis
EKDEAKRLLEISKNKTITNINQAQT

SEQ ID NO: 1737881 - protein, 19 aa, Staphylococcus epidermidis
EKKNILGYILWVGVLFIFT

SEQ ID NO: 1737882 - protein, 25 aa, Staphylococcus epidermidis
EKKRLKWGSLLFHLGIIPVFFGHVV

SEQ ID NO: 1737883 - protein, 19 aa, Staphylococcus epidermidis
EKLKSIQIREDKILSSQRS

SEQ ID NO: 1737884 - protein, 26 aa, Staphylococcus epidermidis
EKNKGIGTIRDIQPLVVKKPTAKSKI

SEQ ID NO: 1737885 - protein, 19 aa, Staphylococcus epidermidis
ELLHLPSPLTTTISFVVSF

SEQ ID NO: 1737886 - protein, 22 aa, Staphylococcus epidermidis
ELSKFYILVLFAGLFHLMNHAV

SEQ ID NO: 1737887 - protein, 20 aa, Staphylococcus epidermidis
ELTYKVTLPENFEYVDNSTE

SEQ ID NO: 1737888 - protein, 20 aa, Staphylococcus epidermidis
ELVSFGAIFLYYPTHFNIHF

SEQ ID NO: 1737889 - protein, 25 aa, Staphylococcus epidermidis
ELVVSYLNWQWVYFILTILYLILVL

SEQ ID NO: 1737890 - protein, 19 aa, Staphylococcus epidermidis
ENFPRLFTHDSHIPNFITI

SEQ ID NO: 1737891 - protein, 25 aa, Staphylococcus epidermidis
ENSLKNKLTEFFTGYATAMNSAFNM

SEQ ID NO: 1737892 - protein, 26 aa, Staphylococcus epidermidis
EQLDEFFNKFVFHGRIQYNVDDLQDI

SEQ ID NO: 1737893 - protein, 23 aa, Staphylococcus epidermidis
EQLWNIGKNSAFALIIPILAGFI

SEQ ID NO: 1737894 - protein, 17 aa, Staphylococcus epidermidis
ERMAGRVFEHFNGLYRF

SEQ ID NO: 1737895 - protein, 19 aa, Staphylococcus epidermidis
ERPEEIQQFIGYIPESYEF

SEQ ID NO: 1737896 - protein, 20 aa, Staphylococcus epidermidis
ESGMPIESLIQIPSKTFNKY

SEQ ID NO: 1737897 - protein, 27 aa, Staphylococcus epidermidis
ETISVPSLIGMLMLIGIVVTNAIVLID

SEQ ID NO: 1737898 - protein, 27 aa, Staphylococcus epidermidis
ETLFMKYRFWLPFIISSIIFSSQHLST

SEQ ID NO: 1737899 - protein, 24 aa, Staphylococcus epidermidis
ETPLRKEGLKAFTFKKTYKPQFIR

SEQ ID NO: 1737900 - protein, 21 aa, Staphylococcus epidermidis
EVAGWNLLLFIVFRSISGIVL

SEQ ID NO: 1737901 - protein, 19 aa, Staphylococcus epidermidis
FAKGKRLNHVPGETFEYSN

SEQ ID NO: 1737902 - protein, 17 aa, Staphylococcus epidermidis
FCAIGGIVATIVLPSIL

SEQ ID NO: 1737903 - protein, 26 aa, Staphylococcus epidermidis
FDNLNSGNYIVHFDKPSGMTQTTTDS

SEQ ID NO: 1737904 - protein, 23 aa, Staphylococcus epidermidis
FESIKEIILLFLNSHQDYKMNKK

SEQ ID NO: 1737905 - protein, 18 aa, Staphylococcus epidermidis
FFFVAVTLHGIWDTEITL

SEQ ID NO: 1737906 - protein, 19 aa, Staphylococcus epidermidis
FFITYKFYYYLPIEKKLKS

SEQ ID NO: 1737907 - protein, 17 aa, Staphylococcus epidermidis
FFVPNVFGNFVILPATR

SEQ ID NO: 1737908 - protein, 20 aa, Staphylococcus epidermidis
FGFHEGRLSWIFYVAMIIFT

SEQ ID NO: 1737909 - protein, 20 aa, Staphylococcus epidermidis
FGGLIKGYPILGWTFFIAAL

SEQ ID NO: 1737910 - protein, 17 aa, Staphylococcus epidermidis
FGKKFSKVFDYILVFFL

SEQ ID NO: 1737911 - protein, 25 aa, Staphylococcus epidermidis
FGNIDSPYIIKVISKYDPNKDDYTT

SEQ ID NO: 1737912 - protein, 17 aa, Staphylococcus epidermidis
FGPKKILIFGLICLVVT

SEQ ID NO: 1737913 - protein, 27 aa, Staphylococcus epidermidis
FGSGAPLPQFWRSAGAINSSVANDFKH

SEQ ID NO: 1737914 - protein, 17 aa, Staphylococcus epidermidis
FHMIWHIFIVLASFLHM

SEQ ID NO: 1737915 - protein, 26 aa, Staphylococcus epidermidis
FHNIICGWCFIVLMFALPIYLSYHVS

SEQ ID NO: 1737916 - protein, 19 aa, Staphylococcus epidermidis
FHNYLAFLIMIILFVIYLV

SEQ ID NO: 1737917 - protein, 21 aa, Staphylococcus epidermidis
FIKFNLIEFVLLRLIPTLIIN

SEQ ID NO: 1737918 - protein, 17 aa, Staphylococcus epidermidis
FIKSTMILMLLYIIMSL

SEQ ID NO: 1737919 - protein, 19 aa, Staphylococcus epidermidis
FILFPSVIIYFILIHFFQH

SEQ ID NO: 1737920 - protein, 19 aa, Staphylococcus epidermidis
FISVISILFGIEYILLSLT

SEQ ID NO: 1737921 - protein, 18 aa, Staphylococcus epidermidis
FKAIQRLRNGTVSVTDVM

SEQ ID NO: 1737922 - protein, 25 aa, Staphylococcus epidermidis
FKASRRFSGLLARVESQDMASSIIM

SEQ ID NO: 1737923 - protein, 18 aa, Staphylococcus epidermidis
FKAYARNAVTEFRNSEKL

SEQ ID NO: 1737924 - protein, 23 aa, Staphylococcus epidermidis
FKDAHSFAVILAMGLVLYMVTII

SEQ ID NO: 1737925 - protein, 25 aa, Staphylococcus epidermidis
FKGSGDVSYRISFKTQGAPTARLYY

SEQ ID NO: 1737926 - protein, 25 aa, Staphylococcus epidermidis
FKISKLAGLMSFIWVTINDVIDYIY

SEQ ID NO: 1737927 - protein, 26 aa, Staphylococcus epidermidis
FKNKTWINIISWLLIIVLSGLNVYLI

SEQ ID NO: 1737928 - protein, 23 aa, Staphylococcus epidermidis
FKNMILVVFCYFMMLFFSIAPFQ

SEQ ID NO: 1737929 - protein, 23 aa, Staphylococcus epidermidis
FKQLEHIIKIFAIIISIIMMIGF

SEQ ID NO: 1737930 - protein, 23 aa, Staphylococcus epidermidis
FKRKQIHEPWLFSLPAVILMLLI

SEQ ID NO: 1737931 - protein, 20 aa, Staphylococcus epidermidis
FKSIPGHGIKATIHQQQILV

SEQ ID NO: 1737932 - protein, 18 aa, Staphylococcus epidermidis
FLAGVSFLLSSYYVYRKR

SEQ ID NO: 1737933 - protein, 17 aa, Staphylococcus epidermidis
FLAVYLYQLITSSISTI

SEQ ID NO: 1737934 - protein, 20 aa, Staphylococcus epidermidis
FLGGLSYTIGAWFYAQKNKP

SEQ ID NO: 1737935 - protein, 19 aa, Staphylococcus epidermidis
FLIGLVLMSVLFFNNLGMV

SEQ ID NO: 1737936 - protein, 18 aa, Staphylococcus epidermidis
FLILCIGIVVVLISVKKN

SEQ ID NO: 1737937 - protein, 19 aa, Staphylococcus epidermidis
FLISICFIFAPFVLLFYSV

SEQ ID NO: 1737938 - protein, 19 aa, Staphylococcus epidermidis
FLIVCEFFYGIPFLGGSVI

SEQ ID NO: 1737939 - protein, 18 aa, Staphylococcus epidermidis
FLIVRPPIEFIRQYLAQW

SEQ ID NO: 1737940 - protein, 18 aa, Staphylococcus epidermidis
FLMGCVLYLAYNRRRNIK

SEQ ID NO: 1737941 - protein, 27 aa, Staphylococcus epidermidis
FLTIVGAFLFFRSSVSLIFKTLKHIKH

SEQ ID NO: 1737942 - protein, 20 aa, Staphylococcus epidermidis
FLVTFCLSINLPIAPEEALL

SEQ ID NO: 1737943 - protein, 19 aa, Staphylococcus epidermidis
FLVVFCWQPIHFYALAIKR

SEQ ID NO: 1737944 - protein, 34 aa, Staphylococcus epidermidis
FMERRTANSIWAWLLVLVFLPLVGFILYLLLGRQ

SEQ ID NO: 1737945 - protein, 17 aa, Staphylococcus epidermidis
FMIVFLFIISATVIGVF

SEQ ID NO: 1737946 - protein, 21 aa, Staphylococcus epidermidis
FNIGMGWIVPAFFGFIIGIIV

SEQ ID NO: 1737947 - protein, 21 aa, Staphylococcus epidermidis
FNMNDFNFISSYFKKNSSIYT

SEQ ID NO: 1737948 - protein, 21 aa, Staphylococcus epidermidis
FNTSICLPQIVASIVSFGLYP

SEQ ID NO: 1737949 - protein, 19 aa, Staphylococcus epidermidis
FRLNVSYILSKIGKNVYPL

SEQ ID NO: 1737950 - protein, 19 aa, Staphylococcus epidermidis
FRLQCIGFIVFILLFMFAN

SEQ ID NO: 1737951 - protein, 23 aa, Staphylococcus epidermidis
FRPDFSKKRNAVAEIVKAQQNKI

SEQ ID NO: 1737952 - protein, 22 aa, Staphylococcus epidermidis
FRPLPIYRKGLLSVLVVVVLAM

SEQ ID NO: 1737953 - protein, 27 aa, Staphylococcus epidermidis
FRTAIFNYWWMFAISFIFFIIAGLLTI

SEQ ID NO: 1737954 - protein, 20 aa, Staphylococcus epidermidis
FRVLGRPAGFIVTFLDIFKG

SEQ ID NO: 1737955 - protein, 17 aa, Staphylococcus epidermidis
FSFKDIKYLPLIPFIFL

SEQ ID NO: 1737956 - protein, 22 aa, Staphylococcus epidermidis
FSHRGMALITFIWIMITFIHAI

SEQ ID NO: 1737957 - protein, 32 aa, Staphylococcus epidermidis
FSIRKFNIGIFSALIATVAFLAHPGQATASEL

SEQ ID NO: 1737958 - protein, 26 aa, Staphylococcus epidermidis
FSISIFSIVVSIVFIRLKNIRKRKMR

SEQ ID NO: 1737959 - protein, 19 aa, Staphylococcus epidermidis
FSKVFDYILVFFLFGIAVT

SEQ ID NO: 1737960 - protein, 25 aa, Staphylococcus epidermidis
FSLFRLEVDLTFIAAVLTIVGYSIN

SEQ ID NO: 1737961 - protein, 18 aa, Staphylococcus epidermidis
FSPLVLYSLYWKDLTRAG

SEQ ID NO: 1737962 - protein, 19 aa, Staphylococcus epidermidis
FSVVTRSKWIGTLVTLVII

SEQ ID NO: 1737963 - protein, 19 aa, Staphylococcus epidermidis
FTPLSAYAFMIFILLYVPC

SEQ ID NO: 1737964 - protein, 17 aa, Staphylococcus epidermidis
FVIGAPISNIFGALTSW

SEQ ID NO: 1737965 - protein, 17 aa, Staphylococcus epidermidis
FVPLLFLGRYTNMIYTL

SEQ ID NO: 1737966 - protein, 18 aa, Staphylococcus epidermidis
FVYLCMYLLIVVIASYSK

SEQ ID NO: 1737967 - protein, 26 aa, Staphylococcus epidermidis
FWQISVVQFFNWFALMYLWTYSTGAI

SEQ ID NO: 1737968 - protein, 18 aa, Staphylococcus epidermidis
FYGHLGLLAIIIIACMFN

SEQ ID NO: 1737969 - protein, 17 aa, Staphylococcus epidermidis
FYKNPDFKKVNPGKYEY

SEQ ID NO: 1737970 - protein, 20 aa, Staphylococcus epidermidis
FYVAAFFRFVLVMIGVLSSS

SEQ ID NO: 1737971 - protein, 22 aa, Staphylococcus epidermidis
GASPLQIIRYFLLPEALGSLIL

SEQ ID NO: 1737972 - protein, 24 aa, Staphylococcus epidermidis
GAVSASFKWYDFVYFIDTIIYLAI

SEQ ID NO: 1737973 - protein, 17 aa, Staphylococcus epidermidis
GDIITGIDGKQIKDDTD

SEQ ID NO: 1737974 - protein, 23 aa, Staphylococcus epidermidis
GDMHYRKYFPFFTLITAFASLAW

SEQ ID NO: 1737975 - protein, 22 aa, Staphylococcus epidermidis
GEIKFSNWQWFISIASIVVLFI

SEQ ID NO: 1737976 - protein, 21 aa, Staphylococcus epidermidis
GELMSRFKIIYIAVVGVLLFA

SEQ ID NO: 1737977 - protein, 25 aa, Staphylococcus epidermidis
GEVAEGFIKFNGMLGHTFKPQADTF

SEQ ID NO: 1737978 - protein, 33 aa, Staphylococcus epidermidis
GEVIKQHWIPVAVVLMSLGGALIFMARRKKHQN

SEQ ID NO: 1737979 - protein, 21 aa, Staphylococcus epidermidis
GEVPMTVKLAYYIAAAVLLIA

SEQ ID NO: 1737980 - protein, 25 aa, Staphylococcus epidermidis
GFVIGWTYWVCWIVSSMSDLTAMGQ

SEQ ID NO: 1737981 - protein, 20 aa, Staphylococcus epidermidis
GIAFKEAIIQKGIYDRGASF

SEQ ID NO: 1737982 - protein, 23 aa, Staphylococcus epidermidis
GIALGFGVLFDAFVVRMTLIPAL

SEQ ID NO: 1737983 - protein, 17 aa, Staphylococcus epidermidis
GIFAFFLLTVFTITLKT

SEQ ID NO: 1737984 - protein, 19 aa, Staphylococcus epidermidis
GIFSQWLASRIKWPSIVVM

SEQ ID NO: 1737985 - protein, 20 aa, Staphylococcus epidermidis
GIIAAIAFLILCIGIVVVLI

SEQ ID NO: 1737986 - protein, 23 aa, Staphylococcus epidermidis
GIIPILISMIILLSFISTHVLAQ

SEQ ID NO: 1737987 - protein, 17 aa, Staphylococcus epidermidis
GILKMFFYSSVGAGFLG

SEQ ID NO: 1737988 - protein, 31 aa, Staphylococcus epidermidis
GIPIAACGLLAPWIAGAAMALSSVSVVMNAL

SEQ ID NO: 1737989 - protein, 25 aa, Staphylococcus epidermidis
GISKAGSVFPILSPILGWIGVFMTG

SEQ ID NO: 1737990 - protein, 20 aa, Staphylococcus epidermidis
GISVAYIYSLYAFYMNNFSS

SEQ ID NO: 1737991 - protein, 27 aa, Staphylococcus epidermidis
GKFIAKNKWLSVIGWLVILGVIITPLM

SEQ ID NO: 1737992 - protein, 20 aa, Staphylococcus epidermidis
GKINRLWLVLLFAGGGLSLI

SEQ ID NO: 1737993 - protein, 22 aa, Staphylococcus epidermidis
GKKSLLKRRLINIKEANLKKQS

SEQ ID NO: 1737994 - protein, 24 aa, Staphylococcus epidermidis
GKVFGCLGIALAMYATTPKENRKK

SEQ ID NO: 1737995 - protein, 23 aa, Staphylococcus epidermidis
GLAGRKQGPAFLHRTNKHGVPHY

SEQ ID NO: 1737996 - protein, 20 aa, Staphylococcus epidermidis
GLDGLRAIAVIGIIIYHLNK

SEQ ID NO: 1737997 - protein, 19 aa, Staphylococcus epidermidis
GLEGAAFAIVGWVGIKLVI

SEQ ID NO: 1737998 - protein, 26 aa, Staphylococcus epidermidis
GLGAMWKFPYMAGIYGGGAFLLMFLI

SEQ ID NO: 1737999 - protein, 19 aa, Staphylococcus epidermidis
GLICLVVTQLLYFIPGSVW

SEQ ID NO: 1738000 - protein, 18 aa, Staphylococcus epidermidis
GLLSISVVLNAIFKDATK

SEQ ID NO: 1738001 - protein, 57 aa, Staphylococcus epidermidis
GLNLGRSAQDVARFLPNKILNIRYKLRPVNISTPREVTFNEAIKYKTFSEYYINTND

SEQ ID NO: 1738002 - protein, 19 aa, Staphylococcus epidermidis
GLSILRFLISVGIVLLCIY

SEQ ID NO: 1738003 - protein, 22 aa, Staphylococcus epidermidis
GMGWPPSGRVLVHWFSVSERGS

SEQ ID NO: 1738004 - protein, 17 aa, Staphylococcus epidermidis
GMIVVSNNNFKDDFEKN

SEQ ID NO: 1738005 - protein, 25 aa, Staphylococcus epidermidis
GMTKWDIFKKYILGNPVIWILCISN

SEQ ID NO: 1738006 - protein, 17 aa, Staphylococcus epidermidis
GMTPFYTALSIWVGGLL

SEQ ID NO: 1738007 - protein, 24 aa, Staphylococcus epidermidis
GNQTRISSFYGVIIYIIILFLFIR

SEQ ID NO: 1738008 - protein, 19 aa, Staphylococcus epidermidis
GPILIKLLFAVVLSIVGTF

SEQ ID NO: 1738009 - protein, 18 aa, Staphylococcus epidermidis
GPIPISWTPFGELFSGLF

SEQ ID NO: 1738010 - protein, 21 aa, Staphylococcus epidermidis
GPKDFVFRVLSGVAIGIVAGL

SEQ ID NO: 1738011 - protein, 32 aa, Staphylococcus epidermidis
GPLLGGAILEFASWHWLFYINIPIAIVAIILV

SEQ ID NO: 1738012 - protein, 17 aa, Staphylococcus epidermidis
GPNGINTVITFDDLGIK

SEQ ID NO: 1738013 - protein, 21 aa, Staphylococcus epidermidis
GQEVMQFFTPFGLWSYIGVII

SEQ ID NO: 1738014 - protein, 26 aa, Staphylococcus epidermidis
GQIIARIGPIKVLRIILLINAMALVL

SEQ ID NO: 1738015 - protein, 18 aa, Staphylococcus epidermidis
GQIPGVLALFVLTICIIG

SEQ ID NO: 1738016 - protein, 18 aa, Staphylococcus epidermidis
GQNLDFNAIDTFKDDIFK

SEQ ID NO: 1738017 - protein, 24 aa, Staphylococcus epidermidis
GRDLTLHAEIFFDGETTPIRKDTT

SEQ ID NO: 1738018 - protein, 23 aa, Staphylococcus epidermidis
GRLQSFKVIFAIIITLVTVIGTY

SEQ ID NO: 1738019 - protein, 19 aa, Staphylococcus epidermidis
GRLSWIFYVAMIIFTIMIL

SEQ ID NO: 1738020 - protein, 24 aa, Staphylococcus epidermidis
GSFLKRYTNTYSRDEEKLIQSVSK

SEQ ID NO: 1738021 - protein, 18 aa, Staphylococcus epidermidis
GSGKSVCINGIITSILLN

SEQ ID NO: 1738022 - protein, 19 aa, Staphylococcus epidermidis
GSIDSVYDPLSYVKNVTGT

SEQ ID NO: 1738023 - protein, 17 aa, Staphylococcus epidermidis
GSLVTSIIFGIILFLVV

SEQ ID NO: 1738024 - protein, 22 aa, Staphylococcus epidermidis
GSVNFAEDWSFWGIKYGLFIQS

SEQ ID NO: 1738025 - protein, 27 aa, Staphylococcus epidermidis
GTINLKNFWIRRIKRLLPAVFALIVVV

SEQ ID NO: 1738026 - protein, 18 aa, Staphylococcus epidermidis
GTMGSIIVLRGLSLMGDA

SEQ ID NO: 1738027 - protein, 19 aa, Staphylococcus epidermidis
GVLMKDMFEKMNVSKSVLS

SEQ ID NO: 1738028 - protein, 22 aa, Staphylococcus epidermidis
GVLYCIQFLSSVIFGFVIARSK

SEQ ID NO: 1738029 - protein, 24 aa, Staphylococcus epidermidis
GVNPEYYAVVDFTGFEKMIDELQP

SEQ ID NO: 1738030 - protein, 27 aa, Staphylococcus epidermidis
GVQNMLKWGALVAIGFIIVATFMFMLD

SEQ ID NO: 1738031 - protein, 19 aa, Staphylococcus epidermidis
GVTLFKLVPEYMFINQMII

SEQ ID NO: 1738032 - protein, 24 aa, Staphylococcus epidermidis
GYFVPIVVSIAVITFIIWIIFVHP

SEQ ID NO: 1738033 - protein, 18 aa, Staphylococcus epidermidis
GYIKEIKPLSIISVGFLL

SEQ ID NO: 1738034 - protein, 20 aa, Staphylococcus epidermidis
HALPWISFIVHYSFSIAIAI

SEQ ID NO: 1738035 - protein, 19 aa, Staphylococcus epidermidis
HANPTRKSDALQELQTKFI

SEQ ID NO: 1738036 - protein, 22 aa, Staphylococcus epidermidis
HASMTFALVFLFSEETGDLFSM

SEQ ID NO: 1738037 - protein, 18 aa, Staphylococcus epidermidis
HFPSLKRVAQYNAENHDS

SEQ ID NO: 1738038 - protein, 25 aa, Staphylococcus epidermidis
HGLKNRLTLVVIVIFIIFLILLFMF

SEQ ID NO: 1738039 - protein, 25 aa, Staphylococcus epidermidis
HHGNFKVKFFVSLIFAIPIILLSPL

SEQ ID NO: 1738040 - protein, 24 aa, Staphylococcus epidermidis
HILMAFVVEFGFRSYLQNILETRM

SEQ ID NO: 1738041 - protein, 18 aa, Staphylococcus epidermidis
HIYQGEALGIIGEPGSSK

SEQ ID NO: 1738042 - protein, 20 aa, Staphylococcus epidermidis
HKDSFFKLAITNVGGDLHTL

SEQ ID NO: 1738043 - protein, 24 aa, Staphylococcus epidermidis
HKIYFCINLILPIFFLSGIFIMLS

SEQ ID NO: 1738044 - protein, 20 aa, Staphylococcus epidermidis
HKSMLFFIAFVIYIMVFIAL

SEQ ID NO: 1738045 - protein, 19 aa, Staphylococcus epidermidis
HKVEQIIQWAHLGDYIEEK

SEQ ID NO: 1738046 - protein, 26 aa, Staphylococcus epidermidis
HKYGFKRNYLCFVFIFLIGSILGLLS

SEQ ID NO: 1738047 - protein, 23 aa, Staphylococcus epidermidis
HLAMPQHAYDEWFEQIRNDKSQF

SEQ ID NO: 1738048 - protein, 17 aa, Staphylococcus epidermidis
HLDRIRLSFFTYHRSDT

SEQ ID NO: 1738049 - protein, 21 aa, Staphylococcus epidermidis
HLPNRALVILTIIGVVIGSMF

SEQ ID NO: 1738050 - protein, 22 aa, Staphylococcus epidermidis
HNTEGQPAVTTGEQAGGKPAAT

SEQ ID NO: 1738051 - protein, 20 aa, Staphylococcus epidermidis
HPQTKATGRHRLNEKANQQQ

SEQ ID NO: 1738052 - protein, 17 aa, Staphylococcus epidermidis
HQQPAILYYDLKGSSQS

SEQ ID NO: 1738053 - protein, 21 aa, Staphylococcus epidermidis
HRQIPIKTIKGVKVALLSYTF

SEQ ID NO: 1738054 - protein, 20 aa, Staphylococcus epidermidis
HSKFDARLREKDVANHIVQT

SEQ ID NO: 1738055 - protein, 23 aa, Staphylococcus epidermidis
HTWNKFKDQVLFTGVYESEQAHR

SEQ ID NO: 1738056 - protein, 19 aa, Staphylococcus epidermidis
HVLPVLGLILCLFATIPGI

SEQ ID NO: 1738057 - protein, 26 aa, Staphylococcus epidermidis
HVSFPKRVFTALAIGIVFGIVLHLIY

SEQ ID NO: 1738058 - protein, 22 aa, Staphylococcus epidermidis
HYSGVFIYKDLKSIEDTNNAIT

SEQ ID NO: 1738059 - protein, 18 aa, Staphylococcus epidermidis
IAGIFPKAFGMYAQSVYD

SEQ ID NO: 1738060 - protein, 17 aa, Staphylococcus epidermidis
IAISSLVFCILLIIHHF

SEQ ID NO: 1738061 - protein, 22 aa, Staphylococcus epidermidis
IANGIGVKGSFGLDQILGVFMY

SEQ ID NO: 1738062 - protein, 28 aa, Staphylococcus epidermidis
IATAMLIFRRKFTKEQRGSIVPNYVMGL

SEQ ID NO: 1738063 - protein, 17 aa, Staphylococcus epidermidis
ICVAYWALNSIKLDQFF

SEQ ID NO: 1738064 - protein, 17 aa, Staphylococcus epidermidis
IDIKADFFVPNHVQVKS

SEQ ID NO: 1738065 - protein, 21 aa, Staphylococcus epidermidis
IDKKIAKKVFNNQAMGQSIYI

SEQ ID NO: 1738066 - protein, 20 aa, Staphylococcus epidermidis
IDLYLSIPWFAASISTVAGA

SEQ ID NO: 1738067 - protein, 17 aa, Staphylococcus epidermidis
IDSLKFINKAQFTHAND

SEQ ID NO: 1738068 - protein, 17 aa, Staphylococcus epidermidis
IEEAKIEAKDNIQRNST

SEQ ID NO: 1738069 - protein, 22 aa, Staphylococcus epidermidis
IEGLKPTLIYPLLSVSITGLLM

SEQ ID NO: 1738070 - protein, 25 aa, Staphylococcus epidermidis
IENVFAWPGLGPLSIKAITEHDFPV

SEQ ID NO: 1738071 - protein, 24 aa, Staphylococcus epidermidis
IETVKRTDFEEIDQFDPKRFTLNK

SEQ ID NO: 1738072 - protein, 32 aa, Staphylococcus epidermidis
IFALIIPFLYRFVKRIHLGWFVLPVPIVLFIY

SEQ ID NO: 1738073 - protein, 18 aa, Staphylococcus epidermidis
IFCVLLIGLLILPETSIT

SEQ ID NO: 1738074 - protein, 22 aa, Staphylococcus epidermidis
IFDFILRYMERLSYKKLLISLG

SEQ ID NO: 1738075 - protein, 17 aa, Staphylococcus epidermidis
IGAFLLYLPYTGKKPIN

SEQ ID NO: 1738076 - protein, 20 aa, Staphylococcus epidermidis
IGALVPLLFGHDSSILISKG

SEQ ID NO: 1738077 - protein, 21 aa, Staphylococcus epidermidis
IGAPISNIFGALTSWLKGMQG

SEQ ID NO: 1738078 - protein, 17 aa, Staphylococcus epidermidis
IGFLGSMLYLLLKKPLK

SEQ ID NO: 1738079 - protein, 18 aa, Staphylococcus epidermidis
IGHTRWATHGVPNYENSH

SEQ ID NO: 1738080 - protein, 19 aa, Staphylococcus epidermidis
IGMVIHWILFFLMIFFVFI

SEQ ID NO: 1738081 - protein, 19 aa, Staphylococcus epidermidis
IGSMFPFAFLAQLISAGTL

SEQ ID NO: 1738082 - protein, 26 aa, Staphylococcus epidermidis
IGVFFLFKYVKHWIRNEMILRFIKST

SEQ ID NO: 1738083 - protein, 26 aa, Staphylococcus epidermidis
IHQLDPRAKLIFVFFFILLIFFCHSL

SEQ ID NO: 1738084 - protein, 22 aa, Staphylococcus epidermidis
IIAIVIGLFWFKLYQSTTNPKA

SEQ ID NO: 1738085 - protein, 17 aa, Staphylococcus epidermidis
IICRCIMGFAIGMDSPV

SEQ ID NO: 1738086 - protein, 18 aa, Staphylococcus epidermidis
IIFYRPLMISTFDATFSR

SEQ ID NO: 1738087 - protein, 21 aa, Staphylococcus epidermidis
IIGGIGWVLAKVTRQPKFESF

SEQ ID NO: 1738088 - protein, 22 aa, Staphylococcus epidermidis
IIGMALVRFRLTLMRRGIENIN

SEQ ID NO: 1738089 - protein, 18 aa, Staphylococcus epidermidis
IIGTMALTLGILFIGVNK

SEQ ID NO: 1738090 - protein, 33 aa, Staphylococcus epidermidis
IIIARIVSIVLRLCLYYILIFGIINYFVRRGDK

SEQ ID NO: 1738091 - protein, 23 aa, Staphylococcus epidermidis
IIIGFLFVCKEVFYPESKNLNNK

SEQ ID NO: 1738092 - protein, 17 aa, Staphylococcus epidermidis
IILITFFIGYTIHPING

SEQ ID NO: 1738093 - protein, 24 aa, Staphylococcus epidermidis
IILKPRIENKPGFFVYETELERDW

SEQ ID NO: 1738094 - protein, 21 aa, Staphylococcus epidermidis
IIPIILCIIGFKSDKLIATMI

SEQ ID NO: 1738095 - protein, 21 aa, Staphylococcus epidermidis
IITAFFKPAGSLFYLLVLLSF

SEQ ID NO: 1738096 - protein, 18 aa, Staphylococcus epidermidis
IIVSCILNPVSVEEQEDV

SEQ ID NO: 1738097 - protein, 17 aa, Staphylococcus epidermidis
IIYYIFGAIIAFLIMII

SEQ ID NO: 1738098 - protein, 17 aa, Staphylococcus epidermidis
IKADFFVPNHVQVKSLT

SEQ ID NO: 1738099 - protein, 26 aa, Staphylococcus epidermidis
IKAVQPELDKAIAMLKNKENNNALVQ

SEQ ID NO: 1738100 - protein, 22 aa, Staphylococcus epidermidis
IKEDARAAVEAKAIAQNQQINS

SEQ ID NO: 1738101 - protein, 20 aa, Staphylococcus epidermidis
IKFHVWRVAIQTDKHDYVGV

SEQ ID NO: 1738102 - protein, 22 aa, Staphylococcus epidermidis
IKILFEVVSAFGTVGLTMDLTS

SEQ ID NO: 1738103 - protein, 22 aa, Staphylococcus epidermidis
IKKELRLSEKLSDELVVESIST

SEQ ID NO: 1738104 - protein, 18 aa, Staphylococcus epidermidis
IKNKDWRIKTKHRKNKDI

SEQ ID NO: 1738105 - protein, 17 aa, Staphylococcus epidermidis
IKSMMWTTIPASIIGLA

SEQ ID NO: 1738106 - protein, 21 aa, Staphylococcus epidermidis
IKWAESNANIIADFYKNMKTE

SEQ ID NO: 1738107 - protein, 19 aa, Staphylococcus epidermidis
IKYLPLIPFIFLSFVVTSS

SEQ ID NO: 1738108 - protein, 19 aa, Staphylococcus epidermidis
ILDRICIRKPGTYEFNDYQ

SEQ ID NO: 1738109 - protein, 24 aa, Staphylococcus epidermidis
ILGKGWKLLLIDIIVIIFSISLTL

SEQ ID NO: 1738110 - protein, 19 aa, Staphylococcus epidermidis
ILHVVCICVAYWALNSIKL

SEQ ID NO: 1738111 - protein, 25 aa, Staphylococcus epidermidis
ILIGIICVINYALVRHIAFDKYQNQ

SEQ ID NO: 1738112 - protein, 25 aa, Staphylococcus epidermidis
ILLISCTFLLCFLKVDTSYTYLIVI

SEQ ID NO: 1738113 - protein, 21 aa, Staphylococcus epidermidis
ILLLVVMYFLLIRPQQKRAKE

SEQ ID NO: 1738114 - protein, 23 aa, Staphylococcus epidermidis
ILLMCLPLGIGLYLMQLFYYEPR

SEQ ID NO: 1738115 - protein, 26 aa, Staphylococcus epidermidis
ILMVLTAIALVVVWFIFNQLVAGIAT

SEQ ID NO: 1738116 - protein, 17 aa, Staphylococcus epidermidis
ILRELRMKAPMLSLEVL

SEQ ID NO: 1738117 - protein, 17 aa, Staphylococcus epidermidis
ILVNIFLVIVYIDKVNK

SEQ ID NO: 1738118 - protein, 17 aa, Staphylococcus epidermidis
INAQVVEKESARNAIEQ

SEQ ID NO: 1738119 - protein, 22 aa, Staphylococcus epidermidis
INGMTCAACSNRIEKVLNQTQG

SEQ ID NO: 1738120 - protein, 23 aa, Staphylococcus epidermidis
INGVICGIIAYILKIKGTALSAG

SEQ ID NO: 1738121 - protein, 17 aa, Staphylococcus epidermidis
INICPVTSIAPLCFSMA

SEQ ID NO: 1738122 - protein, 18 aa, Staphylococcus epidermidis
INISRIWIVFMFLIGFVA

SEQ ID NO: 1738123 - protein, 23 aa, Staphylococcus epidermidis
INKNTKLGMRYTYKNTIDDKTIY

SEQ ID NO: 1738124 - protein, 22 aa, Staphylococcus epidermidis
INPTLKHKVLWGLLIGAISVAM

SEQ ID NO: 1738125 - protein, 18 aa, Staphylococcus epidermidis
INVLSHRIFMAIIYTVAI

SEQ ID NO: 1738126 - protein, 27 aa, Staphylococcus epidermidis
IPPFFSGQAPYIFAHRGGMAMRPEQTQ

SEQ ID NO: 1738127 - protein, 20 aa, Staphylococcus epidermidis
IPSEQLVSAYQQLEKALELA

SEQ ID NO: 1738128 - protein, 21 aa, Staphylococcus epidermidis
IPVFLIFFFYHKFRYKTKKIP

SEQ ID NO: 1738129 - protein, 24 aa, Staphylococcus epidermidis
IRIITIGAGIAWILGAIALHVTMN

SEQ ID NO: 1738130 - protein, 26 aa, Staphylococcus epidermidis
IRPLQWIASIYIEFLRGTPMLVQVFI

SEQ ID NO: 1738131 - protein, 20 aa, Staphylococcus epidermidis
IRTGRLIAISSLVFCILLII

SEQ ID NO: 1738132 - protein, 17 aa, Staphylococcus epidermidis
IRTVQEVNNALQQVNQL

SEQ ID NO: 1738133 - protein, 18 aa, Staphylococcus epidermidis
ISFIVHYSFSIAIAIIYI

SEQ ID NO: 1738134 - protein, 25 aa, Staphylococcus epidermidis
ISILKSPYTYLAFILVIGMTVFQAS

SEQ ID NO: 1738135 - protein, 27 aa, Staphylococcus epidermidis
ISILVVMAICMAIFYLLVGLDFDIFEY

SEQ ID NO: 1738136 - protein, 25 aa, Staphylococcus epidermidis
ISKLVYPIIHICVIVLKPITILLNK

SEQ ID NO: 1738137 - protein, 28 aa, Staphylococcus epidermidis
ISMLISLYLKLMVIFGLAVTIFILASIS

SEQ ID NO: 1738138 - protein, 24 aa, Staphylococcus epidermidis
ITEYRPEYNKKKNAILKLYDVSDT

SEQ ID NO: 1738139 - protein, 28 aa, Staphylococcus epidermidis
ITHSLPFTILWPILITFFIFVIFSQTNP

SEQ ID NO: 1738140 - protein, 24 aa, Staphylococcus epidermidis
ITKIKIDFHCIFFLFLEKITPIPR

SEQ ID NO: 1738141 - protein, 35 aa, Staphylococcus epidermidis
ITLIGGILVWLGWYGFNVGSAFTFDHIAMISFVNT

SEQ ID NO: 1738142 - protein, 19 aa, Staphylococcus epidermidis
ITSLSRINAQVVEKESARN

SEQ ID NO: 1738143 - protein, 21 aa, Staphylococcus epidermidis
ITSPIFIKQKWFGEQHTPVYV

SEQ ID NO: 1738144 - protein, 18 aa, Staphylococcus epidermidis
ITTFEAIGGILGIIMIVF

SEQ ID NO: 1738145 - protein, 26 aa, Staphylococcus epidermidis
ITYTISMNWSLEVARALTGGIGIVLT

SEQ ID NO: 1738146 - protein, 18 aa, Staphylococcus epidermidis
IVISAILVAIGWALIWKR

SEQ ID NO: 1738147 - protein, 25 aa, Staphylococcus epidermidis
IVIVKPKANEIIRKKAAEQTTLINQ

SEQ ID NO: 1738148 - protein, 28 aa, Staphylococcus epidermidis
IVQFSQTCFHRWQFTIIMIAPLVIISAT

SEQ ID NO: 1738149 - protein, 19 aa, Staphylococcus epidermidis
IVRILKLPFDISLHFYFFF

SEQ ID NO: 1738150 - protein, 18 aa, Staphylococcus epidermidis
IVVSGCSINQSFSDKQNT

SEQ ID NO: 1738151 - protein, 25 aa, Staphylococcus epidermidis
IWVSPKLDRILGMISGILYFGIYVV

SEQ ID NO: 1738152 - protein, 17 aa, Staphylococcus epidermidis
IYFIILFVISMTESHIF

SEQ ID NO: 1738153 - protein, 19 aa, Staphylococcus epidermidis
IYFYPRFKISKLAGLMSFI

SEQ ID NO: 1738154 - protein, 18 aa, Staphylococcus epidermidis
IYISLRLIFIVMIATIMT

SEQ ID NO: 1738155 - protein, 29 aa, Staphylococcus epidermidis
IYLFMLGFYRLPGLVAIIALTTYIYLTLV

SEQ ID NO: 1738156 - protein, 23 aa, Staphylococcus epidermidis
IYLFYSPRLKFDVLENPNKNSKT

SEQ ID NO: 1738157 - protein, 17 aa, Staphylococcus epidermidis
IYLSYHVSDGLQYYVSH

SEQ ID NO: 1738158 - protein, 20 aa, Staphylococcus epidermidis
KAEANRLLQNVLTSTSDEIA

SEQ ID NO: 1738159 - protein, 19 aa, Staphylococcus epidermidis
KAEARAAVTNSANSKIKDI

SEQ ID NO: 1738160 - protein, 23 aa, Staphylococcus epidermidis
KAIKEILNLCLMKEEDLDDVKIT

SEQ ID NO: 1738161 - protein, 21 aa, Staphylococcus epidermidis
KALYYWIRYLNYNVIYRDKED

SEQ ID NO: 1738162 - protein, 24 aa, Staphylococcus epidermidis
KDKMEFQMLYGFRTELAQKIANEG

SEQ ID NO: 1738163 - protein, 18 aa, Staphylococcus epidermidis
KDNFTQAINNARDALNKT

SEQ ID NO: 1738164 - protein, 17 aa, Staphylococcus epidermidis
KDSRLASLLIITAVQAV

SEQ ID NO: 1738165 - protein, 17 aa, Staphylococcus epidermidis
KDYRYFYKILKSNFKQD

SEQ ID NO: 1738166 - protein, 18 aa, Staphylococcus epidermidis
KEAQKMFRQEGIRMPQPV

SEQ ID NO: 1738167 - protein, 20 aa, Staphylococcus epidermidis
KEAVITIARGQNYTIGPNLR

SEQ ID NO: 1738168 - protein, 17 aa, Staphylococcus epidermidis
KEMIQRQSVAVGVDVSF

SEQ ID NO: 1738169 - protein, 23 aa, Staphylococcus epidermidis
KENKTPSSIRNFDQAMNRAQSQI

SEQ ID NO: 1738170 - protein, 17 aa, Staphylococcus epidermidis
KEYNLDFDLEYQQQVRE

SEQ ID NO: 1738171 - protein, 25 aa, Staphylococcus epidermidis
KFIAVRLPWMPSIDINLDLRLDGLS

SEQ ID NO: 1738172 - protein, 24 aa, Staphylococcus epidermidis
KFILPIVVGLIIWALTPIKPDALN

SEQ ID NO: 1738173 - protein, 28 aa, Staphylococcus epidermidis
KFLGSKARRICWFGSIVVAIVLAIPMYS

SEQ ID NO: 1738174 - protein, 18 aa, Staphylococcus epidermidis
KFLRFPITQIVNMGMQTL

SEQ ID NO: 1738175 - protein, 25 aa, Staphylococcus epidermidis
KFRQKGGHAESFFPSKLPLINLRMN

SEQ ID NO: 1738176 - protein, 17 aa, Staphylococcus epidermidis
KFSIRKYAIGTFSTVIA

SEQ ID NO: 1738177 - protein, 19 aa, Staphylococcus epidermidis
KGAQISLYIGVVAALLDIC

SEQ ID NO: 1738178 - protein, 21 aa, Staphylococcus epidermidis
KGIGLPGGMALVFSLISGAGW

SEQ ID NO: 1738179 - protein, 19 aa, Staphylococcus epidermidis
KGNKKRSKTLISLVQNIVK

SEQ ID NO: 1738180 - protein, 24 aa, Staphylococcus epidermidis
KIFPLDFKILIGIGLLFCVGTPLT

SEQ ID NO: 1738181 - protein, 21 aa, Staphylococcus epidermidis
KIFYRDYSVLFFIILLSTMFL

SEQ ID NO: 1738182 - protein, 26 aa, Staphylococcus epidermidis
KISEVHPETIIKRNAKQEIEQDAQSQ

SEQ ID NO: 1738183 - protein, 24 aa, Staphylococcus epidermidis
KKPLKLKLCYRFNNTSIQWKQLFI

SEQ ID NO: 1738184 - protein, 19 aa, Staphylococcus epidermidis
KKPLPKFLTLFAGPLFNFI

SEQ ID NO: 1738185 - protein, 20 aa, Staphylococcus epidermidis
KKSYKPVWIIISFIILITIL

SEQ ID NO: 1738186 - protein, 25 aa, Staphylococcus epidermidis
KKVKHICVVIFLVVFLIGFIILLSL

SEQ ID NO: 1738187 - protein, 19 aa, Staphylococcus epidermidis
KLAIPGSISAFIGAGVLTF

SEQ ID NO: 1738188 - protein, 17 aa, Staphylococcus epidermidis
KLIEPFLNEPLEIANNF

SEQ ID NO: 1738189 - protein, 18 aa, Staphylococcus epidermidis
KLLLEHVNKLASVEGVND

SEQ ID NO: 1738190 - protein, 25 aa, Staphylococcus epidermidis
KLPFDISLHFYFFFFVGVIITGILK

SEQ ID NO: 1738191 - protein, 20 aa, Staphylococcus epidermidis
KLSFLQIFFEVMSAFGTCGL

SEQ ID NO: 1738192 - protein, 22 aa, Staphylococcus epidermidis
KLSKRFQKLILLHTSAQGIYSE

SEQ ID NO: 1738193 - protein, 26 aa, Staphylococcus epidermidis
KLSMKRQQYVLKRMRVEGKISKQQYE

SEQ ID NO: 1738194 - protein, 17 aa, Staphylococcus epidermidis
KLVCVGIASYIGSQTFV

SEQ ID NO: 1738195 - protein, 22 aa, Staphylococcus epidermidis
KLYKHFYYKLFALLLLATIIFA

SEQ ID NO: 1738196 - protein, 21 aa, Staphylococcus epidermidis
KNIIAVLAIILIIYIALQHAP

SEQ ID NO: 1738197 - protein, 17 aa, Staphylococcus epidermidis
KNLEKNLEMSKGHTDVS

SEQ ID NO: 1738198 - protein, 23 aa, Staphylococcus epidermidis
KNMLGCLPVLIQMPILMGLYMSL

SEQ ID NO: 1738199 - protein, 20 aa, Staphylococcus epidermidis
KPASVRRYNEAISNIRKELD

SEQ ID NO: 1738200 - protein, 21 aa, Staphylococcus epidermidis
KPKEGIGTWIGKDIKTLTHHY

SEQ ID NO: 1738201 - protein, 19 aa, Staphylococcus epidermidis
KPKFAYAFMAAIRMVPLII

SEQ ID NO: 1738202 - protein, 18 aa, Staphylococcus epidermidis
KQDAIQRLNGKRDEVKNL

SEQ ID NO: 1738203 - protein, 26 aa, Staphylococcus epidermidis
KQEAINRVSAELARVQAQINAEHTTQ

SEQ ID NO: 1738204 - protein, 19 aa, Staphylococcus epidermidis
KQLLAPIIVLIIWNMTTHL

SEQ ID NO: 1738205 - protein, 19 aa, Staphylococcus epidermidis
KQYRNVFLLMVIVGLFGSN

SEQ ID NO: 1738206 - protein, 22 aa, Staphylococcus epidermidis
KRIYQNLTFDSIVFRNALQYTV

SEQ ID NO: 1738207 - protein, 18 aa, Staphylococcus epidermidis
KRMRVEGKISKQQYENAK

SEQ ID NO: 1738208 - protein, 25 aa, Staphylococcus epidermidis
KRNKIKFSLVIGILVLISYLLFLLS

SEQ ID NO: 1738209 - protein, 18 aa, Staphylococcus epidermidis
KSAAIDRVNVAKIDAINN

SEQ ID NO: 1738210 - protein, 20 aa, Staphylococcus epidermidis
KSEARQAVQNKANEQINHIQ

SEQ ID NO: 1738211 - protein, 25 aa, Staphylococcus epidermidis
KSKRIFLKAIITILILLIIFFGVMY

SEQ ID NO: 1738212 - protein, 22 aa, Staphylococcus epidermidis
KSMDGFLHFLGRVFQDNYGFAI

SEQ ID NO: 1738213 - protein, 19 aa, Staphylococcus epidermidis
KSNEARTAIQNEHSNNGVA

SEQ ID NO: 1738214 - protein, 39 aa, Staphylococcus epidermidis
KSNKSIVVDGQFKSVDAFKNLKIPLSISGQAAQNDSDSD

SEQ ID NO: 1738215 - protein, 18 aa, Staphylococcus epidermidis
KSPLLVGVGEGFNVIASD

SEQ ID NO: 1738216 - protein, 24 aa, Staphylococcus epidermidis
KSQFNIHVTDEWIIQIAYDKLIIM

SEQ ID NO: 1738217 - protein, 21 aa, Staphylococcus epidermidis
KSTIALFCTYLFSYYISKNKI

SEQ ID NO: 1738218 - protein, 20 aa, Staphylococcus epidermidis
KSVCINGIITSILLNTKPHE

SEQ ID NO: 1738219 - protein, 20 aa, Staphylococcus epidermidis
KTAHVQITWMNWFVAAIIPG

SEQ ID NO: 1738220 - protein, 18 aa, Staphylococcus epidermidis
KTGIAIILAMSIASLLPD

SEQ ID NO: 1738221 - protein, 22 aa, Staphylococcus epidermidis
KTRAFTLIEMLLVLLIISLLLI

SEQ ID NO: 1738222 - protein, 21 aa, Staphylococcus epidermidis
KTYRYSVPPLFAFITTLFIGL

SEQ ID NO: 1738223 - protein, 24 aa, Staphylococcus epidermidis
KVFPKMHIVMLLAALSMAGVPFLN

SEQ ID NO: 1738224 - protein, 18 aa, Staphylococcus epidermidis
KVNIVSLPNTDKVADHLT

SEQ ID NO: 1738225 - protein, 17 aa, Staphylococcus epidermidis
LAEAKRDANTTIDGLTY

SEQ ID NO: 1738226 - protein, 25 aa, Staphylococcus epidermidis
LAGVNGDVTFYYRDGSVDVIDAENV

SEQ ID NO: 1738227 - protein, 25 aa, Staphylococcus epidermidis
LALLFIAQLYFHFSHNITSQREPVL

SEQ ID NO: 1738228 - protein, 26 aa, Staphylococcus epidermidis
LATEKSKDLKLIKGLKDLNKAQLEDV

SEQ ID NO: 1738229 - protein, 18 aa, Staphylococcus epidermidis
LAWIANILSLLFLIFGIL

SEQ ID NO: 1738230 - protein, 26 aa, Staphylococcus epidermidis
LAYVPFELCLLLKLFKPVKAFEWPLF

SEQ ID NO: 1738231 - protein, 21 aa, Staphylococcus epidermidis
LCLLGGLVGGIIGYIIGAINW

SEQ ID NO: 1738232 - protein, 31 aa, Staphylococcus epidermidis
LDGFGQIFLMPSIIGGLLILIGIFIGSKKAG

SEQ ID NO: 1738233 - protein, 17 aa, Staphylococcus epidermidis
LDLILRRLIHLYENDIF

SEQ ID NO: 1738234 - protein, 18 aa, Staphylococcus epidermidis
LDTAKADASSTLRNTNPS

SEQ ID NO: 1738235 - protein, 20 aa, Staphylococcus epidermidis
LEALNNAKTGLRADKEELQN

SEQ ID NO: 1738236 - protein, 20 aa, Staphylococcus epidermidis
LEEKQIALGKLEEVKNEALN

SEQ ID NO: 1738237 - protein, 18 aa, Staphylococcus epidermidis
LEKFKFTAAQTEIDDAHE

SEQ ID NO: 1738238 - protein, 17 aa, Staphylococcus epidermidis
LELDRWHWIFVVNIISA

SEQ ID NO: 1738239 - protein, 18 aa, Staphylococcus epidermidis
LETFAIAVIGTFIASIIC

SEQ ID NO: 1738240 - protein, 20 aa, Staphylococcus epidermidis
LEVAKQQALNHLNTLNDLND

SEQ ID NO: 1738241 - protein, 26 aa, Staphylococcus epidermidis
LFLSFIAGALWLIAGIMLLVRKPQTQ

SEQ ID NO: 1738242 - protein, 24 aa, Staphylococcus epidermidis
LFNKRYALIDALAFITLFKYGSWA

SEQ ID NO: 1738243 - protein, 24 aa, Staphylococcus epidermidis
LFSSRIPRTVSILLSGSSLALSGL

SEQ ID NO: 1738244 - protein, 18 aa, Staphylococcus epidermidis
LGHFSVYFILLVGVILGT

SEQ ID NO: 1738245 - protein, 23 aa, Staphylococcus epidermidis
LGKKLIICIGLVFFAVSEFMFAA

SEQ ID NO: 1738246 - protein, 17 aa, Staphylococcus epidermidis
LGLHGSDIIPLLEGFGC

SEQ ID NO: 1738247 - protein, 23 aa, Staphylococcus epidermidis
LGLPFNEAWEVAQQMAKKIVTNE

SEQ ID NO: 1738248 - protein, 30 aa, Staphylococcus epidermidis
LGTVGRAYRSALNWSLNHKWIVLIVSIFIL

SEQ ID NO: 1738249 - protein, 20 aa, Staphylococcus epidermidis
LHILLGFTVFACWPFTRLVH

SEQ ID NO: 1738250 - protein, 18 aa, Staphylococcus epidermidis
LHVLRNALQVAISIFCMS

SEQ ID NO: 1738251 - protein, 30 aa, Staphylococcus epidermidis
LHVTMNFPLSISFVIGGLFLITGPTVIQPL

SEQ ID NO: 1738252 - protein, 19 aa, Staphylococcus epidermidis
LIAMFSIFMCLVLGAQQIH

SEQ ID NO: 1738253 - protein, 23 aa, Staphylococcus epidermidis
LIFKRKWLDNRAFSKKFVPVVMA

SEQ ID NO: 1738254 - protein, 25 aa, Staphylococcus epidermidis
LIFMGIICLIYWIGSILILVLTCLD

SEQ ID NO: 1738255 - protein, 24 aa, Staphylococcus epidermidis
LITLFLKFDRLIAVLGGVTPFLVA

SEQ ID NO: 1738256 - protein, 21 aa, Staphylococcus epidermidis
LKFSEVDNVLKLKNWYMKGDT

SEQ ID NO: 1738257 - protein, 22 aa, Staphylococcus epidermidis
LKGTFKAYGSAYGHGVSGVNMG

SEQ ID NO: 1738258 - protein, 17 aa, Staphylococcus epidermidis
LKKKGVDTVEAIATAVG

SEQ ID NO: 1738259 - protein, 20 aa, Staphylococcus epidermidis
LKQQFDHALSNARKVLAKEN

SEQ ID NO: 1738260 - protein, 21 aa, Staphylococcus epidermidis
LKSIENKSDFVATENMPNYVK

SEQ ID NO: 1738261 - protein, 22 aa, Staphylococcus epidermidis
LKTELSFVEPMISRLELDEANN

SEQ ID NO: 1738262 - protein, 26 aa, Staphylococcus epidermidis
LKYYRFNRISLFIVKLILGMIIMSIV

SEQ ID NO: 1738263 - protein, 24 aa, Staphylococcus epidermidis
LLGLIPIYLGIKVAIFDDCEGERR

SEQ ID NO: 1738264 - protein, 19 aa, Staphylococcus epidermidis
LLGLIPIYLGIKVAIYDDC

SEQ ID NO: 1738265 - protein, 19 aa, Staphylococcus epidermidis
LLILFCFLISICFIFAPFV

SEQ ID NO: 1738266 - protein, 25 aa, Staphylococcus epidermidis
LLIMIKRLNIIILLLMFISAISSFF

SEQ ID NO: 1738267 - protein, 23 aa, Staphylococcus epidermidis
LLKGRRAIVAIGCMFMITFVVLF

SEQ ID NO: 1738268 - protein, 17 aa, Staphylococcus epidermidis
LLLGLPFNEAWEVAQQM

SEQ ID NO: 1738269 - protein, 17 aa, Staphylococcus epidermidis
LLQHSGIAFKEAIIQKG

SEQ ID NO: 1738270 - protein, 18 aa, Staphylococcus epidermidis
LLTLDFYKPIFGKNKSDK

SEQ ID NO: 1738271 - protein, 23 aa, Staphylococcus epidermidis
LLTVIFVVGIIFSRSKAVDYSTA

SEQ ID NO: 1738272 - protein, 20 aa, Staphylococcus epidermidis
LMIFMLWALLGWKVAIVYFI

SEQ ID NO: 1738273 - protein, 17 aa, Staphylococcus epidermidis
LMLFFKILGVSIIPMAL

SEQ ID NO: 1738274 - protein, 17 aa, Staphylococcus epidermidis
LMLIMSVFLSFTVVAQN

SEQ ID NO: 1738275 - protein, 17 aa, Staphylococcus epidermidis
LMNPLMIFMLWALLGWK

SEQ ID NO: 1738276 - protein, 22 aa, Staphylococcus epidermidis
LNGESRFKQALDNALNDIDSLN

SEQ ID NO: 1738277 - protein, 17 aa, Staphylococcus epidermidis
LNGVELLDADKQNAHQS

SEQ ID NO: 1738278 - protein, 19 aa, Staphylococcus epidermidis
LNHGVKWLSNLNILLGAIL

SEQ ID NO: 1738279 - protein, 24 aa, Staphylococcus epidermidis
LNIGFLSQRPHIFADSIKNNIAMY

SEQ ID NO: 1738280 - protein, 17 aa, Staphylococcus epidermidis
LNQRLTDTINLLQPLAN

SEQ ID NO: 1738281 - protein, 23 aa, Staphylococcus epidermidis
LPFISYGGSSLWSLMTGIGVVLS

SEQ ID NO: 1738282 - protein, 26 aa, Staphylococcus epidermidis
LPIAISMRITKGFKQLIALSVILGEL

SEQ ID NO: 1738283 - protein, 25 aa, Staphylococcus epidermidis
LPYNQERWQGANAMNAYQIEELFSQ

SEQ ID NO: 1738284 - protein, 23 aa, Staphylococcus epidermidis
LQIKLELDSLVTLHEQIFKSLSK

SEQ ID NO: 1738285 - protein, 18 aa, Staphylococcus epidermidis
LQLKRASLQYSFLTNLIA

SEQ ID NO: 1738286 - protein, 30 aa, Staphylococcus epidermidis
LQNAARSGRPIQFLVGFDVEDSHHNPETLL

SEQ ID NO: 1738287 - protein, 22 aa, Staphylococcus epidermidis
LQNARTSLVPDKTQLQEAKNRL

SEQ ID NO: 1738288 - protein, 17 aa, Staphylococcus epidermidis
LQQLLSHGFTLYQSFKF

SEQ ID NO: 1738289 - protein, 20 aa, Staphylococcus epidermidis
LRFLISVGIVLLCIYLGYQG

SEQ ID NO: 1738290 - protein, 29 aa, Staphylococcus epidermidis
LRLIILMVIAILGMAGWLFYAHQLIEKKT

SEQ ID NO: 1738291 - protein, 21 aa, Staphylococcus epidermidis
LRYNKCILMTQSFIFNSLAFN

SEQ ID NO: 1738292 - protein, 25 aa, Staphylococcus epidermidis
LSIASWRMIFIFLTIITLIVILGIL

SEQ ID NO: 1738293 - protein, 32 aa, Staphylococcus epidermidis
LSNEYDYTTTVFGSIALISSLLLLRRQRKESK

SEQ ID NO: 1738294 - protein, 20 aa, Staphylococcus epidermidis
LSTAMPAIFIILAVGIIVGS

SEQ ID NO: 1738295 - protein, 18 aa, Staphylococcus epidermidis
LTEAQALDGLMGALKESI

SEQ ID NO: 1738296 - protein, 18 aa, Staphylococcus epidermidis
LTFIFIFISGIAFFITYK

SEQ ID NO: 1738297 - protein, 18 aa, Staphylococcus epidermidis
LTPVKRQNAIATINAKAD

SEQ ID NO: 1738298 - protein, 28 aa, Staphylococcus epidermidis
LVALAVYLFRFVWVYVLYPYFYLSVSPF

SEQ ID NO: 1738299 - protein, 28 aa, Staphylococcus epidermidis
LVCHLVALMRYGGGVSYQLIEDESPFIA

SEQ ID NO: 1738300 - protein, 23 aa, Staphylococcus epidermidis
LVGVLWIKFKVISISLILTLLLL

SEQ ID NO: 1738301 - protein, 17 aa, Staphylococcus epidermidis
LVIVRRYNPYIVLFISI

SEQ ID NO: 1738302 - protein, 24 aa, Staphylococcus epidermidis
LVLLSMVCVGLFYHHLPMLLNTFL

SEQ ID NO: 1738303 - protein, 22 aa, Staphylococcus epidermidis
LVMIGSFIFSAGINAFVISGNL

SEQ ID NO: 1738304 - protein, 18 aa, Staphylococcus epidermidis
LVNYPGISTPLEVPVKVW

SEQ ID NO: 1738305 - protein, 21 aa, Staphylococcus epidermidis
LVPLFTGRLVDKFSVSSINWG

SEQ ID NO: 1738306 - protein, 22 aa, Staphylococcus epidermidis
LVPSLGATFFKNGVKNREQKEG

SEQ ID NO: 1738307 - protein, 22 aa, Staphylococcus epidermidis
LVSIGTAIGLMFTQIGFPIIDI

SEQ ID NO: 1738308 - protein, 18 aa, Staphylococcus epidermidis
LVVLIAWVLYYFVNINLT

SEQ ID NO: 1738309 - protein, 18 aa, Staphylococcus epidermidis
LVVTQLLYFIPGSVWFLM

SEQ ID NO: 1738310 - protein, 26 aa, Staphylococcus epidermidis
LYLIARITPIFAISEGWVWTITLVGL

SEQ ID NO: 1738311 - protein, 17 aa, Staphylococcus epidermidis
LYPNMYINVDLKDAPDT

SEQ ID NO: 1738312 - protein, 23 aa, Staphylococcus epidermidis
MAFALQSAMMGRIFQTLGANPNN

SEQ ID NO: 1738313 - protein, 20 aa, Staphylococcus epidermidis
MAGRVFEHFNGLYRFQGLRR

SEQ ID NO: 1738314 - protein, 25 aa, Staphylococcus epidermidis
MDKYSTRHLYIFSMAIFLIGSIVAA

SEQ ID NO: 1738315 - protein, 19 aa, Staphylococcus epidermidis
MDVQRSFAVFTMASLITFI

SEQ ID NO: 1738316 - protein, 31 aa, Staphylococcus epidermidis
MEKKHLRLIILIELFIQFIISAILSIVGGYL

SEQ ID NO: 1738317 - protein, 19 aa, Staphylococcus epidermidis
MFFLLAFCMIVPWRCAMLY

SEQ ID NO: 1738318 - protein, 28 aa, Staphylococcus epidermidis
MGVIYKAQLYLAPYSPKGYIEKLGQNLS

SEQ ID NO: 1738319 - protein, 25 aa, Staphylococcus epidermidis
MGVVLILLVIFGYISADRMAKRQSE

SEQ ID NO: 1738320 - protein, 39 aa, Staphylococcus epidermidis
MIAVCGLSLVGIDFLAVMGFASAISVLFAVLAALTLLPA

SEQ ID NO: 1738321 - protein, 18 aa, Staphylococcus epidermidis
MIHKAGVTLFKLVPEYMF

SEQ ID NO: 1738322 - protein, 27 aa, Staphylococcus epidermidis
MIMFGLKLPLLIAFAVVFAGLSFGYIY

SEQ ID NO: 1738323 - protein, 17 aa, Staphylococcus epidermidis
MKAMRDSIMNQEQIRKN

SEQ ID NO: 1738324 - protein, 23 aa, Staphylococcus epidermidis
MLFFELLTLFIIVSFIVSLIQQV

SEQ ID NO: 1738325 - protein, 21 aa, Staphylococcus epidermidis
MLLPFVCALILVFTKNKNRIS

SEQ ID NO: 1738326 - protein, 18 aa, Staphylococcus epidermidis
MLPELFPMRARGAATGIS

SEQ ID NO: 1738327 - protein, 21 aa, Staphylococcus epidermidis
MNISESLAILLLILLLVVVFI

SEQ ID NO: 1738328 - protein, 20 aa, Staphylococcus epidermidis
MPWELSVIYSPLRLIILMVI

SEQ ID NO: 1738329 - protein, 17 aa, Staphylococcus epidermidis
MRLGLHGSDIIPLLEGF

SEQ ID NO: 1738330 - protein, 20 aa, Staphylococcus epidermidis
MSRNLLWFYLIVLICVMIAS

SEQ ID NO: 1738331 - protein, 17 aa, Staphylococcus epidermidis
MTLVALGISVAYIYSLY

SEQ ID NO: 1738332 - protein, 17 aa, Staphylococcus epidermidis
MTMTLPIIFYVFTVIVS

SEQ ID NO: 1738333 - protein, 18 aa, Staphylococcus epidermidis
MTTLFIISILVILAILFL

SEQ ID NO: 1738334 - protein, 21 aa, Staphylococcus epidermidis
MVQNLWWGAGYNIVAVPLAAG

SEQ ID NO: 1738335 - protein, 29 aa, Staphylococcus epidermidis
MYANHLFIKRRTKEFALYQLIGLTRGNIL

SEQ ID NO: 1738336 - protein, 21 aa, Staphylococcus epidermidis
MYWVVCFVISIIQGWYESRIE

SEQ ID NO: 1738337 - protein, 31 aa, Staphylococcus epidermidis
NADKSLPLAGVTLISGLAIMSSRKKKKDKKV

SEQ ID NO: 1738338 - protein, 24 aa, Staphylococcus epidermidis
NAHQLLKLKDWHDIELQSLKEQAE

SEQ ID NO: 1738339 - protein, 24 aa, Staphylococcus epidermidis
NAIQPEVTKAINILQDKEDNSELV

SEQ ID NO: 1738340 - protein, 19 aa, Staphylococcus epidermidis
NALAKQLIKTFENTADVTH

SEQ ID NO: 1738341 - protein, 23 aa, Staphylococcus epidermidis
NANYMTCILLTFIGALIISLYGY

SEQ ID NO: 1738342 - protein, 22 aa, Staphylococcus epidermidis
NAVIQKPIRTVQEVNNALQQVN

SEQ ID NO: 1738343 - protein, 24 aa, Staphylococcus epidermidis
NDALKAARLNLENKINQTVQTDGM

SEQ ID NO: 1738344 - protein, 44 aa, Staphylococcus epidermidis
NDFKHGSATNYAFYDGVNNFSDFARGGELYFDREGATQTNKYYG

SEQ ID NO: 1738345 - protein, 24 aa, Staphylococcus epidermidis
NDLSTTQFVIWLQNGVWAIIVYFI

SEQ ID NO: 1738346 - protein, 22 aa, Staphylococcus epidermidis
NDMFDWHLRWYFLENVPHLALI

SEQ ID NO: 1738347 - protein, 26 aa, Staphylococcus epidermidis
NDQVLDARLGYYSVVKETNVQLLQPN

SEQ ID NO: 1738348 - protein, 24 aa, Staphylococcus epidermidis
NEYRIPRTLLGLLIGSSLAISGSV

SEQ ID NO: 1738349 - protein, 17 aa, Staphylococcus epidermidis
NFIKGSRVVSFIIASIV

SEQ ID NO: 1738350 - protein, 23 aa, Staphylococcus epidermidis
NGATCYDILKIIGYPELVLLQIK

SEQ ID NO: 1738351 - protein, 21 aa, Staphylococcus epidermidis
NGDLFRFYKNPDFKKVNPGKY

SEQ ID NO: 1738352 - protein, 23 aa, Staphylococcus epidermidis
NGFKEIETIKGLTSNEKTQFDKQ

SEQ ID NO: 1738353 - protein, 17 aa, Staphylococcus epidermidis
NGINTVITFDDLGIKTS

SEQ ID NO: 1738354 - protein, 18 aa, Staphylococcus epidermidis
NGLGIYIGRFLRLHTVYL

SEQ ID NO: 1738355 - protein, 19 aa, Staphylococcus epidermidis
NHNSKKWYRPLGYDAEDIN

SEQ ID NO: 1738356 - protein, 18 aa, Staphylococcus epidermidis
NIAETIRAYLYFDSYKQI

SEQ ID NO: 1738357 - protein, 25 aa, Staphylococcus epidermidis
NIFFVLCLISLFITVITIIFNRTAL

SEQ ID NO: 1738358 - protein, 23 aa, Staphylococcus epidermidis
NILGSWLLLLGIGMLYKTVGTLN

SEQ ID NO: 1738359 - protein, 19 aa, Staphylococcus epidermidis
NISESYCSNLFARYLNMNF

SEQ ID NO: 1738360 - protein, 19 aa, Staphylococcus epidermidis
NKCGKHLKTSTQRKSENQI

SEQ ID NO: 1738361 - protein, 23 aa, Staphylococcus epidermidis
NKRMSLKTSFSIILITGLIIWSF

SEQ ID NO: 1738362 - protein, 18 aa, Staphylococcus epidermidis
NKVFRLNVSYILSKIGKN

SEQ ID NO: 1738363 - protein, 29 aa, Staphylococcus epidermidis
NLLIKFHPTRFAFLMALVVLIAWVLYYFV

SEQ ID NO: 1738364 - protein, 21 aa, Staphylococcus epidermidis
NLLLLPRLGAALTVVITVTGQ

SEQ ID NO: 1738365 - protein, 18 aa, Staphylococcus epidermidis
NLTLNFMIVFLFIISATV

SEQ ID NO: 1738366 - protein, 24 aa, Staphylococcus epidermidis
NMIYYIVACIGFIFIGLGLGFFAT

SEQ ID NO: 1738367 - protein, 22 aa, Staphylococcus epidermidis
NMRERALEIGATFHIVSLPDSG

SEQ ID NO: 1738368 - protein, 24 aa, Staphylococcus epidermidis
NNAIPVFAGVIVVLAFFLLMIVFR

SEQ ID NO: 1738369 - protein, 31 aa, Staphylococcus epidermidis
NNSNQQFPPRNAQRRKRRRETATNQSKQQDD

SEQ ID NO: 1738370 - protein, 19 aa, Staphylococcus epidermidis
NNVPFRILLFYIGSLAVIM

SEQ ID NO: 1738371 - protein, 22 aa, Staphylococcus epidermidis
NPKADIPGIIYSTIGFGSLLYG

SEQ ID NO: 1738372 - protein, 27 aa, Staphylococcus epidermidis
NQSGQLGATVKPGSAPNQDTEVKPNPD

SEQ ID NO: 1738373 - protein, 21 aa, Staphylococcus epidermidis
NRLMAMLIYLLSLFTGIIGPL

SEQ ID NO: 1738374 - protein, 24 aa, Staphylococcus epidermidis
NRLSYKYRRFVSPVTMRAKASNQL

SEQ ID NO: 1738375 - protein, 21 aa, Staphylococcus epidermidis
NRVKSSLSMTKILGTRNYVNE

SEQ ID NO: 1738376 - protein, 21 aa, Staphylococcus epidermidis
NSEINKISVIAIKKPEAIAEI

SEQ ID NO: 1738377 - protein, 19 aa, Staphylococcus epidermidis
NSKTFAVNHLDNLNQAQKE

SEQ ID NO: 1738378 - protein, 32 aa, Staphylococcus epidermidis
NSLISRFRQLATGAYKYNPFLINQVKNLNQLD

SEQ ID NO: 1738379 - protein, 18 aa, Staphylococcus epidermidis
NSNFFSYLIYRIGKDDAA

SEQ ID NO: 1738380 - protein, 28 aa, Staphylococcus epidermidis
NSNHKGHEYMYYWFGLPSDQTPTGPVTF

SEQ ID NO: 1738381 - protein, 25 aa, Staphylococcus epidermidis
NSTLKVLFGHALRNALIPIITIIVP

SEQ ID NO: 1738382 - protein, 21 aa, Staphylococcus epidermidis
NSVAYRLAQAAKEKRSKLTNG

SEQ ID NO: 1738383 - protein, 22 aa, Staphylococcus epidermidis
NTVELSRIIGIIVDNAIEASEN

SEQ ID NO: 1738384 - protein, 26 aa, Staphylococcus epidermidis
NVNIKSVVMDLLFEKLDCHLAMPQHA

SEQ ID NO: 1738385 - protein, 24 aa, Staphylococcus epidermidis
NYKTRTVGFYSLGIVWVLQTISLS

SEQ ID NO: 1738386 - protein, 20 aa, Staphylococcus epidermidis
NYLPFFNIGMGWIVPAFFGF

SEQ ID NO: 1738387 - protein, 21 aa, Staphylococcus epidermidis
NYQHPTWMLVFGIIAVIVTIM

SEQ ID NO: 1738388 - protein, 26 aa, Staphylococcus epidermidis
NYTIGPNLRKYFSLSNGSDLPNRDFT

SEQ ID NO: 1738389 - protein, 19 aa, Staphylococcus epidermidis
PAFLCILLVLTFIIFTLAS

SEQ ID NO: 1738390 - protein, 17 aa, Staphylococcus epidermidis
PAGFIVTFLDIFKGFIT

SEQ ID NO: 1738391 - protein, 18 aa, Staphylococcus epidermidis
PATAVKSKAKKDIDQKLA

SEQ ID NO: 1738392 - protein, 26 aa, Staphylococcus epidermidis
PDQIRGLDTIYSFKGSGDVSYRISFK

SEQ ID NO: 1738393 - protein, 24 aa, Staphylococcus epidermidis
PELTRNSMDAFPIVAYSFTSNNQK

SEQ ID NO: 1738394 - protein, 27 aa, Staphylococcus epidermidis
PFDKKREFNPDLKPGEERVKQKGEPGT

SEQ ID NO: 1738395 - protein, 18 aa, Staphylococcus epidermidis
PFIDLSLFSNNVYIGTTL

SEQ ID NO: 1738396 - protein, 23 aa, Staphylococcus epidermidis
PGNYFITVKFGDKVEQFEIRSKP

SEQ ID NO: 1738397 - protein, 23 aa, Staphylococcus epidermidis
PGSVWFLMMVRLMNGLATAVATT

SEQ ID NO: 1738398 - protein, 24 aa, Staphylococcus epidermidis
PHNLKLILLSLITFVICYITSNIA

SEQ ID NO: 1738399 - protein, 21 aa, Staphylococcus epidermidis
PIASILVSLIILKSAYGISKS

SEQ ID NO: 1738400 - protein, 31 aa, Staphylococcus epidermidis
PIGTVIGDWVGWRFTFLFIIIVSVFVGVLML

SEQ ID NO: 1738401 - protein, 21 aa, Staphylococcus epidermidis
PIVALLKLNGWDTFHDIAQMK

SEQ ID NO: 1738402 - protein, 24 aa, Staphylococcus epidermidis
PKDHSWAKFIVGKPVIAVIVSLII

SEQ ID NO: 1738403 - protein, 23 aa, Staphylococcus epidermidis
PKDLKTYRMVFNTISVERMNSIL

SEQ ID NO: 1738404 - protein, 21 aa, Staphylococcus epidermidis
PKFLTLFAGPLFNFILALVLF

SEQ ID NO: 1738405 - protein, 18 aa, Staphylococcus epidermidis
PLGTDFKGSVSQGIVSGL

SEQ ID NO: 1738406 - protein, 18 aa, Staphylococcus epidermidis
PLMHLYKLIEPFLNEPLE

SEQ ID NO: 1738407 - protein, 17 aa, Staphylococcus epidermidis
PQVPHWLTVLFIVLLLI

SEQ ID NO: 1738408 - protein, 17 aa, Staphylococcus epidermidis
PQWYKWFFEHIVAHTTG

SEQ ID NO: 1738409 - protein, 25 aa, Staphylococcus epidermidis
PSKGILICLTFMILNAILSFKLKKS

SEQ ID NO: 1738410 - protein, 21 aa, Staphylococcus epidermidis
PTATLFLCLSLLFILFNKRYA

SEQ ID NO: 1738411 - protein, 18 aa, Staphylococcus epidermidis
PTHRKPGLYKNFDDGHIY

SEQ ID NO: 1738412 - protein, 30 aa, Staphylococcus epidermidis
PTKRNILLMFCPLLPFIGFAFIFLIPSKGI

SEQ ID NO: 1738413 - protein, 19 aa, Staphylococcus epidermidis
PTLTWPFIFATWIMLFAGI

SEQ ID NO: 1738414 - protein, 21 aa, Staphylococcus epidermidis
PVTDNTGGSGLRDVNVNLPQG

SEQ ID NO: 1738415 - protein, 25 aa, Staphylococcus epidermidis
QANVAKKPSARVELDSKFEDLKRQI

SEQ ID NO: 1738416 - protein, 25 aa, Staphylococcus epidermidis
QDMASSIIMFIKLVFMIDYVLFHLI

SEQ ID NO: 1738417 - protein, 19 aa, Staphylococcus epidermidis
QDRQCPKCHKVVNVDDKFC

SEQ ID NO: 1738418 - protein, 19 aa, Staphylococcus epidermidis
QELETIHANPTRKSDALQE

SEQ ID NO: 1738419 - protein, 26 aa, Staphylococcus epidermidis
QELNLKLKIVEVNAPTGNNRVYRVST

SEQ ID NO: 1738420 - protein, 22 aa, Staphylococcus epidermidis
QFQSRFKKFILILLVGASIGTS

SEQ ID NO: 1738421 - protein, 26 aa, Staphylococcus epidermidis
QFSFMPLKHLWSLAIEEQFYLFFPAV

SEQ ID NO: 1738422 - protein, 22 aa, Staphylococcus epidermidis
QHFSGLFLFGLVMINFPISLIS

SEQ ID NO: 1738423 - protein, 17 aa, Staphylococcus epidermidis
QHHFILFTIYGVTSYIL

SEQ ID NO: 1738424 - protein, 23 aa, Staphylococcus epidermidis
QHTFKIILFCIAYAIFSITIGMQ

SEQ ID NO: 1738425 - protein, 22 aa, Staphylococcus epidermidis
QKFLRIGFIVLTILSAALSIFS

SEQ ID NO: 1738426 - protein, 24 aa, Staphylococcus epidermidis
QKKVPMKVVHEIQDFEVPKGIEDH

SEQ ID NO: 1738427 - protein, 17 aa, Staphylococcus epidermidis
QLGSEFDLNLAYENMRE

SEQ ID NO: 1738428 - protein, 17 aa, Staphylococcus epidermidis
QLINFSLRQMDKLPDDV

SEQ ID NO: 1738429 - protein, 19 aa, Staphylococcus epidermidis
QLLIALVVLIVFSLFMSNI

SEQ ID NO: 1738430 - protein, 36 aa, Staphylococcus epidermidis
QLNGERRLKEHQQKSEVFIIKELDILNNAQKAAIIN

SEQ ID NO: 1738431 - protein, 25 aa, Staphylococcus epidermidis
QLPEGKTALKYGFDLATEVGIKSPG

SEQ ID NO: 1738432 - protein, 24 aa, Staphylococcus epidermidis
QMSYNHTWSILGYVLNGFVFSILG

SEQ ID NO: 1738433 - protein, 23 aa, Staphylococcus epidermidis
QNKEDIKRSSAYINADPTKVTAY

SEQ ID NO: 1738434 - protein, 19 aa, Staphylococcus epidermidis
QNRSRIPEMTYNFKRIERY

SEQ ID NO: 1738435 - protein, 19 aa, Staphylococcus epidermidis
QPNVIKKPTAINSLTQEAN

SEQ ID NO: 1738436 - protein, 21 aa, Staphylococcus epidermidis
QRKFIEWLIILSIFIVSIPNK

SEQ ID NO: 1738437 - protein, 20 aa, Staphylococcus epidermidis
QRLSAFQLLLLVFFSSTFTA

SEQ ID NO: 1738438 - protein, 45 aa, Staphylococcus epidermidis
QSEGKKKGGFMKILLPLIAAILILGAIAIFGGMALNNHNDSKSDD

SEQ ID NO: 1738439 - protein, 19 aa, Staphylococcus epidermidis
QSMIIDFLGLMYQYKTILT

SEQ ID NO: 1738440 - protein, 20 aa, Staphylococcus epidermidis
QTTPEFFQAISPYLPFTYSI

SEQ ID NO: 1738441 - protein, 24 aa, Staphylococcus epidermidis
RANTIINKPIRSVEEVNNALHEVN

SEQ ID NO: 1738442 - protein, 18 aa, Staphylococcus epidermidis
REEVKRKISEANANIRSY

SEQ ID NO: 1738443 - protein, 26 aa, Staphylococcus epidermidis
REFISGVLLVPALVSFIWFSVFGVLG

SEQ ID NO: 1738444 - protein, 19 aa, Staphylococcus epidermidis
RGKVLSIIMMDRGMIPLGS

SEQ ID NO: 1738445 - protein, 20 aa, Staphylococcus epidermidis
RIRAFIPIMIPLFISAFQRA

SEQ ID NO: 1738446 - protein, 25 aa, Staphylococcus epidermidis
RIRLTKRKLHILVHDNGIGMSPSHL

SEQ ID NO: 1738447 - protein, 20 aa, Staphylococcus epidermidis
RITSRMGYIITKTVSIVLIS

SEQ ID NO: 1738448 - protein, 21 aa, Staphylococcus epidermidis
RKYNEAKSRIQTQIDSAKNEA

SEQ ID NO: 1738449 - protein, 34 aa, Staphylococcus epidermidis
RLLLNRYLGIPIFLGIMWLIFQTTFTWIGTPLSD

SEQ ID NO: 1738450 - protein, 20 aa, Staphylococcus epidermidis
RLLPAVFALIVVVGIATLLL

SEQ ID NO: 1738451 - protein, 25 aa, Staphylococcus epidermidis
RLSLARLLLRPSAGFWILDEPTTAL

SEQ ID NO: 1738452 - protein, 21 aa, Staphylococcus epidermidis
RMRKLPFIILVILIILISIIV

SEQ ID NO: 1738453 - protein, 19 aa, Staphylococcus epidermidis
RMTLIPALTKLFGKASWYL

SEQ ID NO: 1738454 - protein, 18 aa, Staphylococcus epidermidis
RNEMILRFIKSTMILMLL

SEQ ID NO: 1738455 - protein, 19 aa, Staphylococcus epidermidis
RNKLAVIGMIGLLLIVIMA

SEQ ID NO: 1738456 - protein, 19 aa, Staphylococcus epidermidis
RPLYLGAMGSFLIGSIVAA

SEQ ID NO: 1738457 - protein, 23 aa, Staphylococcus epidermidis
RPPFLKTMFSISIFSIVVSIVFI

SEQ ID NO: 1738458 - protein, 18 aa, Staphylococcus epidermidis
RQDEPFIDLSLFSNNVYI

SEQ ID NO: 1738459 - protein, 27 aa, Staphylococcus epidermidis
RQSKEAFQLLMWMGFIILISLIVWILA

SEQ ID NO: 1738460 - protein, 17 aa, Staphylococcus epidermidis
RRDRIETVPSYYNEYDQ

SEQ ID NO: 1738461 - protein, 18 aa, Staphylococcus epidermidis
RRIIVGLRGMLLKRRVKT

SEQ ID NO: 1738462 - protein, 20 aa, Staphylococcus epidermidis
RRLSIKNVRRLSSFSDIFVN

SEQ ID NO: 1738463 - protein, 37 aa, Staphylococcus epidermidis
RRSLFASTIFPVFMVMIIGLISFYAIYIWVEHRTIHQ

SEQ ID NO: 1738464 - protein, 17 aa, Staphylococcus epidermidis
RRYEWFGDIIAQLRADV

SEQ ID NO: 1738465 - protein, 17 aa, Staphylococcus epidermidis
RRYSVSKNQVFYFNPAG

SEQ ID NO: 1738466 - protein, 22 aa, Staphylococcus epidermidis
RSDYLDARTEYYVSKDDDDSGF

SEQ ID NO: 1738467 - protein, 17 aa, Staphylococcus epidermidis
RSHCDFCHTIIKPLDLL

SEQ ID NO: 1738468 - protein, 24 aa, Staphylococcus epidermidis
RSILVPLKAVLGFILSLMATLGFT

SEQ ID NO: 1738469 - protein, 23 aa, Staphylococcus epidermidis
RSPQISMKRWALAGRHIGQDIMG

SEQ ID NO: 1738470 - protein, 29 aa, Staphylococcus epidermidis
RSRPEVKVVDSLNGFTMVNGGKVGLLNSV

SEQ ID NO: 1738471 - protein, 24 aa, Staphylococcus epidermidis
RSYPYKNGLKNYVFKQKDEYYIVS

SEQ ID NO: 1738472 - protein, 19 aa, Staphylococcus epidermidis
RSYSLYLWHYPIIIFMNSY

SEQ ID NO: 1738473 - protein, 25 aa, Staphylococcus epidermidis
RTILTLKGYRYVAAVVSFMEVLVYV

SEQ ID NO: 1738474 - protein, 22 aa, Staphylococcus epidermidis
RTNRNFRFFQIFTAALQSFSHG

SEQ ID NO: 1738475 - protein, 26 aa, Staphylococcus epidermidis
RTSVSDGITKFIYRKISTAQSPIVEN

SEQ ID NO: 1738476 - protein, 21 aa, Staphylococcus epidermidis
RTVRYGYTASFILVILQVITG

SEQ ID NO: 1738477 - protein, 18 aa, Staphylococcus epidermidis
RYIRMIVMGSFIAMASSV

SEQ ID NO: 1738478 - protein, 19 aa, Staphylococcus epidermidis
SAIFFEAFLSFIGIGVPAP

SEQ ID NO: 1738479 - protein, 27 aa, Staphylococcus epidermidis
SAKLFGELEFWFAIIKIVTIIALIVIG

SEQ ID NO: 1738480 - protein, 26 aa, Staphylococcus epidermidis
SDRTWTRFGRRMPYLLIAGPIGAIVL

SEQ ID NO: 1738481 - protein, 23 aa, Staphylococcus epidermidis
SDVGEGQPILQLISSNPQINATI

SEQ ID NO: 1738482 - protein, 17 aa, Staphylococcus epidermidis
SDVPTLLATFLLSPIAG

SEQ ID NO: 1738483 - protein, 26 aa, Staphylococcus epidermidis
SEDHLKFSLFLAMLLACLLIQAATNM

SEQ ID NO: 1738484 - protein, 26 aa, Staphylococcus epidermidis
SEEKILLALVLYRFAYYFVPVMIALI

SEQ ID NO: 1738485 - protein, 25 aa, Staphylococcus epidermidis
SEICQEWLYHMGVPQEEIVELAQSE

SEQ ID NO: 1738486 - protein, 23 aa, Staphylococcus epidermidis
SEKARRLLIQLSQFFRSNLNGAR

SEQ ID NO: 1738487 - protein, 21 aa, Staphylococcus epidermidis
SEMKTSQALLILDAIIVLSFI

SEQ ID NO: 1738488 - protein, 17 aa, Staphylococcus epidermidis
SEYFAYDGIHLEYSGVK

SEQ ID NO: 1738489 - protein, 17 aa, Staphylococcus epidermidis
SFIKLIKIDPIEAIGGG

SEQ ID NO: 1738490 - protein, 23 aa, Staphylococcus epidermidis
SGILAFHIDPIFAIIIMGFSAMM

SEQ ID NO: 1738491 - protein, 19 aa, Staphylococcus epidermidis
SGPMPIVLMSLVKSIFNTH

SEQ ID NO: 1738492 - protein, 18 aa, Staphylococcus epidermidis
SGVVKLGWEVMFPPRTPS

SEQ ID NO: 1738493 - protein, 17 aa, Staphylococcus epidermidis
SGYFPGYIDAIIMRICD

SEQ ID NO: 1738494 - protein, 20 aa, Staphylococcus epidermidis
SHTSEELYHRTSRSQSNSLK

SEQ ID NO: 1738495 - protein, 17 aa, Staphylococcus epidermidis
SIFDRPSLLDKLHSRGS

SEQ ID NO: 1738496 - protein, 19 aa, Staphylococcus epidermidis
SIGAFIIKLLQGYIPVNSA

SEQ ID NO: 1738497 - protein, 27 aa, Staphylococcus epidermidis
SIILLLMCVRWWIKYLSFKKNEHLKDK

SEQ ID NO: 1738498 - protein, 18 aa, Staphylococcus epidermidis
SIPNASIVTVEYDNGTDM

SEQ ID NO: 1738499 - protein, 22 aa, Staphylococcus epidermidis
SKEPRLEPRLGNQYGGKLSLIF

SEQ ID NO: 1738500 - protein, 27 aa, Staphylococcus epidermidis
SKFRDIWTSSISFIFFVGVIIGISYLS

SEQ ID NO: 1738501 - protein, 27 aa, Staphylococcus epidermidis
SKHIKIKLWHFILVILGIILLTSIITV

SEQ ID NO: 1738502 - protein, 42 aa, Staphylococcus epidermidis
SKNGVLTFRSSDYLKDLPLSGELKAIVYYNQYVQSNFSNSVP

SEQ ID NO: 1738503 - protein, 18 aa, Staphylococcus epidermidis
SLIIDALLAFFIVSTITM

SEQ ID NO: 1738504 - protein, 18 aa, Staphylococcus epidermidis
SLIILIGMVVYFFVKKRL

SEQ ID NO: 1738505 - protein, 19 aa, Staphylococcus epidermidis
SLLLYFSYLNHWWPFTSYI

SEQ ID NO: 1738506 - protein, 18 aa, Staphylococcus epidermidis
SLNYRNADYNLKRQFNKA

SEQ ID NO: 1738507 - protein, 25 aa, Staphylococcus epidermidis
SLPIDFKKLMIIGSLISVATASVPM

SEQ ID NO: 1738508 - protein, 24 aa, Staphylococcus epidermidis
SLVLGTAIGPFFGMLLMNSFSINI

SEQ ID NO: 1738509 - protein, 25 aa, Staphylococcus epidermidis
SLVTMFTVLLFKRHTPAIAKSNNGN

SEQ ID NO: 1738510 - protein, 17 aa, Staphylococcus epidermidis
SNEAYNTTYHFNITATD

SEQ ID NO: 1738511 - protein, 19 aa, Staphylococcus epidermidis
SNHPLAISIVDFAKSKNVS

SEQ ID NO: 1738512 - protein, 28 aa, Staphylococcus epidermidis
SNNIKLAEPILVIGNPLGTDFKGSVSQG

SEQ ID NO: 1738513 - protein, 18 aa, Staphylococcus epidermidis
SNYTLASYNKYNKLKERA

SEQ ID NO: 1738514 - protein, 22 aa, Staphylococcus epidermidis
SQVKSTMLVTVWVFIGIEGAVV

SEQ ID NO: 1738515 - protein, 19 aa, Staphylococcus epidermidis
SRLASLLIITAVQAVSIWN

SEQ ID NO: 1738516 - protein, 19 aa, Staphylococcus epidermidis
SRLYYIILTIVIIAICVVV

SEQ ID NO: 1738517 - protein, 17 aa, Staphylococcus epidermidis
SSALLYVSIHWIILGNT

SEQ ID NO: 1738518 - protein, 23 aa, Staphylococcus epidermidis
SSETFKSKGFLLLGVGIFIFSLI

SEQ ID NO: 1738519 - protein, 20 aa, Staphylococcus epidermidis
SSFILLLNLRHRDVTKSLFD

SEQ ID NO: 1738520 - protein, 28 aa, Staphylococcus epidermidis
SSIFIAVPLWGMLKKRQFKKTKNNKLVV

SEQ ID NO: 1738521 - protein, 21 aa, Staphylococcus epidermidis
SSILIGLFVKYFKTIRPKTYI

SEQ ID NO: 1738522 - protein, 24 aa, Staphylococcus epidermidis
SSISEIQLTLSFAMIGLAIGQFVF

SEQ ID NO: 1738523 - protein, 33 aa, Staphylococcus epidermidis
SSISGLFSRRFWPSLKFLLPILVGMLIAIGLLS

SEQ ID NO: 1738524 - protein, 19 aa, Staphylococcus epidermidis
SSMPAMLLLAGIMMLLGAV

SEQ ID NO: 1738525 - protein, 23 aa, Staphylococcus epidermidis
SSNANGVTVYWFKDKQESLAQTL

SEQ ID NO: 1738526 - protein, 25 aa, Staphylococcus epidermidis
SSQILLNIRKSYGIVVLANTNSNQV

SEQ ID NO: 1738527 - protein, 25 aa, Staphylococcus epidermidis
SSVIRPREVFKYLMITFLVLVANSV

SEQ ID NO: 1738528 - protein, 23 aa, Staphylococcus epidermidis
STALFLLCFYHLPNLNRYNEKPT

SEQ ID NO: 1738529 - protein, 18 aa, Staphylococcus epidermidis
STITNIYIVWAIGLFIGL

SEQ ID NO: 1738530 - protein, 27 aa, Staphylococcus epidermidis
STNIRLRKIVPIGISVFILILIIVLFF

SEQ ID NO: 1738531 - protein, 17 aa, Staphylococcus epidermidis
STQNRPGPKAQQQKRKS

SEQ ID NO: 1738532 - protein, 24 aa, Staphylococcus epidermidis
SVGLGILCYIFWGIYLKEGMYQYN

SEQ ID NO: 1738533 - protein, 19 aa, Staphylococcus epidermidis
SVIIYFILIHFFQHSFLLN

SEQ ID NO: 1738534 - protein, 23 aa, Staphylococcus epidermidis
SVILCLMLLLPLSHMKKRIKHPI

SEQ ID NO: 1738535 - protein, 20 aa, Staphylococcus epidermidis
SVLANFTFALGIPLGHTLTH

SEQ ID NO: 1738536 - protein, 25 aa, Staphylococcus epidermidis
SVNFDRQNHTLTFSSNGLNLGRSAQ

SEQ ID NO: 1738537 - protein, 29 aa, Staphylococcus epidermidis
SYISVRLKQEFDPMILFSLHINGVKMYSL

SEQ ID NO: 1738538 - protein, 17 aa, Staphylococcus epidermidis
SYLLLGYPMKAQKGAQS

SEQ ID NO: 1738539 - protein, 19 aa, Staphylococcus epidermidis
SYSLYLWHFPVISFIHSYF

SEQ ID NO: 1738540 - protein, 17 aa, Staphylococcus epidermidis
SYSQLYGIMGILGFTTL

SEQ ID NO: 1738541 - protein, 17 aa, Staphylococcus epidermidis
TAADGWIGVTLIFGAFA

SEQ ID NO: 1738542 - protein, 27 aa, Staphylococcus epidermidis
TAGTMEWAKLGILMSLLFFPNGPILIK

SEQ ID NO: 1738543 - protein, 24 aa, Staphylococcus epidermidis
TAKNRKGGTQLVLRNAENNQEIAS

SEQ ID NO: 1738544 - protein, 27 aa, Staphylococcus epidermidis
TDFLKTTRNAFFIGRTIDYNVSLEGAL

SEQ ID NO: 1738545 - protein, 17 aa, Staphylococcus epidermidis
TEHKVEQIIQWAHLGDY

SEQ ID NO: 1738546 - protein, 24 aa, Staphylococcus epidermidis
TEPHLKLFNQMSFFHDVKQWLKNA

SEQ ID NO: 1738547 - protein, 25 aa, Staphylococcus epidermidis
TETFKEVLKGTGVEPGKINKETQQP

SEQ ID NO: 1738548 - protein, 22 aa, Staphylococcus epidermidis
TEVHVASEFVYNMPLLSEKPLF

SEQ ID NO: 1738549 - protein, 19 aa, Staphylococcus epidermidis
TFPVIGTILGSFVFGIGIV

SEQ ID NO: 1738550 - protein, 19 aa, Staphylococcus epidermidis
TFTDFTFTKAVLFTLIFIV

SEQ ID NO: 1738551 - protein, 24 aa, Staphylococcus epidermidis
TGFISSIFYWFVIIFIINYTTAYT

SEQ ID NO: 1738552 - protein, 17 aa, Staphylococcus epidermidis
TGIPQWILVMLLTVITI

SEQ ID NO: 1738553 - protein, 17 aa, Staphylococcus epidermidis
TGPLLAFLPVITIGLLF

SEQ ID NO: 1738554 - protein, 19 aa, Staphylococcus epidermidis
TGPVTFTIINRDGSSTSTG

SEQ ID NO: 1738555 - protein, 21 aa, Staphylococcus epidermidis
TGTFLPPVVPIHFNLLTMLIY

SEQ ID NO: 1738556 - protein, 19 aa, Staphylococcus epidermidis
THKSFLIPPIIKGHQVESS

SEQ ID NO: 1738557 - protein, 29 aa, Staphylococcus epidermidis
TILSAALSIFSFFTANLIFGIIFALLTVI

SEQ ID NO: 1738558 - protein, 19 aa, Staphylococcus epidermidis
TINKQVIWVFLIPVIVAII

SEQ ID NO: 1738559 - protein, 30 aa, Staphylococcus epidermidis
TIPYMLCSLLMIRVGERFMQKRGPQLPLML

SEQ ID NO: 1738560 - protein, 20 aa, Staphylococcus epidermidis
TKIFLKLVLPLSKRSILAGI

SEQ ID NO: 1738561 - protein, 22 aa, Staphylococcus epidermidis
TLCLACVLYLIGQTIINHVSIL

SEQ ID NO: 1738562 - protein, 17 aa, Staphylococcus epidermidis
TLHLKRTIRQFDPTLQR

SEQ ID NO: 1738563 - protein, 19 aa, Staphylococcus epidermidis
TLIFLYILVYRGFVTSVLS

SEQ ID NO: 1738564 - protein, 25 aa, Staphylococcus epidermidis
TLKVHAHRLLPILVAIFIISNLVGM

SEQ ID NO: 1738565 - protein, 29 aa, Staphylococcus epidermidis
TLYYWGWWLSWSPFVGVFIARVSKGRSIR

SEQ ID NO: 1738566 - protein, 31 aa, Staphylococcus epidermidis; identical to SEQ ID NO: 1580534

SEQ ID NO: 1738567 - protein, 22 aa, Staphylococcus epidermidis
TMICLIDIGHLFRVNRRLGGSS

SEQ ID NO: 1738568 - protein, 26 aa, Staphylococcus epidermidis
TMVIEGRKNLAASLLIAAAIVGLFTT

SEQ ID NO: 1738569 - protein, 17 aa, Staphylococcus epidermidis
TNDKKPASVRRYNEAIS

SEQ ID NO: 1738570 - protein, 21 aa, Staphylococcus epidermidis
TNGKKPASIRQYETAKARIQN

SEQ ID NO: 1738571 - protein, 20 aa, Staphylococcus epidermidis
TNIYIVWAIGLFIGLMYGIL

SEQ ID NO: 1738572 - protein, 23 aa, Staphylococcus epidermidis
TPHPVTKPNARQVVNNRADQQKT

SEQ ID NO: 1738573 - protein, 20 aa, Staphylococcus epidermidis
TPIWFILLGLMYLRYKKADK

SEQ ID NO: 1738574 - protein, 27 aa, Staphylococcus epidermidis
TRLIKVNKLWKVPREAARISAWSFILA

SEQ ID NO: 1738575 - protein, 20 aa, Staphylococcus epidermidis
TRPTSFMIPGFFVITVSVIT

SEQ ID NO: 1738576 - protein, 24 aa, Staphylococcus epidermidis
TRQPKFESFFGVEMMFLGNTEALA

SEQ ID NO: 1738577 - protein, 17 aa, Staphylococcus epidermidis
TRTWKGAQISLYIGVVA

SEQ ID NO: 1738578 - protein, 24 aa, Staphylococcus epidermidis
TSQFHVLRALKFAKKAHLSFDGIG

SEQ ID NO: 1738579 - protein, 25 aa, Staphylococcus epidermidis
TTALRKQFFKHYKLDRHTRSDSDKY

SEQ ID NO: 1738580 - protein, 29 aa, Staphylococcus epidermidis
TTDIVQVRWLFRISSFIIFSIIIQSIYIA

SEQ ID NO: 1738581 - protein, 25 aa, Staphylococcus epidermidis
TTVIVFFCVFLIFSPIGKLKLGKPN

SEQ ID NO: 1738582 - protein, 24 aa, Staphylococcus epidermidis
TTVLTGLLLFPSVNDTTTHAAEVT

SEQ ID NO: 1738583 - protein, 22 aa, Staphylococcus epidermidis
TVTDLRPAGIITCDNDRIDAVS

SEQ ID NO: 1738584 - protein, 27 aa, Staphylococcus epidermidis
TVYGQENLYRIAIQYYGEGTQANVDKI

SEQ ID NO: 1738585 - protein, 18 aa, Staphylococcus epidermidis
TYINMLFKIHDWLVQLFL

SEQ ID NO: 1738586 - protein, 27 aa, Staphylococcus epidermidis
TYYLIKWLFDVTMKYLKWNISIVKGSV

SEQ ID NO: 1738587 - protein, 17 aa, Staphylococcus epidermidis
VAMYSLWLTKKYKKNVS

SEQ ID NO: 1738588 - protein, 17 aa, Staphylococcus epidermidis
VANNLVIATKQKSLDNI

SEQ ID NO: 1738589 - protein, 23 aa, Staphylococcus epidermidis
VDKIKRANGLSSNNIHNGQTLVI

SEQ ID NO: 1738590 - protein, 19 aa, Staphylococcus epidermidis
VEKVLNKKGTGVSEGQYSY

SEQ ID NO: 1738591 - protein, 18 aa, Staphylococcus epidermidis
VEPDNGYGGRQVSHSNVI

SEQ ID NO: 1738592 - protein, 34 aa, Staphylococcus epidermidis
VFDVFLLLFIMKFGFRKIEAIVGTLIFTVLAIFV

SEQ ID NO: 1738593 - protein, 20 aa, Staphylococcus epidermidis
VFLMSSYCLLVIGTTKIQLQ

SEQ ID NO: 1738594 - protein, 23 aa, Staphylococcus epidermidis
VFTAQFYASFAFAILISIIIDIG

SEQ ID NO: 1738595 - protein, 20 aa, Staphylococcus epidermidis
VFVAPTIKFHVWRVAIQTDK

SEQ ID NO: 1738596 - protein, 20 aa, Staphylococcus epidermidis
VGAAIALWVRCGKNKELRNT

SEQ ID NO: 1738597 - protein, 26 aa, Staphylococcus epidermidis
VGASTYRKNFCQRFLGEVNVTVIKGN

SEQ ID NO: 1738598 - protein, 30 aa, Staphylococcus epidermidis
VGIDYSLFILFRFKELKKKGVDTVEAIATA

SEQ ID NO: 1738599 - protein, 17 aa, Staphylococcus epidermidis
VGLLGVIDLCINLKKII

SEQ ID NO: 1738600 - protein, 21 aa, Staphylococcus epidermidis
VGPVANFLAGVSFLLSSYYVY

SEQ ID NO: 1738601 - protein, 20 aa, Staphylococcus epidermidis
VGSYGWKAILYFEIITTIAI

SEQ ID NO: 1738602 - protein, 19 aa, Staphylococcus epidermidis
VGVFIPFTLAQFGMVLKWL

SEQ ID NO: 1738603 - protein, 20 aa, Staphylococcus epidermidis
VHNVWEFLNAFFAEIIKVMS

SEQ ID NO: 1738604 - protein, 23 aa, Staphylococcus epidermidis
VIFGMALLVCLVRLIKGPTTADR

SEQ ID NO: 1738605 - protein, 20 aa, Staphylococcus epidermidis
VIGILCLMISHWFKSKDNTH

SEQ ID NO: 1738606 - protein, 26 aa, Staphylococcus epidermidis
VILFLMEFARGMYILSYINFLPTVTS

SEQ ID NO: 1738607 - protein, 23 aa, Staphylococcus epidermidis
VILGELSVILGLIIAFYMNISPG

SEQ ID NO: 1738608 - protein, 18 aa, Staphylococcus epidermidis
VILLVYFSFIDIHGHFSF

SEQ ID NO: 1738609 - protein, 17 aa, Staphylococcus epidermidis
VINPMWFGILFAVIGAL

SEQ ID NO: 1738610 - protein, 23 aa, Staphylococcus epidermidis
VIPFAGAFIVHKICKKVLSTYSD

SEQ ID NO: 1738611 - protein, 18 aa, Staphylococcus epidermidis
VITPRKAIEALYYNRYLK

SEQ ID NO: 1738612 - protein, 23 aa, Staphylococcus epidermidis
VKEIPKDATIIWYDFENATDEEN

SEQ ID NO: 1738613 - protein, 18 aa, Staphylococcus epidermidis
VKNGKEFEVNTRIENNGN

SEQ ID NO: 1738614 - protein, 22 aa, Staphylococcus epidermidis
VKRKISEANANIRSYLLQNNPI

SEQ ID NO: 1738615 - protein, 20 aa, Staphylococcus epidermidis
VKTNALAALASEAKNKNAII

SEQ ID NO: 1738616 - protein, 26 aa, Staphylococcus epidermidis
VKWSTAQRMVVTWVITLPISAVLAAI

SEQ ID NO: 1738617 - protein, 20 aa, Staphylococcus epidermidis
VKYFKTIRPKTYIYTNLIAQ

SEQ ID NO: 1738618 - protein, 20 aa, Staphylococcus epidermidis
VKYPVIMIPIFLTAAISGIA

SEQ ID NO: 1738619 - protein, 17 aa, Staphylococcus epidermidis
VLISRLYFHAHYFSDVV

SEQ ID NO: 1738620 - protein, 17 aa, Staphylococcus epidermidis
VLLSIPVIYFYSKDNKF

SEQ ID NO: 1738621 - protein, 17 aa, Staphylococcus epidermidis
VLSLISTMILYQFVTFS

SEQ ID NO: 1738622 - protein, 21 aa, Staphylococcus epidermidis
VLWMIAAIRLFAKKDKTDVNE

SEQ ID NO: 1738623 - protein, 18 aa, Staphylococcus epidermidis
VNFIGRFIVNHNFETHVF

SEQ ID NO: 1738624 - protein, 17 aa, Staphylococcus epidermidis
VNKNVKNGKEFEVNTRI

SEQ ID NO: 1738625 - protein, 18 aa, Staphylococcus epidermidis
VNLLESFIILPIVLPPTV

SEQ ID NO: 1738626 - protein, 23 aa, Staphylococcus epidermidis
VNPNSEIIFSFNTMTAKNRKGGT

SEQ ID NO: 1738627 - protein, 20 aa, Staphylococcus epidermidis
VPFLVAWILDLILRRLIHLY

SEQ ID NO: 1738628 - protein, 26 aa, Staphylococcus epidermidis
VPNKNRVAIKQGNALPTNLAGGSTSH

SEQ ID NO: 1738629 - protein, 26 aa, Staphylococcus epidermidis
VQRKLWLRNFMQAFFVVFFVYMAMYL

SEQ ID NO: 1738630 - protein, 22 aa, Staphylococcus epidermidis
VQSNFSNSVPFSSDTTPPTINE

SEQ ID NO: 1738631 - protein, 24 aa, Staphylococcus epidermidis
VSAALKESISLIDSIEIQAHKKLE

SEQ ID NO: 1738632 - protein, 19 aa, Staphylococcus epidermidis
VSIPNKWTLMISIALSLLL

SEQ ID NO: 1738633 - protein, 20 aa, Staphylococcus epidermidis
VSTFIPGFKMKYEDKERDIT

SEQ ID NO: 1738634 - protein, 17 aa, Staphylococcus epidermidis
VTFLIYLFYSPRLKFDV

SEQ ID NO: 1738635 - protein, 20 aa, Staphylococcus epidermidis
VTGICFLLALFFSPLIEVVT

SEQ ID NO: 1738636 - protein, 18 aa, Staphylococcus epidermidis
VTGTVLGIYPSYLPYNQE

SEQ ID NO: 1738637 - protein, 17 aa, Staphylococcus epidermidis
VTIGVTVASAFVIGSAV

SEQ ID NO: 1738638 - protein, 18 aa, Staphylococcus epidermidis
VTIIFGFAFIQAALQLLM

SEQ ID NO: 1738639 - protein, 18 aa, Staphylococcus epidermidis
VTLIAGPIFNRFAQKMVP

SEQ ID NO: 1738640 - protein, 18 aa, Staphylococcus epidermidis
VTQINWFAVIALSLGGMV

SEQ ID NO: 1738641 - protein, 19 aa, Staphylococcus epidermidis
VTVILLIAILFQFNLAHVA

SEQ ID NO: 1738642 - protein, 17 aa, Staphylococcus epidermidis
VVFIGFDMIRPALTNYF

SEQ ID NO: 1738643 - protein, 21 aa, Staphylococcus epidermidis
VVISVICCLLITGVLTYTLDD

SEQ ID NO: 1738644 - protein, 17 aa, Staphylococcus epidermidis
VVLPFTLSVIFILINYL

SEQ ID NO: 1738645 - protein, 17 aa, Staphylococcus epidermidis
VVMLLTIAIILGFGALE

SEQ ID NO: 1738646 - protein, 27 aa, Staphylococcus epidermidis
VVVICLWFLFCVFIFQYIKLLFSRPRF

SEQ ID NO: 1738647 - protein, 18 aa, Staphylococcus epidermidis
VWFVIMLLMYQKYKKESR

SEQ ID NO: 1738648 - protein, 21 aa, Staphylococcus epidermidis
VYMMILVTFFIVVSGCSINQS

SEQ ID NO: 1738649 - protein, 20 aa, Staphylococcus epidermidis
WAGVPTEVHVASEFVYNMPL

SEQ ID NO: 1738650 - protein, 18 aa, Staphylococcus epidermidis
WALIWKRQVHKHKNIMLW

SEQ ID NO: 1738651 - protein, 20 aa, Staphylococcus epidermidis
WALLGWKVAIVYFIVLAIFS

SEQ ID NO: 1738652 - protein, 23 aa, Staphylococcus epidermidis
WKDLTRAGAISGMVAGAVVVIVW

SEQ ID NO: 1738653 - protein, 19 aa, Staphylococcus epidermidis
WMYILCALLVTIAMTLSKI

SEQ ID NO: 1738654 - protein, 19 aa, Staphylococcus epidermidis
WRVPFIVIVGIALVTFIFG

SEQ ID NO: 1738655 - protein, 18 aa, Staphylococcus epidermidis
WTTPGPLGIVMGTGFAFW

SEQ ID NO: 1738656 - protein, 19 aa, Staphylococcus epidermidis
WVVLILSTILFFYGGKPFL

SEQ ID NO: 1738657 - protein, 24 aa, Staphylococcus epidermidis
WYSYLCPMLNWFIPIKFTELTYQE

SEQ ID NO: 1738658 - protein, 17 aa, Staphylococcus epidermidis
YDATLGRQINTNDVLTL

SEQ ID NO: 1738659 - protein, 18 aa, Staphylococcus epidermidis
YDDFSSYIIPGIMTLIFS

SEQ ID NO: 1738660 - protein, 23 aa, Staphylococcus epidermidis
YEIIPGFIVSVLITYIVSKLTKK

SEQ ID NO: 1738661 - protein, 24 aa, Staphylococcus epidermidis
YFFVKKRLSYFLIVGFMLSCIGNI

SEQ ID NO: 1738662 - protein, 27 aa, Staphylococcus epidermidis
YFISYSRFQNILLMLLIIPTWINLLLK

SEQ ID NO: 1738663 - protein, 27 aa, Staphylococcus epidermidis
YGCTHSGCGCILGCLTISLISFLLSLL

SEQ ID NO: 1738664 - protein, 22 aa, Staphylococcus epidermidis
YGHNIVNFYSLLPWFIITVPIV

SEQ ID NO: 1738665 - protein, 18 aa, Staphylococcus epidermidis
YGLFPGIIISWLGIVSGT

SEQ ID NO: 1738666 - protein, 18 aa, Staphylococcus epidermidis
YGLFSSIMGMGFISAFLS

SEQ ID NO: 1738667 - protein, 19 aa, Staphylococcus epidermidis
YGSLSFHFANTMSQVKSTM

SEQ ID NO: 1738668 - protein, 17 aa, Staphylococcus epidermidis
YHFLYTFMFSMIIGELI

SEQ ID NO: 1738669 - protein, 29 aa, Staphylococcus epidermidis
YITTKRLKDGYQWDILFNSNHKGHEYMYY

SEQ ID NO: 1738670 - protein, 19 aa, Staphylococcus epidermidis
YKHHGFDIKGTTRALFSTI

SEQ ID NO: 1738671 - protein, 23 aa, Staphylococcus epidermidis
YLAKMVFAQTFILSLIGTIIGFL

SEQ ID NO: 1738672 - protein, 19 aa, Staphylococcus epidermidis
YLHYKRKVLTQNLVDKHMQ

SEQ ID NO: 1738673 - protein, 28 aa, Staphylococcus epidermidis
YLKDGTIRDEVWLNKKLNYISKKTYQGI

SEQ ID NO: 1738674 - protein, 22 aa, Staphylococcus epidermidis
YLNHWWPFTSYIFLGLGLLSIL

SEQ ID NO: 1738675 - protein, 33 aa, Staphylococcus epidermidis
YLPQVFKSMLIPIVIIITMCFVHLPTAIIMIVT

SEQ ID NO: 1738676 - protein, 20 aa, Staphylococcus epidermidis
YLTLVAFNFISGVLTLPGLA

SEQ ID NO: 1738677 - protein, 21 aa, Staphylococcus epidermidis
YLVRIYRIIMLIITFLTELIK

SEQ ID NO: 1738678 - protein, 21 aa, Staphylococcus epidermidis
YMAYSILGFFAFIFIILLINS

SEQ ID NO: 1738679 - protein, 18 aa, Staphylococcus epidermidis
YMERLSYKKLLISLGTIV

SEQ ID NO: 1738680 - protein, 18 aa, Staphylococcus epidermidis
YMILRFHNYLAFLIMIIL

SEQ ID NO: 1738681 - protein, 18 aa, Staphylococcus epidermidis
YMNHLSEIPKIWHGGIAI

SEQ ID NO: 1738682 - protein, 23 aa, Staphylococcus epidermidis
YMPSDGWWLLNFISTIGAVLMAI

SEQ ID NO: 1738683 - protein, 18 aa, Staphylococcus epidermidis
YMPYVTAYFMPRAYKDRP

SEQ ID NO: 1738684 - protein, 19 aa, Staphylococcus epidermidis
YNAKRQKAEQVIQNANKII

SEQ ID NO: 1738685 - protein, 18 aa, Staphylococcus epidermidis
YNLDFDLEYQQQVREQWR

SEQ ID NO: 1738686 - protein, 19 aa, Staphylococcus epidermidis
YNTFLPWLSLVPVVSVIGL

SEQ ID NO: 1738687 - protein, 31 aa, Staphylococcus epidermidis
YPEHIRPGITFASKRLLKFAIILYGLKLNMG

SEQ ID NO: 1738688 - protein, 20 aa, Staphylococcus epidermidis
YPELRLRLVKGAYKEDASIA

SEQ ID NO: 1738689 - protein, 17 aa, Staphylococcus epidermidis
YPSYLPYNQERWQGANA

SEQ ID NO: 1738690 - protein, 20 aa, Staphylococcus epidermidis
YRSAKKIRYMPGLDGLRAIA

SEQ ID NO: 1738691 - protein, 17 aa, Staphylococcus epidermidis
YSGNALTKFLSLLMLVN

SEQ ID NO: 1738692 - protein, 20 aa, Staphylococcus epidermidis
YSIGLLVFICIWTFILSFIL

SEQ ID NO: 1738693 - protein, 19 aa, Staphylococcus epidermidis
YSLYWKDLTRAGAISGMVA

SEQ ID NO: 1738694 - protein, 25 aa, Staphylococcus epidermidis
YSPLKRLLLYIIILLTMCAFLNLMP

SEQ ID NO: 1738695 - protein, 17 aa, Staphylococcus epidermidis
YSPLRLIILMVIAILGM

SEQ ID NO: 1738696 - protein, 21 aa, Staphylococcus epidermidis
YSRNALFNHILSWVCLVLGLI

SEQ ID NO: 1738697 - protein, 17 aa, Staphylococcus epidermidis
YSVSKNQVFYFNPAGLY

SEQ ID NO: 1738698 - protein, 18 aa, Staphylococcus epidermidis
YTRIIDVLIGIAIAVIGI

SEQ ID NO: 1738699 - protein, 19 aa, Staphylococcus epidermidis
YVVEWVTLLLLLFIIIIYI

SEQ ID NO: 1738700 - protein, 19 aa, Staphylococcus epidermidis
YVWLNRLLIVILMFLNGLG

SEQ ID NO: 1738701 - protein, 25 aa, Staphylococcus epidermidis
YVYTKRIAVPIGIHMLMNGSVVLTQ

SEQ ID NO: 1738702 - protein, 26 aa, Staphylococcus epidermidis
YYFKTQRSLFWSFLIVFLLIFIILQI

SEQ ID NO: 1738703 - protein, 23 aa, Staphylococcus epidermidis
YYMSTEMFGVFKALTTALITPFS

SEQ ID NO: 1738704 - protein, 18 aa, Staphylococcus epidermidis
YYNFYGVGALDSDPIKTG

SEQ ID NO: 1738705 - protein, 18 aa, Staphylococcus epidermidis
YYNRYLKQNDQVLDARLG

SEQ ID NO: 1738706 - protein, 19 aa, Staphylococcus epidermidis
AAFAIVGWVGIKLVIMVLA

SEQ ID NO: 1738707 - protein, 18 aa, Staphylococcus epidermidis
ADIISGYFVPIVVSIAVI

SEQ ID NO: 1738708 - protein, 29 aa, Staphylococcus epidermidis
ADYNLKRQFNKALKEAKGVLNKNSGTNVN

SEQ ID NO: 1738709 - protein, 26 aa, Staphylococcus epidermidis
AEIERLKKQAIDKVNHSKSIKDIETV

SEQ ID NO: 1738710 - protein, 19 aa, Staphylococcus epidermidis
AEVALSYALLGGFAALISY

SEQ ID NO: 1738711 - protein, 17 aa, Staphylococcus epidermidis
AFAIPINDVRKIAKELE

SEQ ID NO: 1738712 - protein, 19 aa, Staphylococcus epidermidis
AGGELKHGTIALIEDGTPV

SEQ ID NO: 1738713 - protein, 17 aa, Staphylococcus epidermidis
AGYKKGWIDTIIMRIID

SEQ ID NO: 1738714 - protein, 35 aa, Staphylococcus epidermidis
AGYYKHLENGEGLPIDGWKFYWNQQSTGTTSDQWQ

SEQ ID NO: 1738715 - protein, 22 aa, Staphylococcus epidermidis
AILYTRFSGFAFSESELVVQKA

SEQ ID NO: 1738716 - protein, 25 aa, Staphylococcus epidermidis
AIPKIKDNSGEIIATGTYDNTNKQI

SEQ ID NO: 1738717 - protein, 23 aa, Staphylococcus epidermidis
AIQNIRFDDMIQLYIDATEGVQH

SEQ ID NO: 1738718 - protein, 20 aa, Staphylococcus epidermidis
ALENSVKKLSDFINEDEAAQ

SEQ ID NO: 1738719 - protein, 17 aa, Staphylococcus epidermidis
ALNEITIQLDTQRDLIK

SEQ ID NO: 1738720 - protein, 22 aa, Staphylococcus epidermidis
ANSSWQLSFTVNRQQQFKKQPK

SEQ ID NO: 1738721 - protein, 19 aa, Staphylococcus epidermidis
ASYHNYRMIDRDRADATEY

SEQ ID NO: 1738722 - protein, 26 aa, Staphylococcus epidermidis
ATISVSWIWFVFLAILGRITGKIDKS

SEQ ID NO: 1738723 - protein, 19 aa, Staphylococcus epidermidis
ATWGFVLSWLPLHSKYLVV

SEQ ID NO: 1738724 - protein, 35 aa, Staphylococcus epidermidis
AVFMRPDIGETFSEFRIFLAVLITLLLIISISLVI

SEQ ID NO: 1738725 - protein, 18 aa, Staphylococcus epidermidis
AVLPGVALSFLFNIPMFI

SEQ ID NO: 1738726 - protein, 18 aa, Staphylococcus epidermidis
AVVTYYLIKWLFDVTMKY

SEQ ID NO: 1738727 - protein, 19 aa, Staphylococcus epidermidis
AYLVVPIVGAFLIDLIGVI

SEQ ID NO: 1738728 - protein, 24 aa, Staphylococcus epidermidis
CLGGVGISMGMSWAAATDLGRNFS

SEQ ID NO: 1738729 - protein, 30 aa, Staphylococcus epidermidis
CSTTLLNLFHGWPWYAIWLVLLGFGGGMIV

SEQ ID NO: 1738730 - protein, 28 aa, Staphylococcus epidermidis
CVKVLKLKIRWPFWLSQIGLILLGVQIG

SEQ ID NO: 1738731 - protein, 20 aa, Staphylococcus epidermidis
DALMKAFQIDAPVNPGNSGG

SEQ ID NO: 1738732 - protein, 20 aa, Staphylococcus epidermidis
DASHELRTPLQIIQGHLNLI

SEQ ID NO: 1738733 - protein, 23 aa, Staphylococcus epidermidis
DDKFCVNCGQSVFDNPKTKTEHN

SEQ ID NO: 1738734 - protein, 25 aa, Staphylococcus epidermidis
DFQIFWKIVLPMSKPVVASITLFNA

SEQ ID NO: 1738735 - protein, 25 aa, Staphylococcus epidermidis
DHIQFLKIRLGMQVLAINIEKSIVV

SEQ ID NO: 1738736 - protein, 18 aa, Staphylococcus epidermidis
DHYLLPWEKVIAIEQQHH

SEQ ID NO: 1738737 - protein, 36 aa, Staphylococcus epidermidis
DIKPFIKTRLISPIGKLRAGLDLFKKPIEIEDDISV

SEQ ID NO: 1738738 - protein, 25 aa, Staphylococcus epidermidis
DLEILPRFNKIIVMNDGEIIENDSY

SEQ ID NO: 1738739 - protein, 19 aa, Staphylococcus epidermidis
DRILKEQNPSVADVNNALN

SEQ ID NO: 1738740 - protein, 32 aa, Staphylococcus epidermidis
DRKNSVNKWLFLLCTLIGLIVLVALLIQTFVK

SEQ ID NO: 1738741 - protein, 24 aa, Staphylococcus epidermidis
DSLSAAIIEKGKVNKLLKRNPTVE

SEQ ID NO: 1738742 - protein, 27 aa, Staphylococcus epidermidis
DTFFNEKGRIIGLLQMFMTKESIADRI

SEQ ID NO: 1738743 - protein, 18 aa, Staphylococcus epidermidis
DTSIKRNAKNDIDIKAAD

SEQ ID NO: 1738744 - protein, 20 aa, Staphylococcus epidermidis
EATNRVNAGLAQAIQNINNA

SEQ ID NO: 1738745 - protein, 24 aa, Staphylococcus epidermidis
EAVIRYKKKYIPQIAVNHSVFTEG

SEQ ID NO: 1738746 - protein, 30 aa, Staphylococcus epidermidis
EAVSAVQYMSSWPWDWAKPMGSLMKDGSIS

SEQ ID NO: 1738747 - protein, 19 aa, Staphylococcus epidermidis
EAYYEYTLRIESINNEMRK

SEQ ID NO: 1738748 - protein, 19 aa, Staphylococcus epidermidis
EDINIFKSLGYGVEEKHND

SEQ ID NO: 1738749 - protein, 18 aa, Staphylococcus epidermidis
EEYVFRKVIFGELYNFIK

SEQ ID NO: 1738750 - protein, 22 aa, Staphylococcus epidermidis
EFNMNLPFINKFILKMERDEAD

SEQ ID NO: 1738751 - protein, 21 aa, Staphylococcus epidermidis
EIKEADGIIIAADRQVDLSRF

SEQ ID NO: 1738752 - protein, 19 aa, Staphylococcus epidermidis
EKEAYEQAIAKGQEIINSE

SEQ ID NO: 1738753 - protein, 20 aa, Staphylococcus epidermidis
EKFAKIGSYIFMFLIGTVAI

SEQ ID NO: 1738754 - protein, 24 aa, Staphylococcus epidermidis
EKHIAEHKLGYVVVNKTQQILNNQ

SEQ ID NO: 1738755 - protein, 21 aa, Staphylococcus epidermidis
EKPLSNVLVTLTYPDGTSKSV

SEQ ID NO: 1738756 - protein, 27 aa, Staphylococcus epidermidis
EKQIFVSKLKALINRTHKQIDEAETFV

SEQ ID NO: 1738757 - protein, 18 aa, Staphylococcus epidermidis
EKRGRRSTRSVVENRSSR

SEQ ID NO: 1738758 - protein, 25 aa, Staphylococcus epidermidis
ELNVTSRSRMYTFSKNKAIRNLKQN

SEQ ID NO: 1738759 - protein, 18 aa, Staphylococcus epidermidis
ENNDYVVVNVDWGIPNER

SEQ ID NO: 1738760 - protein, 26 aa, Staphylococcus epidermidis
EQFEIRSKPTPPRIITTANELRGNPN

SEQ ID NO: 1738761 - protein, 23 aa, Staphylococcus epidermidis
EQVFSTRYLKMFIDSIWYAALIT

SEQ ID NO: 1738762 - protein, 35 aa, Staphylococcus epidermidis
ERYNHAKPPRFLVRFWTLFVSFLIGLVLMSVLFFN

SEQ ID NO: 1738763 - protein, 18 aa, Staphylococcus epidermidis
ESILSLITTQGWIRISFI

SEQ ID NO: 1738764 - protein, 23 aa, Staphylococcus epidermidis
ESYSFGGSIALLSLLLFIASGIY

SEQ ID NO: 1738765 - protein, 24 aa, Staphylococcus epidermidis
FATLDMRLRYTLLPMCLDIEHSLK

SEQ ID NO: 1738766 - protein, 17 aa, Staphylococcus epidermidis
FCYFMMLFFSIAPFQMI

SEQ ID NO: 1738767 - protein, 25 aa, Staphylococcus epidermidis
FDSIVFRNALQYTVIMAVAIFIALA

SEQ ID NO: 1738768 - protein, 20 aa, Staphylococcus epidermidis
FFSYLIYRIGKDDAAGLAAQ

SEQ ID NO: 1738769 - protein, 20 aa, Staphylococcus epidermidis
FGTGSAFAFPGSMIGVLLSS

SEQ ID NO: 1738770 - protein, 17 aa, Staphylococcus epidermidis
FGVVGILMAVLWAIIAK

SEQ ID NO: 1738771 - protein, 24 aa, Staphylococcus epidermidis
FHHYRNVPSLSFFFLSLNKMIDYY

SEQ ID NO: 1738772 - protein, 22 aa, Staphylococcus epidermidis
FIHKPLRILTWLMAIIVYLTIY

SEQ ID NO: 1738773 - protein, 17 aa, Staphylococcus epidermidis
FINKFILKMERDEADST

SEQ ID NO: 1738774 - protein, 24 aa, Staphylococcus epidermidis
FKVEGHKLIGIRGMPRVGKTESIV

SEQ ID NO: 1738775 - protein, 17 aa, Staphylococcus epidermidis
FLELRYDTFTKRFVSIL

SEQ ID NO: 1738776 - protein, 18 aa, Staphylococcus epidermidis
FLNKPVAIMFWIIAELAI

SEQ ID NO: 1738777 - protein, 19 aa, Staphylococcus epidermidis
FLTYMTIVIVSCIIFSTFF

SEQ ID NO: 1738778 - protein, 18 aa, Staphylococcus epidermidis
FMKMGGHVIALPLFMETF

SEQ ID NO: 1738779 - protein, 18 aa, Staphylococcus epidermidis
FNAIDTFKDDIFKTKDAL

SEQ ID NO: 1738780 - protein, 18 aa, Staphylococcus epidermidis
FNINFLPVVVAEILMGIV

SEQ ID NO: 1738781 - protein, 21 aa, Staphylococcus epidermidis
FPGAVPPLIGWVAIDGSLSLA

SEQ ID NO: 1738782 - protein, 17 aa, Staphylococcus epidermidis
FQWAMMVFVFFVITMAL

SEQ ID NO: 1738783 - protein, 25 aa, Staphylococcus epidermidis
FRVNRRLGGSSSYYFFYSLPVSKRD

SEQ ID NO: 1738784 - protein, 20 aa, Staphylococcus epidermidis
FSLVILRAQRLPMLAQLGES

SEQ ID NO: 1738785 - protein, 17 aa, Staphylococcus epidermidis
FSSNGLNLGRSAQDVAR

SEQ ID NO: 1738786 - protein, 18 aa, Staphylococcus epidermidis
FTLFKGVGIIFLITGIIF

SEQ ID NO: 1738787 - protein, 33 aa, Staphylococcus epidermidis
FVFSIKDLAPFIAAIVCILVFKHRKEQLAGLKF

SEQ ID NO: 1738788 - protein, 18 aa, Staphylococcus epidermidis
FVHYLRFPIGVWLLYIGV

SEQ ID NO: 1738789 - protein, 19 aa, Staphylococcus epidermidis
FVPFYSFILFPSVIIYFIL

SEQ ID NO: 1738790 - protein, 17 aa, Staphylococcus epidermidis
FVVPVIYEILFTLKNKI

SEQ ID NO: 1738791 - protein, 26 aa, Staphylococcus epidermidis
FWFKFWSVIESGGWVIFTHMEIVFVV

SEQ ID NO: 1738792 - protein, 17 aa, Staphylococcus epidermidis
FYFIYRFAIPHEKDIVN

SEQ ID NO: 1738793 - protein, 26 aa, Staphylococcus epidermidis
FYLFSYLRLKPAPMFIATILYGMSTV

SEQ ID NO: 1738794 - protein, 17 aa, Staphylococcus epidermidis
GASGFFMSFQMALFSFV

SEQ ID NO: 1738795 - protein, 18 aa, Staphylococcus epidermidis
GCSPKQYRTIISKLDSLP

SEQ ID NO: 1738796 - protein, 21 aa, Staphylococcus epidermidis
GDNRLLLGIILGVITFWLFAQ

SEQ ID NO: 1738797 - protein, 17 aa, Staphylococcus epidermidis
GDSIYIFTNAHVVGDQE

SEQ ID NO: 1738798 - protein, 17 aa, Staphylococcus epidermidis
GELKTNGYIDLSVGASF

SEQ ID NO: 1738799 - protein, 17 aa, Staphylococcus epidermidis
GEPTFEKMMHPLFELLH

SEQ ID NO: 1738800 - protein, 20 aa, Staphylococcus epidermidis
GESSVKGFATMLLLGILMIF

SEQ ID NO: 1738801 - protein, 23 aa, Staphylococcus epidermidis
GFWMFKEYFGLTVKETFLTWSLL

SEQ ID NO: 1738802 - protein, 21 aa, Staphylococcus epidermidis
GGALGALIRFCLSMLNEGSTI

SEQ ID NO: 1738803 - protein, 19 aa, Staphylococcus epidermidis
GGLWFPVNTFPDWLQSISK

SEQ ID NO: 1738804 - protein, 20 aa, Staphylococcus epidermidis
GILTLWYYWIKRRKNIKKMV

SEQ ID NO: 1738805 - protein, 30 aa, Staphylococcus epidermidis
GIMRDWEPGKKIHFIGHSMGGQTIRQMEEF

SEQ ID NO: 1738806 - protein, 20 aa, Staphylococcus epidermidis
GIVIFRQGWEKFTGDFTLNG

SEQ ID NO: 1738807 - protein, 17 aa, Staphylococcus epidermidis
GKLGRVFLLIPLSIVLI

SEQ ID NO: 1738808 - protein, 17 aa, Staphylococcus epidermidis
GKYMAYSILGFFAFIFI

SEQ ID NO: 1738809 - protein, 18 aa, Staphylococcus epidermidis
GLAQGLARENISIFDQIK

SEQ ID NO: 1738810 - protein, 18 aa, Staphylococcus epidermidis
GLIFKLAPSYFSKEAGSA

SEQ ID NO: 1738811 - protein, 25 aa, Staphylococcus epidermidis
GLRDVNVNLPQGWTKTFTINPNNNT

SEQ ID NO: 1738812 - protein, 17 aa, Staphylococcus epidermidis
GLVVIENVFAWPGLGPL

SEQ ID NO: 1738813 - protein, 17 aa, Staphylococcus epidermidis
GLWSFCVTWGFLQSKKS

SEQ ID NO: 1738814 - protein, 19 aa, Staphylococcus epidermidis
GLYMLFLIVKKLRKYVTSN

SEQ ID NO: 1738815 - protein, 17 aa, Staphylococcus epidermidis
GMTCAACSNRIEKKLNR

SEQ ID NO: 1738816 - protein, 17 aa, Staphylococcus epidermidis
GNKILGLIVPVGVIASL

SEQ ID NO: 1738817 - protein, 25 aa, Staphylococcus epidermidis
GRGEPGTVVEVTFPDGNKVEGKVDS

SEQ ID NO: 1738818 - protein, 18 aa, Staphylococcus epidermidis
GSVLIKLILNYPLIMLLH

SEQ ID NO: 1738819 - protein, 23 aa, Staphylococcus epidermidis
GTNKDANIIIGMIQNMDDARALL

SEQ ID NO: 1738820 - protein, 18 aa, Staphylococcus epidermidis
GTSMSPILLAWIVAAVLR

SEQ ID NO: 1738821 - protein, 17 aa, Staphylococcus epidermidis
GVIPFNLIKGIIISIIF

SEQ ID NO: 1738822 - protein, 31 aa, Staphylococcus epidermidis
GVITLTGLLSSFWLVLAKRRKKEEEEKQSIK

SEQ ID NO: 1738823 - protein, 17 aa, Staphylococcus epidermidis
GVQNLIALVNYPGISTP

SEQ ID NO: 1738824 - protein, 24 aa, Staphylococcus epidermidis
HIFQGHVAWGYSIILIISSVIGAQ

SEQ ID NO: 1738825 - protein, 24 aa, Staphylococcus epidermidis
HKEPKRYIFAWVLLGFCIVMIYQI

SEQ ID NO: 1738826 - protein, 18 aa, Staphylococcus epidermidis
HLYHFKVLIACLLVLFIL

SEQ ID NO: 1738827 - protein, 31 aa, Staphylococcus epidermidis
HQEIKDVRAITRFKIPEGYSIKDVTKEYAKF

SEQ ID NO: 1738828 - protein, 27 aa, Staphylococcus epidermidis
HRLKGVRKKLWLSIALIGSLQYGGLIT

SEQ ID NO: 1738829 - protein, 21 aa, Staphylococcus epidermidis
HRYGRTYKGIMRDWEPGKKIH

SEQ ID NO: 1738830 - protein, 20 aa, Staphylococcus epidermidis
HSYIIFRFHHDGVLSTGPND

SEQ ID NO: 1738831 - protein, 20 aa, Staphylococcus epidermidis
HTDFIFAIICEEMGLIGGLI

SEQ ID NO: 1738832 - protein, 19 aa, Staphylococcus epidermidis
HTKMHSVQAILSRLVSCLL

SEQ ID NO: 1738833 - protein, 24 aa, Staphylococcus epidermidis
HYYYKPNHFFFIAGLKSRVKSSAI

SEQ ID NO: 1738834 - protein, 23 aa, Staphylococcus epidermidis
IAEEDAKHIFDRFYKLSDESSSN

SEQ ID NO: 1738835 - protein, 17 aa, Staphylococcus epidermidis
IAFSLVILRAQRLPMLA

SEQ ID NO: 1738836 - protein, 17 aa, Staphylococcus epidermidis
IAGPIGFVGLIVPHIVK

SEQ ID NO: 1738837 - protein, 23 aa, Staphylococcus epidermidis
IAIKKPEAIAEIQELADKKLNKF

SEQ ID NO: 1738838 - protein, 19 aa, Staphylococcus epidermidis
IAIPSRFVLNIVRTIPDLL

SEQ ID NO: 1738839 - protein, 19 aa, Staphylococcus epidermidis
IAMISCLILTYIFNPTFVV

SEQ ID NO: 1738840 - protein, 22 aa, Staphylococcus epidermidis
IDGDGPGGLIIMKDMSEKPDSS

SEQ ID NO: 1738841 - protein, 25 aa, Staphylococcus epidermidis
IDIKAADKKIKIQRINDATDEEIQE

SEQ ID NO: 1738842 - protein, 30 aa, Staphylococcus epidermidis
IDLQKDLWKYLSIVGVIVLFTVYLASRSIN

SEQ ID NO: 1738843 - protein, 23 aa, Staphylococcus epidermidis
IDRDLICAIMVGVLSGIVTLAMF

SEQ ID NO: 1738844 - protein, 25 aa, Staphylococcus epidermidis
IDTSLLRYYFWMTIVIIMLLVGVIA

SEQ ID NO: 1738845 - protein, 21 aa, Staphylococcus epidermidis
IEAIHKIKPISTIKPQALNEI

SEQ ID NO: 1738846 - protein, 24 aa, Staphylococcus epidermidis
IFIFCFIGNILGGFILFFLMKYAH

SEQ ID NO: 1738847 - protein, 17 aa, Staphylococcus epidermidis
IGSIILLAPIARLIATG

SEQ ID NO: 1738848 - protein, 17 aa, Staphylococcus epidermidis
IGVAIGMAKKNDGAVAL

SEQ ID NO: 1738849 - protein, 26 aa, Staphylococcus epidermidis
IHFRKSSIHVLSFIFVLMILLNPQFI

SEQ ID NO: 1738850 - protein, 17 aa, Staphylococcus epidermidis
IHIFPALLGSIILIFII

SEQ ID NO: 1738851 - protein, 27 aa, Staphylococcus epidermidis
IHNVRMPRMLAGLIIGGALAIAGLLMQ

SEQ ID NO: 1738852 - protein, 17 aa, Staphylococcus epidermidis
IITVAISVIVLASITYY

SEQ ID NO: 1738853 - protein, 19 aa, Staphylococcus epidermidis
IKDTLKRQLDEIEHANATS

SEQ ID NO: 1738854 - protein, 24 aa, Staphylococcus epidermidis
IKKSRLRIYIVLIVCVIVMMLLLS

SEQ ID NO: 1738855 - protein, 18 aa, Staphylococcus epidermidis
IMILEAIYFYPRFKISKL

SEQ ID NO: 1738856 - protein, 25 aa, Staphylococcus epidermidis
IMLGFLYKYIIAYLIQTYAVNPLQL

SEQ ID NO: 1738857 - protein, 17 aa, Staphylococcus epidermidis
IMMPLLFIFLIIVVAQS

SEQ ID NO: 1738858 - protein, 19 aa, Staphylococcus epidermidis
INSLALWAAIIAFSTIYSF

SEQ ID NO: 1738859 - protein, 18 aa, Staphylococcus epidermidis
INSPEFQDLKLLVQTLHA

SEQ ID NO: 1738860 - protein, 23 aa, Staphylococcus epidermidis
INVLPIVIVPLVTERKRIKEHPD

SEQ ID NO: 1738861 - protein, 22 aa, Staphylococcus epidermidis
IPELSNDFIVLDFTYDLPLSTY

SEQ ID NO: 1738862 - protein, 21 aa, Staphylococcus epidermidis
IPFNLIKGIIISIIFVLLFRR

SEQ ID NO: 1738863 - protein, 28 aa, Staphylococcus epidermidis
IPLIIIVLCLIFRISTVPSMLISSISAL

SEQ ID NO: 1738864 - protein, 22 aa, Staphylococcus epidermidis
IPRRLVKRKKILSIFLYCTIVV

SEQ ID NO: 1738865 - protein, 17 aa, Staphylococcus epidermidis
IPTLLGYAGVGLSFGIV

SEQ ID NO: 1738866 - protein, 17 aa, Staphylococcus epidermidis
IRSGIFIALATFLRPVG

SEQ ID NO: 1738867 - protein, 27 aa, Staphylococcus epidermidis
ISALKPLKCLFIISFLAQLGSIVINTY

SEQ ID NO: 1738868 - protein, 22 aa, Staphylococcus epidermidis
ISFIAIIALFCFKLYQHYYYKL

SEQ ID NO: 1738869 - protein, 17 aa, Staphylococcus epidermidis
ISGIAFFITYKFYYYLP

SEQ ID NO: 1738870 - protein, 19 aa, Staphylococcus epidermidis
ISIILYFSFSTLKYSHSIN

SEQ ID NO: 1738871 - protein, 22 aa, Staphylococcus epidermidis
ISKIRATWMLYLIGIYPLLIFL

SEQ ID NO: 1738872 - protein, 21 aa, Staphylococcus epidermidis
ISMVFLRPMVEQIIYRYLIIH

SEQ ID NO: 1738873 - protein, 23 aa, Staphylococcus epidermidis
ISRWAPRTKRGRYLGFWNTSHNI

SEQ ID NO: 1738874 - protein, 24 aa, Staphylococcus epidermidis
ITKQPVDEIVHYGGEEIKPGHKDE

SEQ ID NO: 1738875 - protein, 17 aa, Staphylococcus epidermidis
IVAGSVCAHKRWLFISS

SEQ ID NO: 1738876 - protein, 25 aa, Staphylococcus epidermidis
IVFIFAIVVLRLGYLQIAQGSHYKQ

SEQ ID NO: 1738877 - protein, 32 aa, Staphylococcus epidermidis
IVFSIGLCYSILMALSRIRIGAHFTSDVTMSL

SEQ ID NO: 1738878 - protein, 18 aa, Staphylococcus epidermidis
IVIPSAIMYYFWQSKALI

SEQ ID NO: 1738879 - protein, 23 aa, Staphylococcus epidermidis
IVNRLPKSMPQYHVGHIKMIKEI

SEQ ID NO: 1738880 - protein, 17 aa, Staphylococcus epidermidis
IVRKKAKASKEIELEAD

SEQ ID NO: 1738881 - protein, 26 aa, Staphylococcus epidermidis
IVSFCFIFLLLLFFRYILKRYFNYML

SEQ ID NO: 1738882 - protein, 23 aa, Staphylococcus epidermidis
IYMIRIGLQIANLMSDLKGRIAI

SEQ ID NO: 1738883 - protein, 17 aa, Staphylococcus epidermidis
KAKLDANQMIDQKVEDI

SEQ ID NO: 1738884 - protein, 25 aa, Staphylococcus epidermidis
KANHPIEMNMIWKSMLIPSMGYVVG

SEQ ID NO: 1738885 - protein, 24 aa, Staphylococcus epidermidis
KDIVNRWQKLYILVCATLLSVLVS

SEQ ID NO: 1738886 - protein, 17 aa, Staphylococcus epidermidis
KDTTYKLSQSIPKQIYE

SEQ ID NO: 1738887 - protein, 21 aa, Staphylococcus epidermidis
KEFITFLIAMISCLILTYIFN

SEQ ID NO: 1738888 - protein, 20 aa, Staphylococcus epidermidis
KGDIPGLAILIIKDNKIFLN

SEQ ID NO: 1738889 - protein, 25 aa, Staphylococcus epidermidis
KGQFKQFRHGLSSFIEALVKDIESK

SEQ ID NO: 1738890 - protein, 18 aa, Staphylococcus epidermidis
KIELEFQPLTSFSNKRYI

SEQ ID NO: 1738891 - protein, 17 aa, Staphylococcus epidermidis
KIGWFIFAIAYTLFSNF

SEQ ID NO: 1738892 - protein, 20 aa, Staphylococcus epidermidis
KKIAGFLGIDVNELVDYKLT

SEQ ID NO: 1738893 - protein, 32 aa, Staphylococcus epidermidis
KKKRKKGWLFGCGGCLVLLILIIVGVTACTGT

SEQ ID NO: 1738894 - protein, 25 aa, Staphylococcus epidermidis
KKLVFPFIIACGFIVYSTSLPLVVS

SEQ ID NO: 1738895 - protein, 21 aa, Staphylococcus epidermidis
KLEDPETLFIVMSQILFHPLV

SEQ ID NO: 1738896 - protein, 19 aa, Staphylococcus epidermidis
KLFESNKYYPIYGSSELEK

SEQ ID NO: 1738897 - protein, 24 aa, Staphylococcus epidermidis
KLPGVNTTMDWDRKYPYGDTLRGI

SEQ ID NO: 1738898 - protein, 21 aa, Staphylococcus epidermidis
KLSHNHYGFYIAFSISTLLYP

SEQ ID NO: 1738899 - protein, 19 aa, Staphylococcus epidermidis
KLTVFVILGSVLIKLILNY

SEQ ID NO: 1738900 - protein, 20 aa, Staphylococcus epidermidis
KMSKGVYRFKVKGIYGENYQ

SEQ ID NO: 1738901 - protein, 21 aa, Staphylococcus epidermidis
KNGTKYLIFDNMSFTAPTKKP

SEQ ID NO: 1738902 - protein, 25 aa, Staphylococcus epidermidis
KNKIISLLISFIFVMSPLYFRFTIY

SEQ ID NO: 1738903 - protein, 17 aa, Staphylococcus epidermidis
KNLRSAVLLLLVGEIGY

SEQ ID NO: 1738904 - protein, 18 aa, Staphylococcus epidermidis
KNLTINWFNVLSLTVIIF

SEQ ID NO: 1738905 - protein, 19 aa, Staphylococcus epidermidis
KNMFENYGLISLKDDHIEV

SEQ ID NO: 1738906 - protein, 19 aa, Staphylococcus epidermidis
KPRSINAYNKAIQSLETQI

SEQ ID NO: 1738907 - protein, 26 aa, Staphylococcus epidermidis
KQRYINILFIISWIQLIGGLTRANQP

SEQ ID NO: 1738908 - protein, 22 aa, Staphylococcus epidermidis
KREVLKKYWLQIFGGIAVGTII

SEQ ID NO: 1738909 - protein, 17 aa, Staphylococcus epidermidis
KRLPMLDLPIIPIIVSR

SEQ ID NO: 1738910 - protein, 20 aa, Staphylococcus epidermidis
KRLVPIMTAFFCTILAIILL

SEQ ID NO: 1738911 - protein, 20 aa, Staphylococcus epidermidis
KSKAKKDIDQKLAQQINQIQ

SEQ ID NO: 1738912 - protein, 25 aa, Staphylococcus epidermidis
KSTFMKAVALNLILAQSIQTATAHS

SEQ ID NO: 1738913 - protein, 23 aa, Staphylococcus epidermidis
KVAGYLFYFAVIVGVISFIVWML

SEQ ID NO: 1738914 - protein, 26 aa, Staphylococcus epidermidis
KYANFKFSYSWIHLAKIILISIIMMI

SEQ ID NO: 1738915 - protein, 18 aa, Staphylococcus epidermidis
KYGHHRYGRTYKGIMRDW

SEQ ID NO: 1738916 - protein, 19 aa, Staphylococcus epidermidis
KYLCLHYGLGMLAGTLVHF

SEQ ID NO: 1738917 - protein, 17 aa, Staphylococcus epidermidis
KYLKYGVNTISEFLELR

SEQ ID NO: 1738918 - protein, 21 aa, Staphylococcus epidermidis
KYYGDENFALLNSEKPDQIRG

SEQ ID NO: 1738919 - protein, 24 aa, Staphylococcus epidermidis
LDDNLRKLTGLNLKGETKTKYDAM

SEQ ID NO: 1738920 - protein, 19 aa, Staphylococcus epidermidis
LDHLFKVSLISFMILFIGL

SEQ ID NO: 1738921 - protein, 17 aa, Staphylococcus epidermidis
LDKNALQAFFDASYHNY

SEQ ID NO: 1738922 - protein, 23 aa, Staphylococcus epidermidis
LDNFKEIFKQGTLLNALFISIAK

SEQ ID NO: 1738923 - protein, 25 aa, Staphylococcus epidermidis
LDTARSQLTLNREPYINHINNESHL

SEQ ID NO: 1738924 - protein, 17 aa, Staphylococcus epidermidis
LEHLDRIRLSFFTYHRS

SEQ ID NO: 1738925 - protein, 20 aa, Staphylococcus epidermidis
LESLTLLPIFFPKEDINHGK

SEQ ID NO: 1738926 - protein, 21 aa, Staphylococcus epidermidis
LETRMNTFFASIVVGLIYSVF

SEQ ID NO: 1738927 - protein, 17 aa, Staphylococcus epidermidis
LFHASGIIAAVVAGLVH

SEQ ID NO: 1738928 - protein, 18 aa, Staphylococcus epidermidis
LFIGSMLFGLFFGAGNLI

SEQ ID NO: 1738929 - protein, 25 aa, Staphylococcus epidermidis
LFIKLARIPFWFLIKGLTPIFFFLV

SEQ ID NO: 1738930 - protein, 22 aa, Staphylococcus epidermidis
LFTYKAPSGMRAMGALANAAIA

SEQ ID NO: 1738931 - protein, 30 aa, Staphylococcus epidermidis
LFVEAFKELWLPIITICFILAISKITTYGG

SEQ ID NO: 1738932 - protein, 17 aa, Staphylococcus epidermidis
LGAIIISGIITWIHNRY

SEQ ID NO: 1738933 - protein, 21 aa, Staphylococcus epidermidis
LGILFAIGVAIGMAKKNDGAV

SEQ ID NO: 1738934 - protein, 24 aa, Staphylococcus epidermidis
LGKIKSIYFIGGILGMAFVTSNII

SEQ ID NO: 1738935 - protein, 18 aa, Staphylococcus epidermidis
LHNRAMIQYGTYARLHIF

SEQ ID NO: 1738936 - protein, 23 aa, Staphylococcus epidermidis
LIAALLYGAYYAYNHYISDEQSH

SEQ ID NO: 1738937 - protein, 23 aa, Staphylococcus epidermidis
LIILCGVVTLLIRVIPFVMISRV

SEQ ID NO: 1738938 - protein, 25 aa, Staphylococcus epidermidis
LILIVVVVGFGIYFYASKDKEINNT

SEQ ID NO: 1738939 - protein, 31 aa, Staphylococcus epidermidis
LILSTPVQFIIGWQFYVGAYKNLRNGSANMD

SEQ ID NO: 1738940 - protein, 17 aa, Staphylococcus epidermidis
LITRIRAFIPIMIPLFI

SEQ ID NO: 1738941 - protein, 21 aa, Staphylococcus epidermidis
LKRQLDEIEHANATSNSKAQA

SEQ ID NO: 1738942 - protein, 27 aa, Staphylococcus epidermidis
LKSKENKKRFTAMMLVCAMFAICWIAY

SEQ ID NO: 1738943 - protein, 20 aa, Staphylococcus epidermidis
LKTNGYIDLSVGASFIPYQG

SEQ ID NO: 1738944 - protein, 38 aa, Staphylococcus epidermidis
LLFIFPLGLFLMWKFSKWPSIARTIITVAISVIVLASI

SEQ ID NO: 1738945 - protein, 38 aa, Staphylococcus epidermidis
LLFIFPLGLFLMWRYAHWKNWLKLTVSSVYIISLVLTL

SEQ ID NO: 1738946 - protein, 23 aa, Staphylococcus epidermidis
LLGDISSLLGMLGISIVTINGVD

SEQ ID NO: 1738947 - protein, 17 aa, Staphylococcus epidermidis
LLGFCIVMIYQIIISII

SEQ ID NO: 1738948 - protein, 23 aa, Staphylococcus epidermidis
LLHDVFIIIAIFSLFRLEVDLTF

SEQ ID NO: 1738949 - protein, 23 aa, Staphylococcus epidermidis
LLICMVLAYAFLLGLFILGLVAS

SEQ ID NO: 1738950 - protein, 18 aa, Staphylococcus epidermidis
LLICTGFASQLLVTKSLF

SEQ ID NO: 1738951 - protein, 24 aa, Staphylococcus epidermidis
LLLIKYRYIFKLQTGRFFILQLSH

SEQ ID NO: 1738952 - protein, 25 aa, Staphylococcus epidermidis
LLSFFKFIFATALFIFVIFTLYREL

SEQ ID NO: 1738953 - protein, 21 aa, Staphylococcus epidermidis
LLVGVGEGFNVIASDALAMLQ

SEQ ID NO: 1738954 - protein, 17 aa, Staphylococcus epidermidis
LLVVVVFAMVFFVIVVL

SEQ ID NO: 1738955 - protein, 18 aa, Staphylococcus epidermidis
LMWKQVNSSLVFVGSVVS

SEQ ID NO: 1738956 - protein, 17 aa, Staphylococcus epidermidis
LNFSIMFAFIGVTLIIS

SEQ ID NO: 1738957 - protein, 18 aa, Staphylococcus epidermidis
LNHAKALNEAMRQLENEV

SEQ ID NO: 1738958 - protein, 20 aa, Staphylococcus epidermidis
LNIGCSMMDILYLKILLFSN

SEQ ID NO: 1738959 - protein, 18 aa, Staphylococcus epidermidis
LNLAKGIHPWLGLVLTVI

SEQ ID NO: 1738960 - protein, 23 aa, Staphylococcus epidermidis
LNQVWPILLFLPFIVFIFIRIHV

SEQ ID NO: 1738961 - protein, 21 aa, Staphylococcus epidermidis
LPALIGYLLGFPMFGILISTG

SEQ ID NO: 1738962 - protein, 26 aa, Staphylococcus epidermidis
LPPEKTYKIGDYVWEDVDKDGIQNTN

SEQ ID NO: 1738963 - protein, 19 aa, Staphylococcus epidermidis
LPPKDVFLASVLIGTLGAV

SEQ ID NO: 1738964 - protein, 19 aa, Staphylococcus epidermidis
LPTILKLTSFYLNTAQNNE

SEQ ID NO: 1738965 - protein, 18 aa, Staphylococcus epidermidis
LQNIYLRVYYPPIVIGLT

SEQ ID NO: 1738966 - protein, 23 aa, Staphylococcus epidermidis
LRHQPKWILKSIIVIVLAIISAF

SEQ ID NO: 1738967 - protein, 18 aa, Staphylococcus epidermidis
LRTPLQIIQGHLNLIQRW

SEQ ID NO: 1738968 - protein, 18 aa, Staphylococcus epidermidis
LSFSRNFGKEAAMIAGYQ

SEQ ID NO: 1738969 - protein, 22 aa, Staphylococcus epidermidis
LSPLMWINFSMIWILEQTINVN

SEQ ID NO: 1738970 - protein, 23 aa, Staphylococcus epidermidis
LSVSLPSFFIGLILLYIFSLKLN

SEQ ID NO: 1738971 - protein, 21 aa, Staphylococcus epidermidis
LTGICVALLFTKYFVNYANDM

SEQ ID NO: 1738972 - protein, 20 aa, Staphylococcus epidermidis
LTHKSCRVKGEFKFEKELSL

SEQ ID NO: 1738973 - protein, 28 aa, Staphylococcus epidermidis
LTLFFWFFKLKYSFGHIINSKIFTQEFI

SEQ ID NO: 1738974 - protein, 18 aa, Staphylococcus epidermidis
LTPYGILAIMASTLATSD

SEQ ID NO: 1738975 - protein, 17 aa, Staphylococcus epidermidis
LWAIERFFKERKIGWFI

SEQ ID NO: 1738976 - protein, 24 aa, Staphylococcus epidermidis
MFFFQRVSGILAFVFIAMHLWQTR

SEQ ID NO: 1738977 - protein, 18 aa, Staphylococcus epidermidis
MFIFPSIIALIIGIVTLF

SEQ ID NO: 1738978 - protein, 18 aa, Staphylococcus epidermidis
MIAWLFIFILMKAGLTQV

SEQ ID NO: 1738979 - protein, 25 aa, Staphylococcus epidermidis
MKILKSELLLAFSTSSSEAVLPIMM

SEQ ID NO: 1738980 - protein, 23 aa, Staphylococcus epidermidis
MKQGETGRQIGWFISYDKDNPNM

SEQ ID NO: 1738981 - protein, 26 aa, Staphylococcus epidermidis
MSPLYFRFTIYWPFFSDTFIWLPLLL

SEQ ID NO: 1738982 - protein, 17 aa, Staphylococcus epidermidis
MTGFIAWVGIAISHFRF

SEQ ID NO: 1738983 - protein, 25 aa, Staphylococcus epidermidis
MTMLMRRLGSILGIKMIMKQMVSST

SEQ ID NO: 1738984 - protein, 21 aa, Staphylococcus epidermidis
MVNGGKVGLLNSVLERTSVFD

SEQ ID NO: 1738985 - protein, 19 aa, Staphylococcus epidermidis
NAAKDVWINGFSPEYTMSV

SEQ ID NO: 1738986 - protein, 26 aa, Staphylococcus epidermidis
NDALKKLKAIGFKDIHVEQAYSQTYE

SEQ ID NO: 1738987 - protein, 19 aa, Staphylococcus epidermidis
NFIKRSVLNTVLKKIRGTF

SEQ ID NO: 1738988 - protein, 17 aa, Staphylococcus epidermidis
NFNYLHSKFDARLREKD

SEQ ID NO: 1738989 - protein, 20 aa, Staphylococcus epidermidis
NGIFAFERTLSMILMSILFI

SEQ ID NO: 1738990 - protein, 25 aa, Staphylococcus epidermidis
NGKKTWFKFFIGVLLISLLASIINK

SEQ ID NO: 1738991 - protein, 21 aa, Staphylococcus epidermidis
NHHYYNFFGIGAFDEDAVKTG

SEQ ID NO: 1738992 - protein, 19 aa, Staphylococcus epidermidis
NIFFARVALELGSKKFEKG

SEQ ID NO: 1738993 - protein, 20 aa, Staphylococcus epidermidis
NIILPTLVTILAIDIGVNVG

SEQ ID NO: 1738994 - protein, 23 aa, Staphylococcus epidermidis
NIIPELIGVLLLTNATYTTLLLV

SEQ ID NO: 1738995 - protein, 19 aa, Staphylococcus epidermidis
NKKMVKFMLVFETKNMSVN

SEQ ID NO: 1738996 - protein, 22 aa, Staphylococcus epidermidis
NKKTWLIVTIVLAIIIALVVIF

SEQ ID NO: 1738997 - protein, 17 aa, Staphylococcus epidermidis
NMPYGFKKKELITDKKD

SEQ ID NO: 1738998 - protein, 20 aa, Staphylococcus epidermidis
NNVSAWSIYLVIKIAGIITM

SEQ ID NO: 1738999 - protein, 17 aa, Staphylococcus epidermidis
NPELLKANIDQATQSVQ

SEQ ID NO: 1739000 - protein, 29 aa, Staphylococcus epidermidis
NSLQKGTSYFRFQYFNPLNSSKYYENLDD

SEQ ID NO: 1739001 - protein, 24 aa, Staphylococcus epidermidis
NVYMFKTALKLAGDPYTSGMSLPN

SEQ ID NO: 1739002 - protein, 24 aa, Staphylococcus epidermidis
NYDRAVELYYYVKGGRVDYGAAHA

SEQ ID NO: 1739003 - protein, 23 aa, Staphylococcus epidermidis
NYIKKELNRNLLAVSNEITDQLN

SEQ ID NO: 1739004 - protein, 21 aa, Staphylococcus epidermidis
PEGYTPTLKHSGTNPALDSEG

SEQ ID NO: 1739005 - protein, 18 aa, Staphylococcus epidermidis
PEKVKMPNVLGMSKNDAL

SEQ ID NO: 1739006 - protein, 19 aa, Staphylococcus epidermidis
PFSRSDYKNIVLAGKYKSR

SEQ ID NO: 1739007 - protein, 51 aa, Staphylococcus epidermidis
PGISTPLEVPVKVWVYNFDFTQPIYKIQVGDTFPKGTWAGYYKHLENGEGL

SEQ ID NO: 1739008 - protein, 18 aa, Staphylococcus epidermidis
PHRKRVVSNLSVGNITFE

SEQ ID NO: 1739009 - protein, 17 aa, Staphylococcus epidermidis
PIAGAIVLYGFNDAVRS

SEQ ID NO: 1739010 - protein, 21 aa, Staphylococcus epidermidis
PIFIGICLIVSLLSLTPILTF

SEQ ID NO: 1739011 - protein, 17 aa, Staphylococcus epidermidis
PIKRFTLIVLVSCILSF

SEQ ID NO: 1739012 - protein, 17 aa, Staphylococcus epidermidis
PPLDKNALQAFFDASYH

SEQ ID NO: 1739013 - protein, 32 aa, Staphylococcus epidermidis; identical to SEQ ID NO: 1576533

SEQ ID NO: 1739014 - protein, 22 aa, Staphylococcus epidermidis
PRKAIEALYYNRYLKQNDQVLD

SEQ ID NO: 1739015 - protein, 17 aa, Staphylococcus epidermidis
PTQLASAFAAIANGGTY

SEQ ID NO: 1739016 - protein, 22 aa, Staphylococcus epidermidis
PVAHWVWGGGWISKIGAIDYAG

SEQ ID NO: 1739017 - protein, 18 aa, Staphylococcus epidermidis
PVLATWRGIFQGYKSMGP

SEQ ID NO: 1739018 - protein, 22 aa, Staphylococcus epidermidis
PYLNRVNGVFFGQIFTVYFNDR

SEQ ID NO: 1739019 - protein, 17 aa, Staphylococcus epidermidis
PYRKGMRAYVDDRQSNI

SEQ ID NO: 1739020 - protein, 26 aa, Staphylococcus epidermidis
QAILSRLVSCLLILFLGSAIFSLLGQ

SEQ ID NO: 1739021 - protein, 44 aa, Staphylococcus epidermidis
QAQFKNQYPVVFVHGFLGFAGDNQFSLAPKYWGGTKYNIDRNLT

SEQ ID NO: 1739022 - protein, 23 aa, Staphylococcus epidermidis
QEIRIKLTSNEPIKDSEWSITGY

SEQ ID NO: 1739023 - protein, 21 aa, Staphylococcus epidermidis
QEKRIPISIEVPDEIDRIDMN

SEQ ID NO: 1739024 - protein, 22 aa, Staphylococcus epidermidis
QELEDGVGLPLFTALPIVSSML

SEQ ID NO: 1739025 - protein, 20 aa, Staphylococcus epidermidis
QFVISFGFLLPVSAPQNMLA

SEQ ID NO: 1739026 - protein, 21 aa, Staphylococcus epidermidis
QGWYKRLMVTPLSSFQYYLVK

SEQ ID NO: 1739027 - protein, 24 aa, Staphylococcus epidermidis
QKPTRYTIMVGIDLLLIILIIVTL

SEQ ID NO: 1739028 - protein, 24 aa, Staphylococcus epidermidis
QLHTNRFYFILSFVLMVTVPNTIY

SEQ ID NO: 1739029 - protein, 17 aa, Staphylococcus epidermidis
QPLREGVKVCTNCGTPV

SEQ ID NO: 1739030 - protein, 19 aa, Staphylococcus epidermidis
QSTGIGLFIVQHIANHLNI

SEQ ID NO: 1739031 - protein, 21 aa, Staphylococcus epidermidis
QVFFFDKFMKYMSELNFIAWS

SEQ ID NO: 1739032 - protein, 24 aa, Staphylococcus epidermidis
QVFKDIFPLSAVILILYALDLLSR

SEQ ID NO: 1739033 - protein, 20 aa, Staphylococcus epidermidis
RAMIQYGTYARLHIFSRSQQ

SEQ ID NO: 1739034 - protein, 18 aa, Staphylococcus epidermidis
RDSEPLKITIRIRLTKRK

SEQ ID NO: 1739035 - protein, 25 aa, Staphylococcus epidermidis
RDYPVIQGCVLFIGFFVVIINTIAD

SEQ ID NO: 1739036 - protein, 18 aa, Staphylococcus epidermidis
RFEREVHNSSQLSHENIV

SEQ ID NO: 1739037 - protein, 19 aa, Staphylococcus epidermidis
RFFKERKIGWFIFAIAYTL

SEQ ID NO: 1739038 - protein, 18 aa, Staphylococcus epidermidis
RFTLIVLVSCILSFILYG

SEQ ID NO: 1739039 - protein, 18 aa, Staphylococcus epidermidis
RGALGVVQLIILYMLRSQ

SEQ ID NO: 1739040 - protein, 17 aa, Staphylococcus epidermidis
RIGIKRLLTIALTTCIV

SEQ ID NO: 1739041 - protein, 19 aa, Staphylococcus epidermidis
RILIVGCIFAIFQQFIGIN

SEQ ID NO: 1739042 - protein, 25 aa, Staphylococcus epidermidis
RLFLEPTRFNYLIIVAIGVIVGAII

SEQ ID NO: 1739043 - protein, 24 aa, Staphylococcus epidermidis
RLLRDFKAGLFILTVSLILINNFY

SEQ ID NO: 1739044 - protein, 24 aa, Staphylococcus epidermidis
RLSKAKAKAIQYVQSLSYINDAQR

SEQ ID NO: 1739045 - protein, 18 aa, Staphylococcus epidermidis
RLTDTINLLQPLANKESL

SEQ ID NO: 1739046 - protein, 19 aa, Staphylococcus epidermidis
RNALQVAISIFCMSIPMIM

SEQ ID NO: 1739047 - protein, 21 aa, Staphylococcus epidermidis
RNTKRIISFLLILSAITVLIM

SEQ ID NO: 1739048 - protein, 22 aa, Staphylococcus epidermidis
RPDVKGREAILHVHAKNKPLDE

SEQ ID NO: 1739049 - protein, 18 aa, Staphylococcus epidermidis
RPMVEQIIYRYLIIHELG

SEQ ID NO: 1739050 - protein, 22 aa, Staphylococcus epidermidis
RQHGGTISDLFTGGKDNMVASI

SEQ ID NO: 1739051 - protein, 21 aa, Staphylococcus epidermidis
RQLLYVIMSFVIVFFMAFIMN

SEQ ID NO: 1739052 - protein, 25 aa, Staphylococcus epidermidis
RRKKQKRIQYTIITLLILIIVLILL

SEQ ID NO: 1739053 - protein, 17 aa, Staphylococcus epidermidis
RSVKWMFVALILIIVLF

SEQ ID NO: 1739054 - protein, 18 aa, Staphylococcus epidermidis
RTVLKRNFILIPTYILLQ

SEQ ID NO: 1739055 - protein, 18 aa, Staphylococcus epidermidis
RVPFSYKDIVFIACILII

SEQ ID NO: 1739056 - protein, 19 aa, Staphylococcus epidermidis
RVVLPAALPGILTGFILSL

SEQ ID NO: 1739057 - protein, 25 aa, Staphylococcus epidermidis
RYYSKRLPEMLGVFQGLTFVVTISF

SEQ ID NO: 1739058 - protein, 28 aa, Staphylococcus epidermidis
SAKLFGELEFWLSIIKVLTILALIAVGV

SEQ ID NO: 1739059 - protein, 23 aa, Staphylococcus epidermidis
SDGLWHHRFMMIVLTLLMVASVI

SEQ ID NO: 1739060 - protein, 25 aa, Staphylococcus epidermidis
SDVVPWPTLFFGMFFNNLFFWCANQ

SEQ ID NO: 1739061 - protein, 17 aa, Staphylococcus epidermidis
SEFMFAAGQSFTILIIS

SEQ ID NO: 1739062 - protein, 21 aa, Staphylococcus epidermidis
SEILDTFVIRTGIEQGDFSYA

SEQ ID NO: 1739063 - protein, 21 aa, Staphylococcus epidermidis
SELSVLIASKVLRKEISEQDQ

SEQ ID NO: 1739064 - protein, 24 aa, Staphylococcus epidermidis
SERNAINLPAKVNHGVLIGEVKEN

SEQ ID NO: 1739065 - protein, 17 aa, Staphylococcus epidermidis
SFIRPNSRFDAQYHAYR

SEQ ID NO: 1739066 - protein, 17 aa, Staphylococcus epidermidis
SGAIFGLIGSIFVIMYL

SEQ ID NO: 1739067 - protein, 25 aa, Staphylococcus epidermidis
SGTPSSRNAGSFTKTVTVVYQNGQT

SEQ ID NO: 1739068 - protein, 20 aa, Staphylococcus epidermidis
SGYLKYILLIMIAWLFIFIL

SEQ ID NO: 1739069 - protein, 25 aa, Staphylococcus epidermidis
SHREWRLIVISVLLLFFWSTEKVLH

SEQ ID NO: 1739070 - protein, 22 aa, Staphylococcus epidermidis
SILRRICIPAPVIGGLLFAILV

SEQ ID NO: 1739071 - protein, 25 aa, Staphylococcus epidermidis
SIPSNGRWYDHIGIKKDRREAVYKK

SEQ ID NO: 1739072 - protein, 30 aa, Staphylococcus epidermidis
SIRKYAIGTFSTVIATLVFMGINTNHASAD

SEQ ID NO: 1739073 - protein, 17 aa, Staphylococcus epidermidis
SKIMMPLLFIFLIIVVA

SEQ ID NO: 1739074 - protein, 24 aa, Staphylococcus epidermidis
SLADKAIDVIIQFVAQNRGKFSDE

SEQ ID NO: 1739075 - protein, 18 aa, Staphylococcus epidermidis
SLIFIRQRLTMVVLNGMI

SEQ ID NO: 1739076 - protein, 20 aa, Staphylococcus epidermidis
SLMNFCLLSFPLDLIEERNQ

SEQ ID NO: 1739077 - protein, 27 aa, Staphylococcus epidermidis
SMLLTLWIVPWLSAMKARKLKQQVTQT

SEQ ID NO: 1739078 - protein, 18 aa, Staphylococcus epidermidis
SNDGRRSTLERIASDTDQ

SEQ ID NO: 1739079 - protein, 32 aa, Staphylococcus epidermidis
SQKRIEFYRLYLLMIHLLKFGGMYADSVQRSM

SEQ ID NO: 1739080 - protein, 18 aa, Staphylococcus epidermidis
SRTGSIIGTFVFPIILAA

SEQ ID NO: 1739081 - protein, 18 aa, Staphylococcus epidermidis
SSATGHTMDFFWELATLI

SEQ ID NO: 1739082 - protein, 18 aa, Staphylococcus epidermidis
SSLTIGVIFVIIALIKDA

SEQ ID NO: 1739083 - protein, 24 aa, Staphylococcus epidermidis
SSNFFKKQYWLFGVKKKDRHDINE

SEQ ID NO: 1739084 - protein, 17 aa, Staphylococcus epidermidis
STIYSFIGYLSWSTAFE

SEQ ID NO: 1739085 - protein, 19 aa, Staphylococcus epidermidis
STRLSRILCILLIIISVVG

SEQ ID NO: 1739086 - protein, 17 aa, Staphylococcus epidermidis
SVILAVGVSTLIGIIFG

SEQ ID NO: 1739087 - protein, 27 aa, Staphylococcus epidermidis
SVILVITIIISFLFYFYTTEKKVDKDK

SEQ ID NO: 1739088 - protein, 19 aa, Staphylococcus epidermidis
SYEDLKNLTINWFNVLSLT

SEQ ID NO: 1739089 - protein, 17 aa, Staphylococcus epidermidis
SYLSWKLNPAGSISIMV

SEQ ID NO: 1739090 - protein, 17 aa, Staphylococcus epidermidis
TFKWNATQTYDNGDVVK

SEQ ID NO: 1739091 - protein, 20 aa, Staphylococcus epidermidis
TGAMKDYHKAKVYGSKTFGK

SEQ ID NO: 1739092 - protein, 25 aa, Staphylococcus epidermidis
THTGRELGQFYLGIMDNIMRIEEAD

SEQ ID NO: 1739093 - protein, 17 aa, Staphylococcus epidermidis
TIEAVDIMVFILVLGGL

SEQ ID NO: 1739094 - protein, 20 aa, Staphylococcus epidermidis
TITLKTYFSYYVDFSLGVKG

SEQ ID NO: 1739095 - protein, 23 aa, Staphylococcus epidermidis
TKQPVDEIVHYGGEEIKPGHKDE

SEQ ID NO: 1739096 - protein, 19 aa, Staphylococcus epidermidis
TLFVPVELFNSWTSAQSQF

SEQ ID NO: 1739097 - protein, 21 aa, Staphylococcus epidermidis
TLLPMCLDIEHSLKTDILKKI

SEQ ID NO: 1739098 - protein, 26 aa, Staphylococcus epidermidis
TNHVFSFKLLLSLLIIGFIVLAILLA

SEQ ID NO: 1739099 - protein, 18 aa, Staphylococcus epidermidis
TNIAVAFGALIGGLMYGA

SEQ ID NO: 1739100 - protein, 20 aa, Staphylococcus epidermidis
TNTYDGTGFVIARTSQTDIT

SEQ ID NO: 1739101 - protein, 19 aa, Staphylococcus epidermidis
TPASIRKYNEAKSRIQTQI

SEQ ID NO: 1739102 - protein, 21 aa, Staphylococcus epidermidis
TQIFGIPVFLFLNLLIVLLCI

SEQ ID NO: 1739103 - protein, 25 aa, Staphylococcus epidermidis
TQKPTARKAISGMASQLNNSINNTP

SEQ ID NO: 1739104 - protein, 20 aa, Staphylococcus epidermidis
TRKIKELFVARKVEKQYSKN

SEQ ID NO: 1739105 - protein, 22 aa, Staphylococcus epidermidis
TRKLVKETINRIGRLSGGKDVD

SEQ ID NO: 1739106 - protein, 24 aa, Staphylococcus epidermidis
TRRSIGAIVLQLALLFIAQLYFHF

SEQ ID NO: 1739107 - protein, 18 aa, Staphylococcus epidermidis
TSGKTPASIRKYNEAKSR

SEQ ID NO: 1739108 - protein, 20 aa, Staphylococcus epidermidis
TTVSCLIPYKSSKEEHFNES

SEQ ID NO: 1739109 - protein, 23 aa, Staphylococcus epidermidis
TTYPRLRVTGAPFEAVGLPDCIQ

SEQ ID NO: 1739110 - protein, 17 aa, Staphylococcus epidermidis
TVLSYPVYLFIIGLIVL

SEQ ID NO: 1739111 - protein, 17 aa, Staphylococcus epidermidis
TYFSYYVDFSLGVKGLV

SEQ ID NO: 1739112 - protein, 17 aa, Staphylococcus epidermidis
TYKVYKNGVVLYKSGNY

SEQ ID NO: 1739113 - protein, 24 aa, Staphylococcus epidermidis
TYLHIMWIYIVRSFGMAFVMMPIM

SEQ ID NO: 1739114 - protein, 18 aa, Staphylococcus epidermidis
VAVSLIAPWLGRTALTWI

SEQ ID NO: 1739115 - protein, 24 aa, Staphylococcus epidermidis
VAVVLLAWVFLPKYLKYGVNTISE

SEQ ID NO: 1739116 - protein, 24 aa, Staphylococcus epidermidis
VDSELERSLKLYGRDIDHNSPFYK

SEQ ID NO: 1739117 - protein, 18 aa, Staphylococcus epidermidis
VEQLKYDSKDNIHADELQ

SEQ ID NO: 1739118 - protein, 37 aa, Staphylococcus epidermidis
VFKHRKEQLAGLKFSISLKVIERLLLALILPLIILMI

SEQ ID NO: 1739119 - protein, 39 aa, Staphylococcus epidermidis
VFSKILKLREGHIFIRKCLRTSIMFSIILLGFVAMNILF

SEQ ID NO: 1739120 - protein, 17 aa, Staphylococcus epidermidis
VGAGLVFIAFIAAYCLI

SEQ ID NO: 1739121 - protein, 21 aa, Staphylococcus epidermidis
VGVLIIPPLISFTWIAGFGGT

SEQ ID NO: 1739122 - protein, 19 aa, Staphylococcus epidermidis
VGVVSIITGVTIFIGGQQA

SEQ ID NO: 1739123 - protein, 17 aa, Staphylococcus epidermidis
VIKSPWLGRILIVGCIF

SEQ ID NO: 1739124 - protein, 18 aa, Staphylococcus epidermidis
VINGCIVALFTHWLRNRN

SEQ ID NO: 1739125 - protein, 21 aa, Staphylococcus epidermidis
VIVSCIIFSTFFLSVNQGAQS

SEQ ID NO: 1739126 - protein, 26 aa, Staphylococcus epidermidis
VKALKLKMPLIRVFRVSYIINALNSI

SEQ ID NO: 1739127 - protein, 21 aa, Staphylococcus epidermidis
VKDNLRKARIEKLTQEEIHQQ

SEQ ID NO: 1739128 - protein, 25 aa, Staphylococcus epidermidis
VKGFKRTRVSMFIWLVLLLPLPFLL

SEQ ID NO: 1739129 - protein, 17 aa, Staphylococcus epidermidis
VKKLSDFINEDEAAQNE

SEQ ID NO: 1739130 - protein, 24 aa, Staphylococcus epidermidis
VLAFKDFRFDTGIIGGDWKGLYYF

SEQ ID NO: 1739131 - protein, 18 aa, Staphylococcus epidermidis
VLCSILATWGLLQATHMW

SEQ ID NO: 1739132 - protein, 20 aa, Staphylococcus epidermidis
VLGLILCLFATIPGIVLWNR

SEQ ID NO: 1739133 - protein, 19 aa, Staphylococcus epidermidis
VLIHLSIGILIYLAFLIIY

SEQ ID NO: 1739134 - protein, 25 aa, Staphylococcus epidermidis
VLSGLSFSCAMAFSAASQIYLGKFI

SEQ ID NO: 1739135 - protein, 37 aa, Staphylococcus epidermidis
VNEFKQLVVAFFKEHWPKMLIIIGIIVLLLILNAIFT

SEQ ID NO: 1739136 - protein, 23 aa, Staphylococcus epidermidis
VNEKRIRPEDMHIMANIFLPSNE

SEQ ID NO: 1739137 - protein, 18 aa, Staphylococcus epidermidis
VNSSLVFVGSVVSLVLLI

SEQ ID NO: 1739138 - protein, 17 aa, Staphylococcus epidermidis
VQLKVNDAIHILQNKEN

SEQ ID NO: 1739139 - protein, 19 aa, Staphylococcus epidermidis
VSKKDYKAIAKELSISEDY

SEQ ID NO: 1739140 - protein, 25 aa, Staphylococcus epidermidis
VSVYLAITMLLVWLSLISITYRSDK

SEQ ID NO: 1739141 - protein, 21 aa, Staphylococcus epidermidis
VTFVLRLTPYGILAIMASTLA

SEQ ID NO: 1739142 - protein, 17 aa, Staphylococcus epidermidis
VTQRKKPFLSMMPVVAM

SEQ ID NO: 1739143 - protein, 18 aa, Staphylococcus epidermidis
WAAIIAFSTIYSFIGYLS

SEQ ID NO: 1739144 - protein, 17 aa, Staphylococcus epidermidis
WDEMKHKAADIGKANTQ

SEQ ID NO: 1739145 - protein, 27 aa, Staphylococcus epidermidis
WINGFSPEYTMSVWMGFNKVKQYGTNS

SEQ ID NO: 1739146 - protein, 23 aa, Staphylococcus epidermidis
WIRFASKILPLIILITIIIHILS

SEQ ID NO: 1739147 - protein, 20 aa, Staphylococcus epidermidis
WKGLYYFKRFFSDPRCIQII

SEQ ID NO: 1739148 - protein, 20 aa, Staphylococcus epidermidis
WKVAIVYFIVLAIFSILTGF

SEQ ID NO: 1739149 - protein, 18 aa, Staphylococcus epidermidis
WLNIIGWNGNLAVFILFG

SEQ ID NO: 1739150 - protein, 21 aa, Staphylococcus epidermidis
WSFYGNLLIMLPMSLWAIERF

SEQ ID NO: 1739151 - protein, 18 aa, Staphylococcus epidermidis
WYFLENVPHLALILFILV

SEQ ID NO: 1739152 - protein, 17 aa, Staphylococcus epidermidis
YAVGVVSIITGVTIFIG

SEQ ID NO: 1739153 - protein, 26 aa, Staphylococcus epidermidis
YDDPPIWVCLELMTFGQFSAFVEFYS

SEQ ID NO: 1739154 - protein, 24 aa, Staphylococcus epidermidis
YDTKGHGTVSIYDALRQSFNIPAL

SEQ ID NO: 1739155 - protein, 18 aa, Staphylococcus epidermidis
YHKIWDRIIRVMTSLSVS

SEQ ID NO: 1739156 - protein, 25 aa, Staphylococcus epidermidis
YIGVWLYHFLERVLIPTGLHHFIYA

SEQ ID NO: 1739157 - protein, 19 aa, Staphylococcus epidermidis
YILYSIFCVLLIGLLILPE

SEQ ID NO: 1739158 - protein, 18 aa, Staphylococcus epidermidis
YKILPSIKKKGITTINYL

SEQ ID NO: 1739159 - protein, 20 aa, Staphylococcus epidermidis
YKNIYMLKGGYKKWTGKIKS

SEQ ID NO: 1739160 - protein, 24 aa, Staphylococcus epidermidis
YKQEWFIVLSLLFIFPLGLFLMWK

SEQ ID NO: 1739161 - protein, 24 aa, Staphylococcus epidermidis
YLMILPCLLFFLIFNYIPMTSLVL

SEQ ID NO: 1739162 - protein, 25 aa, Staphylococcus epidermidis
YPLGKATSHLLGYVGPINSEELKQK

SEQ ID NO: 1739163 - protein, 17 aa, Staphylococcus epidermidis
YTLIRIIYRHPKDSLTR

SEQ ID NO: 1739164 - protein, 17 aa, Staphylococcus epidermidis
YYEAIVIGFYFIYRFAI

SEQ ID NO: 1739165 - protein, 18 aa, Staphylococcus epidermidis
AAENGILFKGGQFVERAH

SEQ ID NO: 1739166 - protein, 27 aa, Staphylococcus epidermidis
AAIINQIRASKDIKIINQIVDNAIELN

SEQ ID NO: 1739167 - protein, 20 aa, Staphylococcus epidermidis
AALLAIIFDFILRYMERLSY

SEQ ID NO: 1739168 - protein, 17 aa, Staphylococcus epidermidis
AALSIPSYIALGIWLVI

SEQ ID NO: 1739169 - protein, 26 aa, Staphylococcus epidermidis
ADEDLKLQYDYAINLANNVLDKENGT

SEQ ID NO: 1739170 - protein, 17 aa, Staphylococcus epidermidis
AENGILFKGGQFVERAH

SEQ ID NO: 1739171 - protein, 20 aa, Staphylococcus epidermidis
AERQRIPLIINQENAVLAIG

SEQ ID NO: 1739172 - protein, 34 aa, Staphylococcus epidermidis
AETSLNGFERLNHARPRALEYIKSLEKINNAQKS

SEQ ID NO: 1739173 - protein, 20 aa, Staphylococcus epidermidis
AHALANAGADVIIGHNTVIQ

SEQ ID NO: 1739174 - protein, 25 aa, Staphylococcus epidermidis
AIGIFCIIMIFALLGFLPYNLNPAK

SEQ ID NO: 1739175 - protein, 43 aa, Staphylococcus epidermidis
AIIVYFIVCLLISFLALISMNIRILSGLLFLIAAIVTIPLVLL

SEQ ID NO: 1739176 - protein, 19 aa, Staphylococcus epidermidis
AIMYYFWQSKALIVLVIII

SEQ ID NO: 1739177 - protein, 24 aa, Staphylococcus epidermidis
ALDKARPKIEEIVPQVSKKRDVLN

SEQ ID NO: 1739178 - protein, 18 aa, Staphylococcus epidermidis
ALFDPAPLYGDREFDIGI

SEQ ID NO: 1739179 - protein, 21 aa, Staphylococcus epidermidis
ALNKVMGKLEQFINHADSVEN

SEQ ID NO: 1739180 - protein, 17 aa, Staphylococcus epidermidis
AMLLQSMTVRLGIATGM

SEQ ID NO: 1739181 - protein, 18 aa, Staphylococcus epidermidis
AMLLQSMTVRLGIATGMD

SEQ ID NO: 1739182 - protein, 21 aa, Staphylococcus epidermidis
ANKFAGISWSHWLGTDHLGRD

SEQ ID NO: 1739183 - protein, 22 aa, Staphylococcus epidermidis
ANKFAGISWSHWLGTDHLGRDV

SEQ ID NO: 1739184 - protein, 17 aa, Staphylococcus epidermidis
APPQWLYHCSLSLSFVI

SEQ ID NO: 1739185 - protein, 18 aa, Staphylococcus epidermidis
AQGLILIIFYKIHQSVIN

SEQ ID NO: 1739186 - protein, 18 aa, Staphylococcus epidermidis
AQKAAIINQIRASKDIKI

SEQ ID NO: 1739187 - protein, 29 aa, Staphylococcus epidermidis
ASERQPVKIPGYQHYRTSVSDGITKFIYR

SEQ ID NO: 1739188 - protein, 18 aa, Staphylococcus epidermidis
ASVIGLVLLFIALCTGIV

SEQ ID NO: 1739189 - protein, 17 aa, Staphylococcus epidermidis
AVLPGVALSFLFNIPMF

SEQ ID NO: 1739190 - protein, 25 aa, Staphylococcus epidermidis
AVPLAAGALAFVGLILSPAVGAILM

SEQ ID NO: 1739191 - protein, 26 aa, Staphylococcus epidermidis
AVVDRDGRLIGIVSLKIDMHNVEGMA

SEQ ID NO: 1739192 - protein, 25 aa, Staphylococcus epidermidis
AYEYKTMSSYEYKEGDKIGVPGFVR

SEQ ID NO: 1739193 - protein, 25 aa, Staphylococcus epidermidis
AYEYKTMSSYEYKEGDKIGVPGLVR

SEQ ID NO: 1739194 - protein, 18 aa, Staphylococcus epidermidis
AYLLKISRSFEVILLEEK

SEQ ID NO: 1739195 - protein, 23 aa, Staphylococcus epidermidis
CLGGVGISMGMSWAAATDLGRNF

SEQ ID NO: 1739196 - protein, 21 aa, Staphylococcus epidermidis
CLIMLKLMLAIAFFVVSLTIS

SEQ ID NO: 1739197 - protein, 20 aa, Staphylococcus epidermidis
CNKIYCFIDEIFKGTNTTER

SEQ ID NO: 1739198 - protein, 18 aa, Staphylococcus epidermidis
DAGIRSGIFIALATFLRP

SEQ ID NO: 1739199 - protein, 23 aa, Staphylococcus epidermidis
DASHELRTPLQIIQGHLNLIQRW

SEQ ID NO: 1739200 - protein, 17 aa, Staphylococcus epidermidis
DDPKLSFSIVYTNQPVP

SEQ ID NO: 1739201 - protein, 31 aa, Staphylococcus epidermidis
DFLNSNFWLYWKTMFAFEPWHSAMEMRRYLM

SEQ ID NO: 1739202 - protein, 17 aa, Staphylococcus epidermidis
DHHTVYSGETFKNTINV

SEQ ID NO: 1739203 - protein, 18 aa, Staphylococcus epidermidis
DHHTVYSGETFKNTINVN

SEQ ID NO: 1739204 - protein, 23 aa, Staphylococcus epidermidis
DIFKLTYQFGMIILSVLTLTTCH

SEQ ID NO: 1739205 - protein, 17 aa, Staphylococcus epidermidis
DIHSIPVVKRKQNSDNK

SEQ ID NO: 1739206 - protein, 18 aa, Staphylococcus epidermidis
DKGFKIGDILSLSQSDEK

SEQ ID NO: 1739207 - protein, 25 aa, Staphylococcus epidermidis
DMEGKNFKGAITIDMSESDSIAYES

SEQ ID NO: 1739208 - protein, 25 aa, Staphylococcus epidermidis
DYKMNALRLAKSYVKNINISNQASY

SEQ ID NO: 1739209 - protein, 19 aa, Staphylococcus epidermidis
EALIKDVVMIAARILLESG

SEQ ID NO: 1739210 - protein, 20 aa, Staphylococcus epidermidis
EEGIGFVVIILFILKLLAAI

SEQ ID NO: 1739211 - protein, 23 aa, Staphylococcus epidermidis
EEGKAIPHWDVFGLHINEVGYQG

SEQ ID NO: 1739212 - protein, 30 aa, Staphylococcus epidermidis
EEYDASYELPILYVTVWLDDQGNIIKDAVE

SEQ ID NO: 1739213 - protein, 31 aa, Staphylococcus epidermidis
EEYDASYELPILYVTVWLDDQGNIIKDAVED

SEQ ID NO: 1739214 - protein, 20 aa, Staphylococcus epidermidis
EFRTASYDNTIAFSTSSGQG

SEQ ID NO: 1739215 - protein, 24 aa, Staphylococcus epidermidis
EHIRYGESILKCSILKSQHINNVA

SEQ ID NO: 1739216 - protein, 21 aa, Staphylococcus epidermidis
EIENFKFFVQYGNFKNLKDYK

SEQ ID NO: 1739217 - protein, 19 aa, Staphylococcus epidermidis
ELGTFPIGDYNLKASKDME

SEQ ID NO: 1739218 - protein, 28 aa, Staphylococcus epidermidis
ELKIIFRKKLYLVVSIFLPVVFYLLFTS

SEQ ID NO: 1739219 - protein, 26 aa, Staphylococcus epidermidis
ENHPERYYNGRDYRREQQLEEENEKS

SEQ ID NO: 1739220 - protein, 19 aa, Staphylococcus epidermidis
ENVNFIWRLLACYVTSVTV

SEQ ID NO: 1739221 - protein, 19 aa, Staphylococcus epidermidis
EPMSAKKQILFALSVSLLN

SEQ ID NO: 1739222 - protein, 29 aa, Staphylococcus epidermidis
EQKHTGWLIVLSIIFVLLIAALLYGAYYA

SEQ ID NO: 1739223 - protein, 21 aa, Staphylococcus epidermidis
ETLQIIFPYSLSMAIVGLVES

SEQ ID NO: 1739224 - protein, 18 aa, Staphylococcus epidermidis
EVALSYALLGGFAALISY

SEQ ID NO: 1739225 - protein, 26 aa, Staphylococcus epidermidis
EYFHTIMFSSYIWKNVGWDSIIYFAA

SEQ ID NO: 1739226 - protein, 18 aa, Staphylococcus epidermidis
EYSLEWFPIAVVATLVGY

SEQ ID NO: 1739227 - protein, 21 aa, Staphylococcus epidermidis
FDLIIGLLLNFQIFLKNKKYD

SEQ ID NO: 1739228 - protein, 18 aa, Staphylococcus epidermidis
FDPNLAPGTEKVVQKGEP

SEQ ID NO: 1739229 - protein, 21 aa, Staphylococcus epidermidis
FEGVFIYPALLAIIIAILSYI

SEQ ID NO: 1739230 - protein, 25 aa, Staphylococcus epidermidis
FGLTVKETFLTWSLLETIISVSGII

SEQ ID NO: 1739231 - protein, 25 aa, Staphylococcus epidermidis
FGLVYFLFCLGFRNLGFMYLFSETF

SEQ ID NO: 1739232 - protein, 18 aa, Staphylococcus epidermidis
FIEIIWVTGLDQAHSLFT

SEQ ID NO: 1739233 - protein, 21 aa, Staphylococcus epidermidis
FIGSICLLTSILSGNTLNGLM

SEQ ID NO: 1739234 - protein, 18 aa, Staphylococcus epidermidis
FIHNQWLLIFSFVLIGIN

SEQ ID NO: 1739235 - protein, 24 aa, Staphylococcus epidermidis
FKEEGHKLIGIRGMPRVGKTESIV

SEQ ID NO: 1739236 - protein, 21 aa, Staphylococcus epidermidis
FKISFKNSLQLLIKNKSKTHE

SEQ ID NO: 1739237 - protein, 17 aa, Staphylococcus epidermidis
FKPLKVIATDEDITSPI

SEQ ID NO: 1739238 - protein, 23 aa, Staphylococcus epidermidis
FLSKNQKGMIVQQDWKGSHNQFH

SEQ ID NO: 1739239 - protein, 22 aa, Staphylococcus epidermidis
FMPIPMPASVIGLVLLFIALCT

SEQ ID NO: 1739240 - protein, 24 aa, Staphylococcus epidermidis
FNKYSYRKLFIIGLALFTLGSLVC

SEQ ID NO: 1739241 - protein, 23 aa, Staphylococcus epidermidis
FNQLYVVFKMIFWFNPALYISKT

SEQ ID NO: 1739242 - protein, 17 aa, Staphylococcus epidermidis
FPIGVWLLYIGVFFTIL

SEQ ID NO: 1739243 - protein, 17 aa, Staphylococcus epidermidis
FQSKIPSLKGWKNTKDV

SEQ ID NO: 1739244 - protein, 24 aa, Staphylococcus epidermidis
FSKEEIRTLLNIAGREGAFNEIEN

SEQ ID NO: 1739245 - protein, 24 aa, Staphylococcus epidermidis
FSSYIIPGIMTLIFSIGFIHNIIK

SEQ ID NO: 1739246 - protein, 25 aa, Staphylococcus epidermidis
FSSYIIPGIMTLIFSIGFIHNIIKV

SEQ ID NO: 1739247 - protein, 17 aa, Staphylococcus epidermidis
FSTGSLIVNDFSRNQKD

SEQ ID NO: 1739248 - protein, 22 aa, Staphylococcus epidermidis
FTELEDLYFRGNERLLHQAFNN

SEQ ID NO: 1739249 - protein, 20 aa, Staphylococcus epidermidis
FTKDFKFKRTLYDDIRKDHA

SEQ ID NO: 1739250 - protein, 17 aa, Staphylococcus epidermidis
FVIVTTYQFGQYAMLFL

SEQ ID NO: 1739251 - protein, 17 aa, Staphylococcus epidermidis
FYVKKEKVLGMTISQHP

SEQ ID NO: 1739252 - protein, 21 aa, Staphylococcus epidermidis
GAPTARLYYAAGARSGEYKQA

SEQ ID NO: 1739253 - protein, 17 aa, Staphylococcus epidermidis
GDNQNLPDSNRIYDYSE

SEQ ID NO: 1739254 - protein, 20 aa, Staphylococcus epidermidis
GDNRLLLGIILGVITFWLFA

SEQ ID NO: 1739255 - protein, 22 aa, Staphylococcus epidermidis
GFYILYQFLFKRAHEHHHHVGN

SEQ ID NO: 1739256 - protein, 24 aa, Staphylococcus epidermidis
GGKDVDIDLGFSQWGLKQQPNESY

SEQ ID NO: 1739257 - protein, 18 aa, Staphylococcus epidermidis
GHVLPLVAKYLINREDEV

SEQ ID NO: 1739258 - protein, 27 aa, Staphylococcus epidermidis
GINLPFQFTFPGSEWVVLILSTILFFY

SEQ ID NO: 1739259 - protein, 19 aa, Staphylococcus epidermidis
GIYFRNVRRSMLEQLNEDY

SEQ ID NO: 1739260 - protein, 26 aa, Staphylococcus epidermidis
GLDVKWGAAITAIFAILIFVSRSGQK

SEQ ID NO: 1739261 - protein, 17 aa, Staphylococcus epidermidis
GMMTGLIIGGVDPLQAI

SEQ ID NO: 1739262 - protein, 31 aa, Staphylococcus epidermidis
GNGAFLMFIAFYFKKLRTQKIVFSIGLCYSI

SEQ ID NO: 1739263 - protein, 23 aa, Staphylococcus epidermidis
GPLKRKIKGNVLNKVNNSNDEIK

SEQ ID NO: 1739264 - protein, 23 aa, Staphylococcus epidermidis
GPLKRKIKGNVLNKVNNSSDEIK

SEQ ID NO: 1739265 - protein, 22 aa, Staphylococcus epidermidis
GQAGGLAIIIGWIITAIGMISL

SEQ ID NO: 1739266 - protein, 17 aa, Staphylococcus epidermidis
GRFASYILPIITMSIGM

SEQ ID NO: 1739267 - protein, 21 aa, Staphylococcus epidermidis
GSFFRQRLGNEVLENLIEPLM

SEQ ID NO: 1739268 - protein, 18 aa, Staphylococcus epidermidis
GTTVLGIVSLFSWGLGYF

SEQ ID NO: 1739269 - protein, 17 aa, Staphylococcus epidermidis
GWEKFTGDFTLNGLVPV

SEQ ID NO: 1739270 - protein, 31 aa, Staphylococcus epidermidis
HDSKGTLLGALFAGLGALLLGKRRKNRKNKN

SEQ ID NO: 1739271 - protein, 17 aa, Staphylococcus epidermidis
HFNKLRHQPKWILKSII

SEQ ID NO: 1739272 - protein, 18 aa, Staphylococcus epidermidis
HFTSLKGFYDASFGLGGD

SEQ ID NO: 1739273 - protein, 17 aa, Staphylococcus epidermidis
HHKDIRLSDTDKIDPIV

SEQ ID NO: 1739274 - protein, 27 aa, Staphylococcus epidermidis
HKKSKEKQLSEEDIHSIPVVKRKQNSD

SEQ ID NO: 1739275 - protein, 19 aa, Staphylococcus epidermidis
HKRITWLYNLTTIMTLIFA

SEQ ID NO: 1739276 - protein, 17 aa, Staphylococcus epidermidis
HLYEHFTSLKGFYDASF

SEQ ID NO: 1739277 - protein, 36 aa, Staphylococcus epidermidis
HNPETLLPVNLYVKPELKHTIELYHDNEKQNRKEFS

SEQ ID NO: 1739278 - protein, 23 aa, Staphylococcus epidermidis
HSNAFKGLSWHQSLFYALFQSST

SEQ ID NO: 1739279 - protein, 20 aa, Staphylococcus epidermidis
IAAMFHWTAGFSFSAGLIDY

SEQ ID NO: 1739280 - protein, 17 aa, Staphylococcus epidermidis
IALHVTMNFPLSISFVI

SEQ ID NO: 1739281 - protein, 23 aa, Staphylococcus epidermidis
IALSCITILLLMIYQKDFYKNQV

SEQ ID NO: 1739282 - protein, 18 aa, Staphylococcus epidermidis
IATKLGYPESNSFVTNTV

SEQ ID NO: 1739283 - protein, 19 aa, Staphylococcus epidermidis
IATKLGYPESNSFVTNTVI

SEQ ID NO: 1739284 - protein, 34 aa, Staphylococcus epidermidis
ICGPLLVKLTHRFSSRSVLLWTLIVFIFGNGMIA

SEQ ID NO: 1739285 - protein, 22 aa, Staphylococcus epidermidis
ICLIMLKLMLAIAFFVVSLTIS

SEQ ID NO: 1739286 - protein, 17 aa, Staphylococcus epidermidis
ICVVVVILFNTLKTNRS

SEQ ID NO: 1739287 - protein, 17 aa, Staphylococcus epidermidis
IDSGFYQTPKYSLGNYV

SEQ ID NO: 1739288 - protein, 20 aa, Staphylococcus epidermidis
IENFKFFVQYGNFKNLKDYK

SEQ ID NO: 1739289 - protein, 17 aa, Staphylococcus epidermidis
IFDVMRMFFIGGVLSLI

SEQ ID NO: 1739290 - protein, 18 aa, Staphylococcus epidermidis
IFEYKVSKNMGFEVYYLA

SEQ ID NO: 1739291 - protein, 24 aa, Staphylococcus epidermidis
IFFTPRIGIIAGLIIGVFAGVIWE

SEQ ID NO: 1739292 - protein, 17 aa, Staphylococcus epidermidis
IFLPVVFYLLFTSILDM

SEQ ID NO: 1739293 - protein, 17 aa, Staphylococcus epidermidis
IGWYMWSLWSLIIALLP

SEQ ID NO: 1739294 - protein, 21 aa, Staphylococcus epidermidis
IHSPITFWYGKYIILIPSLYF

SEQ ID NO: 1739295 - protein, 19 aa, Staphylococcus epidermidis
IIGGDWKGLYYFKRFFSDP

SEQ ID NO: 1739296 - protein, 22 aa, Staphylococcus epidermidis
IIISGVLLRKAFLKMDNYVDDL

SEQ ID NO: 1739297 - protein, 21 aa, Staphylococcus epidermidis
IILIICSIYLAFILIGSLNGK

SEQ ID NO: 1739298 - protein, 17 aa, Staphylococcus epidermidis
IKGDAFISIHNDALDSS

SEQ ID NO: 1739299 - protein, 17 aa, Staphylococcus epidermidis
IKIEARDNSGQAVTNKV

SEQ ID NO: 1739300 - protein, 18 aa, Staphylococcus epidermidis
IKMSVPVLSVIYPVAITV

SEQ ID NO: 1739301 - protein, 19 aa, Staphylococcus epidermidis
IKMSVPVLSVIYPVAITVI

SEQ ID NO: 1739302 - protein, 23 aa, Staphylococcus epidermidis
IKSLKVRFIYTMQLIVAFIAILI

SEQ ID NO: 1739303 - protein, 28 aa, Staphylococcus epidermidis
IKSLPFRRIISFFLVFTMLFSVGVVPLY

SEQ ID NO: 1739304 - protein, 25 aa, Staphylococcus epidermidis
IKVMRISGAFWTFLLVIALSILILL

SEQ ID NO: 1739305 - protein, 24 aa, Staphylococcus epidermidis
ILGAGVEWGTTFVTLVTFVILIIL

SEQ ID NO: 1739306 - protein, 28 aa, Staphylococcus epidermidis
ILLVSAFLLNLVFAFIIIFMERRTANSI

SEQ ID NO: 1739307 - protein, 29 aa, Staphylococcus epidermidis
ILLVSAFLLNLVFAFIIIFMERRTANSIW

SEQ ID NO: 1739308 - protein, 17 aa, Staphylococcus epidermidis
ILSWIGNGLHLLYVFLI

SEQ ID NO: 1739309 - protein, 17 aa, Staphylococcus epidermidis
ILSWIGNGLHLLYVFLV

SEQ ID NO: 1739310 - protein, 17 aa, Staphylococcus epidermidis
INIKFKGANKLSDKSEK

SEQ ID NO: 1739311 - protein, 18 aa, Staphylococcus epidermidis
INYLYTFSVLFFVDLIII

SEQ ID NO: 1739312 - protein, 19 aa, Staphylococcus epidermidis
IPSGVLGLIGIVGYVSYYS

SEQ ID NO: 1739313 - protein, 26 aa, Staphylococcus epidermidis
IPSICIIGIGIIGWYMWSLWSLIIAL

SEQ ID NO: 1739314 - protein, 19 aa, Staphylococcus epidermidis
IQFEFFRRDLLKEKMTTQN

SEQ ID NO: 1739315 - protein, 21 aa, Staphylococcus epidermidis
IRPLILKYRIQFIEQKTQIHY

SEQ ID NO: 1739316 - protein, 17 aa, Staphylococcus epidermidis
ISAMIASVMTWILAPYM

SEQ ID NO: 1739317 - protein, 17 aa, Staphylococcus epidermidis
ISQEIYHNLLFNSIVSI

SEQ ID NO: 1739318 - protein, 23 aa, Staphylococcus epidermidis
ISRRRYRTLKKVVIKSIWFNITQ

SEQ ID NO: 1739319 - protein, 21 aa, Staphylococcus epidermidis
ISYPAAYFISYSRFQNILLML

SEQ ID NO: 1739320 - protein, 24 aa, Staphylococcus epidermidis
ITALSMGLAKAGTWMNTGEGGLSE

SEQ ID NO: 1739321 - protein, 25 aa, Staphylococcus epidermidis
ITALSMGLAKAGTWMNTGEGGLSEY

SEQ ID NO: 1739322 - protein, 23 aa, Staphylococcus epidermidis
ITKQPVDEIVHYGGEQIPQGHKD

SEQ ID NO: 1739323 - protein, 17 aa, Staphylococcus epidermidis
ITPYLNRVNGVFFGQIF

SEQ ID NO: 1739324 - protein, 30 aa, Staphylococcus epidermidis
IVCILFMIIVPWFKFKHLRYFLDDKEIHIR

SEQ ID NO: 1739325 - protein, 17 aa, Staphylococcus epidermidis
IVLFQWKFITIESNGVM

SEQ ID NO: 1739326 - protein, 18 aa, Staphylococcus epidermidis
IYESAAIDGANRFKQIIH

SEQ ID NO: 1739327 - protein, 19 aa, Staphylococcus epidermidis
IYHNLLFNSIVSIVFTIVI

SEQ ID NO: 1739328 - protein, 25 aa, Staphylococcus epidermidis
IYSLFRKQSFRGNEYLNSLQKGTSY

SEQ ID NO: 1739329 - protein, 19 aa, Staphylococcus epidermidis
KALFCSGMIMILSSIVFGA

SEQ ID NO: 1739330 - protein, 17 aa, Staphylococcus epidermidis
KASKDMEGKNFKGAITI

SEQ ID NO: 1739331 - protein, 20 aa, Staphylococcus epidermidis
KASLFLLIGVMYKITKTTDL

SEQ ID NO: 1739332 - protein, 17 aa, Staphylococcus epidermidis
KAYIKNRVTNFRFSLFT

SEQ ID NO: 1739333 - protein, 26 aa, Staphylococcus epidermidis
KDMEGKNFKGAITIDMSESDSIAYES

SEQ ID NO: 1739334 - protein, 22 aa, Staphylococcus epidermidis
KEIKEADGIIIAADRQVDLSRF

SEQ ID NO: 1739335 - protein, 24 aa, Staphylococcus epidermidis
KESNGSGIGLYFANIVLQQYNSEL

SEQ ID NO: 1739336 - protein, 21 aa, Staphylococcus epidermidis
KETSSWKWTLLAVVYPIATAY

SEQ ID NO: 1739337 - protein, 22 aa, Staphylococcus epidermidis
KETSSWKWTLLAVVYPIVTAYI

SEQ ID NO: 1739338 - protein, 19 aa, Staphylococcus epidermidis
KEYSLEWFPIAVVATLVGY

SEQ ID NO: 1739339 - protein, 24 aa, Staphylococcus epidermidis
KGASVGRKDLEFTFVENKEENIFF

SEQ ID NO: 1739340 - protein, 18 aa, Staphylococcus epidermidis
KGETKTKYDAMKKDNTET

SEQ ID NO: 1739341 - protein, 26 aa, Staphylococcus epidermidis
KHLMFSKTFLFYCLLIIIFTVLNCQQ

SEQ ID NO: 1739342 - protein, 22 aa, Staphylococcus epidermidis
KHYFKLSWKKIYQVSTLGIPTA

SEQ ID NO: 1739343 - protein, 20 aa, Staphylococcus epidermidis
KIPSLKGWKNTKDVYQPNVQ

SEQ ID NO: 1739344 - protein, 22 aa, Staphylococcus epidermidis
KKEALYFRQWILNFKRSIAIIY

SEQ ID NO: 1739345 - protein, 23 aa, Staphylococcus epidermidis
KKEFALNMALGMEKKHLRLIILI

SEQ ID NO: 1739346 - protein, 18 aa, Staphylococcus epidermidis
KKERNGFTIIKKKKEHGY

SEQ ID NO: 1739347 - protein, 30 aa, Staphylococcus epidermidis; identical to SEQ ID NO: 1580252

SEQ ID NO: 1739348 - protein, 20 aa, Staphylococcus epidermidis
KLQYDYAINLANNVLDKENG

SEQ ID NO: 1739349 - protein, 17 aa, Staphylococcus epidermidis
KNAKVSGILLVITGIIG

SEQ ID NO: 1739350 - protein, 26 aa, Staphylococcus epidermidis
KPSQRKFWYSFGLVFGGIGLISIFFI

SEQ ID NO: 1739351 - protein, 25 aa, Staphylococcus epidermidis
KQPKGKIMISRGMVLYINRNTRTTK

SEQ ID NO: 1739352 - protein, 30 aa, Staphylococcus epidermidis
KQSIDEISKILPVIEIKSAARNEIHQKAEV

SEQ ID NO: 1739353 - protein, 18 aa, Staphylococcus epidermidis
KRDHPFVYWATLKNVASL

SEQ ID NO: 1739354 - protein, 23 aa, Staphylococcus epidermidis
KRPIIKRYVALVGTLLTLVIALI

SEQ ID NO: 1739355 - protein, 17 aa, Staphylococcus epidermidis
KSNHLTLTLSVYMFTVI

SEQ ID NO: 1739356 - protein, 17 aa, Staphylococcus epidermidis
KTRKLQCPDCHEMHYCV

SEQ ID NO: 1739357 - protein, 21 aa, Staphylococcus epidermidis
KVALGIGGAITAVALSRKESR

SEQ ID NO: 1739358 - protein, 25 aa, Staphylococcus epidermidis
KVLQKFCLENKIGKYTLHSIRHTHC

SEQ ID NO: 1739359 - protein, 18 aa, Staphylococcus epidermidis
LCLCRLNVVISLFISALV

SEQ ID NO: 1739360 - protein, 19 aa, Staphylococcus epidermidis
LCLCRLNVVISLFISALVG

SEQ ID NO: 1739361 - protein, 25 aa, Staphylococcus epidermidis
LCNMLSYGIGENVNFIWRLLACYVT

SEQ ID NO: 1739362 - protein, 20 aa, Staphylococcus epidermidis
LDFWTWMMIIPMVLGSVLIG

SEQ ID NO: 1739363 - protein, 18 aa, Staphylococcus epidermidis
LDKEIIKQLTDAVNQANN

SEQ ID NO: 1739364 - protein, 17 aa, Staphylococcus epidermidis
LFDPAPLYGDREFDIGI

SEQ ID NO: 1739365 - protein, 26 aa, Staphylococcus epidermidis
LFFRYILKRYFNYMLNYKVWYLTLLA

SEQ ID NO: 1739366 - protein, 27 aa, Staphylococcus epidermidis
LFFRYILKRYFNYMLNYKVWYLTLLAG

SEQ ID NO: 1739367 - protein, 23 aa, Staphylococcus epidermidis
LFLFLIFHLIRLASKIDSQFNKV

SEQ ID NO: 1739368 - protein, 18 aa, Staphylococcus epidermidis
LFWYCKKIKKDPKSSYSY

SEQ ID NO: 1739369 - protein, 18 aa, Staphylococcus epidermidis
LGAALTVVITVTGQIIMG

SEQ ID NO: 1739370 - protein, 18 aa, Staphylococcus epidermidis
LGAIALHVTMNFPLSISF

SEQ ID NO: 1739371 - protein, 23 aa, Staphylococcus epidermidis
LGILFAIGVAIGMAKKNDGAVAL

SEQ ID NO: 1739372 - protein, 18 aa, Staphylococcus epidermidis
LGTFPIGDYNLKASKDME

SEQ ID NO: 1739373 - protein, 24 aa, Staphylococcus epidermidis
LIHPHELFIPAIILSLLILFFYLF

SEQ ID NO: 1739374 - protein, 19 aa, Staphylococcus epidermidis
LILALPFPIILAIMFNEIK

SEQ ID NO: 1739375 - protein, 17 aa, Staphylococcus epidermidis
LILSPAVGAILMSLSTV

SEQ ID NO: 1739376 - protein, 17 aa, Staphylococcus epidermidis
LILTYIFNPTFVVPLSA

SEQ ID NO: 1739377 - protein, 20 aa, Staphylococcus epidermidis
LILWFYFRKSIPKTFDISSI

SEQ ID NO: 1739378 - protein, 18 aa, Staphylococcus epidermidis
LIPFIPIKFSFFKFNNLN

SEQ ID NO: 1739379 - protein, 17 aa, Staphylococcus epidermidis
LIPFIPIKFSFIKFNNV

SEQ ID NO: 1739380 - protein, 20 aa, Staphylococcus epidermidis
LIRPLLLKYRIQFIEQKTQI

SEQ ID NO: 1739381 - protein, 24 aa, Staphylococcus epidermidis
LITLCLTLAFPAYLLKISRSFEVI

SEQ ID NO: 1739382 - protein, 22 aa, Staphylococcus epidermidis
LIVFRFPPHVAVGTSMMMIFFS

SEQ ID NO: 1739383 - protein, 30 aa, Staphylococcus epidermidis; identical to SEQ ID NO: 1578227

SEQ ID NO: 1739384 - protein, 31 aa, Staphylococcus epidermidis; identical to SEQ ID NO: 1576334

SEQ ID NO: 1739385 - protein, 17 aa, Staphylococcus epidermidis
LKPYVLIVTVIAILATF

SEQ ID NO: 1739386 - protein, 23 aa, Staphylococcus epidermidis
LKYIKAESDLKHVADKVEENTKD

SEQ ID NO: 1739387 - protein, 22 aa, Staphylococcus epidermidis
LLGDISSLLGMLGISIVTINGV

SEQ ID NO: 1739388 - protein, 19 aa, Staphylococcus epidermidis
LLIFIVYCHYLQRNKQNYK

SEQ ID NO: 1739389 - protein, 29 aa, Staphylococcus epidermidis
LLPGSYLLGIHWRLGYTGIILVSIADEAL

SEQ ID NO: 1739390 - protein, 19 aa, Staphylococcus epidermidis
LLTLFVVPVIYEILFTLKN

SEQ ID NO: 1739391 - protein, 19 aa, Staphylococcus epidermidis
LNEEEARAYLKYIKAESDL

SEQ ID NO: 1739392 - protein, 24 aa, Staphylococcus epidermidis
LNGFSWPIVLVLLILFYFYSHYLF

SEQ ID NO: 1739393 - protein, 19 aa, Staphylococcus epidermidis
LNNVKIVIVSGVIPFNLIK

SEQ ID NO: 1739394 - protein, 20 aa, Staphylococcus epidermidis
LNNVKIVIVSGVIPFNLIKG

SEQ ID NO: 1739395 - protein, 19 aa, Staphylococcus epidermidis
LPFPIILAIMFNEIKDSKL

SEQ ID NO: 1739396 - protein, 22 aa, Staphylococcus epidermidis
LPIIPIIVSRYWVQLISNVPKE

SEQ ID NO: 1739397 - protein, 22 aa, Staphylococcus epidermidis
LPKKVRNDYRFYPSNQEQQRLE

SEQ ID NO: 1739398 - protein, 23 aa, Staphylococcus epidermidis
LQFPKENWWVFVVLLLLVGNVEV

SEQ ID NO: 1739399 - protein, 18 aa, Staphylococcus epidermidis
LRDAEALDQSMQTLRDLV

SEQ ID NO: 1739400 - protein, 20 aa, Staphylococcus epidermidis
LSDLGYDLTHHFMFVMRDLK

SEQ ID NO: 1739401 - protein, 26 aa, Staphylococcus epidermidis
LSKKTIRYGTASALTLALYLFNSNVT

SEQ ID NO: 1739402 - protein, 25 aa, Staphylococcus epidermidis
LSLITTQGWIRISFIDDLPLKEYSL

SEQ ID NO: 1739403 - protein, 21 aa, Staphylococcus epidermidis
LSMLLTLWIVPWLSAKKARKL

SEQ ID NO: 1739404 - protein, 23 aa, Staphylococcus epidermidis
LTGPESYILPVFVITITYAGIYF

SEQ ID NO: 1739405 - protein, 23 aa, Staphylococcus epidermidis
LTGPESYILPVFVITITYTGIYF

SEQ ID NO: 1739406 - protein, 31 aa, Staphylococcus epidermidis
LTKLFGKASWYLPKWLGAVLPNVDVEGKALE

SEQ ID NO: 1739407 - protein, 19 aa, Staphylococcus epidermidis
LVIACPCALGLATPTSIMV

SEQ ID NO: 1739408 - protein, 20 aa, Staphylococcus epidermidis
LVRLNIPLVLIKGVTILLLL

SEQ ID NO: 1739409 - protein, 18 aa, Staphylococcus epidermidis
LYILVYRGFVTSVLSFLI

SEQ ID NO: 1739410 - protein, 20 aa, Staphylococcus epidermidis
MGGLTFLISIIISSIIAIIF

SEQ ID NO: 1739411 - protein, 20 aa, Staphylococcus epidermidis
MGGLTFLISIIITSIIAIIF

SEQ ID NO: 1739412 - protein, 27 aa, Staphylococcus epidermidis
MISSYHIFRIFFILFVIAPLIGYFINV

SEQ ID NO: 1739413 - protein, 17 aa, Staphylococcus epidermidis
MKMGGHVIALPLFMETF

SEQ ID NO: 1739414 - protein, 23 aa, Staphylococcus epidermidis
MLIVFRFPPHVAVGTSMMMIFFS

SEQ ID NO: 1739415 - protein, 27 aa, Staphylococcus epidermidis
MMERYRIPRLLGITIIYVAIIGIITLI

SEQ ID NO: 1739416 - protein, 27 aa, Staphylococcus epidermidis
MMERYRIPRLLGITIIYVAIVGIITLI

SEQ ID NO: 1739417 - protein, 22 aa, Staphylococcus epidermidis
MMRKIDSQAGYNFLTGNGSNPI

SEQ ID NO: 1739418 - protein, 18 aa, Staphylococcus epidermidis
MRMFFIGGVLSLISTMIL

SEQ ID NO: 1739419 - protein, 19 aa, Staphylococcus epidermidis
MRMFFIGGVLSLISTMILY

SEQ ID NO: 1739420 - protein, 18 aa, Staphylococcus epidermidis
MRVYIKIPLLLGLITLPV

SEQ ID NO: 1739421 - protein, 18 aa, Staphylococcus epidermidis
MSLSLSWDVGKLDDVFNQ

SEQ ID NO: 1739422 - protein, 18 aa, Staphylococcus epidermidis
MTGFIAWVGIAISHFRFR

SEQ ID NO: 1739423 - protein, 24 aa, Staphylococcus epidermidis
NAELRTGPNAAYPVIYKIEKGKSF

SEQ ID NO: 1739424 - protein, 24 aa, Staphylococcus epidermidis
NAVFFYNHFNQILANRFTYFGLGL

SEQ ID NO: 1739425 - protein, 18 aa, Staphylococcus epidermidis
NFGKEAAMIAGYQHSTMH

SEQ ID NO: 1739426 - protein, 24 aa, Staphylococcus epidermidis
NGKKSLLKRRLINIKEGNLKKQSK

SEQ ID NO: 1739427 - protein, 27 aa, Staphylococcus epidermidis
NGKMEELKVAVAKASLVRQNSNYINED

SEQ ID NO: 1739428 - protein, 18 aa, Staphylococcus epidermidis
NHAQPSPQTGGTTATQAG

SEQ ID NO: 1739429 - protein, 25 aa, Staphylococcus epidermidis
NISSDIFVWFKLVLNDTSEFHNIKQ

SEQ ID NO: 1739430 - protein, 22 aa, Staphylococcus epidermidis
NKQITYTFTDYVDKYENIKAHL

SEQ ID NO: 1739431 - protein, 23 aa, Staphylococcus epidermidis
NKQITYTFTDYVDKYENIKAHLK

SEQ ID NO: 1739432 - protein, 19 aa, Staphylococcus epidermidis
NKRDHPFVYWATLKNVASL

SEQ ID NO: 1739433 - protein, 25 aa, Staphylococcus epidermidis
NKWITCLFVAFPVFTSYTAYRNAHH

SEQ ID NO: 1739434 - protein, 23 aa, Staphylococcus epidermidis
NKYSYRKLFIIGLALFTLGSLVC

SEQ ID NO: 1739435 - protein, 20 aa, Staphylococcus epidermidis
NLDDQVLALITGEIGSMPEL

SEQ ID NO: 1739436 - protein, 26 aa, Staphylococcus epidermidis
NLMIPCKPDHPFVYWATFSNAADLLD

SEQ ID NO: 1739437 - protein, 25 aa, Staphylococcus epidermidis
NNKEHAFNTLAHIIIWDTDQQPLVF

SEQ ID NO: 1739438 - protein, 23 aa, Staphylococcus epidermidis
NNSKARLTFNLSDGKATSYKQTA

SEQ ID NO: 1739439 - protein, 23 aa, Staphylococcus epidermidis
NNSKARLTFNLSDGKATSYKQTT

SEQ ID NO: 1739440 - protein, 41 aa, Staphylococcus epidermidis
NQSASYFIKQWALDRIKQIQLETMNSIRGAHTVQDVHKALL

SEQ ID NO: 1739441 - protein, 27 aa, Staphylococcus epidermidis
NQSGQLGATVKPGSAPNQDTEATPNPD

SEQ ID NO: 1739442 - protein, 30 aa, Staphylococcus epidermidis
NSMVTRVISRWAQDYNIYFKRYNSDQFVAY

SEQ ID NO: 1739443 - protein, 31 aa, Staphylococcus epidermidis
NSMVTRVISRWAQDYNIYFKRYNSDQFVAYF

SEQ ID NO: 1739444 - protein, 25 aa, Staphylococcus epidermidis
NVNWAGWLLFFGIVFFSGSLYFLAL

SEQ ID NO: 1739445 - protein, 19 aa, Staphylococcus epidermidis
NVTETIFTIDVEDTTKPTV

SEQ ID NO: 1739446 - protein, 27 aa, Staphylococcus epidermidis
NYQAIDNVVALGRIKGNDPNDHDGFNG

SEQ ID NO: 1739447 - protein, 26 aa, Staphylococcus epidermidis
PAIGIFCIIMIFALLGFLPYNLNPAK

SEQ ID NO: 1739448 - protein, 30 aa, Staphylococcus epidermidis
PASERQPVKIPGYQHYRTSVSDGITKFIYR

SEQ ID NO: 1739449 - protein, 17 aa, Staphylococcus epidermidis
PDFPGYASTLFANAMVI

SEQ ID NO: 1739450 - protein, 22 aa, Staphylococcus epidermidis
PFDKKREFDPNLAPGTEKVVQK

SEQ ID NO: 1739451 - protein, 31 aa, Staphylococcus epidermidis
PFQNILEKWGFPRWASITTIFIGLIAIIAIV

SEQ ID NO: 1739452 - protein, 31 aa, Staphylococcus epidermidis
PFQNILEKWGFPRWASITTIFIGLIVIIAIV

SEQ ID NO: 1739453 - protein, 18 aa, Staphylococcus epidermidis
PKFGIGKGLFLSLFTSVS

SEQ ID NO: 1739454 - protein, 17 aa, Staphylococcus epidermidis
PKLSFSIVYTNQPVPPP

SEQ ID NO: 1739455 - protein, 17 aa, Staphylococcus epidermidis
PLISLSILIVIIGLIII

SEQ ID NO: 1739456 - protein, 25 aa, Staphylococcus epidermidis
PNENRTANLQSMFTNIDTKNHTVEQ

SEQ ID NO: 1739457 - protein, 21 aa, Staphylococcus epidermidis
PNVQWPEVWQAILETLYMTIV

SEQ ID NO: 1739458 - protein, 18 aa, Staphylococcus epidermidis
PSGVLGLIGIVGYVSYYS

SEQ ID NO: 1739459 - protein, 18 aa, Staphylococcus epidermidis
PTQLASAFAAIANGGTYN

SEQ ID NO: 1739460 - protein, 19 aa, Staphylococcus epidermidis
PVLATWRGIFQGYKSMGPT

SEQ ID NO: 1739461 - protein, 24 aa, Staphylococcus epidermidis
QFINHIGFQFSFLISLFIILAKPY

SEQ ID NO: 1739462 - protein, 32 aa, Staphylococcus epidermidis; identical to SEQ ID NO: 1575819

SEQ ID NO: 1739463 - protein, 25 aa, Staphylococcus epidermidis
QFVFMLRLVITIIYILFLITINLFI

SEQ ID NO: 1739464 - protein, 19 aa, Staphylococcus epidermidis
QFVISFGFLLPVSAPQNML

SEQ ID NO: 1739465 - protein, 25 aa, Staphylococcus epidermidis
QHDWDHLDLVGMDAFDLTHTGRELG

SEQ ID NO: 1739466 - protein, 23 aa, Staphylococcus epidermidis
QILPVSMPFHIDMHNIIIVLVIF

SEQ ID NO: 1739467 - protein, 23 aa, Staphylococcus epidermidis
QKKPQARQALIAKTNERQSTINT

SEQ ID NO: 1739468 - protein, 22 aa, Staphylococcus epidermidis
QPELPYIVVIVDELADLMMVAG

SEQ ID NO: 1739469 - protein, 17 aa, Staphylococcus epidermidis
QRLQQLLSHGFTLYQSF

SEQ ID NO: 1739470 - protein, 18 aa, Staphylococcus epidermidis
QSKNFWQDAWSQLKRNKL

SEQ ID NO: 1739471 - protein, 27 aa, Staphylococcus epidermidis
QTVKRKVVVQLTRFEKILYIALITVIA

SEQ ID NO: 1739472 - protein, 28 aa, Staphylococcus epidermidis
QTVKRKVVVQLTRFEKILYIALITVIAL

SEQ ID NO: 1739473 - protein, 39 aa, Staphylococcus epidermidis; identical to SEQ ID NO: 1581497

SEQ ID NO: 1739474 - protein, 26 aa, Staphylococcus epidermidis
REGVKVCTNCGTPVRNDGPNYKHSEQ

SEQ ID NO: 1739475 - protein, 33 aa, Staphylococcus epidermidis
RFPSSIILYVIRYKFKLSFSIITHWIYNIFIVV

SEQ ID NO: 1739476 - protein, 23 aa, Staphylococcus epidermidis
RIGELSTLIYLIFPILAIFVDKR

SEQ ID NO: 1739477 - protein, 18 aa, Staphylococcus epidermidis
RKMTRLIIAIIVVSVGLV

SEQ ID NO: 1739478 - protein, 19 aa, Staphylococcus epidermidis
RKNGYKNIYMLKGGYKKWT

SEQ ID NO: 1739479 - protein, 17 aa, Staphylococcus epidermidis
RLLEAMLTGAVLTLAGQ

SEQ ID NO: 1739480 - protein, 17 aa, Staphylococcus epidermidis
RMNEMRVLTIAMMSMSS

SEQ ID NO: 1739481 - protein, 17 aa, Staphylococcus epidermidis
RNIKGDAFISIHNDALD

SEQ ID NO: 1739482 - protein, 19 aa, Staphylococcus epidermidis
RNIKGDAFISIHNDALDSS

SEQ ID NO: 1739483 - protein, 17 aa, Staphylococcus epidermidis
RNSLGMTYESYFNQYKV

SEQ ID NO: 1739484 - protein, 17 aa, Staphylococcus epidermidis
RQLRFVLMTLNIIKVTT

SEQ ID NO: 1739485 - protein, 17 aa, Staphylococcus epidermidis
RQRAFKFIITILSIAFW

SEQ ID NO: 1739486 - protein, 17 aa, Staphylococcus epidermidis
RQRAFKFIITILSIVFW

SEQ ID NO: 1739487 - protein, 20 aa, Staphylococcus epidermidis
RTSYRLLHWQYKDTLTVLLL

SEQ ID NO: 1739488 - protein, 17 aa, Staphylococcus epidermidis
RWLIISISIFIIMMIIL

SEQ ID NO: 1739489 - protein, 18 aa, Staphylococcus epidermidis
RWLIISISIFIIMMIILN

SEQ ID NO: 1739490 - protein, 21 aa, Staphylococcus epidermidis
RYLVYKFKPLKVIATDEDITS

SEQ ID NO: 1739491 - protein, 17 aa, Staphylococcus epidermidis
RYTIVLLLLIFSTIFSL

SEQ ID NO: 1739492 - protein, 20 aa, Staphylococcus epidermidis
RYVNADSGLQANYNSALNYG

SEQ ID NO: 1739493 - protein, 22 aa, Staphylococcus epidermidis
SAGYIFRFGFNLFDGANNITEI

SEQ ID NO: 1739494 - protein, 32 aa, Staphylococcus epidermidis
SEEWGRPWVFSRVFLALGITFLALWILTNIFD

SEQ ID NO: 1739495 - protein, 19 aa, Staphylococcus epidermidis
SGIALFLGLSFLWFPIFSI

SEQ ID NO: 1739496 - protein, 17 aa, Staphylococcus epidermidis
SGMIMILSSIVFGAMST

SEQ ID NO: 1739497 - protein, 17 aa, Staphylococcus epidermidis
SHLLEEAKNNAITGINK

SEQ ID NO: 1739498 - protein, 18 aa, Staphylococcus epidermidis
SILICVTFSLLMVTPISL

SEQ ID NO: 1739499 - protein, 20 aa, Staphylococcus epidermidis
SILNIKRFYVKKEKVLGMAI

SEQ ID NO: 1739500 - protein, 20 aa, Staphylococcus epidermidis
SILNIKRFYVKKEKVLGMTI

SEQ ID NO: 1739501 - protein, 31 aa, Staphylococcus epidermidis
SIMTPLLIIYVFTQFFYKKYITTSINYLNDT

SEQ ID NO: 1739502 - protein, 17 aa, Staphylococcus epidermidis
SLIKKFEKETGIQVVYE

SEQ ID NO: 1739503 - protein, 20 aa, Staphylococcus epidermidis
SLKHLWGRFRPYEITDKAGH

SEQ ID NO: 1739504 - protein, 21 aa, Staphylococcus epidermidis
SLLTICVIFLVRMLYIKYTQN

SEQ ID NO: 1739505 - protein, 17 aa, Staphylococcus epidermidis
SLTGLNHGVKWLSNLNI

SEQ ID NO: 1739506 - protein, 18 aa, Staphylococcus epidermidis
SRKRYSPDSTYKIYLAMF

SEQ ID NO: 1739507 - protein, 25 aa, Staphylococcus epidermidis
SRLLGCTLALIALIQIFRPFKHYFK

SEQ ID NO: 1739508 - protein, 17 aa, Staphylococcus epidermidis
SRMSWNHNHYPFDSWNK

SEQ ID NO: 1739509 - protein, 34 aa, Staphylococcus epidermidis
SSPTSFANLRTFSRFTVLNTMAAPTTTSTTTTSS

SEQ ID NO: 1739510 - protein, 20 aa, Staphylococcus epidermidis
SVSHVVGWGSQYSKNNISLF

SEQ ID NO: 1739511 - protein, 20 aa, Staphylococcus epidermidis
SYPAAYFISYSRFQNILLML

SEQ ID NO: 1739512 - protein, 17 aa, Staphylococcus epidermidis
TDFLCERARNYLSSEKG

SEQ ID NO: 1739513 - protein, 18 aa, Staphylococcus epidermidis
TDFLCERARNYLSSEKGE

SEQ ID NO: 1739514 - protein, 29 aa, Staphylococcus epidermidis
TELFGTLCLCLSFIPKFGIGKGLFLSLFT

SEQ ID NO: 1739515 - protein, 32 aa, Staphylococcus epidermidis
TELFGTLCLCLSFIPKFGIGKGLFLSLFTSVS

SEQ ID NO: 1739516 - protein, 22 aa, Staphylococcus epidermidis
TFISWLVCGILLIKKRQNKSIK

SEQ ID NO: 1739517 - protein, 23 aa, Staphylococcus epidermidis
TIFLLCALVGILAGVPSVGLITQ

SEQ ID NO: 1739518 - protein, 22 aa, Staphylococcus epidermidis
TITLKTYFSYYVDFSLGVKGLV

SEQ ID NO: 1739519 - protein, 22 aa, Staphylococcus epidermidis
TKIGEVWAMVALSLLLVAYLML

SEQ ID NO: 1739520 - protein, 26 aa, Staphylococcus epidermidis
TKKLIIAKAEAKQMIKELSQKKRDAI

SEQ ID NO: 1739521 - protein, 17 aa, Staphylococcus epidermidis
TKTDVKNDTELPETGLS

SEQ ID NO: 1739522 - protein, 19 aa, Staphylococcus epidermidis
TVDTGGQPARADQGQEGPQ

SEQ ID NO: 1739523 - protein, 22 aa, Staphylococcus epidermidis
TVITCSLSFTICMILGTLTVSQ

SEQ ID NO: 1739524 - protein, 24 aa, Staphylococcus epidermidis
TVPSDLTDSFAIPKIKDNSGEIIA

SEQ ID NO: 1739525 - protein, 18 aa, Staphylococcus epidermidis
VANKLRDAEALDQSMQTL

SEQ ID NO: 1739526 - protein, 19 aa, Staphylococcus epidermidis
VAVVTAFSRLLGCTLALIA

SEQ ID NO: 1739527 - protein, 23 aa, Staphylococcus epidermidis
VENYKRTPIFYSLGNTTSDNFLS

SEQ ID NO: 1739528 - protein, 19 aa, Staphylococcus epidermidis
VFIIFYSMMYWITSRIYYT

SEQ ID NO: 1739529 - protein, 35 aa, Staphylococcus epidermidis
VFLAQRPFFSFSWNEFAWWLVAHLFFIILMATCLP

SEQ ID NO: 1739530 - protein, 27 aa, Staphylococcus epidermidis
VIVVLAFFLLMIVFRSILVPLKAVLGF

SEQ ID NO: 1739531 - protein, 21 aa, Staphylococcus epidermidis
VKASLFLLIGVMYKITKTTDL

SEQ ID NO: 1739532 - protein, 23 aa, Staphylococcus epidermidis
VKISKDALHGERELNDNKNSKTF

SEQ ID NO: 1739533 - protein, 18 aa, Staphylococcus epidermidis
VLIGIAIAVIGIFILARK

SEQ ID NO: 1739534 - protein, 17 aa, Staphylococcus epidermidis
VLIKGVTILLLLIYAVY

SEQ ID NO: 1739535 - protein, 18 aa, Staphylococcus epidermidis
VLIKGVTILLLLIYAVYT

SEQ ID NO: 1739536 - protein, 24 aa, Staphylococcus epidermidis
VLVFFVSRAYHWYELDEQFVDGVK

SEQ ID NO: 1739537 - protein, 19 aa, Staphylococcus epidermidis
VMITARILLESGAEGTRVE

SEQ ID NO: 1739538 - protein, 24 aa, Staphylococcus epidermidis
VNWAGWLLFFGIVFFSGSLYFLAL

SEQ ID NO: 1739539 - protein, 18 aa, Staphylococcus epidermidis
VQQDWKGSHNQFHITPIQ

SEQ ID NO: 1739540 - protein, 19 aa, Staphylococcus epidermidis
VRLNIPLVLIKGVTILLLL

SEQ ID NO: 1739541 - protein, 22 aa, Staphylococcus epidermidis
VSELSVLIASKVLRKEISEQDQ

SEQ ID NO: 1739542 - protein, 17 aa, Staphylococcus epidermidis
VSHDGPIIDGFKGDKKT

SEQ ID NO: 1739543 - protein, 24 aa, Staphylococcus epidermidis
VTFVLRLTPYGILAIMASTLATSD

SEQ ID NO: 1739544 - protein, 17 aa, Staphylococcus epidermidis
VTNFRFSLFTKITTTTY

SEQ ID NO: 1739545 - protein, 17 aa, Staphylococcus epidermidis
VVIIRYLVYKFKPLKVI

SEQ ID NO: 1739546 - protein, 32 aa, Staphylococcus epidermidis; identical to SEQ ID NO: 1578471

SEQ ID NO: 1739547 - protein, 22 aa, Staphylococcus epidermidis
VVVDLWNAKSFRKLSLHSKLVL

SEQ ID NO: 1739548 - protein, 18 aa, Staphylococcus epidermidis
VYFGMGVIFSLAYVYTKR

SEQ ID NO: 1739549 - protein, 20 aa, Staphylococcus epidermidis
VYFHKVRGLLSFWIGTLLIA

SEQ ID NO: 1739550 - protein, 20 aa, Staphylococcus epidermidis
VYVKLEFSIWLFLLLLLVPD

SEQ ID NO: 1739551 - protein, 17 aa, Staphylococcus epidermidis
WGILSGKMLFFYIITII

SEQ ID NO: 1739552 - protein, 18 aa, Staphylococcus epidermidis
WGILSGKMLFFYIITIII

SEQ ID NO: 1739553 - protein, 27 aa, Staphylococcus epidermidis
WKAILYFEIITTIAIGLGLIIGNLFKP

SEQ ID NO: 1739554 - protein, 20 aa, Staphylococcus epidermidis
WRLLACYVTSVTVIIVALII

SEQ ID NO: 1739555 - protein, 25 aa, Staphylococcus epidermidis
WVFGSLLCLFYMIKAFRQIDVIKSS

SEQ ID NO: 1739556 - protein, 17 aa, Staphylococcus epidermidis
WYMWSLWSLIIALLPIL

SEQ ID NO: 1739557 - protein, 23 aa, Staphylococcus epidermidis
YKDLHILQLLAVVCSVMVLTLIA

SEQ ID NO: 1739558 - protein, 25 aa, Staphylococcus epidermidis
YKEGDKIGVPGFVRGLHDMHAKEGK

SEQ ID NO: 1739559 - protein, 20 aa, Staphylococcus epidermidis
YKNADKVLDSSRFINEDQPE

SEQ ID NO: 1739560 - protein, 28 aa, Staphylococcus epidermidis
YLSKKTLRYGTASALTLALYLFNSNVTV

SEQ ID NO: 1739561 - protein, 18 aa, Staphylococcus epidermidis
YLVVPIVGAFLIDLIGVI

SEQ ID NO: 1739562 - protein, 32 aa, Staphylococcus epidermidis
YPILKRLVKRLPAMVLPSWAYNKIAPVAIDDV

SEQ ID NO: 1739563 - protein, 21 aa, Staphylococcus epidermidis
YRLFYERCNELLLGKFSSEKT

SEQ ID NO: 1739564 - protein, 26 aa, Staphylococcus epidermidis
YTNFWKQPHYIFSFTSACISIMTPLL

SEQ ID NO: 1739565 - protein, 23 aa, Staphylococcus epidermidis
AAGYFKPFWPLAIINVFEEFTST

SEQ ID NO: 1739566 - protein, 27 aa, Staphylococcus epidermidis
AAIGLLAPWVAGAAMALSSVSVVTNAL

SEQ ID NO: 1739567 - protein, 21 aa, Staphylococcus epidermidis
AALLAIIFDFILRYMERLSYK

SEQ ID NO: 1739568 - protein, 17 aa, Staphylococcus epidermidis
ADIISGYFVPIVVGIAI

SEQ ID NO: 1739569 - protein, 17 aa, Staphylococcus epidermidis
ADIISGYFVPIVVSIAV

SEQ ID NO: 1739570 - protein, 29 aa, Staphylococcus epidermidis
ADYNLKRQFNKALKEAKGILNKNSGPNVN

SEQ ID NO: 1739571 - protein, 18 aa, Staphylococcus epidermidis
ADYVKSYYIIFLLCALVG

SEQ ID NO: 1739572 - protein, 22 aa, Staphylococcus epidermidis
AEEDAKHIFDRFYKLSDESSSN

SEQ ID NO: 1739573 - protein, 21 aa, Staphylococcus epidermidis
AEGNHPIDINFSKDQIDRNTA

SEQ ID NO: 1739574 - protein, 26 aa, Staphylococcus epidermidis
AEIERLKKQAIDKVTHSKSIKDIETV

SEQ ID NO: 1739575 - protein, 25 aa, Staphylococcus epidermidis
AEQAEEFERVTTGTVDTGGQPARAD

SEQ ID NO: 1739576 - protein, 26 aa, Staphylococcus epidermidis
AEQAEEFERVTTGTVDTGGQPARADQ

SEQ ID NO: 1739577 - protein, 21 aa, Staphylococcus epidermidis
AERQRIPLIINQENAVLAIGD

SEQ ID NO: 1739578 - protein, 20 aa, Staphylococcus epidermidis
AGFIEIIWVTGLDQAHSLFT

SEQ ID NO: 1739579 - protein, 20 aa, Staphylococcus epidermidis
AGIYFRNVRRSMLEQLNEDY

SEQ ID NO: 1739580 - protein, 25 aa, Staphylococcus epidermidis
AGLGHIFLTIAFILFFILLGKRINK

SEQ ID NO: 1739581 - protein, 18 aa, Staphylococcus epidermidis
AGPLFNFILALVLFIGLA

SEQ ID NO: 1739582 - protein, 23 aa, Staphylococcus epidermidis
AGRFGDGLINVFTQLGPLFLWTA

SEQ ID NO: 1739583 - protein, 19 aa, Staphylococcus epidermidis
AIENMKWSTNHAVQDESSY

SEQ ID NO: 1739584 - protein, 20 aa, Staphylococcus epidermidis
AIVSYAKEKSLEFLEVDHFE

SEQ ID NO: 1739585 - protein, 26 aa, Staphylococcus epidermidis
ALDTARSQLTLNREPYINHINNESHL

SEQ ID NO: 1739586 - protein, 20 aa, Staphylococcus epidermidis
ALLEQFSWHSAFLINVPFAI

SEQ ID NO: 1739587 - protein, 32 aa, Staphylococcus epidermidis
ALTKLFGKASWYLPKWLGAVLPNVDVEGKALE

SEQ ID NO: 1739588 - protein, 17 aa, Staphylococcus epidermidis
AMGELRQSIANKDQVKA

SEQ ID NO: 1739589 - protein, 17 aa, Staphylococcus epidermidis
ANGLLSLGASPAMSEAP

SEQ ID NO: 1739590 - protein, 18 aa, Staphylococcus epidermidis
ARVDGCNDFQIFWKIVLP

SEQ ID NO: 1739591 - protein, 27 aa, Staphylococcus epidermidis
ASVIVAILVLRSGFYVTKSSLHVLMEG

SEQ ID NO: 1739592 - protein, 22 aa, Staphylococcus epidermidis
ATKIGEVWAMVALSLLLVAYLM

SEQ ID NO: 1739593 - protein, 23 aa, Staphylococcus epidermidis
ATMPGSLPTMFYTHVRYRALAIT

SEQ ID NO: 1739594 - protein, 23 aa, Staphylococcus epidermidis
AVIRYKKKYIPQIAVNHSVFTEG

SEQ ID NO: 1739595 - protein, 27 aa, Staphylococcus epidermidis
AVVDRDGRLIGIVSLKIDMHNVEGMAF

SEQ ID NO: 1739596 - protein, 18 aa, Staphylococcus epidermidis
CLILTYIFNPTFVVPLSA

SEQ ID NO: 1739597 - protein, 21 aa, Staphylococcus epidermidis
CNKIYCFIDEIFKGTNTTERI

SEQ ID NO: 1739598 - protein, 25 aa, Staphylococcus epidermidis
CRVKGEFKFEKELSLLDISTVQFKS

SEQ ID NO: 1739599 - protein, 26 aa, Staphylococcus epidermidis
CRVKGEFKFEKELSLLNISTVQFKSC

SEQ ID NO: 1739600 - protein, 18 aa, Staphylococcus epidermidis
CSGMIMILSSIVFGAMST

SEQ ID NO: 1739601 - protein, 28 aa, Staphylococcus epidermidis
CSTTLLNLFHGWPWYAIWLVLLGFGGGM

SEQ ID NO: 1739602 - protein, 23 aa, Staphylococcus epidermidis
DFGGWKAPFGIQFLGDSLSLLMV

SEQ ID NO: 1739603 - protein, 24 aa, Staphylococcus epidermidis
DFIGFSSAWGYWFAAFLGNVAYAT

SEQ ID NO: 1739604 - protein, 30 aa, Staphylococcus epidermidis
DFLNSNFWLYWKTMFAFEPWHSAMEMRRYL

SEQ ID NO: 1739605 - protein, 25 aa, Staphylococcus epidermidis
DFVNGGKVNLSFAQSDFYTQIESIT

SEQ ID NO: 1739606 - protein, 19 aa, Staphylococcus epidermidis
DGIIKAHDAENLIYDVTFE

SEQ ID NO: 1739607 - protein, 19 aa, Staphylococcus epidermidis
DHFEAIPGRGINATIDGKE

SEQ ID NO: 1739608 - protein, 25 aa, Staphylococcus epidermidis
DIKKEIIKYVLLALITLISFIIAIF

SEQ ID NO: 1739609 - protein, 18 aa, Staphylococcus epidermidis
DINIFKSLGYGVEEKHND

SEQ ID NO: 1739610 - protein, 25 aa, Staphylococcus epidermidis
DLEILPRFNKIIVMNDGEIIENGSY

SEQ ID NO: 1739611 - protein, 27 aa, Staphylococcus epidermidis
DLPPEKTYKIGDYVWEDVDKDGIQNTN

SEQ ID NO: 1739612 - protein, 18 aa, Staphylococcus epidermidis
DNKLRQAQEIAKNEIQNL

SEQ ID NO: 1739613 - protein, 27 aa, Staphylococcus epidermidis
DRKEFSVSKRAGHGVFQVMSGTLHNTV

SEQ ID NO: 1739614 - protein, 25 aa, Staphylococcus epidermidis
DRRTASSTWAWLFVLFVLPVIGFIL

SEQ ID NO: 1739615 - protein, 20 aa, Staphylococcus epidermidis
DSASIKASESASTSKKLSES

SEQ ID NO: 1739616 - protein, 19 aa, Staphylococcus epidermidis
DTNINLTFNDGRTLNGKVD

SEQ ID NO: 1739617 - protein, 31 aa, Staphylococcus epidermidis
EAVSAVQYMSSWPWDWAKPMGSLMKDGSIST

SEQ ID NO: 1739618 - protein, 24 aa, Staphylococcus epidermidis
EEGKAIPHWDVFGLHINEVGYQGQ

SEQ ID NO: 1739619 - protein, 17 aa, Staphylococcus epidermidis
EELLFRHLIIHELGKKL

SEQ ID NO: 1739620 - protein, 24 aa, Staphylococcus epidermidis
EFICPNNKRLGFKRYAYRHDKYGF

SEQ ID NO: 1739621 - protein, 20 aa, Staphylococcus epidermidis
EFVIAIRFLLGIAGALIMPT

SEQ ID NO: 1739622 - protein, 19 aa, Staphylococcus epidermidis
EGIGFVVIILFILKLLAAI

SEQ ID NO: 1739623 - protein, 20 aa, Staphylococcus epidermidis
EHPLAEAIVSYAKEKSLEFL

SEQ ID NO: 1739624 - protein, 20 aa, Staphylococcus epidermidis
EKLNKLLLIISLLSIFQVVE

SEQ ID NO: 1739625 - protein, 22 aa, Staphylococcus epidermidis
EKPLSNVLVTLTYPDGTSKSVR

SEQ ID NO: 1739626 - protein, 18 aa, Staphylococcus epidermidis
ELFHASGIIAAVVAGLVH

SEQ ID NO: 1739627 - protein, 28 aa, Staphylococcus epidermidis
ELKIIFRKKLYLVMSIFLPVVFYLLFTS

SEQ ID NO: 1739628 - protein, 27 aa, Staphylococcus epidermidis
ELNDKMKLLRDKLKTLVNPVKASLNYR

SEQ ID NO: 1739629 - protein, 17 aa, Staphylococcus epidermidis
ENGILFKGGEHIEGTHA

SEQ ID NO: 1739630 - protein, 25 aa, Staphylococcus epidermidis
ENHPERYYNGRDYRREQQLEEENEK

SEQ ID NO: 1739631 - protein, 20 aa, Staphylococcus epidermidis
EPIGVFTLIRFYYKDIIVCF

SEQ ID NO: 1739632 - protein, 26 aa, Staphylococcus epidermidis
EQFEIRSKPTPPRIITTANELRGNSN

SEQ ID NO: 1739633 - protein, 29 aa, Staphylococcus epidermidis
EQKHTGWLIVLSIIFVLLIAALLYGAYYT

SEQ ID NO: 1739634 - protein, 17 aa, Staphylococcus epidermidis
ERYITLVSLYKVHQQNI

SEQ ID NO: 1739635 - protein, 18 aa, Staphylococcus epidermidis
ESILSLITTQGWIRISLI

SEQ ID NO: 1739636 - protein, 20 aa, Staphylococcus epidermidis
ESRKRYSPDSTYKIYLALFG

SEQ ID NO: 1739637 - protein, 19 aa, Staphylococcus epidermidis
ESSVKGFATMLLLGILMIF

SEQ ID NO: 1739638 - protein, 25 aa, Staphylococcus epidermidis
EVIQWFYKEVDWFEAKLKDETNNTG

SEQ ID NO: 1739639 - protein, 17 aa, Staphylococcus epidermidis
FAAIQVFLLVWVTKTIA

SEQ ID NO: 1739640 - protein, 25 aa, Staphylococcus epidermidis
FDKKREFNPDLKPGEERVKQKGEPG

SEQ ID NO: 1739641 - protein, 27 aa, Staphylococcus epidermidis
FERLNHARPRALEYIKSLEKINNAQKS

SEQ ID NO: 1739642 - protein, 17 aa, Staphylococcus epidermidis
FETPEGYTPTLKHSGTN

SEQ ID NO: 1739643 - protein, 18 aa, Staphylococcus epidermidis
FETPEGYTPTLKHSGTNP

SEQ ID NO: 1739644 - protein, 17 aa, Staphylococcus epidermidis
FGKEAAMIAGYQHSTMH

SEQ ID NO: 1739645 - protein, 25 aa, Staphylococcus epidermidis
FGLTVKETFLTWSLLETIISVSGVI

SEQ ID NO: 1739646 - protein, 17 aa, Staphylococcus epidermidis
FGSDLYSTFSCVKDKIY

SEQ ID NO: 1739647 - protein, 17 aa, Staphylococcus epidermidis
FGTGSAFAFPGSMIGVL

SEQ ID NO: 1739648 - protein, 25 aa, Staphylococcus epidermidis
FIAESYRAAILYQNWFFITHWKLSL

SEQ ID NO: 1739649 - protein, 24 aa, Staphylococcus epidermidis
FIFWLIVGISMWFFVNQGILNGTK

SEQ ID NO: 1739650 - protein, 18 aa, Staphylococcus epidermidis
FIHNQWLLIFSFILIGIN

SEQ ID NO: 1739651 - protein, 26 aa, Staphylococcus epidermidis
FIVFIFAIVVLRLGYLQIAQGSHYKQ

SEQ ID NO: 1739652 - protein, 21 aa, Staphylococcus epidermidis
FKISFKNSLQLLLKNKSKTHE

SEQ ID NO: 1739653 - protein, 20 aa, Staphylococcus epidermidis
FKSNHLTLTLSIYMFTVICV

SEQ ID NO: 1739654 - protein, 17 aa, Staphylococcus epidermidis
FLLRPIGGIVFGIIGDK

SEQ ID NO: 1739655 - protein, 17 aa, Staphylococcus epidermidis
FLNCLFFSILALLELRI

SEQ ID NO: 1739656 - protein, 17 aa, Staphylococcus epidermidis
FLNKPVAIMFWIIAELA

SEQ ID NO: 1739657 - protein, 19 aa, Staphylococcus epidermidis
FMFGPILAALLCVKVLKLK

SEQ ID NO: 1739658 - protein, 25 aa, Staphylococcus epidermidis
FMPIPMPASVIGLVLLFIALCTGIV

SEQ ID NO: 1739659 - protein, 21 aa, Staphylococcus epidermidis
FNHLACRIISAILQISALMMW

SEQ ID NO: 1739660 - protein, 17 aa, Staphylococcus epidermidis
FNINFLPVVVAEILMGI

SEQ ID NO: 1739661 - protein, 24 aa, Staphylococcus epidermidis
FNKKREFDPNLAPGTEKVVQKGEP

SEQ ID NO: 1739662 - protein, 18 aa, Staphylococcus epidermidis
FNNAHLWDDSAVDAIDTI

SEQ ID NO: 1739663 - protein, 18 aa, Staphylococcus epidermidis
FQWAMMVFVFFVITMALS

SEQ ID NO: 1739664 - protein, 17 aa, Staphylococcus epidermidis
FRALGGEVEAFFPSKVP

SEQ ID NO: 1739665 - protein, 25 aa, Staphylococcus epidermidis
FSLFIFYKILILWTLPTLIFTIAMG

SEQ ID NO: 1739666 - protein, 29 aa, Staphylococcus epidermidis
FSLLASILVLWFYFRKSIPKTFDISSISE

SEQ ID NO: 1739667 - protein, 18 aa, Staphylococcus epidermidis
FSRSDYKNIVLAGKYKSR

SEQ ID NO: 1739668 - protein, 19 aa, Staphylococcus epidermidis
FSYLIYRIGKDDAAGLAAQ

SEQ ID NO: 1739669 - protein, 33 aa, Staphylococcus epidermidis
FTRNLTDWIKNSGGTTFSLSMTASTGGAKNLQQ

SEQ ID NO: 1739670 - protein, 31 aa, Staphylococcus epidermidis
FVLATPVQFVIGWQFYVGAYKNLRNGSANMD

SEQ ID NO: 1739671 - protein, 22 aa, Staphylococcus epidermidis
FVMRDLKWIFLSYVLLSIGTTL

SEQ ID NO: 1739672 - protein, 21 aa, Staphylococcus epidermidis
FWIFKEYFGLTVKETFLTWSL

SEQ ID NO: 1739673 - protein, 30 aa, Staphylococcus epidermidis
FYITISFIAIIALFCFKLYQHYYYKLFAIA

SEQ ID NO: 1739674 - protein, 17 aa, Staphylococcus epidermidis
FYKNPDFKKVNPSKYEY

SEQ ID NO: 1739675 - protein, 17 aa, Staphylococcus epidermidis
GAIVLYGFNDAVRSTIT

SEQ ID NO: 1739676 - protein, 17 aa, Staphylococcus epidermidis
GALGVVQLIILYMLRSQ

SEQ ID NO: 1739677 - protein, 20 aa, Staphylococcus epidermidis
GAPTARLYYAAGARSGEYKQ

SEQ ID NO: 1739678 - protein, 21 aa, Staphylococcus epidermidis
GDGAPFKRQQNIINSNSGHRN

SEQ ID NO: 1739679 - protein, 20 aa, Staphylococcus epidermidis
GDSAPFKRQQNIINSNLGHR

SEQ ID NO: 1739680 - protein, 22 aa, Staphylococcus epidermidis
GEFRTASYDNTIAFSTSSGQGQ

SEQ ID NO: 1739681 - protein, 24 aa, Staphylococcus epidermidis
GEGLKTRRMVLFMNRNTRTSKGKF

SEQ ID NO: 1739682 - protein, 21 aa, Staphylococcus epidermidis
GEKFAKIGSYIFMFLIGTVAI

SEQ ID NO: 1739683 - protein, 22 aa, Staphylococcus epidermidis
GELKTNGYIDLSVGASFIPYQG

SEQ ID NO: 1739684 - protein, 18 aa, Staphylococcus epidermidis
GEPTFEKMMHPLFELLHL

SEQ ID NO: 1739685 - protein, 22 aa, Staphylococcus epidermidis
GFYILYQFLFKRAHEHHHHVGD

SEQ ID NO: 1739686 - protein, 26 aa, Staphylococcus epidermidis
GFYQTPKYSLGNYVWYDTNKDGIQGD

SEQ ID NO: 1739687 - protein, 18 aa, Staphylococcus epidermidis
GGELKHGTIALIEDGTPV

SEQ ID NO: 1739688 - protein, 25 aa, Staphylococcus epidermidis
GGLTPMCFLGLKSSRLIMSTFDLKV

SEQ ID NO: 1739689 - protein, 19 aa, Staphylococcus epidermidis
GIFAFERTLSMILMSILFI

SEQ ID NO: 1739690 - protein, 21 aa, Staphylococcus epidermidis
GIIAAIAFLILCIGIVVVLIS

SEQ ID NO: 1739691 - protein, 19 aa, Staphylococcus epidermidis
GIYISLRLIFIVMIATIMT

SEQ ID NO: 1739692 - protein, 24 aa, Staphylococcus epidermidis
GKSEIIQSYILSLAVNFHPHEVAF

SEQ ID NO: 1739693 - protein, 18 aa, Staphylococcus epidermidis
GLEVKLLYDDVGSKKVRL

SEQ ID NO: 1739694 - protein, 24 aa, Staphylococcus epidermidis
GLFINIIVAWIMLRGSDVEENLNM

SEQ ID NO: 1739695 - protein, 20 aa, Staphylococcus epidermidis
GLIVAILVAVLFFILFLIAN

SEQ ID NO: 1739696 - protein, 20 aa, Staphylococcus epidermidis
GLIVAILVAVLFFILFLVAN

SEQ ID NO: 1739697 - protein, 20 aa, Staphylococcus epidermidis
GLIVAILVAVLFFVLFLVAN

SEQ ID NO: 1739698 - protein, 26 aa, Staphylococcus epidermidis
GLNGFSWPIVLVLLILFYFYSHYLFA

SEQ ID NO: 1739699 - protein, 17 aa, Staphylococcus epidermidis
GMRVGREILATSANTIY

SEQ ID NO: 1739700 - protein, 18 aa, Staphylococcus epidermidis
GNDTLKLYAILLLGIMVF

SEQ ID NO: 1739701 - protein, 19 aa, Staphylococcus epidermidis
GNDTLKLYAILLMGIMVFL

SEQ ID NO: 1739702 - protein, 29 aa, Staphylococcus epidermidis
GNGAFLMFIAFYFKKIRTQKIVFSIGLCY

SEQ ID NO: 1739703 - protein, 34 aa, Staphylococcus epidermidis
GNYHIQIPSDERFKVGQQLIVKVVDEEGNVSEPS

SEQ ID NO: 1739704 - protein, 19 aa, Staphylococcus epidermidis
GPEKVKMPNVLGMSKNDAL

SEQ ID NO: 1739705 - protein, 20 aa, Staphylococcus epidermidis
GRDSGAITFMLSRAPFGFKG

SEQ ID NO: 1739706 - protein, 21 aa, Staphylococcus epidermidis
GSGIALFLGLSFLWFPIFSII

SEQ ID NO: 1739707 - protein, 18 aa, Staphylococcus epidermidis
GTPSEVGSYDIIVTTTDE

SEQ ID NO: 1739708 - protein, 17 aa, Staphylococcus epidermidis
GTSMSPILLAWIVAAVL

SEQ ID NO: 1739709 - protein, 18 aa, Staphylococcus epidermidis
GVIICKLLGLDNYASSAI

SEQ ID NO: 1739710 - protein, 23 aa, Staphylococcus epidermidis
GVIPFNLIKGIIISIIFVLLFRR

SEQ ID NO: 1739711 - protein, 31 aa, Staphylococcus epidermidis
GVITLTGLLSSFWLVLAKRRKKEEEKQSIKN

SEQ ID NO: 1739712 - protein, 19 aa, Staphylococcus epidermidis
GVLCSILATWGLLQATHMW

SEQ ID NO: 1739713 - protein, 20 aa, Staphylococcus epidermidis
GVLIIPPLISFTWIAGFGGT

SEQ ID NO: 1739714 - protein, 25 aa, Staphylococcus epidermidis
GVLVFFVSRAYRWYELDEQFVDGVK

SEQ ID NO: 1739715 - protein, 26 aa, Staphylococcus epidermidis
GVLYIPHFLSWVVVISIFKKLLAPDD

SEQ ID NO: 1739716 - protein, 19 aa, Staphylococcus epidermidis
GWYKRLMVTPLSSFQYYLV

SEQ ID NO: 1739717 - protein, 18 aa, Staphylococcus epidermidis
GYLVLPMVYAKGMHAMAN

SEQ ID NO: 1739718 - protein, 22 aa, Staphylococcus epidermidis
HAEGNHPIDINFSKDQIDRNTA

SEQ ID NO: 1739719 - protein, 24 aa, Staphylococcus epidermidis
HAIFIKYNLGYSVWNNHKYAFLLL

SEQ ID NO: 1739720 - protein, 17 aa, Staphylococcus epidermidis
HDAENLIYDVTFEVDDK

SEQ ID NO: 1739721 - protein, 18 aa, Staphylococcus epidermidis
HFNNLYLMKRLAQFEMKI

SEQ ID NO: 1739722 - protein, 19 aa, Staphylococcus epidermidis
HIEFLKVRLGMQVVAGNIE

SEQ ID NO: 1739723 - protein, 18 aa, Staphylococcus epidermidis
HLYFVNWKHAIFIKYNLG

SEQ ID NO: 1739724 - protein, 19 aa, Staphylococcus epidermidis
HLYHFKVLIACLLVLFILM

SEQ ID NO: 1739725 - protein, 35 aa, Staphylococcus epidermidis
HNPETLLPVNLYVKPELKHTIELYHDNEKQDRKEF

SEQ ID NO: 1739726 - protein, 19 aa, Staphylococcus epidermidis
HPDDLNMPYGFKKKELITD

SEQ ID NO: 1739727 - protein, 24 aa, Staphylococcus epidermidis
HREWRLIVISVLLLFFWSTEKVLH

SEQ ID NO: 1739728 - protein, 21 aa, Staphylococcus epidermidis
HTVEQTIYINPLRYSAKETNV

SEQ ID NO: 1739729 - protein, 27 aa, Staphylococcus epidermidis
IAALLIIFFRWGWADPLASVIVAILVL

SEQ ID NO: 1739730 - protein, 21 aa, Staphylococcus epidermidis
IAAMFHWTGGFSFSAGLIDYV

SEQ ID NO: 1739731 - protein, 28 aa, Staphylococcus epidermidis
IADEALRFIIMYLRWRNDRWQARMKQIG

SEQ ID NO: 1739732 - protein, 20 aa, Staphylococcus epidermidis
IAIPSRFVLNIVRTIPDLLL

SEQ ID NO: 1739733 - protein, 19 aa, Staphylococcus epidermidis
IALGEEFLFREVVFNILLN

SEQ ID NO: 1739734 - protein, 18 aa, Staphylococcus epidermidis
IAMHLWQTRLQKAFYGKS

SEQ ID NO: 1739735 - protein, 17 aa, Staphylococcus epidermidis
ICALNGYYPTIYTLQLL

SEQ ID NO: 1739736 - protein, 17 aa, Staphylococcus epidermidis
ICTVIWIVLVIILSFKF

SEQ ID NO: 1739737 - protein, 29 aa, Staphylococcus epidermidis
IDLQKDLWKYLSIVGVIVLFTVYLASRSI

SEQ ID NO: 1739738 - protein, 22 aa, Staphylococcus epidermidis
IDRDLICAIMVGVLGGIVTLAM

SEQ ID NO: 1739739 - protein, 17 aa, Staphylococcus epidermidis
IEKWNADAIILKKDANQ

SEQ ID NO: 1739740 - protein, 17 aa, Staphylococcus epidermidis
IFEEKKNILGYILWVGV

SEQ ID NO: 1739741 - protein, 20 aa, Staphylococcus epidermidis
IFVPFYSFILFPSVIIYFIL

SEQ ID NO: 1739742 - protein, 24 aa, Staphylococcus epidermidis
IGAISWPVLAIIGVIVALIGIIVW

SEQ ID NO: 1739743 - protein, 18 aa, Staphylococcus epidermidis
IGLQIANLMSDLKGRIAI

SEQ ID NO: 1739744 - protein, 18 aa, Staphylococcus epidermidis
IGMTCAACSNRIEKKLNR

SEQ ID NO: 1739745 - protein, 19 aa, Staphylococcus epidermidis
IGNAMEWFDFGLYSYLAVI

SEQ ID NO: 1739746 - protein, 19 aa, Staphylococcus epidermidis
IGSFFQWFDSAFNGFSLPQ

SEQ ID NO: 1739747 - protein, 17 aa, Staphylococcus epidermidis
IGTMALTLGILFIGVNK

SEQ ID NO: 1739748 - protein, 23 aa, Staphylococcus epidermidis
IHPHELFIPAIILSLLILFFYLF

SEQ ID NO: 1739749 - protein, 19 aa, Staphylococcus epidermidis
IIAIIVVSVGLVFLLQILL

SEQ ID NO: 1739750 - protein, 17 aa, Staphylococcus epidermidis
IIEELLFRHLIIHELGK

SEQ ID NO: 1739751 - protein, 23 aa, Staphylococcus epidermidis
IIFLLCALVGILAGVPSVGLITQ

SEQ ID NO: 1739752 - protein, 18 aa, Staphylococcus epidermidis
IILCCLLTIIVFKRSEKQ

SEQ ID NO: 1739753 - protein, 23 aa, Staphylococcus epidermidis
IILIICSSYLAFILIGSLNGKDM

SEQ ID NO: 1739754 - protein, 21 aa, Staphylococcus epidermidis
IISGVLLRKAFLKMDSYVDDL

SEQ ID NO: 1739755 - protein, 22 aa, Staphylococcus epidermidis
IKHRDLIRMLLMKQDAFLTENN

SEQ ID NO: 1739756 - protein, 21 aa, Staphylococcus epidermidis
ILGAGVEWGTTIVTLVTFVIL

SEQ ID NO: 1739757 - protein, 27 aa, Staphylococcus epidermidis
ILREKGTPSAAGFRIDTGYYNNDPLDK

SEQ ID NO: 1739758 - protein, 18 aa, Staphylococcus epidermidis
ILSLPLLLVMVVHISPIS

SEQ ID NO: 1739759 - protein, 22 aa, Staphylococcus epidermidis
ILSSIPQFFAIKSHSKATSIYG

SEQ ID NO: 1739760 - protein, 24 aa, Staphylococcus epidermidis
IMLGFLYKYIIAYLIQTYAVNPLQ

SEQ ID NO: 1739761 - protein, 18 aa, Staphylococcus epidermidis
IMLPMSLWAIERFFKERK

SEQ ID NO: 1739762 - protein, 17 aa, Staphylococcus epidermidis
IMNAVKTVINWFNQFRA

SEQ ID NO: 1739763 - protein, 23 aa, Staphylococcus epidermidis
IMTCVFIGFIVCGRWITHDIQTY

SEQ ID NO: 1739764 - protein, 26 aa, Staphylococcus epidermidis
INGFSPEYTMSVWMGFNKVKQYGTNS

SEQ ID NO: 1739765 - protein, 17 aa, Staphylococcus epidermidis
INSPEFQDLKLLVQTLH

SEQ ID NO: 1739766 - protein, 18 aa, Staphylococcus epidermidis
INVLPIVIVPLVTERKRI

SEQ ID NO: 1739767 - protein, 28 aa, Staphylococcus epidermidis
IPSETTLKGGQPLQVIAIDKAGNKSEAT

SEQ ID NO: 1739768 - protein, 30 aa, Staphylococcus epidermidis
IPSLCIIGMGIIGWYMWSLWSLIIALLPIL

SEQ ID NO: 1739769 - protein, 20 aa, Staphylococcus epidermidis
IQFEFFRRDLLKEKMTTQNN

SEQ ID NO: 1739770 - protein, 24 aa, Staphylococcus epidermidis
IQIFMYWFIFGLGFRNNRTVENIP

SEQ ID NO: 1739771 - protein, 20 aa, Staphylococcus epidermidis
IRIALSFAQVVVQSFIVYYA

SEQ ID NO: 1739772 - protein, 18 aa, Staphylococcus epidermidis
IRKYAVGVVSIITGVTIF

SEQ ID NO: 1739773 - protein, 27 aa, Staphylococcus epidermidis
IRRKKQKRIQYTIITLLILIIVLILLY

SEQ ID NO: 1739774 - protein, 17 aa, Staphylococcus epidermidis
ISAIITDFQRNIRKAQR

SEQ ID NO: 1739775 - protein, 26 aa, Staphylococcus epidermidis
ISGTPSEVGKYLITITTIDKDGNTAT

SEQ ID NO: 1739776 - protein, 18 aa, Staphylococcus epidermidis
ISIFSLFIFYKILILWTL

SEQ ID NO: 1739777 - protein, 19 aa, Staphylococcus epidermidis
ISIILYFSFSTLKYSNSIN

SEQ ID NO: 1739778 - protein, 19 aa, Staphylococcus epidermidis
ISLIFIRQRLTMVVLNGMI

SEQ ID NO: 1739779 - protein, 21 aa, Staphylococcus epidermidis
ITGMTCAACSNKVEKNLNKLD

SEQ ID NO: 1739780 - protein, 25 aa, Staphylococcus epidermidis
ITNTDWNALFSMKSGSWLKGFLPAL

SEQ ID NO: 1739781 - protein, 18 aa, Staphylococcus epidermidis
ITVSCIGIILSILFTHYV

SEQ ID NO: 1739782 - protein, 22 aa, Staphylococcus epidermidis
IVAIAVAIALIAIITKFVGKSY

SEQ ID NO: 1739783 - protein, 31 aa, Staphylococcus epidermidis
IVCILFMIIVPWFKFKHLRYFLDDKEIHIRE

SEQ ID NO: 1739784 - protein, 19 aa, Staphylococcus epidermidis
IVIFRQGWEKFTGDFTLNG

SEQ ID NO: 1739785 - protein, 25 aa, Staphylococcus epidermidis
IVSFCFIFLLLLFFRYILKRYFNYM

SEQ ID NO: 1739786 - protein, 26 aa, Staphylococcus epidermidis
IVVLAFFLLMIVFRSILVPLKAVLGF

SEQ ID NO: 1739787 - protein, 17 aa, Staphylococcus epidermidis
IYISLLILTIFIGGCGF

SEQ ID NO: 1739788 - protein, 20 aa, Staphylococcus epidermidis
IYMIRIGLQIANLMSDLKGR

SEQ ID NO: 1739789 - protein, 26 aa, Staphylococcus epidermidis
KAILYFEIITTIAIGLGLIIGNLFKP

SEQ ID NO: 1739790 - protein, 18 aa, Staphylococcus epidermidis
KALFCSGMIMILSSIVFG

SEQ ID NO: 1739791 - protein, 26 aa, Staphylococcus epidermidis
KANHPIEMNMIWKAMLIPSMGYVVGL

SEQ ID NO: 1739792 - protein, 25 aa, Staphylococcus epidermidis
KATDSLATSEARTSTNQISNLTSTS

SEQ ID NO: 1739793 - protein, 24 aa, Staphylococcus epidermidis
KDYIPFKFVLQLIHFTFFVIITLI

SEQ ID NO: 1739794 - protein, 19 aa, Staphylococcus epidermidis
KEATPHSPIVEANEEHVNV

SEQ ID NO: 1739795 - protein, 23 aa, Staphylococcus epidermidis
KEGDKIGVPGLVRGLHDMHEKEG

SEQ ID NO: 1739796 - protein, 21 aa, Staphylococcus epidermidis
KEGKTAMLISVDNELRGVVAV

SEQ ID NO: 1739797 - protein, 17 aa, Staphylococcus epidermidis
KEISGKAEPGSTVVITF

SEQ ID NO: 1739798 - protein, 26 aa, Staphylococcus epidermidis
KELNVTLRSRMYTFSKNKAIRNLKQN

SEQ ID NO: 1739799 - protein, 18 aa, Staphylococcus epidermidis
KESKDRKTPKKDKKEKIT

SEQ ID NO: 1739800 - protein, 18 aa, Staphylococcus epidermidis
KETLKFKWLNSHKKEGRN

SEQ ID NO: 1739801 - protein, 18 aa, Staphylococcus epidermidis
KFAIFSIIGILSLSIFTS

SEQ ID NO: 1739802 - protein, 35 aa, Staphylococcus epidermidis
KGEDGVVSNGFIVAVAIVLAIFGLAKKSRKDDDDQ

SEQ ID NO: 1739803 - protein, 17 aa, Staphylococcus epidermidis
KGETKTKYDAMKKDNTE

SEQ ID NO: 1739804 - protein, 24 aa, Staphylococcus epidermidis
KGFKRTRVSMFIWLVLLLPLPFLL

SEQ ID NO: 1739805 - protein, 17 aa, Staphylococcus epidermidis
KGKDIWIDFDVANQTLQ

SEQ ID NO: 1739806 - protein, 23 aa, Staphylococcus epidermidis
KGVKDIKGRAAINDDNFTQFQIA

SEQ ID NO: 1739807 - protein, 19 aa, Staphylococcus epidermidis
KHETEFAGIIFSFTGQSST

SEQ ID NO: 1739808 - protein, 21 aa, Staphylococcus epidermidis
KIALGIGGAITAVALSRKESR

SEQ ID NO: 1739809 - protein, 24 aa, Staphylococcus epidermidis
KIDGKGWQKDKSWGGYNVTRYEVV

SEQ ID NO: 1739810 - protein, 25 aa, Staphylococcus epidermidis
KIDGKGWQKDKSWGGYNVTRYEVVN

SEQ ID NO: 1739811 - protein, 30 aa, Staphylococcus epidermidis
KIHRSLLSLSIAIIGIFLGVTGLYIFRRKK

SEQ ID NO: 1739812 - protein, 19 aa, Staphylococcus epidermidis
KIKELKKYIPLLIICALST

SEQ ID NO: 1739813 - protein, 19 aa, Staphylococcus epidermidis
KIMKNYNWEYFKAQINKKL

SEQ ID NO: 1739814 - protein, 24 aa, Staphylococcus epidermidis
KINRLSFKGQIFFVSIDSMMEQIN

SEQ ID NO: 1739815 - protein, 21 aa, Staphylococcus epidermidis
KKGDIPGLAILIIKDNKIFLN

SEQ ID NO: 1739816 - protein, 31 aa, Staphylococcus epidermidis
KKIHRSLLSLSIAIIGIFLGVTGLYIFRRKK

SEQ ID NO: 1739817 - protein, 19 aa, Staphylococcus epidermidis
KKIVKRDFLLVPLYVLAIF

SEQ ID NO: 1739818 - protein, 26 aa, Staphylococcus epidermidis
KKLIIAKAEAKQVIKELSQKKRDAIN

SEQ ID NO: 1739819 - protein, 25 aa, Staphylococcus epidermidis
KKPLPKFLTLFAGPLFNFILALVLF

SEQ ID NO: 1739820 - protein, 19 aa, Staphylococcus epidermidis
KKYYISISLLMTFIVLVFD

SEQ ID NO: 1739821 - protein, 18 aa, Staphylococcus epidermidis
KLFESNKYYPIYGSSELE

SEQ ID NO: 1739822 - protein, 17 aa, Staphylococcus epidermidis
KLFIPLISIVGVIIITI

SEQ ID NO: 1739823 - protein, 19 aa, Staphylococcus epidermidis
KLGHFSVYFILLVGVILGT

SEQ ID NO: 1739824 - protein, 27 aa, Staphylococcus epidermidis
KLNDKMKLLRDKLKTLVNPVKASLNYR

SEQ ID NO: 1739825 - protein, 17 aa, Staphylococcus epidermidis
KLPGVNTTMDWDRKYPY

SEQ ID NO: 1739826 - protein, 17 aa, Staphylococcus epidermidis
KLTDTGSSFVIDKANKQ

SEQ ID NO: 1739827 - protein, 23 aa, Staphylococcus epidermidis
KMSKGVYRFKVKGIYGENYQTLK

SEQ ID NO: 1739828 - protein, 20 aa, Staphylococcus epidermidis
KNGQLKPGYNLQIATNSQFV

SEQ ID NO: 1739829 - protein, 17 aa, Staphylococcus epidermidis
KNLRSAVILLLVGEIGY

SEQ ID NO: 1739830 - protein, 24 aa, Staphylococcus epidermidis
KNNAITEINKLTALNDAQRQKAIE

SEQ ID NO: 1739831 - protein, 30 aa, Staphylococcus epidermidis
KNSVNKWLFLLCTLIGLIVLVALLIQTFVK

SEQ ID NO: 1739832 - protein, 25 aa, Staphylococcus epidermidis
KPKILKKLTLGIGIFATLLTSLILG

SEQ ID NO: 1739833 - protein, 20 aa, Staphylococcus epidermidis
KPKILKKVTLGIGIFATLLT

SEQ ID NO: 1739834 - protein, 25 aa, Staphylococcus epidermidis
KPSQRKFWYSFGLLFGGIGLISIFF

SEQ ID NO: 1739835 - protein, 23 aa, Staphylococcus epidermidis
KQAGQGYRGYGTFVKNDSQGNTS

SEQ ID NO: 1739836 - protein, 19 aa, Staphylococcus epidermidis
KQLSEGDIHSIPVVKRKQN

SEQ ID NO: 1739837 - protein, 19 aa, Staphylococcus epidermidis
KQQDLKGILAFSTVSQLGM

SEQ ID NO: 1739838 - protein, 25 aa, Staphylococcus epidermidis
KQRYINILFIISWIQLIGGLTRANQ

SEQ ID NO: 1739839 - protein, 30 aa, Staphylococcus epidermidis
KQSIKDMISHAALRTEVKQLLQQAKILDEA

SEQ ID NO: 1739840 - protein, 29 aa, Staphylococcus epidermidis
KQSIKDMISHAALRTEVKQLLQQAKTLDE

SEQ ID NO: 1739841 - protein, 25 aa, Staphylococcus epidermidis
KQSRIKIFTKDNMQVIGDITTIADK

SEQ ID NO: 1739842 - protein, 26 aa, Staphylococcus epidermidis
KQSRIKIFTKDNMQVIGDITTIADKM

SEQ ID NO: 1739843 - protein, 22 aa, Staphylococcus epidermidis
KQTKWFVGITISTAIGGLSLII

SEQ ID NO: 1739844 - protein, 19 aa, Staphylococcus epidermidis
KRFEREVHNSSQLSHENIV

SEQ ID NO: 1739845 - protein, 17 aa, Staphylococcus epidermidis
KRSFSAGTIAAFMTMFA

SEQ ID NO: 1739846 - protein, 24 aa, Staphylococcus epidermidis
KTFGYKRFEILAAVLNGITLMLIA

SEQ ID NO: 1739847 - protein, 25 aa, Staphylococcus epidermidis
KTGKDYDLQEQRGYTDSEQHNETQS

SEQ ID NO: 1739848 - protein, 19 aa, Staphylococcus epidermidis
KTSKDALHGERELNDNKNS

SEQ ID NO: 1739849 - protein, 22 aa, Staphylococcus epidermidis
KVEGLPAGMTFDEATNTISGTP

SEQ ID NO: 1739850 - protein, 21 aa, Staphylococcus epidermidis
KVMRISGAFWTLLLVIALSIL

SEQ ID NO: 1739851 - protein, 19 aa, Staphylococcus epidermidis
KVTLGIGIFATLLTSLILG

SEQ ID NO: 1739852 - protein, 20 aa, Staphylococcus epidermidis
KWLDGRSEMHFSVGQFTQTY

SEQ ID NO: 1739853 - protein, 21 aa, Staphylococcus epidermidis
KWLDGRSEMHFSVGQFTQTYL

SEQ ID NO: 1739854 - protein, 27 aa, Staphylococcus epidermidis
KYANFKFSYSWIHLAKIILISIIMMIG

SEQ ID NO: 1739855 - protein, 18 aa, Staphylococcus epidermidis
LAITMIVIFVKRNLSSSD

SEQ ID NO: 1739856 - protein, 17 aa, Staphylococcus epidermidis
LAQGLARENISIFDQIK

SEQ ID NO: 1739857 - protein, 21 aa, Staphylococcus epidermidis
LAVSITDFFQGVIMLIAMVMV

SEQ ID NO: 1739858 - protein, 18 aa, Staphylococcus epidermidis
LDDQVLALITGEIGSMPE

SEQ ID NO: 1739859 - protein, 18 aa, Staphylococcus epidermidis
LDKEIIKQLTDGVNQANN

SEQ ID NO: 1739860 - protein, 17 aa, Staphylococcus epidermidis
LDPLPSISFSDTDFSQY

SEQ ID NO: 1739861 - protein, 17 aa, Staphylococcus epidermidis
LDVEYKTALSSVNKTIT

SEQ ID NO: 1739862 - protein, 24 aa, Staphylococcus epidermidis
LDVKWGATITAIFAILIFVSRSGQ

SEQ ID NO: 1739863 - protein, 20 aa, Staphylococcus epidermidis
LEDGVGLPLFTALPIVSSML

SEQ ID NO: 1739864 - protein, 25 aa, Staphylococcus epidermidis
LEHSNVFKGLSWHQSLFYALFQSST

SEQ ID NO: 1739865 - protein, 29 aa, Staphylococcus epidermidis
LESKLLFLISKWFFISLIHLMLILLSLFY

SEQ ID NO: 1739866 - protein, 17 aa, Staphylococcus epidermidis
LFCFKLYQHYYYKLFAI

SEQ ID NO: 1739867 - protein, 17 aa, Staphylococcus epidermidis
LFIGSMLFGLFFGAGNL

SEQ ID NO: 1739868 - protein, 24 aa, Staphylococcus epidermidis
LFLFLIFHLIRLASKIDSQFNKVF

SEQ ID NO: 1739869 - protein, 17 aa, Staphylococcus epidermidis
LFTHTWITPILFIDIVI

SEQ ID NO: 1739870 - protein, 23 aa, Staphylococcus epidermidis
LFTYLIVCTIFIFSYVTMILFYK

SEQ ID NO: 1739871 - protein, 20 aa, Staphylococcus epidermidis
LGAIALHVTMNFPLSISFVI

SEQ ID NO: 1739872 - protein, 18 aa, Staphylococcus epidermidis
LGIAFLMNLMMPSLDKKL

SEQ ID NO: 1739873 - protein, 19 aa, Staphylococcus epidermidis
LGLILCLFATIPGIVLWNR

SEQ ID NO: 1739874 - protein, 18 aa, Staphylococcus epidermidis
LGLIPIYLGIKVAIYDDC

SEQ ID NO: 1739875 - protein, 18 aa, Staphylococcus epidermidis
LGLNNPIFIQWWDWLNQL

SEQ ID NO: 1739876 - protein, 17 aa, Staphylococcus epidermidis
LGPLLGWGLFPTIASKF

SEQ ID NO: 1739877 - protein, 19 aa, Staphylococcus epidermidis
LGVIICKLLSLDNYASSAI

SEQ ID NO: 1739878 - protein, 17 aa, Staphylococcus epidermidis
LHELQTTLINRVSASRE

SEQ ID NO: 1739879 - protein, 26 aa, Staphylococcus epidermidis
LIDYKGGGMANLFKDLKHLVGTITNL

SEQ ID NO: 1739880 - protein, 25 aa, Staphylococcus epidermidis
LIITQFKSGMLIFSILSLITSFSIV

SEQ ID NO: 1739881 - protein, 24 aa, Staphylococcus epidermidis
LILSMSLSLCWDVGKLDDVFNQTI

SEQ ID NO: 1739882 - protein, 31 aa, Staphylococcus epidermidis
LILSTPVQFIIGWQFYVGAYKNLRNGSTNMD

SEQ ID NO: 1739883 - protein, 19 aa, Staphylococcus epidermidis
LIMLPMSLWAIERFFKERK

SEQ ID NO: 1739884 - protein, 18 aa, Staphylococcus epidermidis
LIPFIPIKFSFFKFNNVN

SEQ ID NO: 1739885 - protein, 25 aa, Staphylococcus epidermidis
LIRFYYKDIIVCFVAVAFFNVTNYM

SEQ ID NO: 1739886 - protein, 19 aa, Staphylococcus epidermidis
LKAQGFTNCYLAKMVFAQT

SEQ ID NO: 1739887 - protein, 18 aa, Staphylococcus epidermidis
LKGILAFSTVSQLGMIMS

SEQ ID NO: 1739888 - protein, 19 aa, Staphylococcus epidermidis
LKKYIPLLIICALSTEVFT

SEQ ID NO: 1739889 - protein, 20 aa, Staphylococcus epidermidis
LKLAIPGSISAFIGAGVLTF

SEQ ID NO: 1739890 - protein, 17 aa, Staphylococcus epidermidis
LKLVFTFATFAIAFLLR

SEQ ID NO: 1739891 - protein, 17 aa, Staphylococcus epidermidis
LKLYAILLMGIMVFLSV

SEQ ID NO: 1739892 - protein, 28 aa, Staphylococcus epidermidis
LKSKENKKRFTAMMLVCAMFAICWIAYI

SEQ ID NO: 1739893 - protein, 18 aa, Staphylococcus epidermidis
LKVEGAVEYGVKNSKYLA

SEQ ID NO: 1739894 - protein, 24 aa, Staphylococcus epidermidis
LKVGRLMKFIPRSVMIGFVNALGI

SEQ ID NO: 1739895 - protein, 20 aa, Staphylococcus epidermidis
LKVRFIYTMQLIVAFIAILI

SEQ ID NO: 1739896 - protein, 20 aa, Staphylococcus epidermidis
LLASILILWFYFRKSIPKTF

SEQ ID NO: 1739897 - protein, 17 aa, Staphylococcus epidermidis
LLFRHLIIHELGKKLTY

SEQ ID NO: 1739898 - protein, 18 aa, Staphylococcus epidermidis
LLGGFLFDKLGGYKTILI

SEQ ID NO: 1739899 - protein, 18 aa, Staphylococcus epidermidis
LLHQNRLQDKVVKQPTKG

SEQ ID NO: 1739900 - protein, 19 aa, Staphylococcus epidermidis
LLITYVVLCLIGLVMVYSA

SEQ ID NO: 1739901 - protein, 19 aa, Staphylococcus epidermidis
LMFALPIYLSYHVSDGLQY

SEQ ID NO: 1739902 - protein, 17 aa, Staphylococcus epidermidis
LMWKQVNSSLIFVGSVV

SEQ ID NO: 1739903 - protein, 20 aa, Staphylococcus epidermidis
LNEEEARAYLKYIKAESDLK

SEQ ID NO: 1739904 - protein, 17 aa, Staphylococcus epidermidis
LNIIGWNGNLAVFILFG

SEQ ID NO: 1739905 - protein, 24 aa, Staphylococcus epidermidis
LNKRYSHKSCIILGAITLTLGLFT

SEQ ID NO: 1739906 - protein, 21 aa, Staphylococcus epidermidis
LNKVMGKLEQFINHADSVENS

SEQ ID NO: 1739907 - protein, 19 aa, Staphylococcus epidermidis
LNMPYGFKKKELITDKKDQ

SEQ ID NO: 1739908 - protein, 23 aa, Staphylococcus epidermidis
LNQVWPILLFLPFVVFIFIRIHV

SEQ ID NO: 1739909 - protein, 19 aa, Staphylococcus epidermidis
LPAIVIKWLSFIPITLFTA

SEQ ID NO: 1739910 - protein, 20 aa, Staphylococcus epidermidis
LPAIVIKWLSFIPITLFTAL

SEQ ID NO: 1739911 - protein, 17 aa, Staphylococcus epidermidis
LPEGVSFDSETNTISGT

SEQ ID NO: 1739912 - protein, 20 aa, Staphylococcus epidermidis
LPFISYGGSSLWSLMTGIGV

SEQ ID NO: 1739913 - protein, 25 aa, Staphylococcus epidermidis
LPLSTNIFYFLAMISFLLVISFAPA

SEQ ID NO: 1739914 - protein, 18 aa, Staphylococcus epidermidis
LPPKDVFLASVLIGTLGA

SEQ ID NO: 1739915 - protein, 17 aa, Staphylococcus epidermidis
LPVRRADYVKSYYIIFL

SEQ ID NO: 1739916 - protein, 18 aa, Staphylococcus epidermidis
LQEIEAYYEYTLRIESIN

SEQ ID NO: 1739917 - protein, 17 aa, Staphylococcus epidermidis
LQNIYLRVYYPPIVIGL

SEQ ID NO: 1739918 - protein, 17 aa, Staphylococcus epidermidis
LRQAQEIAKNEIQNLDG

SEQ ID NO: 1739919 - protein, 20 aa, Staphylococcus epidermidis
LRSAVLLLLVGEIGYWIYSA

SEQ ID NO: 1739920 - protein, 20 aa, Staphylococcus epidermidis
LRSAVLLLLVGEIGYWLYSA

SEQ ID NO: 1739921 - protein, 20 aa, Staphylococcus epidermidis
LRYNKCILMTQSFIFNSLAF

SEQ ID NO: 1739922 - protein, 17 aa, Staphylococcus epidermidis
LSAACLLPATIALINSF

SEQ ID NO: 1739923 - protein, 27 aa, Staphylococcus epidermidis
LSGSATYDPKTGIATLTPDAYSQKGAI

SEQ ID NO: 1739924 - protein, 19 aa, Staphylococcus epidermidis
LSKFKHFRALGGEVEAFFP

SEQ ID NO: 1739925 - protein, 19 aa, Staphylococcus epidermidis
LSSMLYRVFLDISSFSSKG

SEQ ID NO: 1739926 - protein, 22 aa, Staphylococcus epidermidis
LSTTQFVIWLQNGVWAIIVYFI

SEQ ID NO: 1739927 - protein, 22 aa, Staphylococcus epidermidis
LSVSLPSFFIGLILLYIFSLKL

SEQ ID NO: 1739928 - protein, 24 aa, Staphylococcus epidermidis
LVSTARIGRSLGIHLILATQKPSG

SEQ ID NO: 1739929 - protein, 18 aa, Staphylococcus epidermidis
LYAILLLGIMVFLSVVIL

SEQ ID NO: 1739930 - protein, 18 aa, Staphylococcus epidermidis
LYAILLMGIMVFLSVVIL

SEQ ID NO: 1739931 - protein, 24 aa, Staphylococcus epidermidis
LYFACGFVGACGWMVYTVLFNGFE

SEQ ID NO: 1739932 - protein, 21 aa, Staphylococcus epidermidis
LYGNRHCKNIRDVSRQINRII

SEQ ID NO: 1739933 - protein, 17 aa, Staphylococcus epidermidis
LYLWLNVISNLIFYIIY

SEQ ID NO: 1739934 - protein, 23 aa, Staphylococcus epidermidis
LYSEPFIDDFVRFKSFTLKSTYY

SEQ ID NO: 1739935 - protein, 28 aa, Staphylococcus epidermidis
LYYWGWWLSWSPFVGVFIARVSKGRSIR

SEQ ID NO: 1739936 - protein, 23 aa, Staphylococcus epidermidis
MAQVKSTMLVTVWVFTGIEGAVV

SEQ ID NO: 1739937 - protein, 18 aa, Staphylococcus epidermidis
MFALPIYLSYHVSDGLQY

SEQ ID NO: 1739938 - protein, 26 aa, Staphylococcus epidermidis
MFFFQRVSGILAFIFIAMHLWQTRLQ

SEQ ID NO: 1739939 - protein, 28 aa, Staphylococcus epidermidis
MGVNLPFQFTFPGSEWVVLILSTILFFY

SEQ ID NO: 1739940 - protein, 24 aa, Staphylococcus epidermidis
MKILKSELLLAFSTSSSEAVLPIM

SEQ ID NO: 1739941 - protein, 26 aa, Staphylococcus epidermidis
MKSGSWLKGFLPALAFVIVGTGLSWT

SEQ ID NO: 1739942 - protein, 17 aa, Staphylococcus epidermidis
MLLACLLIQAATNMFNE

SEQ ID NO: 1739943 - protein, 19 aa, Staphylococcus epidermidis
MLPELFPMRARGAATGISA

SEQ ID NO: 1739944 - protein, 23 aa, Staphylococcus epidermidis
MPTEVEIAGPIVIENKFIDPKTN

SEQ ID NO: 1739945 - protein, 20 aa, Staphylococcus epidermidis
MSAKIGELFGVEYKDGLPID

SEQ ID NO: 1739946 - protein, 23 aa, Staphylococcus epidermidis
MTSKKRWTALVVLAVSLFVVTMD

SEQ ID NO: 1739947 - protein, 20 aa, Staphylococcus epidermidis
MVVGNLLGGFLFDKLGGYKT

SEQ ID NO: 1739948 - protein, 24 aa, Staphylococcus epidermidis
NAELRTGPNAAYPVIYKIEKGESF

SEQ ID NO: 1739949 - protein, 27 aa, Staphylococcus epidermidis
NDALKKLKAIGFKDIHVEQAYSQTYEK

SEQ ID NO: 1739950 - protein, 22 aa, Staphylococcus epidermidis
NFLSYKYTFLFIALIIIVSLSR

SEQ ID NO: 1739951 - protein, 21 aa, Staphylococcus epidermidis
NGDLFRFYKNPDFKKVNPSKY

SEQ ID NO: 1739952 - protein, 19 aa, Staphylococcus epidermidis
NGEEIKVRLIGVDTPETVK

SEQ ID NO: 1739953 - protein, 28 aa, Staphylococcus epidermidis
NGKMEELKVAVAKAPLVRQNSNYINEDV

SEQ ID NO: 1739954 - protein, 22 aa, Staphylococcus epidermidis
NGKPIDLFFIWFAANLGILGIV

SEQ ID NO: 1739955 - protein, 20 aa, Staphylococcus epidermidis
NHLACRIISAILQISALMMW

SEQ ID NO: 1739956 - protein, 20 aa, Staphylococcus epidermidis
NIKQAFPHFLIPNVPFNLET

SEQ ID NO: 1739957 - protein, 24 aa, Staphylococcus epidermidis
NINQFIWNKNGFFKSQNNTEHRLN

SEQ ID NO: 1739958 - protein, 24 aa, Staphylococcus epidermidis
NISSDIFVWFKLVLNDTSEFHNIK

SEQ ID NO: 1739959 - protein, 17 aa, Staphylococcus epidermidis
NIVLLAFAMIVFTMGEM

SEQ ID NO: 1739960 - protein, 20 aa, Staphylococcus epidermidis
NKVSGLPEGVSFDSETNTIS

SEQ ID NO: 1739961 - protein, 38 aa, Staphylococcus epidermidis
NKYAIRKFTVGTASIVIGATLLFGLGHNEAKAEENSVQ

SEQ ID NO: 1739962 - protein, 21 aa, Staphylococcus epidermidis
NMRERALEIGATFHIVSLPDS

SEQ ID NO: 1739963 - protein, 34 aa, Staphylococcus epidermidis; identical to SEQ ID NO: 1576233

SEQ ID NO: 1739964 - protein, 25 aa, Staphylococcus epidermidis
NNAVTRAKVAAIIGQAKILDHAMEN

SEQ ID NO: 1739965 - protein, 24 aa, Staphylococcus epidermidis
NNAVTRTEVAAIIGQAKLLDHAME

SEQ ID NO: 1739966 - protein, 26 aa, Staphylococcus epidermidis
NNINQFIWNKNGFFKSQNNTEHRMNS

SEQ ID NO: 1739967 - protein, 26 aa, Staphylococcus epidermidis
NNKLVFPFIIACGFIADSTSLPLVVS

SEQ ID NO: 1739968 - protein, 26 aa, Staphylococcus epidermidis
NNNKKHAFNTLAHIIIWDTDQQPLVF

SEQ ID NO: 1739969 - protein, 23 aa, Staphylococcus epidermidis
NNTGIRMFKRYAVITTSAKILGR

SEQ ID NO: 1739970 - protein, 21 aa, Staphylococcus epidermidis
NQLNIAMQALRNSVNDVNNVK

SEQ ID NO: 1739971 - protein, 41 aa, Staphylococcus epidermidis
NQSASYFIKQWALDRIKEIQLETMNSIRGAHTVQDVHKALL

SEQ ID NO: 1739972 - protein, 26 aa, Staphylococcus epidermidis
NQSGQLGATVKPGSAPNQDTEATPNL

SEQ ID NO: 1739973 - protein, 23 aa, Staphylococcus epidermidis
NSEYKAININEAFKNNKQIKKAN

SEQ ID NO: 1739974 - protein, 24 aa, Staphylococcus epidermidis
NSEYKAVNINEAFKNNKQIKKANS

SEQ ID NO: 1739975 - protein, 19 aa, Staphylococcus epidermidis
NSEYKAVNINEAYKNNKHI

SEQ ID NO: 1739976 - protein, 22 aa, Staphylococcus epidermidis
NYIKKELNRNLLAVSNEITDQL

SEQ ID NO: 1739977 - protein, 17 aa, Staphylococcus epidermidis
PDLKPGEERVKQKGEPG

SEQ ID NO: 1739978 - protein, 21 aa, Staphylococcus epidermidis
PELSNNFIVLDFTYDLPLSTY

SEQ ID NO: 1739979 - protein, 17 aa, Staphylococcus epidermidis
PFFTACIGGGVGGAVIG

SEQ ID NO: 1739980 - protein, 29 aa, Staphylococcus epidermidis
PFGFKGNHIPALIGWVGQVGWLSVNVSTG

SEQ ID NO: 1739981 - protein, 17 aa, Staphylococcus epidermidis
PGQFYLVRIYRIIMLII

SEQ ID NO: 1739982 - protein, 22 aa, Staphylococcus epidermidis
PGVNTTMDWDRKYPYGDTLRGI

SEQ ID NO: 1739983 - protein, 17 aa, Staphylococcus epidermidis
PHRKRVVSNLSVGNITF

SEQ ID NO: 1739984 - protein, 21 aa, Staphylococcus epidermidis
PHTDFIFAIICEEMGLIGGLI

SEQ ID NO: 1739985 - protein, 20 aa, Staphylococcus epidermidis
PKFESFFGVEMMFLGNTEAL

SEQ ID NO: 1739986 - protein, 21 aa, Staphylococcus epidermidis
PKKVRNDYRFYPSNQEQQRLE

SEQ ID NO: 1739987 - protein, 17 aa, Staphylococcus epidermidis
PLADAIVTYAKDKGLNL

SEQ ID NO: 1739988 - protein, 18 aa, Staphylococcus epidermidis
PMPHLYIISDEFAELKSE

SEQ ID NO: 1739989 - protein, 23 aa, Staphylococcus epidermidis
PNLLNKYGIRKLSAGTASLLIGA

SEQ ID NO: 1739990 - protein, 21 aa, Staphylococcus epidermidis
PNVQWPEVWQAILETLYMTVV

SEQ ID NO: 1739991 - protein, 17 aa, Staphylococcus epidermidis
PPFSGFYGKFYIVRATF

SEQ ID NO: 1739992 - protein, 17 aa, Staphylococcus epidermidis
PQVPHWLTVLFIVLILI

SEQ ID NO: 1739993 - protein, 17 aa, Staphylococcus epidermidis
PTDKEDKNHSAFKNHSA

SEQ ID NO: 1739994 - protein, 23 aa, Staphylococcus epidermidis
PVAHWVWGGGWISKIGAIDYAGG

SEQ ID NO: 1739995 - protein, 18 aa, Staphylococcus epidermidis
PVIREIANYLGPTLIITF

SEQ ID NO: 1739996 - protein, 21 aa, Staphylococcus epidermidis
PYLNRVNGVFFGQIFTVYFND

SEQ ID NO: 1739997 - protein, 28 aa, Staphylococcus epidermidis
QALDKARPKIEAIVPQVSKKRDALNAIQ

SEQ ID NO: 1739998 - protein, 27 aa, Staphylococcus epidermidis
QAPPQWLYHFSLSLSFVIAQGLILVIF

SEQ ID NO: 1739999 - protein, 34 aa, Staphylococcus epidermidis
QDNTGSVIKLNLTKWLSLQSDFVNGGKVNLSFAQ

SEQ ID NO: 1740000 - protein, 17 aa, Staphylococcus epidermidis
QELEDGVGLPLFTALPI

SEQ ID NO: 1740001 - protein, 22 aa, Staphylococcus epidermidis
QFPKENWWVFVVLLLLVGNVEV

SEQ ID NO: 1740002 - protein, 22 aa, Staphylococcus epidermidis
QFQSRFKKFILILLVGAAIGTS

SEQ ID NO: 1740003 - protein, 26 aa, Staphylococcus epidermidis
QFSFMPLKHLWSLAIEEQFYLFFPAI

SEQ ID NO: 1740004 - protein, 20 aa, Staphylococcus epidermidis
QFTITIQDTISPVVNVTPSQ

SEQ ID NO: 1740005 - protein, 23 aa, Staphylococcus epidermidis
QILPVSMPFHIDMHNIIIVLVVF

SEQ ID NO: 1740006 - protein, 26 aa, Staphylococcus epidermidis
QKGTSYFRFQYFNPLNSSKYYENLDD

SEQ ID NO: 1740007 - protein, 22 aa, Staphylococcus epidermidis
QKKPQARQALIAKTNEKQSAIN

SEQ ID NO: 1740008 - protein, 17 aa, Staphylococcus epidermidis
QLIKLVVSAVLAAPLLM

SEQ ID NO: 1740009 - protein, 26 aa, Staphylococcus epidermidis
QLIYAETSLNGFERLNHARPRALEYI

SEQ ID NO: 1740010 - protein, 17 aa, Staphylococcus epidermidis
QNGVWAIIVYFIVCLLI

SEQ ID NO: 1740011 - protein, 23 aa, Staphylococcus epidermidis
QPELPYIVVIVDELADLMMVAGK

SEQ ID NO: 1740012 - protein, 18 aa, Staphylococcus epidermidis
QPSIKRVTVNQLAAEQGS

SEQ ID NO: 1740013 - protein, 21 aa, Staphylococcus epidermidis
QRKKPFLSMMPVVAMYSLWLT

SEQ ID NO: 1740014 - protein, 23 aa, Staphylococcus epidermidis
QSELPYIVVIVDELADLMMVAGK

SEQ ID NO: 1740015 - protein, 18 aa, Staphylococcus epidermidis
QSTGIGLFIVQHIANHLN

SEQ ID NO: 1740016 - protein, 18 aa, Staphylococcus epidermidis
QTQAHAEQAEEFERVTTG

SEQ ID NO: 1740017 - protein, 19 aa, Staphylococcus epidermidis
QTQAHAEQAEEFERVTTGT

SEQ ID NO: 1740018 - protein, 22 aa, Staphylococcus epidermidis
QTREVGKTINPITITTTDNSKD

SEQ ID NO: 1740019 - protein, 23 aa, Staphylococcus epidermidis
QVFKDIFPLSAVILILYALDLLS

SEQ ID NO: 1740020 - protein, 26 aa, Staphylococcus epidermidis
RDYPVIQGCVLFIGFFVVIINTIADL

SEQ ID NO: 1740021 - protein, 19 aa, Staphylococcus epidermidis
RESKNFWQDAWSQLKRNKL

SEQ ID NO: 1740022 - protein, 18 aa, Staphylococcus epidermidis
RFSIRKYAVGVVSIITGV

SEQ ID NO: 1740023 - protein, 21 aa, Staphylococcus epidermidis
RFSIRKYAVGVVSIITGVTIF

SEQ ID NO: 1740024 - protein, 25 aa, Staphylococcus epidermidis
RFSKEEIRTLLNIAGREGAFNEIEN

SEQ ID NO: 1740025 - protein, 18 aa, Staphylococcus epidermidis
RFVSILFIFTYVVSFLPV

SEQ ID NO: 1740026 - protein, 19 aa, Staphylococcus epidermidis
RFYVKKEKVLGMAISQHPF

SEQ ID NO: 1740027 - protein, 22 aa, Staphylococcus epidermidis
RIGELSTLIYLIFPILAIFVDK

SEQ ID NO: 1740028 - protein, 20 aa, Staphylococcus epidermidis
RILIVGCIFAIFQQFIGINA

SEQ ID NO: 1740029 - protein, 21 aa, Staphylococcus epidermidis
RKAIEALYYNRYLKQNDQVLD

SEQ ID NO: 1740030 - protein, 27 aa, Staphylococcus epidermidis
RKEFSVSKRAGHGVFQIMSGTLHNTVG

SEQ ID NO: 1740031 - protein, 24 aa, Staphylococcus epidermidis
RKKEFALNMVLGMEKKHLRLIILI

SEQ ID NO: 1740032 - protein, 24 aa, Staphylococcus epidermidis
RLFLEPTRFNYLIIVAIGVIVGAI

SEQ ID NO: 1740033 - protein, 31 aa, Staphylococcus epidermidis
RLFVEAFKELWLPIITICFILAISKITTYGG

SEQ ID NO: 1740034 - protein, 19 aa, Staphylococcus epidermidis
RLGAALTVVITVTGQIIMG

SEQ ID NO: 1740035 - protein, 27 aa, Staphylococcus epidermidis
RLVERLPAMVLPSWAYNKIAPVAIDDV

SEQ ID NO: 1740036 - protein, 18 aa, Staphylococcus epidermidis
RMNEMRVLTIAMMSMSSV

SEQ ID NO: 1740037 - protein, 18 aa, Staphylococcus epidermidis
RNQLPISYLYEGVGILET

SEQ ID NO: 1740038 - protein, 23 aa, Staphylococcus epidermidis
RPDVKGREAILHVHAKNKPLDET

SEQ ID NO: 1740039 - protein, 19 aa, Staphylococcus epidermidis
RPIGGIVFGIIGDKYGRKI

SEQ ID NO: 1740040 - protein, 26 aa, Staphylococcus epidermidis
RPNENRTANLQSMFTNIDTKNHTVEQ

SEQ ID NO: 1740041 - protein, 20 aa, Staphylococcus epidermidis
RRVVLPAALPGILTGFILSL

SEQ ID NO: 1740042 - protein, 21 aa, Staphylococcus epidermidis
RSALNLVKIAFRLLMSPISTI

SEQ ID NO: 1740043 - protein, 17 aa, Staphylococcus epidermidis
RTGSIIGTFVFPIILAA

SEQ ID NO: 1740044 - protein, 17 aa, Staphylococcus epidermidis
RTLILTLILTILSGIAF

SEQ ID NO: 1740045 - protein, 17 aa, Staphylococcus epidermidis
RTSYRLLHWQYKDTLTV

SEQ ID NO: 1740046 - protein, 18 aa, Staphylococcus epidermidis
RYEHILNQAHLLGEKHIA

SEQ ID NO: 1740047 - protein, 21 aa, Staphylococcus epidermidis
RYKHILNQAHLLGEKHIAEHK

SEQ ID NO: 1740048 - protein, 23 aa, Staphylococcus epidermidis
RYLVYKFRPLKVIATDEEITSPI

SEQ ID NO: 1740049 - protein, 26 aa, Staphylococcus epidermidis
SAAFFYSIYESIKWLINTNYEPHLYF

SEQ ID NO: 1740050 - protein, 23 aa, Staphylococcus epidermidis
SAGYIFRFGFNLFDGVNNITEIT

SEQ ID NO: 1740051 - protein, 17 aa, Staphylococcus epidermidis
SAVILLLVGEIGYWIYS

SEQ ID NO: 1740052 - protein, 32 aa, Staphylococcus epidermidis
SEEWGRPWVFSRVFLALGITFLALWILTNIFG

SEQ ID NO: 1740053 - protein, 17 aa, Staphylococcus epidermidis
SEQRYSHQQPRSNKSNK

SEQ ID NO: 1740054 - protein, 21 aa, Staphylococcus epidermidis
SGITIISMILCYVVIKITDNI

SEQ ID NO: 1740055 - protein, 24 aa, Staphylococcus epidermidis
SGKAEPGSTVVITFPDGQTAEGKA

SEQ ID NO: 1740056 - protein, 19 aa, Staphylococcus epidermidis
SGMTPFYTALSIWVGGLLM

SEQ ID NO: 1740057 - protein, 29 aa, Staphylococcus epidermidis
SGYFVPIVVGIAIFTFIIWISLVQPGQFE

SEQ ID NO: 1740058 - protein, 21 aa, Staphylococcus epidermidis
SHIPMIYSYFLNYGLLFVSSI

SEQ ID NO: 1740059 - protein, 21 aa, Staphylococcus epidermidis
SHIPMIYSYFLNYGLLVVSSI

SEQ ID NO: 1740060 - protein, 17 aa, Staphylococcus epidermidis
SHLLEEAKNNAITEINK

SEQ ID NO: 1740061 - protein, 19 aa, Staphylococcus epidermidis
SHSWDIPSTILSIAGMIGL

SEQ ID NO: 1740062 - protein, 17 aa, Staphylococcus epidermidis
SIFLLGLIFVYQSDNPY

SEQ ID NO: 1740063 - protein, 17 aa, Staphylococcus epidermidis
SIFTAFISFVIFPYIHS

SEQ ID NO: 1740064 - protein, 22 aa, Staphylococcus epidermidis
SIPSNGRWYDHIGIKKDRREAV

SEQ ID NO: 1740065 - protein, 21 aa, Staphylococcus epidermidis
SIRHTHCSYLLLNDVSIYYTS

SEQ ID NO: 1740066 - protein, 17 aa, Staphylococcus epidermidis
SIVLWIVAIVAIVISLI

SEQ ID NO: 1740067 - protein, 18 aa, Staphylococcus epidermidis
SKDVLTTTVTGLPSGLSF

SEQ ID NO: 1740068 - protein, 19 aa, Staphylococcus epidermidis
SKIMMPLLFIFLIIVVAQS

SEQ ID NO: 1740069 - protein, 17 aa, Staphylococcus epidermidis
SLACLTTACGLIVSVSE

SEQ ID NO: 1740070 - protein, 22 aa, Staphylococcus epidermidis
SLDPAIFYPLIKKLKENNDYVV

SEQ ID NO: 1740071 - protein, 25 aa, Staphylococcus epidermidis
SLITTQGWIRISLIDSLPLKEYSLE

SEQ ID NO: 1740072 - protein, 19 aa, Staphylococcus epidermidis
SLMNFCLLSFPLDLIEERN

SEQ ID NO: 1740073 - protein, 34 aa, Staphylococcus epidermidis
SLTETQLNSWGWRIPFLLGMFLGLFGLYLRRKLE

SEQ ID NO: 1740074 - protein, 20 aa, Staphylococcus epidermidis
SMSTSETFTSQSPINSESQF

SEQ ID NO: 1740075 - protein, 23 aa, Staphylococcus epidermidis
SNKKTWLIVTIVLAIIIALVVIF

SEQ ID NO: 1740076 - protein, 21 aa, Staphylococcus epidermidis
SNNVKAHMSVKISQLGSEFDL

SEQ ID NO: 1740077 - protein, 39 aa, Staphylococcus epidermidis
SNTTGADGWGFMFSKKDGDDFLKNGGILREKGTPSAAGF

SEQ ID NO: 1740078 - protein, 25 aa, Staphylococcus epidermidis
SNVYMFKTALKLAGDPYTSGMSLPN

SEQ ID NO: 1740079 - protein, 25 aa, Staphylococcus epidermidis
SPLYFRFTIYWPFFSDTFIWLPLLL

SEQ ID NO: 1740080 - protein, 33 aa, Staphylococcus epidermidis
SQKRIEFYRLYLLMIHLLKFGGMYADSVQRSMK

SEQ ID NO: 1740081 - protein, 23 aa, Staphylococcus epidermidis
SQVKSTMLVTVWVFIGIEGAVVF

SEQ ID NO: 1740082 - protein, 18 aa, Staphylococcus epidermidis
SRKRYSPNSTYKIYLAMF

SEQ ID NO: 1740083 - protein, 23 aa, Staphylococcus epidermidis
SRLVSCLLILFLGSAIFSLLGQH

SEQ ID NO: 1740084 - protein, 22 aa, Staphylococcus epidermidis
SSKPKKRGKRSLDTNNGNDTTS

SEQ ID NO: 1740085 - protein, 24 aa, Staphylococcus epidermidis
SSKPKKRGKRSLDTNSGNDTTSTT

SEQ ID NO: 1740086 - protein, 25 aa, Staphylococcus epidermidis
SSLKNVCIFISFIYFINFIFFLFSS

SEQ ID NO: 1740087 - protein, 18 aa, Staphylococcus epidermidis
SSLTGLNHGVKWLSNLNI

SEQ ID NO: 1740088 - protein, 17 aa, Staphylococcus epidermidis
SSLTIGVIFVIITLIKD

SEQ ID NO: 1740089 - protein, 27 aa, Staphylococcus epidermidis
STEEIPFDKKRVFNPDLKPGEERVKQK

SEQ ID NO: 1740090 - protein, 18 aa, Staphylococcus epidermidis
STEVSGRGEPGTVVEVTF

SEQ ID NO: 1740091 - protein, 17 aa, Staphylococcus epidermidis
STILSIAGMIGLVWSIK

SEQ ID NO: 1740092 - protein, 27 aa, Staphylococcus epidermidis
STIRNIRQNLFWAFGYNVAGIPIAAIG

SEQ ID NO: 1740093 - protein, 18 aa, Staphylococcus epidermidis
STLLGFVGTMVIEGRKNL

SEQ ID NO: 1740094 - protein, 19 aa, Staphylococcus epidermidis
STLLGFVGTMVIEGRKNLA

SEQ ID NO: 1740095 - protein, 17 aa, Staphylococcus epidermidis
SVFFRLAGDLPVFQKSL

SEQ ID NO: 1740096 - protein, 18 aa, Staphylococcus epidermidis
SVILAVGVSTLIGIIFGW

SEQ ID NO: 1740097 - protein, 27 aa, Staphylococcus epidermidis
SVILVITIIISFIFYFYTTEKKVDKDK

SEQ ID NO: 1740098 - protein, 27 aa, Staphylococcus epidermidis
SYLSLNKRYLFIITIVLFISFILLYMV

SEQ ID NO: 1740099 - protein, 18 aa, Staphylococcus epidermidis
SYRLLHWQYKDTLTVLLL

SEQ ID NO: 1740100 - protein, 18 aa, Staphylococcus epidermidis
TAKFREWSEQVGKSEGFK

SEQ ID NO: 1740101 - protein, 19 aa, Staphylococcus epidermidis
TATLSELGLSPTDSYNFLV

SEQ ID NO: 1740102 - protein, 20 aa, Staphylococcus epidermidis
TDKLGGGGMSIVYLAEDSIL

SEQ ID NO: 1740103 - protein, 20 aa, Staphylococcus epidermidis
TDKLGGGGMSIVYLAVDSIL

SEQ ID NO: 1740104 - protein, 21 aa, Staphylococcus epidermidis
TDKLGGGGMSIVYLAVDSILN

SEQ ID NO: 1740105 - protein, 18 aa, Staphylococcus epidermidis
TFMLSRAPFGFKGNHIPA

SEQ ID NO: 1740106 - protein, 21 aa, Staphylococcus epidermidis
TGAMKDYHKAKVYGSKTFGKG

SEQ ID NO: 1740107 - protein, 21 aa, Staphylococcus epidermidis
TGIEGAVVFSGRAKSKKDVGT

SEQ ID NO: 1740108 - protein, 18 aa, Staphylococcus epidermidis
TGSAFAFPGSMIGVLLSS

SEQ ID NO: 1740109 - protein, 25 aa, Staphylococcus epidermidis
THRFTSRSVLLWTLIVFIFGNGMIA

SEQ ID NO: 1740110 - protein, 31 aa, Staphylococcus epidermidis
TIDSGFYQTPKYSLGNYVWYDTNKDGIQGDD

SEQ ID NO: 1740111 - protein, 20 aa, Staphylococcus epidermidis
TIFIFSYVTMILFYKHLSDS

SEQ ID NO: 1740112 - protein, 18 aa, Staphylococcus epidermidis
TIISMILCYVVIKITDNI

SEQ ID NO: 1740113 - protein, 25 aa, Staphylococcus epidermidis
TIPKIKDNSGEIIATGTYDNKNKQI

SEQ ID NO: 1740114 - protein, 19 aa, Staphylococcus epidermidis
TISELKPYVLIVTVIAILA

SEQ ID NO: 1740115 - protein, 18 aa, Staphylococcus epidermidis
TKNLEDFYDKEGFRDEEF

SEQ ID NO: 1740116 - protein, 20 aa, Staphylococcus epidermidis
TKRFVSILFIFTYVVSFLPV

SEQ ID NO: 1740117 - protein, 22 aa, Staphylococcus epidermidis
TLFAGLGALLLGKRRKNRKNKN

SEQ ID NO: 1740118 - protein, 21 aa, Staphylococcus epidermidis
TLISIFICFTTMFTNIYNNTD

SEQ ID NO: 1740119 - protein, 20 aa, Staphylococcus epidermidis
TLLTLFVVPVIYEILFTLKN

SEQ ID NO: 1740120 - protein, 18 aa, Staphylococcus epidermidis
TLVAFNFISGVLTLPGLA

SEQ ID NO: 1740121 - protein, 17 aa, Staphylococcus epidermidis
TPPSVKKSYGWLVFGRL

SEQ ID NO: 1740122 - protein, 21 aa, Staphylococcus epidermidis
TRKIKELFVARKVEKQYSKNQ

SEQ ID NO: 1740123 - protein, 22 aa, Staphylococcus epidermidis
TTTKINYEVTRNSASDSTSTSI

SEQ ID NO: 1740124 - protein, 17 aa, Staphylococcus epidermidis
TTVLGIVSLFSWGLGYF

SEQ ID NO: 1740125 - protein, 17 aa, Staphylococcus epidermidis
TTVSCLIPYKSSKEEHF

SEQ ID NO: 1740126 - protein, 18 aa, Staphylococcus epidermidis
TVDTGGQPARADQGQEGP

SEQ ID NO: 1740127 - protein, 19 aa, Staphylococcus epidermidis
TVEQTIYINPLRYSAKETN

SEQ ID NO: 1740128 - protein, 27 aa, Staphylococcus epidermidis
TVFGFKGAILSALAYFIASKVIHIIEE

SEQ ID NO: 1740129 - protein, 21 aa, Staphylococcus epidermidis
TVITCSLSFTICMILGTLTVS

SEQ ID NO: 1740130 - protein, 22 aa, Staphylococcus epidermidis
TVIYKFKDVQGPQISVDSQTRE

SEQ ID NO: 1740131 - protein, 19 aa, Staphylococcus epidermidis
TYDYSRYSKDISNKNNKSA

SEQ ID NO: 1740132 - protein, 29 aa, Staphylococcus epidermidis
VADHLTAKVKVILADGSFVTVNVPVKVVE

SEQ ID NO: 1740133 - protein, 25 aa, Staphylococcus epidermidis
VADHLTAKVKVILADGSYVTVNVPV

SEQ ID NO: 1740134 - protein, 17 aa, Staphylococcus epidermidis
VAKHKKSKEKQLSEGDI

SEQ ID NO: 1740135 - protein, 29 aa, Staphylococcus epidermidis
VAMISSYHIFRIFFILFVIAPLIGYFINV

SEQ ID NO: 1740136 - protein, 17 aa, Staphylococcus epidermidis
VAVSLIAPWLGRTALTW

SEQ ID NO: 1740137 - protein, 21 aa, Staphylococcus epidermidis
VDAGIRSGIFIALATFLRPVG

SEQ ID NO: 1740138 - protein, 23 aa, Staphylococcus epidermidis
VDSELERSLKLYGRDIDHNSPFY

SEQ ID NO: 1740139 - protein, 24 aa, Staphylococcus epidermidis
VEANANRYTFVWKKSIQNHESRMN

SEQ ID NO: 1740140 - protein, 19 aa, Staphylococcus epidermidis
VFFFDKFMKYMSELNFIAW

SEQ ID NO: 1740141 - protein, 18 aa, Staphylococcus epidermidis
VFNHINFVTAAIAIILAP

SEQ ID NO: 1740142 - protein, 18 aa, Staphylococcus epidermidis
VGEFKFPSGSIKVTRKGI

SEQ ID NO: 1740143 - protein, 18 aa, Staphylococcus epidermidis
VILADGSYVTVNVPVKVV

SEQ ID NO: 1740144 - protein, 17 aa, Staphylococcus epidermidis
VIMAGIRTAMVLIIGTA

SEQ ID NO: 1740145 - protein, 24 aa, Staphylococcus epidermidis
VIVALIGIIVWLWKTNENFRKTCV

SEQ ID NO: 1740146 - protein, 27 aa, Staphylococcus epidermidis
VKHSKKLLLCISFLLITIFIGGCGFIN

SEQ ID NO: 1740147 - protein, 19 aa, Staphylococcus epidermidis
VKKERNGFTIIKKKKDHGY

SEQ ID NO: 1740148 - protein, 18 aa, Staphylococcus epidermidis
VKNIHDFHVWSVTSGLNA

SEQ ID NO: 1740149 - protein, 18 aa, Staphylococcus epidermidis
VKPSTTPNQDAEVKPNPD

SEQ ID NO: 1740150 - protein, 18 aa, Staphylococcus epidermidis
VKTVINWFNQFRASIEQT

SEQ ID NO: 1740151 - protein, 25 aa, Staphylococcus epidermidis
VLLTIPVLFLFPFVQKHFVKGITIG

SEQ ID NO: 1740152 - protein, 19 aa, Staphylococcus epidermidis
VMIAARILLESGAEGTRVE

SEQ ID NO: 1740153 - protein, 23 aa, Staphylococcus epidermidis
VNEEARKAFSNINHATSNDLVNQ

SEQ ID NO: 1740154 - protein, 21 aa, Staphylococcus epidermidis
VNEKRIRPEDMHIMANIFLPS

SEQ ID NO: 1740155 - protein, 25 aa, Staphylococcus epidermidis
VNKELIPYIDPNSVKLYVSDPDGNP

SEQ ID NO: 1740156 - protein, 22 aa, Staphylococcus epidermidis
VPLSEVKEGDYLVIKPGEKIPV

SEQ ID NO: 1740157 - protein, 22 aa, Staphylococcus epidermidis
VPSDLTDSFTIPKIKDNSGEII

SEQ ID NO: 1740158 - protein, 19 aa, Staphylococcus epidermidis
VQHFYEWLNHVLKTGHSAW

SEQ ID NO: 1740159 - protein, 25 aa, Staphylococcus epidermidis
VQPTDNSFQDFVIDYNGDTKVMTVT

SEQ ID NO: 1740160 - protein, 17 aa, Staphylococcus epidermidis
VRLFKKRSFSAGTIAAF

SEQ ID NO: 1740161 - protein, 18 aa, Staphylococcus epidermidis
VSCLIPYKSSKEEHFNES

SEQ ID NO: 1740162 - protein, 18 aa, Staphylococcus epidermidis
VSHDGPIIDGFKGDKKTR

SEQ ID NO: 1740163 - protein, 23 aa, Staphylococcus epidermidis
VSILRRICIPAPVIGGLLFAILV

SEQ ID NO: 1740164 - protein, 24 aa, Staphylococcus epidermidis
VSLSRPSLVQSYSLLNYILWAVPP

SEQ ID NO: 1740165 - protein, 18 aa, Staphylococcus epidermidis
VSVGLVFLLQILLNVLEF

SEQ ID NO: 1740166 - protein, 35 aa, Staphylococcus epidermidis
VSVSEYFHRIIPKIPYKVFVVFFILVSFILANQGL

SEQ ID NO: 1740167 - protein, 20 aa, Staphylococcus epidermidis
VSVSEYFHRILPKIPYKVFV

SEQ ID NO: 1740168 - protein, 33 aa, Staphylococcus epidermidis
VSVSEYFHRILPKIPYKVFVIFFILVSFILANQ

SEQ ID NO: 1740169 - protein, 19 aa, Staphylococcus epidermidis
VTFPDGNKVEGKVDSDGNY

SEQ ID NO: 1740170 - protein, 20 aa, Staphylococcus epidermidis
VTFPDGNKVEGKVDSDGNYH

SEQ ID NO: 1740171 - protein, 27 aa, Staphylococcus epidermidis
VTHTVTGLPQGLKFDASTNSIVGTPTQ

SEQ ID NO: 1740172 - protein, 27 aa, Staphylococcus epidermidis
VTLLIVYIIPRFFKAIPAPLIAIIVLT

SEQ ID NO: 1740173 - protein, 28 aa, Staphylococcus epidermidis
VTPSQASEVFTPINPITITATDNSGKVV

SEQ ID NO: 1740174 - protein, 22 aa, Staphylococcus epidermidis
VTSVLPEWAFGLFGAVIFGAIL

SEQ ID NO: 1740175 - protein, 23 aa, Staphylococcus epidermidis
VTTPHQVFLNWFSHDPAFDYFKN

SEQ ID NO: 1740176 - protein, 18 aa, Staphylococcus epidermidis
VVLAFVIIFLERDRRTAS

SEQ ID NO: 1740177 - protein, 19 aa, Staphylococcus epidermidis
VVLCLIGLVMVYSASMVAA

SEQ ID NO: 1740178 - protein, 27 aa, Staphylococcus epidermidis
VVNKDNFNEHMNLSGSATYDPKTGIAT

SEQ ID NO: 1740179 - protein, 19 aa, Staphylococcus epidermidis
VVTALAGFIAKLFETHPAI

SEQ ID NO: 1740180 - protein, 24 aa, Staphylococcus epidermidis
VWNNHKYAFLLLAFVNILLLGMFL

SEQ ID NO: 1740181 - protein, 17 aa, Staphylococcus epidermidis
WDEMKHKAVDIGKANTQ

SEQ ID NO: 1740182 - protein, 25 aa, Staphylococcus epidermidis
WIFIFCFIGNILGGFILFFLMKYAH

SEQ ID NO: 1740183 - protein, 23 aa, Staphylococcus epidermidis
WIRFASKILPLIILITVIIHILS

SEQ ID NO: 1740184 - protein, 17 aa, Staphylococcus epidermidis
WITPILFIDIVIFTPII

SEQ ID NO: 1740185 - protein, 18 aa, Staphylococcus epidermidis
WKTNENFRKTCVEAWNTI

SEQ ID NO: 1740186 - protein, 19 aa, Staphylococcus epidermidis
WLDGRSEMHFSVGQFTQTY

SEQ ID NO: 1740187 - protein, 17 aa, Staphylococcus epidermidis
WSQLKRNKLAVIGMIGL

SEQ ID NO: 1740188 - protein, 17 aa, Staphylococcus epidermidis
WSYEKYGDLAVAYDDNE

SEQ ID NO: 1740189 - protein, 19 aa, Staphylococcus epidermidis
WSYETYGDLAVAYDDNEVV

SEQ ID NO: 1740190 - protein, 17 aa, Staphylococcus epidermidis
WTAGFSFSAGLIDYVLS

SEQ ID NO: 1740191 - protein, 19 aa, Staphylococcus epidermidis
WTGGFSFSAGLIDYVLSLV

SEQ ID NO: 1740192 - protein, 20 aa, Staphylococcus epidermidis
WTTPGPLGIVMGTGFAFWSF

SEQ ID NO: 1740193 - protein, 17 aa, Staphylococcus epidermidis
WYAIWLVLLGFGGGMIV

SEQ ID NO: 1740194 - protein, 18 aa, Staphylococcus epidermidis
WYDHIGIKKDRREAVYKK

SEQ ID NO: 1740195 - protein, 28 aa, Staphylococcus epidermidis
YDDSEGVIKAHDAENLIYDVTFEVDDKV

SEQ ID NO: 1740196 - protein, 19 aa, Staphylococcus epidermidis
YDLTHHFMFVMRDLKWIFL

SEQ ID NO: 1740197 - protein, 17 aa, Staphylococcus epidermidis
YDWKQNRSRIPEMTYNF

SEQ ID NO: 1740198 - protein, 19 aa, Staphylococcus epidermidis
YDYWILPGRYKRHTKEYHE

SEQ ID NO: 1740199 - protein, 17 aa, Staphylococcus epidermidis
YEMRTGIIIGIIALILV

SEQ ID NO: 1740200 - protein, 25 aa, Staphylococcus epidermidis
YFGIKFVEYLMRMFIPNLFSLLASI

SEQ ID NO: 1740201 - protein, 19 aa, Staphylococcus epidermidis
YFHKVRGLLSFWIGTLLIA

SEQ ID NO: 1740202 - protein, 28 aa, Staphylococcus epidermidis
YFHRILPKIPYKVFVIFFILVSFILANQ

SEQ ID NO: 1740203 - protein, 18 aa, Staphylococcus epidermidis
YGGSSLWSLMTGIGVVLS

SEQ ID NO: 1740204 - protein, 18 aa, Staphylococcus epidermidis
YGLFSSIMGMGFIAAFLS

SEQ ID NO: 1740205 - protein, 17 aa, Staphylococcus epidermidis
YGVEYLLAATILMGLIQ

SEQ ID NO: 1740206 - protein, 17 aa, Staphylococcus epidermidis
YHKVWDRIIRVMTSLSV

SEQ ID NO: 1740207 - protein, 26 aa, Staphylococcus epidermidis
YIGVWLYHFLERVLIPTGLHHFIYAP

SEQ ID NO: 1740208 - protein, 17 aa, Staphylococcus epidermidis
YILVYRGFVTSVLSFLI

SEQ ID NO: 1740209 - protein, 17 aa, Staphylococcus epidermidis
YITPIIIALLYLYIDER

SEQ ID NO: 1740210 - protein, 17 aa, Staphylococcus epidermidis
YIVFWMNRMMAITTMTI

SEQ ID NO: 1740211 - protein, 18 aa, Staphylococcus epidermidis
YKKMSISEFNKVIQEVEH

SEQ ID NO: 1740212 - protein, 20 aa, Staphylococcus epidermidis
YKNTDKVLDSSRFINEDQPE

SEQ ID NO: 1740213 - protein, 24 aa, Staphylococcus epidermidis
YLKYIKAESDLKHVADKVEENTKD

SEQ ID NO: 1740214 - protein, 26 aa, Staphylococcus epidermidis
YLSLNKRYLLIITIVLFISFILLYMV

SEQ ID NO: 1740215 - protein, 26 aa, Staphylococcus epidermidis
YQAIDNVVALGRIKGNDPNDHDGFNG

SEQ ID NO: 1740216 - protein, 22 aa, Staphylococcus epidermidis
YRLFYERCNELLLGKFSSEKTS

SEQ ID NO: 1740217 - protein, 23 aa, Staphylococcus epidermidis
YSLFRKQSFRGNEYLNSLQKGTS

SEQ ID NO: 1740218 - protein, 22 aa, Staphylococcus epidermidis
YSNNVKAHMSVKISQLGSEFDL

SEQ ID NO: 1740219 - protein, 19 aa, Staphylococcus epidermidis
YYITSCIGLFILLVILSLL

SEQ ID NO: 1740220 - protein, 20 aa, Staphylococcus epidermidis
YYITSCIGLFILLVILSLLL

SEQ ID NO: 1740221 - protein, 23 aa, Staphylococcus epidermidis
YYYKPNHFFFIAGLKSRVKSSAI

SEQ ID NO: 1740222 - protein, 18 aa, Staphylococcus epidermidis
AAAKEINSAMSNLRDGIQ

SEQ ID NO: 1740223 - protein, 17 aa, Staphylococcus epidermidis
AAAWVFRDRFLEILHIG

SEQ ID NO: 1740224 - protein, 23 aa, Staphylococcus epidermidis
AAEKGSNVNHLIKVTDQSITEGY

SEQ ID NO: 1740225 - protein, 19 aa, Staphylococcus epidermidis
AAENGILFKGGEFVERTHH

SEQ ID NO: 1740226 - protein, 18 aa, Staphylococcus epidermidis
AAFAIVGWVGIKLVIMVL

SEQ ID NO: 1740227 - protein, 19 aa, Staphylococcus epidermidis
AAFAIVGWVGIKLVVMVLA

SEQ ID NO: 1740228 - protein, 19 aa, Staphylococcus epidermidis
AAFFPCILVVLFSVVTRSK

SEQ ID NO: 1740229 - protein, 24 aa, Staphylococcus epidermidis
AAGKAATLGAMFLLFGSFLYFIGT

SEQ ID NO: 1740230 - protein, 24 aa, Staphylococcus epidermidis
AAIGMALGLVWYVLFNRKNLGKVG

SEQ ID NO: 1740231 - protein, 27 aa, Staphylococcus epidermidis
AAIINQIRASKDIKMINQIVDNAIELD

SEQ ID NO: 1740232 - protein, 28 aa, Staphylococcus epidermidis
AAILIGFGAAFLFNWLISQDKIPQSLMP

SEQ ID NO: 1740233 - protein, 18 aa, Staphylococcus epidermidis
AAKGIGMKPFRRLTKVEL

SEQ ID NO: 1740234 - protein, 18 aa, Staphylococcus epidermidis
AAKTEAKGNITSQHTTSE

SEQ ID NO: 1740235 - protein, 27 aa, Staphylococcus epidermidis
AALGLLAPWIAGAAMALSSVSVVTNAL

SEQ ID NO: 1740236 - protein, 19 aa, Staphylococcus epidermidis
AALPISGMRLGIPDDSLKA

SEQ ID NO: 1740237 - protein, 17 aa, Staphylococcus epidermidis
AALVTRVNIFAHIKSMM

SEQ ID NO: 1740238 - protein, 18 aa, Staphylococcus epidermidis
AAMTFALVFLFSEETGDL

SEQ ID NO: 1740239 - protein, 21 aa, Staphylococcus epidermidis
AASAGAFGWLILEYALKKTTS

SEQ ID NO: 1740240 - protein, 22 aa, Staphylococcus epidermidis
AASGYAVCIAMLRRLTGMTDVI

SEQ ID NO: 1740241 - protein, 23 aa, Staphylococcus epidermidis
AASGYAVCIAMLRRLTGVTDVIG

SEQ ID NO: 1740242 - protein, 26 aa, Staphylococcus epidermidis
ACIFIKEPFVYFVIWGIFVESLTLLP

SEQ ID NO: 1740243 - protein, 17 aa, Staphylococcus epidermidis
ACSYQIGATLSIFNASH

SEQ ID NO: 1740244 - protein, 17 aa, Staphylococcus epidermidis
ACSYQIGATLSIFNASQ

SEQ ID NO: 1740245 - protein, 26 aa, Staphylococcus epidermidis
ADHEIKMGKYYAGIYIPSKFTHEITG

SEQ ID NO: 1740246 - protein, 19 aa, Staphylococcus epidermidis
ADHYLLPWEKVIAIEQQHH

SEQ ID NO: 1740247 - protein, 18 aa, Staphylococcus epidermidis
ADIISGYFVPIVVGIAIV

SEQ ID NO: 1740248 - protein, 22 aa, Staphylococcus epidermidis
ADLKPDFLEEGLAGLGNSFDAH

SEQ ID NO: 1740249 - protein, 21 aa, Staphylococcus epidermidis
ADLNMSFSILPIMMIVYGVIA

SEQ ID NO: 1740250 - protein, 34 aa, Staphylococcus epidermidis
ADNMTVDTGFYLTPKYNVGDYVWEDTNKDGIQDD

SEQ ID NO: 1740251 - protein, 26 aa, Staphylococcus epidermidis
ADRSYPYKNGFKNYVFKHKDEYYIVS

SEQ ID NO: 1740252 - protein, 20 aa, Staphylococcus epidermidis
ADTSYTYLIIIYAIRMFAVS

SEQ ID NO: 1740253 - protein, 22 aa, Staphylococcus epidermidis
ADWVSSIGYIFPLRYAGDALTN

SEQ ID NO: 1740254 - protein, 20 aa, Staphylococcus epidermidis
AEAMNYMALAGWDTKDMLKG

SEQ ID NO: 1740255 - protein, 20 aa, Staphylococcus epidermidis
AEDKGMLAMEFFDHDPKAHA

SEQ ID NO: 1740256 - protein, 22 aa, Staphylococcus epidermidis
AEEFERVTTGTVDTGGQPARAD

SEQ ID NO: 1740257 - protein, 24 aa, Staphylococcus epidermidis
AEGNETTTNFIIKVVDTTAPPAPA

SEQ ID NO: 1740258 - protein, 21 aa, Staphylococcus epidermidis
AEGVNFVFGGFKFVDPKNPPF

SEQ ID NO: 1740259 - protein, 18 aa, Staphylococcus epidermidis
AELTELRDNYQVHYHITE

SEQ ID NO: 1740260 - protein, 23 aa, Staphylococcus epidermidis
AENEEVIGIIALMDIPNEHAKET

SEQ ID NO: 1740261 - protein, 18 aa, Staphylococcus epidermidis
AERLFKNNRYKRAIEIAE

SEQ ID NO: 1740262 - protein, 17 aa, Staphylococcus epidermidis
AERPQNLSLAFKEFTNP

SEQ ID NO: 1740263 - protein, 25 aa, Staphylococcus epidermidis
AETIPGEGFSGARIIRKETQKMFRQ

SEQ ID NO: 1740264 - protein, 18 aa, Staphylococcus epidermidis
AETLYALDIYHIEVDTSL

SEQ ID NO: 1740265 - protein, 25 aa, Staphylococcus epidermidis
AEVAEGFIKFNCMLGNTFTPQADTF

SEQ ID NO: 1740266 - protein, 25 aa, Staphylococcus epidermidis
AEVAEGFLKFNGMLGHTFKPQADTF

SEQ ID NO: 1740267 - protein, 18 aa, Staphylococcus epidermidis
AFAIPINDVRKIAKELEH

SEQ ID NO: 1740268 - protein, 23 aa, Staphylococcus epidermidis
AFALPFIFDVGLKSKEFISYIIT

SEQ ID NO: 1740269 - protein, 18 aa, Staphylococcus epidermidis
AFILMFLAFDVKEVLTSL

SEQ ID NO: 1740270 - protein, 20 aa, Staphylococcus epidermidis
AFIRHFKRTLILTLILTILS

SEQ ID NO: 1740271 - protein, 17 aa, Staphylococcus epidermidis
AFITFLFVGPVTRQLGY

SEQ ID NO: 1740272 - protein, 20 aa, Staphylococcus epidermidis
AFLILCIGIVVVLISVKKNL

SEQ ID NO: 1740273 - protein, 23 aa, Staphylococcus epidermidis
AFLLRPIGGIVFGIIGDKYGRKV

SEQ ID NO: 1740274 - protein, 18 aa, Staphylococcus epidermidis
AFLSYAIGGIFHIKFLQE

SEQ ID NO: 1740275 - protein, 18 aa, Staphylococcus epidermidis
AFLSYAIGGVFHIKFFQE

SEQ ID NO: 1740276 - protein, 20 aa, Staphylococcus epidermidis
AFMPILVYLGIDWHSLTTWG

SEQ ID NO: 1740277 - protein, 18 aa, Staphylococcus epidermidis
AFNNWYWIVYVIKDIKND

SEQ ID NO: 1740278 - protein, 30 aa, Staphylococcus epidermidis
AFPNITEIYGFRFSFISLFFLCILSTIVVI

SEQ ID NO: 1740279 - protein, 18 aa, Staphylococcus epidermidis
AFTFKVVIQLGSVFAAAW

SEQ ID NO: 1740280 - protein, 18 aa, Staphylococcus epidermidis
AFTGYSVLQLAKEGKLNL

SEQ ID NO: 1740281 - protein, 18 aa, Staphylococcus epidermidis
AFTYIEALFALFVTTLIL

SEQ ID NO: 1740282 - protein, 24 aa, Staphylococcus epidermidis
AFVVNCLLLTLGAALFFGTKTNDL

SEQ ID NO: 1740283 - protein, 18 aa, Staphylococcus epidermidis
AGAFGIAASGAFAFGAMA

SEQ ID NO: 1740284 - protein, 18 aa, Staphylococcus epidermidis
AGAFGIAASGAFAFGTMA

SEQ ID NO: 1740285 - protein, 27 aa, Staphylococcus epidermidis
AGAHLWRYAVGFGAFIAFVLYILRIKY

SEQ ID NO: 1740286 - protein, 22 aa, Staphylococcus epidermidis
AGASRWKSFNYGQASAIVEPIF

SEQ ID NO: 1740287 - protein, 25 aa, Staphylococcus epidermidis
AGGTRIRPILMTAIATIGALIPLLF

SEQ ID NO: 1740288 - protein, 26 aa, Staphylococcus epidermidis
AGIERKWIDKGCMFIADMLLAIPSFI

SEQ ID NO: 1740289 - protein, 26 aa, Staphylococcus epidermidis
AGIFLLFRFTPLLGLSDAYIYTVTFV

SEQ ID NO: 1740290 - protein, 26 aa, Staphylococcus epidermidis
AGIFLLFRFTPLLGLSNVYIYTVTFI

SEQ ID NO: 1740291 - protein, 19 aa, Staphylococcus epidermidis
AGIRDGYRTAMAGMAGMAV

SEQ ID NO: 1740292 - protein, 18 aa, Staphylococcus epidermidis
AGISYIFSSQITKPIVTM

SEQ ID NO: 1740293 - protein, 21 aa, Staphylococcus epidermidis
AGIYFRNVRRSMLEQLNEDYV

SEQ ID NO: 1740294 - protein, 19 aa, Staphylococcus epidermidis
AGLIIGLLFFEMIPESIEL

SEQ ID NO: 1740295 - protein, 23 aa, Staphylococcus epidermidis
AGLQKTEIVTVILILIILFAVFR

SEQ ID NO: 1740296 - protein, 25 aa, Staphylococcus epidermidis
AGLVHKYYRGDHVEITLPVTDNAGG

SEQ ID NO: 1740297 - protein, 18 aa, Staphylococcus epidermidis
AGMGPFILGMIIPFLGYR

SEQ ID NO: 1740298 - protein, 22 aa, Staphylococcus epidermidis
AGPDLYLSIPWFAASISTVAGA

SEQ ID NO: 1740299 - protein, 29 aa, Staphylococcus epidermidis
AGPMITYLIPLLIAFSGGRLIHGLRGGII

SEQ ID NO: 1740300 - protein, 18 aa, Staphylococcus epidermidis
AGQTFTRNLTDWIKNSGG

SEQ ID NO: 1740301 - protein, 38 aa, Staphylococcus epidermidis
AGQTFTRNLTDWIKNSGGTTFSLSMTASTGGAKNLQQV

SEQ ID NO: 1740302 - protein, 17 aa, Staphylococcus epidermidis
AGVASIRVGGHPQFVRP

SEQ ID NO: 1740303 - protein, 19 aa, Staphylococcus epidermidis
AGVPTEVHVASEFVYNMPL

SEQ ID NO: 1740304 - protein, 19 aa, Staphylococcus epidermidis
AGVTLFKLVPQYMFINQMI

SEQ ID NO: 1740305 - protein, 23 aa, Staphylococcus epidermidis
AGYHFLYTFAFSMIIGELIRATQ

SEQ ID NO: 1740306 - protein, 36 aa, Staphylococcus epidermidis
AGYYKHLENGEGLPIDGWKFYWNQQSTGTTSDQWQS

SEQ ID NO: 1740307 - protein, 20 aa, Staphylococcus epidermidis
AHAGMPMRGFHRHFLIPTII

SEQ ID NO: 1740308 - protein, 19 aa, Staphylococcus epidermidis
AHDAENLIYDVTFEVDDKV

SEQ ID NO: 1740309 - protein, 25 aa, Staphylococcus epidermidis
AHGKHSGVFIYKDLKSIEDTNNAIT

SEQ ID NO: 1740310 - protein, 21 aa, Staphylococcus epidermidis
AHKSILFFIAFAIYIMVFIAL

SEQ ID NO: 1740311 - protein, 19 aa, Staphylococcus epidermidis
AIALFLVVFCWQPVHFYAL

SEQ ID NO: 1740312 - protein, 18 aa, Staphylococcus epidermidis
AIALLFANACNFYILKKY

SEQ ID NO: 1740313 - protein, 18 aa, Staphylococcus epidermidis
AIAPNFGVLMFARVIQAV

SEQ ID NO: 1740314 - protein, 23 aa, Staphylococcus epidermidis
AIATAMLIFRKKFTKEQKGSIVP

SEQ ID NO: 1740315 - protein, 24 aa, Staphylococcus epidermidis
AIEGLKPTLIYPLFSVSITGLLMV

SEQ ID NO: 1740316 - protein, 19 aa, Staphylococcus epidermidis
AIEQELKGIIAVADTVKDT

SEQ ID NO: 1740317 - protein, 17 aa, Staphylococcus epidermidis
AIFFIWAIVLFLTNIVK

SEQ ID NO: 1740318 - protein, 24 aa, Staphylococcus epidermidis
AIFKCLSYTFLSCFIIYLCTMIVN

SEQ ID NO: 1740319 - protein, 25 aa, Staphylococcus epidermidis
AIGIFCIIMVFALLGFLPYNLNPAK

SEQ ID NO: 1740320 - protein, 18 aa, Staphylococcus epidermidis
AIGPLLMVFGVMASTIGT

SEQ ID NO: 1740321 - protein, 18 aa, Staphylococcus epidermidis
AIIALVVYALLPILRNTY

SEQ ID NO: 1740322 - protein, 26 aa, Staphylococcus epidermidis
AIIVILLFLRNIRTTAISVVSIPLSI

SEQ ID NO: 1740323 - protein, 43 aa, Staphylococcus epidermidis
AIIVYFIVCLLISFLALISMNIRILSGFLFLIAAIVTIPLVLL

SEQ ID NO: 1740324 - protein, 44 aa, Staphylococcus epidermidis
AIIVYFIVCLLISFLALISMNIRILSGLLFLIAAIVTIPLVLLI

SEQ ID NO: 1740325 - protein, 19 aa, Staphylococcus epidermidis
AIKDQRFSLNFHYPTLPEI

SEQ ID NO: 1740326 - protein, 18 aa, Staphylococcus epidermidis
AIKEGKIKKDDLILLVGF

SEQ ID NO: 1740327 - protein, 25 aa, Staphylococcus epidermidis
AIKKGWPSMMYEIWNNPEKYYSYFI

SEQ ID NO: 1740328 - protein, 22 aa, Staphylococcus epidermidis
AIKKPEAIAEIQELADKKLNKF

SEQ ID NO: 1740329 - protein, 18 aa, Staphylococcus epidermidis
AILILLLMTMKKYKNVAL

SEQ ID NO: 1740330 - protein, 19 aa, Staphylococcus epidermidis
AILYFEIITTVAIGLGIII

SEQ ID NO: 1740331 - protein, 23 aa, Staphylococcus epidermidis
AILYTRFSGFAFSESELVVQKAS

SEQ ID NO: 1740332 - protein, 21 aa, Staphylococcus epidermidis
AILYTRFSGFSFSESELVVQK

SEQ ID NO: 1740333 - protein, 18 aa, Staphylococcus epidermidis
AIMMFARRNKVETVPAYY

SEQ ID NO: 1740334 - protein, 18 aa, Staphylococcus epidermidis
AIMYYFWQSKALIVLVII

SEQ ID NO: 1740335 - protein, 21 aa, Staphylococcus epidermidis
AINKDIVGWIQLKGTTLNYPV

SEQ ID NO: 1740336 - protein, 24 aa, Staphylococcus epidermidis
AINPSLKHKVLWGLLIGAISVAMT

SEQ ID NO: 1740337 - protein, 23 aa, Staphylococcus epidermidis
AIQNIRFDDMIQLYIDAPEDVQH

SEQ ID NO: 1740338 - protein, 21 aa, Staphylococcus epidermidis
AIQPEVTKAINMLQDKEDNSE

SEQ ID NO: 1740339 - protein, 22 aa, Staphylococcus epidermidis
AISAMRYIVGKWVPIMGSWRSA

SEQ ID NO: 1740340 - protein, 21 aa, Staphylococcus epidermidis
AISIITGVAIFIGGHQAQAAE

SEQ ID NO: 1740341 - protein, 18 aa, Staphylococcus epidermidis
AISPGTLIALIFYMTQLT

SEQ ID NO: 1740342 - protein, 36 aa, Staphylococcus epidermidis
AISRGYRQILKWSLNHKWIVIIVSIVILIGSIGLGA

SEQ ID NO: 1740343 - protein, 20 aa, Staphylococcus epidermidis
AITSLSRINAQVVEKESARN

SEQ ID NO: 1740344 - protein, 20 aa, Staphylococcus epidermidis
AITWNFQTLIGFVFAPFAFL

SEQ ID NO: 1740345 - protein, 23 aa, Staphylococcus epidermidis
AIVALIVGIMFIWKSRRKHKHTK

SEQ ID NO: 1740346 - protein, 17 aa, Staphylococcus epidermidis
AIVGSALGLYYKNKVYK

SEQ ID NO: 1740347 - protein, 24 aa, Staphylococcus epidermidis
AKELNEAMKALKTEIDKKEQIKAD

SEQ ID NO: 1740348 - protein, 21 aa, Staphylococcus epidermidis
AKHMFTAIALYFMFLLQSIFM

SEQ ID NO: 1740349 - protein, 26 aa, Staphylococcus epidermidis
AKISEVHPETSIKRNAKQEIEQVAQS

SEQ ID NO: 1740350 - protein, 26 aa, Staphylococcus epidermidis
AKLFGELEFWLSIIKVITIFALIIIG

SEQ ID NO: 1740351 - protein, 27 aa, Staphylococcus epidermidis
AKLFGELEFWLSIIKVLTILALIAVGV

SEQ ID NO: 1740352 - protein, 17 aa, Staphylococcus epidermidis
AKLTKAKEDAVASINNL

SEQ ID NO: 1740353 - protein, 18 aa, Staphylococcus epidermidis
AKNDGIKIIKGTNYNFND

SEQ ID NO: 1740354 - protein, 18 aa, Staphylococcus epidermidis
AKNDLDYILSPIKDRPSL

SEQ ID NO: 1740355 - protein, 21 aa, Staphylococcus epidermidis
AKNFIIALTLCVTLINENHTY

SEQ ID NO: 1740356 - protein, 23 aa, Staphylococcus epidermidis
AKNKKEAIETILATRLNQEKAKM

SEQ ID NO: 1740357 - protein, 21 aa, Staphylococcus epidermidis
AKSNGIHEIELVTPDAHKKSD

SEQ ID NO: 1740358 - protein, 23 aa, Staphylococcus epidermidis
AKTEAITLLSAVSPVVEAKPSAL

SEQ ID NO: 1740359 - protein, 18 aa, Staphylococcus epidermidis
AKTGTVIINYQIVQENSE

SEQ ID NO: 1740360 - protein, 23 aa, Staphylococcus epidermidis
AKVKMPKKEIAPHSPSLTYDNIK

SEQ ID NO: 1740361 - protein, 24 aa, Staphylococcus epidermidis
AKVTREGLALGVYIILTGSRSSAV

SEQ ID NO: 1740362 - protein, 17 aa, Staphylococcus epidermidis
ALAELRSKESLNNAELS

SEQ ID NO: 1740363 - protein, 25 aa, Staphylococcus epidermidis
ALAPGMGLNAFFAFTVVLTMGIPWK

SEQ ID NO: 1740364 - protein, 23 aa, Staphylococcus epidermidis
ALENSVKKLSDFINEDEAAQNEY

SEQ ID NO: 1740365 - protein, 20 aa, Staphylococcus epidermidis
ALENSVKKLSDFINEDESAQ

SEQ ID NO: 1740366 - protein, 19 aa, Staphylococcus epidermidis
ALFDPAPLYGDREFDLGIT

SEQ ID NO: 1740367 - protein, 18 aa, Staphylococcus epidermidis
ALFLPIFIIYTIVKPADK

SEQ ID NO: 1740368 - protein, 18 aa, Staphylococcus epidermidis
ALFSCLFSLPVYKVLIYN

SEQ ID NO: 1740369 - protein, 18 aa, Staphylococcus epidermidis
ALFSDSLATIVGAIFGTT

SEQ ID NO: 1740370 - protein, 17 aa, Staphylococcus epidermidis
ALFTILFTYKWAYQTTH

SEQ ID NO: 1740371 - protein, 20 aa, Staphylococcus epidermidis
ALGLYWSISAGFLIIQMHFA

SEQ ID NO: 1740372 - protein, 18 aa, Staphylococcus epidermidis
ALIEAGGTRIRPILMTAI

SEQ ID NO: 1740373 - protein, 25 aa, Staphylococcus epidermidis
ALIMFSVFIAFVFQEDSAIKSMGIS

SEQ ID NO: 1740374 - protein, 18 aa, Staphylococcus epidermidis
ALIPLLFGQDSSILISKG

SEQ ID NO: 1740375 - protein, 20 aa, Staphylococcus epidermidis
ALISGLALLAARKSKKDKNA

SEQ ID NO: 1740376 - protein, 21 aa, Staphylococcus epidermidis
ALKEIELEADHVKQMINANLS

SEQ ID NO: 1740377 - protein, 17 aa, Staphylococcus epidermidis
ALKEKIAEARTIINEDN

SEQ ID NO: 1740378 - protein, 20 aa, Staphylococcus epidermidis
ALKKEVRYVKALFIVVTAIL

SEQ ID NO: 1740379 - protein, 25 aa, Staphylococcus epidermidis
ALKKISPKFSLIFLIIIYLTIGPLF

SEQ ID NO: 1740380 - protein, 20 aa, Staphylococcus epidermidis
ALLAEYFIAVAFVASGFSAN

SEQ ID NO: 1740381 - protein, 19 aa, Staphylococcus epidermidis
ALLAIIFDLILRYMEKLSY

SEQ ID NO: 1740382 - protein, 24 aa, Staphylococcus epidermidis
ALLFITQLYFHFSHNITSQREPVL

SEQ ID NO: 1740383 - protein, 19 aa, Staphylococcus epidermidis
ALLIPFIIMVFTAIALVAV

SEQ ID NO: 1740384 - protein, 18 aa, Staphylococcus epidermidis
ALLIPFILMVLTAIALVI

SEQ ID NO: 1740385 - protein, 29 aa, Staphylococcus epidermidis
ALLNGIRRILAVGFDNSFDSISNQTNALS

SEQ ID NO: 1740386 - protein, 18 aa, Staphylococcus epidermidis
ALLVPISGLIFFFESNAF

SEQ ID NO: 1740387 - protein, 17 aa, Staphylococcus epidermidis
ALMIWGFLVIISLMMGQ

SEQ ID NO: 1740388 - protein, 24 aa, Staphylococcus epidermidis
ALMRKLKIPVFPIVARKAKGTHNL

SEQ ID NO: 1740389 - protein, 34 aa, Staphylococcus epidermidis
ALNDAKPKIEAIVPKVRKKRSALDELQASADNQI

SEQ ID NO: 1740390 - protein, 22 aa, Staphylococcus epidermidis
ALNKVMGKLEQFINHADSVENS

SEQ ID NO: 1740391 - protein, 24 aa, Staphylococcus epidermidis
ALNRARSFIGHFYQVGVDMIAGMI

SEQ ID NO: 1740392 - protein, 17 aa, Staphylococcus epidermidis
ALNSIRLDQFFKKGYAL

SEQ ID NO: 1740393 - protein, 21 aa, Staphylococcus epidermidis
ALQNIYLRVYYPPVVIGLTAI

SEQ ID NO: 1740394 - protein, 23 aa, Staphylococcus epidermidis
ALSDRFGRRPVLLASLLGATIDY

SEQ ID NO: 1740395 - protein, 18 aa, Staphylococcus epidermidis
ALSIIGTFIFVRLINLIR

SEQ ID NO: 1740396 - protein, 23 aa, Staphylococcus epidermidis
ALSKGLSKAGTWMNTGEGGLSDY

SEQ ID NO: 1740397 - protein, 19 aa, Staphylococcus epidermidis
ALSLVVFNHINFVTAAIAI

SEQ ID NO: 1740398 - protein, 20 aa, Staphylococcus epidermidis
ALSLVVFNHINFVTAAIAII

SEQ ID NO: 1740399 - protein, 18 aa, Staphylococcus epidermidis
ALSLVVFNSISFVTAAIA

SEQ ID NO: 1740400 - protein, 24 aa, Staphylococcus epidermidis
ALSSYKFASLIIIIMYLFLTISPA

SEQ ID NO: 1740401 - protein, 23 aa, Staphylococcus epidermidis
ALTGICYYSSIKLTNPSIASLGL

SEQ ID NO: 1740402 - protein, 19 aa, Staphylococcus epidermidis
ALVIQRFTTRQVFLTGILI

SEQ ID NO: 1740403 - protein, 19 aa, Staphylococcus epidermidis
ALVLLVFAIKAIHVNPVKS

SEQ ID NO: 1740404 - protein, 18 aa, Staphylococcus epidermidis
ALVPLLFGQDSSILISKG

SEQ ID NO: 1740405 - protein, 19 aa, Staphylococcus epidermidis
ALVSFVWFSVFGVLGIETG

SEQ ID NO: 1740406 - protein, 24 aa, Staphylococcus epidermidis
ALYGMAIVVGGIYPAKSGWNELRG

SEQ ID NO: 1740407 - protein, 17 aa, Staphylococcus epidermidis
AMFLRRYQWKKEGIRTK

SEQ ID NO: 1740408 - protein, 24 aa, Staphylococcus epidermidis
AMGASPFQIIRYFLLPEALGSLIL

SEQ ID NO: 1740409 - protein, 17 aa, Staphylococcus epidermidis
AMGELRHSIANKDQVKS

SEQ ID NO: 1740410 - protein, 18 aa, Staphylococcus epidermidis
AMIIKGFVDFGGHSSNYG

SEQ ID NO: 1740411 - protein, 17 aa, Staphylococcus epidermidis
AMISCLILTYIFNPTFV

SEQ ID NO: 1740412 - protein, 17 aa, Staphylococcus epidermidis
AMLIPSMGYIVGLILGL

SEQ ID NO: 1740413 - protein, 17 aa, Staphylococcus epidermidis
AMLLLAGIMMLLGAVSV

SEQ ID NO: 1740414 - protein, 26 aa, Staphylococcus epidermidis
AMSGYIVCVYGIFAFLIPATIILFNN

SEQ ID NO: 1740415 - protein, 23 aa, Staphylococcus epidermidis
AMVIGILCLMISHWFKSKDNTHA

SEQ ID NO: 1740416 - protein, 17 aa, Staphylococcus epidermidis
ANDWFKKYGAWAVFLCR

SEQ ID NO: 1740417 - protein, 17 aa, Staphylococcus epidermidis
ANEGYHFTVYVPYGDDW

SEQ ID NO: 1740418 - protein, 19 aa, Staphylococcus epidermidis
ANEQISGVTINPEFGQVVI

SEQ ID NO: 1740419 - protein, 17 aa, Staphylococcus epidermidis
ANFSIRQVIYYIFGAIM

SEQ ID NO: 1740420 - protein, 17 aa, Staphylococcus epidermidis
ANGYLKNLNIEAGNIIF

SEQ ID NO: 1740421 - protein, 26 aa, Staphylococcus epidermidis
ANHDTRLSSFYGIIIFSVVVFLFISI

SEQ ID NO: 1740422 - protein, 29 aa, Staphylococcus epidermidis
ANIFIIMICCVLLGSLLGFLFYNFHPAKI

SEQ ID NO: 1740423 - protein, 19 aa, Staphylococcus epidermidis
ANKDYLLYWMQLGQGNLDE

SEQ ID NO: 1740424 - protein, 19 aa, Staphylococcus epidermidis
ANKEGTAWRLDKQEEGITI

SEQ ID NO: 1740425 - protein, 29 aa, Staphylococcus epidermidis
ANKELKLIMTLGFILGGIIGFFQGVIAIF

SEQ ID NO: 1740426 - protein, 18 aa, Staphylococcus epidermidis
ANLTRANRNFRFFQIFTA

SEQ ID NO: 1740427 - protein, 24 aa, Staphylococcus epidermidis
ANSEFQMVQFIPLVVIPQVFFSGI

SEQ ID NO: 1740428 - protein, 18 aa, Staphylococcus epidermidis
ANSKLKERIDFNTDNATD

SEQ ID NO: 1740429 - protein, 19 aa, Staphylococcus epidermidis
ANSSWQLSFTVNRQQQFKK

SEQ ID NO: 1740430 - protein, 18 aa, Staphylococcus epidermidis
ANVAFPLLGHVHVTTVTL

SEQ ID NO: 1740431 - protein, 25 aa, Staphylococcus epidermidis
ANVSHELRTPISLLQGYTESIVDGV

SEQ ID NO: 1740432 - protein, 22 aa, Staphylococcus epidermidis
ANYMTCILLTFIGALIISLYGY

SEQ ID NO: 1740433 - protein, 22 aa, Staphylococcus epidermidis
APAIIKTRFPVYMGTMMGLYTV

SEQ ID NO: 1740434 - protein, 18 aa, Staphylococcus epidermidis
APEHPIKLILPIITLVGG

SEQ ID NO: 1740435 - protein, 22 aa, Staphylococcus epidermidis
APFIPMFYIIFGLKTRDESKDQ

SEQ ID NO: 1740436 - protein, 17 aa, Staphylococcus epidermidis
APFKLVSLTAISSIMVN

SEQ ID NO: 1740437 - protein, 24 aa, Staphylococcus epidermidis
APLGLKLGKKVPSFVQKWIISILI

SEQ ID NO: 1740438 - protein, 28 aa, Staphylococcus epidermidis
APPNLKDRFQLFLNRHVLRVISVTLCAA

SEQ ID NO: 1740439 - protein, 18 aa, Staphylococcus epidermidis
APVGAIISFIGVPYFLYL

SEQ ID NO: 1740440 - protein, 19 aa, Staphylococcus epidermidis
APWLGRNALNWIVTMSSTG

SEQ ID NO: 1740441 - protein, 22 aa, Staphylococcus epidermidis
AQATFVTVFAIFFVISLVADLL

SEQ ID NO: 1740442 - protein, 20 aa, Staphylococcus epidermidis
AQGAINFTFLDGKRPTYTNA

SEQ ID NO: 1740443 - protein, 25 aa, Staphylococcus epidermidis
AQINIWRVLVVTGLRGQEVSNKVVP

SEQ ID NO: 1740444 - protein, 17 aa, Staphylococcus epidermidis
AQISLYIGVVAALLDIC

SEQ ID NO: 1740445 - protein, 30 aa, Staphylococcus epidermidis
AQKAAIINQIRASKDIKIINQIVDNAIELN

SEQ ID NO: 1740446 - protein, 18 aa, Staphylococcus epidermidis
AQKAAIINQIRASKDIKM

SEQ ID NO: 1740447 - protein, 19 aa, Staphylococcus epidermidis
AQLTEALLAEPTIKKGKKK

SEQ ID NO: 1740448 - protein, 20 aa, Staphylococcus epidermidis
AQQSPFSLNVIMNKDNLEEQ

SEQ ID NO: 1740449 - protein, 23 aa, Staphylococcus epidermidis
AQRSAYVWPHFSILLANILISIS

SEQ ID NO: 1740450 - protein, 17 aa, Staphylococcus epidermidis
AQSLVFYTIINWLPELL

SEQ ID NO: 1740451 - protein, 25 aa, Staphylococcus epidermidis
AQTKLKRIPTLITESKQNSNNSHIQ

SEQ ID NO: 1740452 - protein, 20 aa, Staphylococcus epidermidis
ARDNGTRLIATDIPNPTKKA

SEQ ID NO: 1740453 - protein, 32 aa, Staphylococcus epidermidis
ARKRGKQGTGLGLFICKMIIEAHGGRIDVESE

SEQ ID NO: 1740454 - protein, 21 aa, Staphylococcus epidermidis
ARLLLRTSAGFWILDEPTTAL

SEQ ID NO: 1740455 - protein, 28 aa, Staphylococcus epidermidis
ARLMSMLIYLLGLFTSFIAPLVIWLVKR

SEQ ID NO: 1740456 - protein, 17 aa, Staphylococcus epidermidis
ARLTFNLNNGKATSYKQ

SEQ ID NO: 1740457 - protein, 21 aa, Staphylococcus epidermidis
ARMTPIFAISEGWVWTITLVG

SEQ ID NO: 1740458 - protein, 18 aa, Staphylococcus epidermidis
ARNFIKTPGILLLDEATS

SEQ ID NO: 1740459 - protein, 17 aa, Staphylococcus epidermidis
ASAESRITMPRKEATPI

SEQ ID NO: 1740460 - protein, 18 aa, Staphylococcus epidermidis
ASAICFFIVPILFIPKTH

SEQ ID NO: 1740461 - protein, 19 aa, Staphylococcus epidermidis
ASAIDKLIKTAARIAESID

SEQ ID NO: 1740462 - protein, 21 aa, Staphylococcus epidermidis
ASALSKVKMPRKESTPEAPTV

SEQ ID NO: 1740463 - protein, 24 aa, Staphylococcus epidermidis
ASASTWNGLAWIVGAALYLVCLPA

SEQ ID NO: 1740464 - protein, 17 aa, Staphylococcus epidermidis
ASEWAKVKMPKKELAPH

SEQ ID NO: 1740465 - protein, 18 aa, Staphylococcus epidermidis
ASGAIFGLIGSIFVIMYL

SEQ ID NO: 1740466 - protein, 25 aa, Staphylococcus epidermidis
ASGHYQFKGLENGSYTVEFETPSGY

SEQ ID NO: 1740467 - protein, 23 aa, Staphylococcus epidermidis
ASGRKTLPILLGKRASVIFMAMM

SEQ ID NO: 1740468 - protein, 19 aa, Staphylococcus epidermidis
ASHAWLFASATLFLSLLPF

SEQ ID NO: 1740469 - protein, 25 aa, Staphylococcus epidermidis
ASIICIPFAFLGARNMVKLRPVTGT

SEQ ID NO: 1740470 - protein, 20 aa, Staphylococcus epidermidis
ASIIGCIKRSQSLAGAINTI

SEQ ID NO: 1740471 - protein, 19 aa, Staphylococcus epidermidis
ASILIATKEGSTWTLDKQE

SEQ ID NO: 1740472 - protein, 21 aa, Staphylococcus epidermidis
ASISVSLRVPVVKKIELEPIS

SEQ ID NO: 1740473 - protein, 24 aa, Staphylococcus epidermidis
ASKIAKKLAHSHLSNAQIVNQLKR

SEQ ID NO: 1740474 - protein, 17 aa, Staphylococcus epidermidis
ASKRLLTSIGIGIITSI

SEQ ID NO: 1740475 - protein, 17 aa, Staphylococcus epidermidis
ASLFIKIKYAFLPEIPK

SEQ ID NO: 1740476 - protein, 19 aa, Staphylococcus epidermidis
ASLNYRNADYNLKRQFNKA

SEQ ID NO: 1740477 - protein, 19 aa, Staphylococcus epidermidis
ASLSLGILSIFIILIPVVI

SEQ ID NO: 1740478 - protein, 43 aa, Staphylococcus epidermidis
ASNQIKAILPDVITKSNARDVLKSLANQLIRTFEHTPDVTDEE

SEQ ID NO: 1740479 - protein, 21 aa, Staphylococcus epidermidis
ASPLQIIRYFLLPEALGSLIL

SEQ ID NO: 1740480 - protein, 18 aa, Staphylococcus epidermidis
ASPVMHHVFWISFVAIFV

SEQ ID NO: 1740481 - protein, 22 aa, Staphylococcus epidermidis
ASQEIKVKMPRKESTPQAPTIS

SEQ ID NO: 1740482 - protein, 24 aa, Staphylococcus epidermidis
ASSEFQMIQFIPLVIVPQVLFAGI

SEQ ID NO: 1740483 - protein, 24 aa, Staphylococcus epidermidis
ASSIVIGGIIFLSGHEDVSAAEQH

SEQ ID NO: 1740484 - protein, 17 aa, Staphylococcus epidermidis
ASTGGAKNLQQVQFGTF

SEQ ID NO: 1740485 - protein, 26 aa, Staphylococcus epidermidis
ASTRGYHGIYKGMTRKEVEDKFGKSN

SEQ ID NO: 1740486 - protein, 21 aa, Staphylococcus epidermidis
ASTSMSVSDSNSASISLSEST

SEQ ID NO: 1740487 - protein, 25 aa, Staphylococcus epidermidis
ASTSMSVSDSNSASISLSESTSTSV

SEQ ID NO: 1740488 - protein, 19 aa, Staphylococcus epidermidis
ASYHNYRMIDRDRADTTEY

SEQ ID NO: 1740489 - protein, 24 aa, Staphylococcus epidermidis
ATELNHAMEALRNSVQNVGQVKQS

SEQ ID NO: 1740490 - protein, 20 aa, Staphylococcus epidermidis
ATFLPQAFLSYAIGGIFHIK

SEQ ID NO: 1740491 - protein, 27 aa, Staphylococcus epidermidis
ATIRNIRQNLFWAFGYNVAGIPIAALG

SEQ ID NO: 1740492 - protein, 18 aa, Staphylococcus epidermidis
ATKEDASWDEMKDKAVDI

SEQ ID NO: 1740493 - protein, 27 aa, Staphylococcus epidermidis
ATKEEQNWILDKEVPGITLDTNTGEVS

SEQ ID NO: 1740494 - protein, 19 aa, Staphylococcus epidermidis
ATKGLGLAIRFMTGPVGIV

SEQ ID NO: 1740495 - protein, 23 aa, Staphylococcus epidermidis
ATKIGEVWAMVALSLLLVAYLML

SEQ ID NO: 1740496 - protein, 24 aa, Staphylococcus epidermidis
ATKIKEDARVAVEAKAIAQNQQIN

SEQ ID NO: 1740497 - protein, 18 aa, Staphylococcus epidermidis
ATLAIALHIIVCLTATLI

SEQ ID NO: 1740498 - protein, 18 aa, Staphylococcus epidermidis
ATLSWMFVGLGAIPSTLI

SEQ ID NO: 1740499 - protein, 23 aa, Staphylococcus epidermidis
ATMPGSLPTMFYTHIRYRTLSVT

SEQ ID NO: 1740500 - protein, 32 aa, Staphylococcus epidermidis
ATNEEKQIFVSKLKALINRAHKQIDEAETFVS

SEQ ID NO: 1740501 - protein, 21 aa, Staphylococcus epidermidis
ATRYWRLIALLPITISSIVVG

SEQ ID NO: 1740502 - protein, 26 aa, Staphylococcus epidermidis
ATSVKRSEIVFGYLAGYGMFAVLQTL

SEQ ID NO: 1740503 - protein, 27 aa, Staphylococcus epidermidis
ATTSFILAFPMAIIWPYIQTGLNSFSE

SEQ ID NO: 1740504 - protein, 20 aa, Staphylococcus epidermidis
ATWGFVLSWLPLHSKYLVVS

SEQ ID NO: 1740505 - protein, 19 aa, Staphylococcus epidermidis
ATWGFVLSWLPLYSKYLIV

SEQ ID NO: 1740506 - protein, 19 aa, Staphylococcus epidermidis
ATYLPQAFLSYAIGGVFHI

SEQ ID NO: 1740507 - protein, 18 aa, Staphylococcus epidermidis
AVALNIIMSQSLRTATAD

SEQ ID NO: 1740508 - protein, 35 aa, Staphylococcus epidermidis
AVFMRPDIGKTFSEFRIFLAVLITLLLIISISLVI

SEQ ID NO: 1740509 - protein, 25 aa, Staphylococcus epidermidis
AVFNYWWMFALSFVFFLIAGALTIF

SEQ ID NO: 1740510 - protein, 25 aa, Staphylococcus epidermidis
AVFTAEFYASFAFAILISILIDIGA

SEQ ID NO: 1740511 - protein, 25 aa, Staphylococcus epidermidis
AVFTAQFYASFAFAILISIIIDIGA

SEQ ID NO: 1740512 - protein, 17 aa, Staphylococcus epidermidis
AVGEALLKFISNPIAVI

SEQ ID NO: 1740513 - protein, 21 aa, Staphylococcus epidermidis
AVGVFIPFTLAQFGMVLKWTK

SEQ ID NO: 1740514 - protein, 21 aa, Staphylococcus epidermidis
AVIIIALIALFLILKSQLSPE

SEQ ID NO: 1740515 - protein, 23 aa, Staphylococcus epidermidis
AVIIRNATDFIGWDIVDLKMSEQ

SEQ ID NO: 1740516 - protein, 18 aa, Staphylococcus epidermidis
AVILMVLIPIVFVIPNVF

SEQ ID NO: 1740517 - protein, 24 aa, Staphylococcus epidermidis
AVITCVFVPIIFKKMFPIPNEVNR

SEQ ID NO: 1740518 - protein, 24 aa, Staphylococcus epidermidis
AVLSIPVWIGVLFLMYQKYKKESR

SEQ ID NO: 1740519 - protein, 21 aa, Staphylococcus epidermidis
AVLVVGCPCALVISTPISIVS

SEQ ID NO: 1740520 - protein, 22 aa, Staphylococcus epidermidis
AVNALIPWGVSGTFIMGALKVS

SEQ ID NO: 1740521 - protein, 42 aa, Staphylococcus epidermidis
AVNQYWPEHMDFRWAQGSGTPSSRNAGSFTKTVTVVYQNGQT

SEQ ID NO: 1740522 - protein, 19 aa, Staphylococcus epidermidis
AVPFSGWLMNQFNGKKVFI

SEQ ID NO: 1740523 - protein, 18 aa, Staphylococcus epidermidis
AVPLGVRGKDDILNLNLH

SEQ ID NO: 1740524 - protein, 20 aa, Staphylococcus epidermidis
AVSGSDYWNVTSFTYTLTLY

SEQ ID NO: 1740525 - protein, 18 aa, Staphylococcus epidermidis
AVTQEAFGYIGLGVLAIA

SEQ ID NO: 1740526 - protein, 19 aa, Staphylococcus epidermidis
AVVGLRLALRKKLKHQSFN

SEQ ID NO: 1740527 - protein, 18 aa, Staphylococcus epidermidis
AWALLPLLLFVLLFLGVG

SEQ ID NO: 1740528 - protein, 17 aa, Staphylococcus epidermidis
AWANWVSLVTIIPIEAV

SEQ ID NO: 1740529 - protein, 25 aa, Staphylococcus epidermidis
AWGIGGLIGSFGIGFVIDKFKNTRF

SEQ ID NO: 1740530 - protein, 17 aa, Staphylococcus epidermidis
AWPTGIFLLLLIIVSCT

SEQ ID NO: 1740531 - protein, 19 aa, Staphylococcus epidermidis
AWSQLKRNKLAVIGMIGLL

SEQ ID NO: 1740532 - protein, 17 aa, Staphylococcus epidermidis
AWSYLSLLMVQGINIIL

SEQ ID NO: 1740533 - protein, 25 aa, Staphylococcus epidermidis
AYESFKQKRFNVFVDGGYMLDNVKI

SEQ ID NO: 1740534 - protein, 17 aa, Staphylococcus epidermidis
AYEVLKRMSRYQNDLYQ

SEQ ID NO: 1740535 - protein, 20 aa, Staphylococcus epidermidis
AYGKVWLFFMYYWIIFGIGC

SEQ ID NO: 1740536 - protein, 19 aa, Staphylococcus epidermidis
AYIYFMKGVLGFHFDHPNR

SEQ ID NO: 1740537 - protein, 20 aa, Staphylococcus epidermidis
AYIYLTLVAFNFISGVLTLP

SEQ ID NO: 1740538 - protein, 27 aa, Staphylococcus epidermidis
AYLGELIRWLLVFGFIFQLPILFMGLA

SEQ ID NO: 1740539 - protein, 25 aa, Staphylococcus epidermidis
AYVPFELCLLLKLFKPVKAFEWPLF

SEQ ID NO: 1740540 - protein, 26 aa, Staphylococcus epidermidis
CEIGGGYLIWLWLREGHSYWLGLLGG

SEQ ID NO: 1740541 - protein, 20 aa, Staphylococcus epidermidis
CFKLCKKKSTFIIPIIIILL

SEQ ID NO: 1740542 - protein, 17 aa, Staphylococcus epidermidis
CFKLFKKKSTFIIPIVI

SEQ ID NO: 1740543 - protein, 22 aa, Staphylococcus epidermidis
CIGENIKSMAPLIYELNQELQN

SEQ ID NO: 1740544 - protein, 17 aa, Staphylococcus epidermidis
CILVFKYKKEQLAGLKF

SEQ ID NO: 1740545 - protein, 17 aa, Staphylococcus epidermidis
CIPIHFEVIVSQKEGKA

SEQ ID NO: 1740546 - protein, 17 aa, Staphylococcus epidermidis
CLCRLNVVISLFISALV

SEQ ID NO: 1740547 - protein, 20 aa, Staphylococcus epidermidis
CLFATIPGIVLWNRSVQSFG

SEQ ID NO: 1740548 - protein, 19 aa, Staphylococcus epidermidis
CLILTYIFNPTFVVLLSAF

SEQ ID NO: 1740549 - protein, 19 aa, Staphylococcus epidermidis
CNGIIPSIHIVQLLIYVPF

SEQ ID NO: 1740550 - protein, 21 aa, Staphylococcus epidermidis
CNKIYCFIDEIFKRTNTTERI

SEQ ID NO: 1740551 - protein, 21 aa, Staphylococcus epidermidis
CPLEGAIVVPLYIHNEIAGTL

SEQ ID NO: 1740552 - protein, 24 aa, Staphylococcus epidermidis
CQGSAAFGAWYVYKRRKMAKEQGL

SEQ ID NO: 1740553 - protein, 19 aa, Staphylococcus epidermidis
CRQVCKFQPERIILLGHGE

SEQ ID NO: 1740554 - protein, 26 aa, Staphylococcus epidermidis
CRVKGEFKFDKEFLLLNISTVQFKSC

SEQ ID NO: 1740555 - protein, 31 aa, Staphylococcus epidermidis
CSTTLLNLFHGWPWYAVWLVLLGFGGGMIVP

SEQ ID NO: 1740556 - protein, 17 aa, Staphylococcus epidermidis
CVKYMSGKTYKIPFTIP

SEQ ID NO: 1740557 - protein, 19 aa, Staphylococcus epidermidis
CYLIYLGIQSIRSAHSSVN

SEQ ID NO: 1740558 - protein, 36 aa, Staphylococcus epidermidis
DADNKTIDSGFYKPTYNLGDYVWEDTNKDGIQDDSE

SEQ ID NO: 1740559 - protein, 25 aa, Staphylococcus epidermidis
DAFYAQPSFWFGVFRYLTEGATIIL

SEQ ID NO: 1740560 - protein, 26 aa, Staphylococcus epidermidis
DAGVKGAVIGSIWLIVSIIPITIILG

SEQ ID NO: 1740561 - protein, 20 aa, Staphylococcus epidermidis
DAIKEIKFVVKNHEEDIEEV

SEQ ID NO: 1740562 - protein, 26 aa, Staphylococcus epidermidis
DAINHVKEQLSLVFNAIEKDQKDIQV

SEQ ID NO: 1740563 - protein, 20 aa, Staphylococcus epidermidis
DAISHVKEQLNAVLGAIDKD

SEQ ID NO: 1740564 - protein, 39 aa, Staphylococcus epidermidis
DAKAKADPRNVGGGGAFGAFVSTDRNGMATTEESTAAKL

SEQ ID NO: 1740565 - protein, 21 aa, Staphylococcus epidermidis
DAKNEAERILGNDNPQVSQVT

SEQ ID NO: 1740566 - protein, 17 aa, Staphylococcus epidermidis
DALAKLSGILMDENVRE

SEQ ID NO: 1740567 - protein, 26 aa, Staphylococcus epidermidis
DALAPMLYKAAKWITSLANKFSNLPT

SEQ ID NO: 1740568 - protein, 17 aa, Staphylococcus epidermidis
DALIPPFIIQILVENSI

SEQ ID NO: 1740569 - protein, 21 aa, Staphylococcus epidermidis
DALMKAFQIDAPVNPGNSGGA

SEQ ID NO: 1740570 - protein, 23 aa, Staphylococcus epidermidis
DALQLRFILDWNSQAHRPQFEYD

SEQ ID NO: 1740571 - protein, 17 aa, Staphylococcus epidermidis
DALSTEWVFLIFAVIGV

SEQ ID NO: 1740572 - protein, 39 aa, Staphylococcus epidermidis
DDDSGFPPGTFFHASNRRWPYNLPRSRNILRASDVQGNA

SEQ ID NO: 1740573 - protein, 18 aa, Staphylococcus epidermidis
DDKDRKGVKKEKGNDKDY

SEQ ID NO: 1740574 - protein, 20 aa, Staphylococcus epidermidis
DDKFCINCGHFLQQTLSNAN

SEQ ID NO: 1740575 - protein, 23 aa, Staphylococcus epidermidis
DDKFCVNCGQSVFDNPKTKTEHF

SEQ ID NO: 1740576 - protein, 23 aa, Staphylococcus epidermidis
DDKFCVNCGQSVFNNPKTKTEHN

SEQ ID NO: 1740577 - protein, 18 aa, Staphylococcus epidermidis
DDKGTWIINSKMIVEPKG

SEQ ID NO: 1740578 - protein, 47 aa, Staphylococcus epidermidis
DDSFIDRIIDDFGKAVGFITLTGLLYGFWLVFAKRRKNEEEEEKLRD

SEQ ID NO: 1740579 - protein, 39 aa, Staphylococcus epidermidis
DDSIKEGDTFTIKYGQYIRPGGLELPAIKTQLRSKDGSI

SEQ ID NO: 1740580 - protein, 23 aa, Staphylococcus epidermidis
DDVFFKRAIELSDDYIQSNQTLV

SEQ ID NO: 1740581 - protein, 18 aa, Staphylococcus epidermidis
DEAKKLLNNESASATGAI

SEQ ID NO: 1740582 - protein, 19 aa, Staphylococcus epidermidis
DEDRFLALYRNYEKGKLLF

SEQ ID NO: 1740583 - protein, 23 aa, Staphylococcus epidermidis
DEEKEVANNLVIARKQNALDNIN

SEQ ID NO: 1740584 - protein, 17 aa, Staphylococcus epidermidis
DEFKFTTFFSGFLIGLI

SEQ ID NO: 1740585 - protein, 17 aa, Staphylococcus epidermidis
DEFQFYGIMTIRDAFLV

SEQ ID NO: 1740586 - protein, 24 aa, Staphylococcus epidermidis
DEHGKIKPHHLLKLSMKRQQYVLK

SEQ ID NO: 1740587 - protein, 17 aa, Staphylococcus epidermidis
DEKRKNLEKNLEMSKGH

SEQ ID NO: 1740588 - protein, 18 aa, Staphylococcus epidermidis
DENNHVFTNLSFTIPKNK

SEQ ID NO: 1740589 - protein, 22 aa, Staphylococcus epidermidis
DEQSLEMFLNIILKESNRIESL

SEQ ID NO: 1740590 - protein, 17 aa, Staphylococcus epidermidis
DESDWIYNGGFYLISAM

SEQ ID NO: 1740591 - protein, 25 aa, Staphylococcus epidermidis
DEVIQWFKEEHDWFNESLKDETNNT

SEQ ID NO: 1740592 - protein, 18 aa, Staphylococcus epidermidis
DEVKSYLDLIEYGNEEIS

SEQ ID NO: 1740593 - protein, 20 aa, Staphylococcus epidermidis
DFKAYARNAVTEFRNSEKLL

SEQ ID NO: 1740594 - protein, 20 aa, Staphylococcus epidermidis
DFLLRYKSLIITAFNQKVNF

SEQ ID NO: 1740595 - protein, 17 aa, Staphylococcus epidermidis
DFVAVRFGNVLGSRGSV

SEQ ID NO: 1740596 - protein, 23 aa, Staphylococcus epidermidis
DFWYPEMPNWITAAATILILVAL

SEQ ID NO: 1740597 - protein, 17 aa, Staphylococcus epidermidis
DGGDLVVEGMVLNINRN

SEQ ID NO: 1740598 - protein, 27 aa, Staphylococcus epidermidis
DGIAKLDAIEITARKKALANTYLQGLS

SEQ ID NO: 1740599 - protein, 20 aa, Staphylococcus epidermidis
DGIIKAHDAENLIYDVTFEV

SEQ ID NO: 1740600 - protein, 26 aa, Staphylococcus epidermidis
DGIVMKSAYNWAFFNPIRKIYYNITI

SEQ ID NO: 1740601 - protein, 21 aa, Staphylococcus epidermidis
DGLWHPLYMVNMLMLLTMASM

SEQ ID NO: 1740602 - protein, 17 aa, Staphylococcus epidermidis
DGLYWRIGACIIGAIFV

SEQ ID NO: 1740603 - protein, 19 aa, Staphylococcus epidermidis
DGPGGLIIMKDFNDKPASS

SEQ ID NO: 1740604 - protein, 20 aa, Staphylococcus epidermidis
DGSLPQLVFLIAVPNDSNDT

SEQ ID NO: 1740605 - protein, 25 aa, Staphylococcus epidermidis
DGTIRDEVWLNKKLNYISKKTYQGI

SEQ ID NO: 1740606 - protein, 20 aa, Staphylococcus epidermidis
DGTRKVVVAKGTINNADNMT

SEQ ID NO: 1740607 - protein, 19 aa, Staphylococcus epidermidis
DGYRTAMAGMAGMAVAGKA

SEQ ID NO: 1740608 - protein, 32 aa, Staphylococcus epidermidis
DHDSKGTLLGALFAGLGALLLGKRRKNRKNKN

SEQ ID NO: 1740609 - protein, 32 aa, Staphylococcus epidermidis
DHDSKGTLLGALFAGLGALLLGRRRKKDNKEK

SEQ ID NO: 1740610 - protein, 32 aa, Staphylococcus epidermidis
DHDSKGTLLGTLFAGLGALLLGRRRKKDNKEK

SEQ ID NO: 1740611 - protein, 41 aa, Staphylococcus epidermidis
DHFDHIINVIISFFKKHWPKLLIIIGIILLLLILNAIFTTV

SEQ ID NO: 1740612 - protein, 20 aa, Staphylococcus epidermidis
DHIQFLKVRLGMQVVAINIE

SEQ ID NO: 1740613 - protein, 17 aa, Staphylococcus epidermidis
DHLRLNATILDVKPYPS

SEQ ID NO: 1740614 - protein, 22 aa, Staphylococcus epidermidis
DICHTKSKIGRRFKILSFIIRL

SEQ ID NO: 1740615 - protein, 26 aa, Staphylococcus epidermidis
DIDIKAADKKIKIQRINDATDEEIQE

SEQ ID NO: 1740616 - protein, 17 aa, Staphylococcus epidermidis
DIFKLTYQFGLIILSVL

SEQ ID NO: 1740617 - protein, 20 aa, Staphylococcus epidermidis
DIIEACRLAHALDFIQKLPD

SEQ ID NO: 1740618 - protein, 27 aa, Staphylococcus epidermidis
DIKGYELYIVLAIFIILDIILALITAY

SEQ ID NO: 1740619 - protein, 19 aa, Staphylococcus epidermidis
DIKKQAVQFYVRRQNDKEP

SEQ ID NO: 1740620 - protein, 20 aa, Staphylococcus epidermidis
DILIISAIVLLLSHHVFAYL

SEQ ID NO: 1740621 - protein, 23 aa, Staphylococcus epidermidis
DILTGICVALLFTKYFVNYANDM

SEQ ID NO: 1740622 - protein, 24 aa, Staphylococcus epidermidis
DINNKKPRSISAYNKAIKSLETQI

SEQ ID NO: 1740623 - protein, 24 aa, Staphylococcus epidermidis
DIRGNLLLFLSIFCLLISLTSWSY

SEQ ID NO: 1740624 - protein, 18 aa, Staphylococcus epidermidis
DISPNMLIQRLKAGKVYK

SEQ ID NO: 1740625 - protein, 27 aa, Staphylococcus epidermidis
DITKVVLMILMFIGRVGLISFIIMLAG

SEQ ID NO: 1740626 - protein, 20 aa, Staphylococcus epidermidis
DIVNRWQKFYILVVATVLSV

SEQ ID NO: 1740627 - protein, 23 aa, Staphylococcus epidermidis
DIYKNKGIDVLNIYGDVQDGTHS

SEQ ID NO: 1740628 - protein, 26 aa, Staphylococcus epidermidis
DIYSLFRKQSFRGNEYLNSLQKGTSY

SEQ ID NO: 1740629 - protein, 19 aa, Staphylococcus epidermidis
DIYWCTADPGWVTGTSYGV

SEQ ID NO: 1740630 - protein, 22 aa, Staphylococcus epidermidis
DKERDLRNKVLDYKEQAENTVN

SEQ ID NO: 1740631 - protein, 17 aa, Staphylococcus epidermidis
DKGESFKKIDRKGKWIE

SEQ ID NO: 1740632 - protein, 17 aa, Staphylococcus epidermidis
DKGFKIGDILSLSQSDE

SEQ ID NO: 1740633 - protein, 18 aa, Staphylococcus epidermidis
DKGTWILNSDMAIQENRG

SEQ ID NO: 1740634 - protein, 18 aa, Staphylococcus epidermidis
DKIDDLKKIKGFGEKTFE

SEQ ID NO: 1740635 - protein, 22 aa, Staphylococcus epidermidis
DKIINLMLFDVSWIDTKLNPKY

SEQ ID NO: 1740636 - protein, 24 aa, Staphylococcus epidermidis
DKLGRRRLVMLIAVVFIIGALTLA

SEQ ID NO: 1740637 - protein, 27 aa, Staphylococcus epidermidis
DKMIFKKLPNIFKFGKKKMDIKDYNSQ

SEQ ID NO: 1740638 - protein, 18 aa, Staphylococcus epidermidis
DKNGKLLIFVNKLSSIII

SEQ ID NO: 1740639 - protein, 20 aa, Staphylococcus epidermidis
DKNLIKWVPNDISNIYGKTY

SEQ ID NO: 1740640 - protein, 35 aa, Staphylococcus epidermidis
DKQKRNIFPYILLSIGVLLTLGFVIFSIRRGRRSK

SEQ ID NO: 1740641 - protein, 17 aa, Staphylococcus epidermidis
DKQVEWIFDVVRIVLPL

SEQ ID NO: 1740642 - protein, 31 aa, Staphylococcus epidermidis
DKSEEVKVLMPIKEFTPLAPLLETNYKKATV

SEQ ID NO: 1740643 - protein, 17 aa, Staphylococcus epidermidis
DKSVPLAGVTLISGLAI

SEQ ID NO: 1740644 - protein, 19 aa, Staphylococcus epidermidis
DKWSDIAVVKAKISDDSIK

SEQ ID NO: 1740645 - protein, 24 aa, Staphylococcus epidermidis
DKWSRAYIGDHVFINGIWFEVQSD

SEQ ID NO: 1740646 - protein, 26 aa, Staphylococcus epidermidis
DLAKSSAPFGLAFSHMFNPTIGNIVI

SEQ ID NO: 1740647 - protein, 25 aa, Staphylococcus epidermidis
DLAPLIASIVCILVFKYKKEQLAGL

SEQ ID NO: 1740648 - protein, 25 aa, Staphylococcus epidermidis
DLDVLSRFDKIVVMLDGEMKEIGSY

SEQ ID NO: 1740649 - protein, 25 aa, Staphylococcus epidermidis
DLEIWEIAVSMGISIIVVALLLWIA

SEQ ID NO: 1740650 - protein, 26 aa, Staphylococcus epidermidis
DLEQNWCSYLFPMLNWFIPIKYTKLT

SEQ ID NO: 1740651 - protein, 17 aa, Staphylococcus epidermidis
DLEQVLNIQPIHFPEKG

SEQ ID NO: 1740652 - protein, 31 aa, Staphylococcus epidermidis
DLFATPRFVLPMLIQGVSFILLFTYISASPF

SEQ ID NO: 1740653 - protein, 17 aa, Staphylococcus epidermidis
DLFKTTLLTILHQLSVI

SEQ ID NO: 1740654 - protein, 19 aa, Staphylococcus epidermidis
DLFSEILFFINIILALYYI

SEQ ID NO: 1740655 - protein, 21 aa, Staphylococcus epidermidis
DLGPRIAHAILPIAGKGHSNW

SEQ ID NO: 1740656 - protein, 24 aa, Staphylococcus epidermidis
DLIKERLPNTILLGAMSLIITYII

SEQ ID NO: 1740657 - protein, 19 aa, Staphylococcus epidermidis
DLIRFLFNYEHLVMVSPIV

SEQ ID NO: 1740658 - protein, 17 aa, Staphylococcus epidermidis
DLIRYGQPKDHGDYYEV

SEQ ID NO: 1740659 - protein, 27 aa, Staphylococcus epidermidis
DLISKKTKIGMRYTFKESIGNKTVYIS

SEQ ID NO: 1740660 - protein, 18 aa, Staphylococcus epidermidis
DLKSEGMLLKINRNTKTA

SEQ ID NO: 1740661 - protein, 22 aa, Staphylococcus epidermidis
DLKSIENKSDFVATENMPNYVK

SEQ ID NO: 1740662 - protein, 24 aa, Staphylococcus epidermidis
DLKYGCRDLKVEGYDLDHVKVDGT

SEQ ID NO: 1740663 - protein, 23 aa, Staphylococcus epidermidis
DLLSEILFFINIVLALYYIYPIF

SEQ ID NO: 1740664 - protein, 24 aa, Staphylococcus epidermidis
DLNDAMKSLRDALNNQALPVQASS

SEQ ID NO: 1740665 - protein, 19 aa, Staphylococcus epidermidis
DLNHAKALNEAMRQLENEV

SEQ ID NO: 1740666 - protein, 24 aa, Staphylococcus epidermidis
DLRKFGGLIQGYPILGWTFFIAAL

SEQ ID NO: 1740667 - protein, 18 aa, Staphylococcus epidermidis
DLTHHFMFVMRDLKWIFL

SEQ ID NO: 1740668 - protein, 22 aa, Staphylococcus epidermidis
DLVEPENGYGGRQVSHSNVVYN

SEQ ID NO: 1740669 - protein, 24 aa, Staphylococcus epidermidis
DLVPRIALGSIVAYIIGQHVDVFI

SEQ ID NO: 1740670 - protein, 19 aa, Staphylococcus epidermidis
DLVVEGMVLNINRNNRETK

SEQ ID NO: 1740671 - protein, 22 aa, Staphylococcus epidermidis
DMMKKYYDKFGIKKEDIRKKYY

SEQ ID NO: 1740672 - protein, 28 aa, Staphylococcus epidermidis
DMSKGLKLKVIFNFGLPLIVALLHGYFA

SEQ ID NO: 1740673 - protein, 28 aa, Staphylococcus epidermidis
DMSKGLLLKILFNFGLPLIVALLHALFA

SEQ ID NO: 1740674 - protein, 31 aa, Staphylococcus epidermidis
DMSPESKVNMPRKEQTPVPPIVNANEAQANV

SEQ ID NO: 1740675 - protein, 19 aa, Staphylococcus epidermidis
DMTHVISLNTGRSYPLELI

SEQ ID NO: 1740676 - protein, 26 aa, Staphylococcus epidermidis
DMTRFIVRVLIPFAFIISLFLISQGT

SEQ ID NO: 1740677 - protein, 24 aa, Staphylococcus epidermidis
DNAGLSLKATREYKSILNDVQQFK

SEQ ID NO: 1740678 - protein, 21 aa, Staphylococcus epidermidis
DNEKYYGAVVFEKDFSKNAMS

SEQ ID NO: 1740679 - protein, 20 aa, Staphylococcus epidermidis
DNFSSFFFTGSWTIIDILII

SEQ ID NO: 1740680 - protein, 21 aa, Staphylococcus epidermidis
DNFYIISIEIVFFIYLGTLSP

SEQ ID NO: 1740681 - protein, 23 aa, Staphylococcus epidermidis
DNFYIISIEIVFFIYLGTLSPTL

SEQ ID NO: 1740682 - protein, 27 aa, Staphylococcus epidermidis
DNKFWGKLGSFSIKNAFLTILVILAVF

SEQ ID NO: 1740683 - protein, 23 aa, Staphylococcus epidermidis
DNKVFRLNVSYILSKIGKNVYPL

SEQ ID NO: 1740684 - protein, 25 aa, Staphylococcus epidermidis
DNLNSGNYIVHFDKPSGMTQTTTDS

SEQ ID NO: 1740685 - protein, 17 aa, Staphylococcus epidermidis
DNLRYRQVIYSHYDDQK

SEQ ID NO: 1740686 - protein, 35 aa, Staphylococcus epidermidis
DNLTIDSGFYKTPKYSVGDYVWKDTNKDGIQDDNE

SEQ ID NO: 1740687 - protein, 19 aa, Staphylococcus epidermidis
DNMSGTLISAYPVGLRYVD

SEQ ID NO: 1740688 - protein, 32 aa, Staphylococcus epidermidis
DNMTVDTGFYLTPKYNVGDYVWEDTNKDGIQD

SEQ ID NO: 1740689 - protein, 24 aa, Staphylococcus epidermidis
DNNQCPKCGQSLPKNNKAKQTSSH

SEQ ID NO: 1740690 - protein, 17 aa, Staphylococcus epidermidis
DNQNYPMEVTIANEVVK

SEQ ID NO: 1740691 - protein, 43 aa, Staphylococcus epidermidis
DNTDPYGVVLARTTNGWDRSVLDPRVAGIYQDIDVTPGSELVI

SEQ ID NO: 1740692 - protein, 31 aa, Staphylococcus epidermidis
DNVKAQAITAIKLINANAHKRQDAINILTNL

SEQ ID NO: 1740693 - protein, 26 aa, Staphylococcus epidermidis
DPKDHPWAKFVVGKPVIAIVISLLIL

SEQ ID NO: 1740694 - protein, 20 aa, Staphylococcus epidermidis
DPLVHFIHFPLGVTLLYIGV

SEQ ID NO: 1740695 - protein, 25 aa, Staphylococcus epidermidis
DPNKAKYALLDFTFLHTLNQFKQTV

SEQ ID NO: 1740696 - protein, 21 aa, Staphylococcus epidermidis
DQDVKHHVTTVGDDKTTTTNI

SEQ ID NO: 1740697 - protein, 25 aa, Staphylococcus epidermidis
DQIWSNSKFKLALKVQDRQDSNEIL

SEQ ID NO: 1740698 - protein, 26 aa, Staphylococcus epidermidis
DQIWSNSKFKLALKVQDRQDSNEILK

SEQ ID NO: 1740699 - protein, 30 aa, Staphylococcus epidermidis
DQLNDWIFKERKLLITIAYKLLMDDHTYTL

SEQ ID NO: 1740700 - protein, 22 aa, Staphylococcus epidermidis
DQRADLKKIEYVYKTLNKDYYK

SEQ ID NO: 1740701 - protein, 25 aa, Staphylococcus epidermidis
DQVIDARLGYYSVVKETNVQLLQPN

SEQ ID NO: 1740702 - protein, 25 aa, Staphylococcus epidermidis
DQVLDARLGYYSVVKETNVQLLQPN

SEQ ID NO: 1740703 - protein, 20 aa, Staphylococcus epidermidis
DRILKEQNPSVADVNNALNK

SEQ ID NO: 1740704 - protein, 35 aa, Staphylococcus epidermidis
DRLLLNRYLGIPIFLGIMWLIFQTTFTWIGTPLSD

SEQ ID NO: 1740705 - protein, 17 aa, Staphylococcus epidermidis
DRNGMATTEASSAAKLN

SEQ ID NO: 1740706 - protein, 19 aa, Staphylococcus epidermidis
DRRQMIGIWSGIVVIIIAS

SEQ ID NO: 1740707 - protein, 25 aa, Staphylococcus epidermidis
DRRSASSTWAWLFVLFILPIIGFIL

SEQ ID NO: 1740708 - protein, 28 aa, Staphylococcus epidermidis
DRSPYEIISALILAWSLMVSWNQMVAFS

SEQ ID NO: 1740709 - protein, 26 aa, Staphylococcus epidermidis
DSDIVPWPTLFFGMFFNNLFFWCANQ

SEQ ID NO: 1740710 - protein, 26 aa, Staphylococcus epidermidis
DSDSDKNAKDKLPDTGANEDHDSKGT

SEQ ID NO: 1740711 - protein, 20 aa, Staphylococcus epidermidis
DSEKKLAYDNAVSQAEQLIN

SEQ ID NO: 1740712 - protein, 17 aa, Staphylococcus epidermidis
DSFGWKETIPPKKDGDS

SEQ ID NO: 1740713 - protein, 42 aa, Staphylococcus epidermidis
DSGAPNKRLLGSYASSYIDMIDRIPPVAPKANSITTEDTSIK

SEQ ID NO: 1740714 - protein, 22 aa, Staphylococcus epidermidis
DSGMKGKEFLPFVNRSAIAGIL

SEQ ID NO: 1740715 - protein, 42 aa, Staphylococcus epidermidis
DSGTPNKRLLGSYASSYIDMIDRIPPVAPKANSITTEDTSIK

SEQ ID NO: 1740716 - protein, 22 aa, Staphylococcus epidermidis
DSHIPMIYSYFLNYGLLVVSSI

SEQ ID NO: 1740717 - protein, 17 aa, Staphylococcus epidermidis
DSIKEGDTFTIKYGQYI

SEQ ID NO: 1740718 - protein, 21 aa, Staphylococcus epidermidis
DSKAFAILYLWLVKLGEAKAQ

SEQ ID NO: 1740719 - protein, 28 aa, Staphylococcus epidermidis
DSKHLYKCLLFLNICIFIVHILKSIFII

SEQ ID NO: 1740720 - protein, 19 aa, Staphylococcus epidermidis
DSLDIARRCIADINQQLGY

SEQ ID NO: 1740721 - protein, 23 aa, Staphylococcus epidermidis
DSLKEEYKFFGFKETIISLYTAY

SEQ ID NO: 1740722 - protein, 24 aa, Staphylococcus epidermidis
DSLSAAIIEKGKVNKLLKRNPTVA

SEQ ID NO: 1740723 - protein, 21 aa, Staphylococcus epidermidis
DSLWHHRFMMIVLTLLMVASI

SEQ ID NO: 1740724 - protein, 25 aa, Staphylococcus epidermidis
DSMGLGILCYIFWGIYLKEGMYQYN

SEQ ID NO: 1740725 - protein, 25 aa, Staphylococcus epidermidis
DSNFLKYLIYRIGKDDASGLAAQMT

SEQ ID NO: 1740726 - protein, 17 aa, Staphylococcus epidermidis
DSNGTKTTVTVKDADNK

SEQ ID NO: 1740727 - protein, 23 aa, Staphylococcus epidermidis
DSRMIDGKDAAIVNGKSESSEHK

SEQ ID NO: 1740728 - protein, 27 aa, Staphylococcus epidermidis
DSSQKSIKSVHTFKPNENFLQTDYRAV

SEQ ID NO: 1740729 - protein, 24 aa, Staphylococcus epidermidis
DSVLNILSTLGFIFLMFLSGLEID

SEQ ID NO: 1740730 - protein, 21 aa, Staphylococcus epidermidis
DSVWFLMIVRLLNGIATAIAT

SEQ ID NO: 1740731 - protein, 17 aa, Staphylococcus epidermidis
DTFTKRFVSILFIFTYV

SEQ ID NO: 1740732 - protein, 30 aa, Staphylococcus epidermidis
DTIIYKVHLMKECLERGINMISSMGAANKT

SEQ ID NO: 1740733 - protein, 25 aa, Staphylococcus epidermidis
DTITFEILDGLAFGVLTVFLINWII

SEQ ID NO: 1740734 - protein, 17 aa, Staphylococcus epidermidis
DTIYSFKGSGDVSYRIS

SEQ ID NO: 1740735 - protein, 18 aa, Staphylococcus epidermidis
DTLMKLNPFWTILLSLIF

SEQ ID NO: 1740736 - protein, 25 aa, Staphylococcus epidermidis
DTLVATKSNATWSLDKQVQGITINE

SEQ ID NO: 1740737 - protein, 24 aa, Staphylococcus epidermidis
DTMSRIAMKLGYSESNSFVTNTVI

SEQ ID NO: 1740738 - protein, 17 aa, Staphylococcus epidermidis
DTNKDGIQDDSEKGISG

SEQ ID NO: 1740739 - protein, 23 aa, Staphylococcus epidermidis
DTRKSGEILQRFMDTSKIREALS

SEQ ID NO: 1740740 - protein, 18 aa, Staphylococcus epidermidis
DTSIKRNAKNDIEGKAAD

SEQ ID NO: 1740741 - protein, 19 aa, Staphylococcus epidermidis
DTSIKRNAKSDIDIKAADK

SEQ ID NO: 1740742 - protein, 24 aa, Staphylococcus epidermidis
DTSLLRYYFWITILIVILIVGLIA

SEQ ID NO: 1740743 - protein, 23 aa, Staphylococcus epidermidis
DTSLLRYYFWMTIVIIMLLVGVI

SEQ ID NO: 1740744 - protein, 19 aa, Staphylococcus epidermidis
DTTAPPAPAINPIKEGAKE

SEQ ID NO: 1740745 - protein, 17 aa, Staphylococcus epidermidis
DTTLDLDFPIVEKPQTD

SEQ ID NO: 1740746 - protein, 18 aa, Staphylococcus epidermidis
DTVLYLMHKHHRISDKQY

SEQ ID NO: 1740747 - protein, 17 aa, Staphylococcus epidermidis
DVFCGNCGTKLPESVAE

SEQ ID NO: 1740748 - protein, 21 aa, Staphylococcus epidermidis
DVGDGQPILQLISDNPQINAT

SEQ ID NO: 1740749 - protein, 22 aa, Staphylococcus epidermidis
DVGEGQPVLQLISSNPQINATI

SEQ ID NO: 1740750 - protein, 23 aa, Staphylococcus epidermidis
DVGGEFYDFDLFKMEYKDQPLEL

SEQ ID NO: 1740751 - protein, 18 aa, Staphylococcus epidermidis
DVLDCVTRLQHWCEKFDV

SEQ ID NO: 1740752 - protein, 20 aa, Staphylococcus epidermidis
DVMFTSSIIYRIKKNAFSLT

SEQ ID NO: 1740753 - protein, 20 aa, Staphylococcus epidermidis
DVPKDATIVWYDFENASERE

SEQ ID NO: 1740754 - protein, 17 aa, Staphylococcus epidermidis
DVPQSLSNVVLRATEKD

SEQ ID NO: 1740755 - protein, 18 aa, Staphylococcus epidermidis
DVRLFKKRSFSAGTIAAF

SEQ ID NO: 1740756 - protein, 17 aa, Staphylococcus epidermidis
DVRLVILHSEYRSIIHP

SEQ ID NO: 1740757 - protein, 17 aa, Staphylococcus epidermidis
DVSELKVGDQLQVLNGD

SEQ ID NO: 1740758 - protein, 20 aa, Staphylococcus epidermidis
DVTSFVIPIGYSFNLDGSAL

SEQ ID NO: 1740759 - protein, 20 aa, Staphylococcus epidermidis
DVVARFGLKLLFGATLVSFI

SEQ ID NO: 1740760 - protein, 24 aa, Staphylococcus epidermidis
DVYQFRTALRFNFKNNGNYIDKEK

SEQ ID NO: 1740761 - protein, 20 aa, Staphylococcus epidermidis
DWTFVIAFIPWMIVIVPYLL

SEQ ID NO: 1740762 - protein, 19 aa, Staphylococcus epidermidis
DYFYHVLHLPMSFFDTRKS

SEQ ID NO: 1740763 - protein, 20 aa, Staphylococcus epidermidis
DYGTFFAMQPMMYIIIGIVL

SEQ ID NO: 1740764 - protein, 21 aa, Staphylococcus epidermidis
DYKHPTWMLVFGIVAVIVTII

SEQ ID NO: 1740765 - protein, 24 aa, Staphylococcus epidermidis
DYKMNALRLAKSYVKNINISNQAL

SEQ ID NO: 1740766 - protein, 25 aa, Staphylococcus epidermidis
DYKMNALRLAKSYVKNINISNQALY

SEQ ID NO: 1740767 - protein, 19 aa, Staphylococcus epidermidis
DYQDAAGRAQDVNGAVNND

SEQ ID NO: 1740768 - protein, 21 aa, Staphylococcus epidermidis
DYQHPTWMLVFGIIAVIVTIM

SEQ ID NO: 1740769 - protein, 18 aa, Staphylococcus epidermidis
DYTRSAVASLGVDSNETE

SEQ ID NO: 1740770 - protein, 24 aa, Staphylococcus epidermidis
DYYLSNKGEVIFRLPGDNKSSKSK

SEQ ID NO: 1740771 - protein, 21 aa, Staphylococcus epidermidis
EADQIFLLPFERHMKNYIKAS

SEQ ID NO: 1740772 - protein, 19 aa, Staphylococcus epidermidis
EAEQILKDHHLSLGDISRS

SEQ ID NO: 1740773 - protein, 22 aa, Staphylococcus epidermidis
EAGFEVFKGNLLSSNDRIYSDL

SEQ ID NO: 1740774 - protein, 18 aa, Staphylococcus epidermidis
EAGNKGWGSTEIVTMFII

SEQ ID NO: 1740775 - protein, 21 aa, Staphylococcus epidermidis
EAISQVEAHSSDAIAKIGEAE

SEQ ID NO: 1740776 - protein, 18 aa, Staphylococcus epidermidis
EAKVHHVLKKKGWENKIK

SEQ ID NO: 1740777 - protein, 25 aa, Staphylococcus epidermidis
EALAMKRYLIAKGIPEDIILMENQS

SEQ ID NO: 1740778 - protein, 18 aa, Staphylococcus epidermidis
EALERFSMDKARQSIRSL

SEQ ID NO: 1740779 - protein, 19 aa, Staphylococcus epidermidis
EALVRRKGQEMMVHVDDIA

SEQ ID NO: 1740780 - protein, 26 aa, Staphylococcus epidermidis
EANGNTLITKRTKYQFSKITHNGENV

SEQ ID NO: 1740781 - protein, 24 aa, Staphylococcus epidermidis
EAPIPGRSAVGIEVPNDKISLVSL

SEQ ID NO: 1740782 - protein, 27 aa, Staphylococcus epidermidis
EAPPNLKDRFQLFLNKHVLRVISVTLC

SEQ ID NO: 1740783 - protein, 22 aa, Staphylococcus epidermidis
EATNRVNAGLAQSIQNINNAHS

SEQ ID NO: 1740784 - protein, 20 aa, Staphylococcus epidermidis
EAVSAVQYMSSWPWDWAKPM

SEQ ID NO: 1740785 - protein, 22 aa, Staphylococcus epidermidis
EDEGTFKWKAYQTYDNGDVVKW

SEQ ID NO: 1740786 - protein, 31 aa, Staphylococcus epidermidis
EDEKDTFSWSRWLPHMTLGAQNIRGFVYNQR

SEQ ID NO: 1740787 - protein, 24 aa, Staphylococcus epidermidis
EDEPERYYNGRDYRREQQLEEENE

SEQ ID NO: 1740788 - protein, 25 aa, Staphylococcus epidermidis
EDFLTRYKALVITSFNSKVSFDSLV

SEQ ID NO: 1740789 - protein, 19 aa, Staphylococcus epidermidis
EDGVGLPLLTALPIVSGML

SEQ ID NO: 1740790 - protein, 22 aa, Staphylococcus epidermidis
EDGYYWFQGRVDDVIMTAGERV

SEQ ID NO: 1740791 - protein, 25 aa, Staphylococcus epidermidis
EDIKFSHWQWFISIASIVILFIADI

SEQ ID NO: 1740792 - protein, 19 aa, Staphylococcus epidermidis
EDINIFKSLGYGVEEKRND

SEQ ID NO: 1740793 - protein, 17 aa, Staphylococcus epidermidis
EDKLIFDNVSLEFKEKK

SEQ ID NO: 1740794 - protein, 21 aa, Staphylococcus epidermidis
EDMASTLGVLSNRGIEGGEAG

SEQ ID NO: 1740795 - protein, 18 aa, Staphylococcus epidermidis
EDPELYKSSAKDLATQIS

SEQ ID NO: 1740796 - protein, 20 aa, Staphylococcus epidermidis
EDYRDSLDFETMINNKVLPI

SEQ ID NO: 1740797 - protein, 24 aa, Staphylococcus epidermidis
EEDECFYLVMEYIEGPTLAEYIHN

SEQ ID NO: 1740798 - protein, 24 aa, Staphylococcus epidermidis
EEDEMLKANVVYSYDGDNDGNQAF

SEQ ID NO: 1740799 - protein, 19 aa, Staphylococcus epidermidis
EEELCIFTLKEFLKLHKYY

SEQ ID NO: 1740800 - protein, 24 aa, Staphylococcus epidermidis
EEERQIALNKVKAIVEDANEKIRE

SEQ ID NO: 1740801 - protein, 20 aa, Staphylococcus epidermidis
EEEVKESSSVESSNSSIDTA

SEQ ID NO: 1740802 - protein, 21 aa, Staphylococcus epidermidis
EEGKFKWNAIQTYDNGDVVKW

SEQ ID NO: 1740803 - protein, 20 aa, Staphylococcus epidermidis
EEGKFPGGFTKMITEKLNFT

SEQ ID NO: 1740804 - protein, 19 aa, Staphylococcus epidermidis
EEIAIRRAFGAKGRDIEIQ

SEQ ID NO: 1740805 - protein, 19 aa, Staphylococcus epidermidis
EEICFRGLIFIFIFTMLNF

SEQ ID NO: 1740806 - protein, 22 aa, Staphylococcus epidermidis
EEKEKRDSLTILASGISGFIAI

SEQ ID NO: 1740807 - protein, 18 aa, Staphylococcus epidermidis
EELLEEFEEGLIRRHQAN

SEQ ID NO: 1740808 - protein, 22 aa, Staphylococcus epidermidis
EELLELYPNMYINVDLKDAPDT

SEQ ID NO: 1740809 - protein, 20 aa, Staphylococcus epidermidis
EEMPGFGISLLTAMLPVILM

SEQ ID NO: 1740810 - protein, 20 aa, Staphylococcus epidermidis
EEPDFLIVIYHGGLNKISKQ

SEQ ID NO: 1740811 - protein, 26 aa, Staphylococcus epidermidis
EESDIPKKRSRRAVEGNNASDVNTVT

SEQ ID NO: 1740812 - protein, 17 aa, Staphylococcus epidermidis
EEVKNLINQDRRDNDVE

SEQ ID NO: 1740813 - protein, 17 aa, Staphylococcus epidermidis
EEYVFRKVIFGELYNFI

SEQ ID NO: 1740814 - protein, 21 aa, Staphylococcus epidermidis
EFARGMYILSYINFLPTVTSI

SEQ ID NO: 1740815 - protein, 20 aa, Staphylococcus epidermidis
EFDLNLAYENMREILLKADK

SEQ ID NO: 1740816 - protein, 20 aa, Staphylococcus epidermidis
EFETPEGYTPTKQNLGSDEG

SEQ ID NO: 1740817 - protein, 26 aa, Staphylococcus epidermidis
EFIIYKFGSDSIRVYKTEFEMQQDLN

SEQ ID NO: 1740818 - protein, 19 aa, Staphylococcus epidermidis
EFILFRLVPTLLLNFILLL

SEQ ID NO: 1740819 - protein, 24 aa, Staphylococcus epidermidis
EFLKFLGNCLFKEANRGLPLPTIL

SEQ ID NO: 1740820 - protein, 19 aa, Staphylococcus epidermidis
EFSLKVVMNYFKRNLEGSK

SEQ ID NO: 1740821 - protein, 25 aa, Staphylococcus epidermidis
EFYLKKIWVAIKFLAVYIYQLLTSS

SEQ ID NO: 1740822 - protein, 22 aa, Staphylococcus epidermidis
EGASHAWLFASLTLFLALSPFL

SEQ ID NO: 1740823 - protein, 17 aa, Staphylococcus epidermidis
EGENFARKSMSRLYYKI

SEQ ID NO: 1740824 - protein, 19 aa, Staphylococcus epidermidis
EGIEVKMLFDDMGSRDLRK

SEQ ID NO: 1740825 - protein, 23 aa, Staphylococcus epidermidis
EGKETRFGIGQSALFTTITTAFT

SEQ ID NO: 1740826 - protein, 17 aa, Staphylococcus epidermidis
EGLASLANFAENKLPDV

SEQ ID NO: 1740827 - protein, 19 aa, Staphylococcus epidermidis
EGLEVKLLYDDVGSKKVNM

SEQ ID NO: 1740828 - protein, 19 aa, Staphylococcus epidermidis
EGLHYILFAFLIVWLTDTG

SEQ ID NO: 1740829 - protein, 29 aa, Staphylococcus epidermidis
EGLNLKYYIRQVIRQVVLVLFLMTLLLLA

SEQ ID NO: 1740830 - protein, 17 aa, Staphylococcus epidermidis
EGMLLKLNRNTREAKGF

SEQ ID NO: 1740831 - protein, 23 aa, Staphylococcus epidermidis
EGNETITQFIIKVVDTTAPVVTP

SEQ ID NO: 1740832 - protein, 19 aa, Staphylococcus epidermidis
EGRFNKDMFLQLADRKNIR

SEQ ID NO: 1740833 - protein, 18 aa, Staphylococcus epidermidis
EGRTTVVIAHRLSTIKKA

SEQ ID NO: 1740834 - protein, 20 aa, Staphylococcus epidermidis
EGVFIYPALLAIIIAIFSYI

SEQ ID NO: 1740835 - protein, 20 aa, Staphylococcus epidermidis
EGVFIYPALLAIIIAILSYI

SEQ ID NO: 1740836 - protein, 17 aa, Staphylococcus epidermidis
EGVKFERHETIKSRDIN

SEQ ID NO: 1740837 - protein, 20 aa, Staphylococcus epidermidis
EGYHFTVYVPYGDDWFAYFM

SEQ ID NO: 1740838 - protein, 20 aa, Staphylococcus epidermidis
EGYLFTVYVPYGNDWFAYFM

SEQ ID NO: 1740839 - protein, 19 aa, Staphylococcus epidermidis
EGYTPTLKHSGTNPALDSE

SEQ ID NO: 1740840 - protein, 26 aa, Staphylococcus epidermidis
EHHPELKISAMIGIVFMTMLLFIFLI

SEQ ID NO: 1740841 - protein, 25 aa, Staphylococcus epidermidis
EHIRYGESILKCSILKSQHINNVAA

SEQ ID NO: 1740842 - protein, 19 aa, Staphylococcus epidermidis
EHLDRIRLSFFTYHRSDSD

SEQ ID NO: 1740843 - protein, 20 aa, Staphylococcus epidermidis
EHLRPILTKRQIYLGKAGFF

SEQ ID NO: 1740844 - protein, 20 aa, Staphylococcus epidermidis
EHSKTWYVTGLWYLAYLITP

SEQ ID NO: 1740845 - protein, 21 aa, Staphylococcus epidermidis
EIANFSGLLGRVLTEMRLVKV

SEQ ID NO: 1740846 - protein, 27 aa, Staphylococcus epidermidis
EIANISNWRFAMLVIIVISFIALISIS

SEQ ID NO: 1740847 - protein, 17 aa, Staphylococcus epidermidis
EIDDLKVEIKKLKAKDE

SEQ ID NO: 1740848 - protein, 23 aa, Staphylococcus epidermidis
EIENFKFFVQYGDFKNLKDYKDG

SEQ ID NO: 1740849 - protein, 25 aa, Staphylococcus epidermidis
EIICKPHPFAQLLHDGIRNAYDYKI

SEQ ID NO: 1740850 - protein, 25 aa, Staphylococcus epidermidis
EIIDFNMFINKIINRHEMAAKDTTF

SEQ ID NO: 1740851 - protein, 19 aa, Staphylococcus epidermidis
EIIKFVIVGGINTLNYYIV

SEQ ID NO: 1740852 - protein, 21 aa, Staphylococcus epidermidis
EIIQMSCILLFTNNLHHAITL

SEQ ID NO: 1740853 - protein, 35 aa, Staphylococcus epidermidis
EIKYNKPYFYKGILLILLVCLIIASITGYGIKSFI

SEQ ID NO: 1740854 - protein, 25 aa, Staphylococcus epidermidis
EILLNPKKSYGIVVLANMNSSHVTN

SEQ ID NO: 1740855 - protein, 24 aa, Staphylococcus epidermidis
EILNPALQIMVYWIVFGLGIRSNA

SEQ ID NO: 1740856 - protein, 20 aa, Staphylococcus epidermidis
EIQAHKKLEAKAYIDGYSDD

SEQ ID NO: 1740857 - protein, 26 aa, Staphylococcus epidermidis
EISIVVCIFLLFALIFFLFTLPFSAF

SEQ ID NO: 1740858 - protein, 27 aa, Staphylococcus epidermidis
EITILNRKWWQSFHFYQKNKELKITTT

SEQ ID NO: 1740859 - protein, 21 aa, Staphylococcus epidermidis
EITRVPTFIFSLVWILFNFYT

SEQ ID NO: 1740860 - protein, 25 aa, Staphylococcus epidermidis
EKAEAKRLLEISKNKTITNINQAQT

SEQ ID NO: 1740861 - protein, 21 aa, Staphylococcus epidermidis
EKAKFARHKVANALTQNAFKN

SEQ ID NO: 1740862 - protein, 22 aa, Staphylococcus epidermidis
EKDAYEFYGKVQAGITTPTQRS

SEQ ID NO: 1740863 - protein, 19 aa, Staphylococcus epidermidis
EKFLRFPITQIVNMVMQTL

SEQ ID NO: 1740864 - protein, 25 aa, Staphylococcus epidermidis
EKHIAEHKLGYVVINKTQQILNNQS

SEQ ID NO: 1740865 - protein, 25 aa, Staphylococcus epidermidis
EKHIAEHKLGYVVVNKTQQILNNQS

SEQ ID NO: 1740866 - protein, 17 aa, Staphylococcus epidermidis
EKIWYWLISIIMIAVIS

SEQ ID NO: 1740867 - protein, 25 aa, Staphylococcus epidermidis
EKKKHIFSFSESRFMRFLGGNDLIY

SEQ ID NO: 1740868 - protein, 21 aa, Staphylococcus epidermidis
EKKYKMTMLKPMKYNNTYALA

SEQ ID NO: 1740869 - protein, 21 aa, Staphylococcus epidermidis
EKLKEAQALDEAMKQLEDQVN

SEQ ID NO: 1740870 - protein, 27 aa, Staphylococcus epidermidis
EKLTIVRGIIAWFYSLIWAFIGFIWIT

SEQ ID NO: 1740871 - protein, 26 aa, Staphylococcus epidermidis
EKNDRYGRTLAYVWISDKRMFNEELV

SEQ ID NO: 1740872 - protein, 27 aa, Staphylococcus epidermidis
EKNKGIGTIRDIQPLVVKKPTAKSKIE

SEQ ID NO: 1740873 - protein, 31 aa, Staphylococcus epidermidis
EKNKVSVFIICYLILFLILRSVMESINEYLI

SEQ ID NO: 1740874 - protein, 18 aa, Staphylococcus epidermidis
EKQELGVITKEQYQKETQ

SEQ ID NO: 1740875 - protein, 27 aa, Staphylococcus epidermidis
EKQIFVSKLKALINRAHKQIDEAETFV

SEQ ID NO: 1740876 - protein, 21 aa, Staphylococcus epidermidis
EKQLAERGANGYSKSIIRDDG

SEQ ID NO: 1740877 - protein, 28 aa, Staphylococcus epidermidis
EKQTVKRKVVVQLTRFEKVLYITLITVI

SEQ ID NO: 1740878 - protein, 18 aa, Staphylococcus epidermidis
EKQVFTSKVKALLNRIQL

SEQ ID NO: 1740879 - protein, 18 aa, Staphylococcus epidermidis
EKRGRRSTRSVVEERSSR

SEQ ID NO: 1740880 - protein, 24 aa, Staphylococcus epidermidis
EKRIEKTKYFSFGITIETTKHIEG

SEQ ID NO: 1740881 - protein, 20 aa, Staphylococcus epidermidis
EKRIPISIEVPDEIDRIDMN

SEQ ID NO: 1740882 - protein, 20 aa, Staphylococcus epidermidis
EKRIPISIEVPDEIDRISMN

SEQ ID NO: 1740883 - protein, 19 aa, Staphylococcus epidermidis
EKSAAIDRVNVAKIDAINN

SEQ ID NO: 1740884 - protein, 41 aa, Staphylococcus epidermidis
EKTKGHKLKKSAAKTTALVGGAFTFNMLNNHQAFAASETPI

SEQ ID NO: 1740885 - protein, 40 aa, Staphylococcus epidermidis
EKTKGHKLKKSAAKTTALVGGAFTFNMLNNHQALAASETP

SEQ ID NO: 1740886 - protein, 26 aa, Staphylococcus epidermidis
EKVFKLSSYYLFNWFFVVYHLGVIVT

SEQ ID NO: 1740887 - protein, 17 aa, Staphylococcus epidermidis
EKVLKSHVIIFKTIDPI

SEQ ID NO: 1740888 - protein, 24 aa, Staphylococcus epidermidis
EKYKKWYVSAMVGFVAFAVVLLLF

SEQ ID NO: 1740889 - protein, 19 aa, Staphylococcus epidermidis
EKYPHANFNSWSDLYQSKY

SEQ ID NO: 1740890 - protein, 26 aa, Staphylococcus epidermidis
EKYVYRVDGFSCANCAGKFERNVKKI

SEQ ID NO: 1740891 - protein, 19 aa, Staphylococcus epidermidis
ELFELPLVLIMTFSLLLSS

SEQ ID NO: 1740892 - protein, 21 aa, Staphylococcus epidermidis
ELKAYLKNRVTNFRFSLFTKI

SEQ ID NO: 1740893 - protein, 18 aa, Staphylococcus epidermidis
ELKGENLLLLLIGGSIAG

SEQ ID NO: 1740894 - protein, 28 aa, Staphylococcus epidermidis
ELKIIFRKKLYLVISILLPVVFYLLFTS

SEQ ID NO: 1740895 - protein, 25 aa, Staphylococcus epidermidis
ELLGPVFRPVMRPLFTLPGRSTVDN

SEQ ID NO: 1740896 - protein, 28 aa, Staphylococcus epidermidis
ELNDKMKLLRDKLKTLVNPVKASLNYRN

SEQ ID NO: 1740897 - protein, 21 aa, Staphylococcus epidermidis
ELNQKLANMFGIYYIITAILI

SEQ ID NO: 1740898 - protein, 20 aa, Staphylococcus epidermidis
ELNSAMSNLRDGIQNKEDIK

SEQ ID NO: 1740899 - protein, 20 aa, Staphylococcus epidermidis
ELSSGALFYIAYLKGITGNN

SEQ ID NO: 1740900 - protein, 19 aa, Staphylococcus epidermidis
ELTELRDSYQVYYKISDDI

SEQ ID NO: 1740901 - protein, 24 aa, Staphylococcus epidermidis
ELVVSYLNWQWVYFILTILYLILV

SEQ ID NO: 1740902 - protein, 22 aa, Staphylococcus epidermidis
EMEYINVISLLFIGTIGMARGS

SEQ ID NO: 1740903 - protein, 19 aa, Staphylococcus epidermidis
EMLGEYILDGFKVAVIVGA

SEQ ID NO: 1740904 - protein, 17 aa, Staphylococcus epidermidis
ENALHLFKQEIEQNKIK

SEQ ID NO: 1740905 - protein, 29 aa, Staphylococcus epidermidis
ENEKSSRTKKWLIALVVILLIVVAIFVTR

SEQ ID NO: 1740906 - protein, 24 aa, Staphylococcus epidermidis
ENFKNGYSSFSWAIFLLIIQASTI

SEQ ID NO: 1740907 - protein, 18 aa, Staphylococcus epidermidis
ENFPRLFTHDTHIPNFIT

SEQ ID NO: 1740908 - protein, 25 aa, Staphylococcus epidermidis
ENHAGDQNAAVTLPADQENNAPQAG

SEQ ID NO: 1740909 - protein, 22 aa, Staphylococcus epidermidis
ENHPERYYNGRDYRREQQLEEE

SEQ ID NO: 1740910 - protein, 20 aa, Staphylococcus epidermidis
ENIAKIMLKEIETIKQHYAV

SEQ ID NO: 1740911 - protein, 31 aa, Staphylococcus epidermidis
ENIILAFILTRWAWFCRIIRTSVMQYTEADH

SEQ ID NO: 1740912 - protein, 26 aa, Staphylococcus epidermidis
ENIYMHFSRTYIRLMRNVYLNNPLTS

SEQ ID NO: 1740913 - protein, 21 aa, Staphylococcus epidermidis
ENLDDQVLALITGEIGSMPEL

SEQ ID NO: 1740914 - protein, 19 aa, Staphylococcus epidermidis
ENLSILSIILDFVIIVMLI

SEQ ID NO: 1740915 - protein, 25 aa, Staphylococcus epidermidis
ENMPHWLSNIGYLFPLRYAGNGLIN

SEQ ID NO: 1740916 - protein, 31 aa, Staphylococcus epidermidis
ENPQGTTGTGFQRETVGTVETTGQPAAGNPG

SEQ ID NO: 1740917 - protein, 21 aa, Staphylococcus epidermidis
ENTMILGWIFYFFLGGYIGYN

SEQ ID NO: 1740918 - protein, 28 aa, Staphylococcus epidermidis
ENVEIYKIFELMLIFSIIIFIFFTFSMI

SEQ ID NO: 1740919 - protein, 18 aa, Staphylococcus epidermidis
EPFRKVIPPIGFIDISSI

SEQ ID NO: 1740920 - protein, 22 aa, Staphylococcus epidermidis
EPGDWLTFFGTLVGALIGALIA

SEQ ID NO: 1740921 - protein, 33 aa, Staphylococcus epidermidis
EPHKAPRSFISPSIVVGPNFYMGIGTPGGNKIP

SEQ ID NO: 1740922 - protein, 28 aa, Staphylococcus epidermidis
EPITSIKFSDDFENVFDIDKNVEVFIPK

SEQ ID NO: 1740923 - protein, 18 aa, Staphylococcus epidermidis
EPMISRLELDQANDKLES

SEQ ID NO: 1740924 - protein, 24 aa, Staphylococcus epidermidis
EPPFLKIMIFISFISIIFSMIYVR

SEQ ID NO: 1740925 - protein, 19 aa, Staphylococcus epidermidis
EPYTRYPVYDEDIDDIIGV

SEQ ID NO: 1740926 - protein, 26 aa, Staphylococcus epidermidis
EQFRLLIPKLHFCVEKINQLTDLNSA

SEQ ID NO: 1740927 - protein, 24 aa, Staphylococcus epidermidis
EQHKVNGLQELGNIHVNPVKKSEA

SEQ ID NO: 1740928 - protein, 20 aa, Staphylococcus epidermidis
EQKEKFGVTAMVGDGVNDAP

SEQ ID NO: 1740929 - protein, 25 aa, Staphylococcus epidermidis
EQKKRKRTTLTYIVGVCLLFISIYL

SEQ ID NO: 1740930 - protein, 20 aa, Staphylococcus epidermidis
EQLAGLKFSISLKVIERLLL

SEQ ID NO: 1740931 - protein, 26 aa, Staphylococcus epidermidis
EQLDEFFNKFVFHGRIQYNVDDLQTI

SEQ ID NO: 1740932 - protein, 26 aa, Staphylococcus epidermidis
EQLEEFFNKFVFHGRIQYNVDDLQDI

SEQ ID NO: 1740933 - protein, 17 aa, Staphylococcus epidermidis
EQLKYDSKDNIHADELQ

SEQ ID NO: 1740934 - protein, 26 aa, Staphylococcus epidermidis
EQLPEGKTALKYGFDLATEVGIKSPG

SEQ ID NO: 1740935 - protein, 24 aa, Staphylococcus epidermidis
EQLWNIGKNSAFALIIPVLAGFIS

SEQ ID NO: 1740936 - protein, 20 aa, Staphylococcus epidermidis
EQRLKEHQQKSEVYVIKELD

SEQ ID NO: 1740937 - protein, 22 aa, Staphylococcus epidermidis
EQSKFRIALREAGSGFLSGLIC

SEQ ID NO: 1740938 - protein, 24 aa, Staphylococcus epidermidis
EQVFSTRYLKMFIDSIWYAALITM

SEQ ID NO: 1740939 - protein, 18 aa, Staphylococcus epidermidis
EREQYRKTLYENIVHSLN

SEQ ID NO: 1740940 - protein, 19 aa, Staphylococcus epidermidis
ERIFYILSFLFNVLILIGV

SEQ ID NO: 1740941 - protein, 23 aa, Staphylococcus epidermidis
ERIGIPHVWHVFVFALAFSLAIN

SEQ ID NO: 1740942 - protein, 17 aa, Staphylococcus epidermidis
ERKDFRKGYTAEGLAII

SEQ ID NO: 1740943 - protein, 18 aa, Staphylococcus epidermidis
ERKIILYKEENELTDNEI

SEQ ID NO: 1740944 - protein, 19 aa, Staphylococcus epidermidis
ERLKGEFKNVGTVVQAYLY

SEQ ID NO: 1740945 - protein, 22 aa, Staphylococcus epidermidis
ERLYRFVDLHGKWMKLKSKDLK

SEQ ID NO: 1740946 - protein, 23 aa, Staphylococcus epidermidis
ERNAINLPTKVNHGVLIGEVKEN

SEQ ID NO: 1740947 - protein, 20 aa, Staphylococcus epidermidis
ERNEALAKVNTALEEAKANI

SEQ ID NO: 1740948 - protein, 18 aa, Staphylococcus epidermidis
ERPEEIQQFIGYLPESYE

SEQ ID NO: 1740949 - protein, 19 aa, Staphylococcus epidermidis
ERPSIGIGLINLSEIPESY

SEQ ID NO: 1740950 - protein, 22 aa, Staphylococcus epidermidis
ERRIDLYFKYNINNYKSMKTTS

SEQ ID NO: 1740951 - protein, 20 aa, Staphylococcus epidermidis
ERRQKEAFEAQQYEQPYDNH

SEQ ID NO: 1740952 - protein, 17 aa, Staphylococcus epidermidis
ESFLAVQSVMFASFEAS

SEQ ID NO: 1740953 - protein, 20 aa, Staphylococcus epidermidis
ESGMPIESLIQIPTKTFNKY

SEQ ID NO: 1740954 - protein, 22 aa, Staphylococcus epidermidis
ESGRKTLPILLGKRASIIFMAA

SEQ ID NO: 1740955 - protein, 30 aa, Staphylococcus epidermidis
ESILSLITTQGWIKISFIDHLPLKHYSLEW

SEQ ID NO: 1740956 - protein, 21 aa, Staphylococcus epidermidis
ESIPCIELPSYEDARDKKENY

SEQ ID NO: 1740957 - protein, 19 aa, Staphylococcus epidermidis
ESKRNIAALGQNASASKRY

SEQ ID NO: 1740958 - protein, 20 aa, Staphylococcus epidermidis
ESLIKDVVMLAARILLESGA

SEQ ID NO: 1740959 - protein, 18 aa, Staphylococcus epidermidis
ESLLKRRLINIKEANLKK

SEQ ID NO: 1740960 - protein, 17 aa, Staphylococcus epidermidis
ESMGGAVGASFKWYDFV

SEQ ID NO: 1740961 - protein, 17 aa, Staphylococcus epidermidis
ESRGIILRINRNTRTTK

SEQ ID NO: 1740962 - protein, 19 aa, Staphylococcus epidermidis
ESRKRYSPDSTYKIYLALF

SEQ ID NO: 1740963 - protein, 19 aa, Staphylococcus epidermidis
ESRKRYSPNSTYKIYLAMF

SEQ ID NO: 1740964 - protein, 18 aa, Staphylococcus epidermidis
ESSVKGFATMLLLGILMI

SEQ ID NO: 1740965 - protein, 19 aa, Staphylococcus epidermidis
ESTSMSVSDSNSTSTSLSD

SEQ ID NO: 1740966 - protein, 17 aa, Staphylococcus epidermidis
ESVPRGRILDRNGKVLV

SEQ ID NO: 1740967 - protein, 24 aa, Staphylococcus epidermidis
ESVSRLYVFSIFIILLLTLVFANF

SEQ ID NO: 1740968 - protein, 18 aa, Staphylococcus epidermidis
ESYLGFTVIFLIFGFAML

SEQ ID NO: 1740969 - protein, 25 aa, Staphylococcus epidermidis
ETAITTKEGAIWSIDKEVPGITLDT

SEQ ID NO: 1740970 - protein, 24 aa, Staphylococcus epidermidis
ETDASIKNGNFRQVSGGNLPTRSN

SEQ ID NO: 1740971 - protein, 17 aa, Staphylococcus epidermidis
ETFAIAVIGTFIASIIC

SEQ ID NO: 1740972 - protein, 28 aa, Staphylococcus epidermidis
ETISVPSLIGMLMLIGIVVTNAIVLIDR

SEQ ID NO: 1740973 - protein, 17 aa, Staphylococcus epidermidis
ETIYVIFAVNEAGQLVG

SEQ ID NO: 1740974 - protein, 22 aa, Staphylococcus epidermidis
ETKIFFKLVLPLSKRSILAGIM

SEQ ID NO: 1740975 - protein, 27 aa, Staphylococcus epidermidis
ETKVFPMWLRWSLFIILVGADTYIAIT

SEQ ID NO: 1740976 - protein, 18 aa, Staphylococcus epidermidis
ETLKASKQGTAYSQQVQT

SEQ ID NO: 1740977 - protein, 17 aa, Staphylococcus epidermidis
ETLKIIVSLIMALSVVS

SEQ ID NO: 1740978 - protein, 17 aa, Staphylococcus epidermidis
ETSLYQRWIIIILLICN

SEQ ID NO: 1740979 - protein, 19 aa, Staphylococcus epidermidis
ETTIAMVIWLLSFFTSFLG

SEQ ID NO: 1740980 - protein, 25 aa, Staphylococcus epidermidis
EVDSELERSLKIYGSKIDRNSPFFK

SEQ ID NO: 1740981 - protein, 21 aa, Staphylococcus epidermidis
EVHVASEFVYNMPLLSEKPLF

SEQ ID NO: 1740982 - protein, 18 aa, Staphylococcus epidermidis
EVHVRRGVIFIDTNIIPY

SEQ ID NO: 1740983 - protein, 25 aa, Staphylococcus epidermidis
EVIQWFYKEVDWFEAKLKDDKSNTG

SEQ ID NO: 1740984 - protein, 28 aa, Staphylococcus epidermidis
EVPNVRQFFLFDLTSRVIGSDENKDRRV

SEQ ID NO: 1740985 - protein, 24 aa, Staphylococcus epidermidis
EVRQKFLEMFPIDKTDIIHNELIA

SEQ ID NO: 1740986 - protein, 23 aa, Staphylococcus epidermidis
EVSKAYIGDHVFIDGIWFEVQEE

SEQ ID NO: 1740987 - protein, 24 aa, Staphylococcus epidermidis
EVTLFKSVGLAIVDIVVAQYFYKK

SEQ ID NO: 1740988 - protein, 19 aa, Staphylococcus epidermidis
EVYVIKELDILNNAQKAAI

SEQ ID NO: 1740989 - protein, 26 aa, Staphylococcus epidermidis
EWAKVKMPKKELAPHSPSLIYDNRNN

SEQ ID NO: 1740990 - protein, 18 aa, Staphylococcus epidermidis
EYFKNCTALRKKYPHGVR

SEQ ID NO: 1740991 - protein, 20 aa, Staphylococcus epidermidis
EYLTIYILVAIMYWVVCFII

SEQ ID NO: 1740992 - protein, 26 aa, Staphylococcus epidermidis
FAFTLTCISVSWIWFIFLALAGKSVG

SEQ ID NO: 1740993 - protein, 20 aa, Staphylococcus epidermidis
FAGLFLFALVMINFPISLIS

SEQ ID NO: 1740994 - protein, 19 aa, Staphylococcus epidermidis
FAGLGSLFLFGRRRKKDAD

SEQ ID NO: 1740995 - protein, 18 aa, Staphylococcus epidermidis
FAGNPVLHHLGIAGGNME

SEQ ID NO: 1740996 - protein, 26 aa, Staphylococcus epidermidis
FAIINKWEWLKWNPINMMNIQIQVID

SEQ ID NO: 1740997 - protein, 21 aa, Staphylococcus epidermidis
FAKGKRLNHAPGETFEYSNMN

SEQ ID NO: 1740998 - protein, 17 aa, Staphylococcus epidermidis
FALERLVTVLVIACPHA

SEQ ID NO: 1740999 - protein, 18 aa, Staphylococcus epidermidis
FALIIPILYRFVKRIHLG

SEQ ID NO: 1741000 - protein, 20 aa, Staphylococcus epidermidis
FALTLGWVGRYLRYFRNLTR

SEQ ID NO: 1741001 - protein, 29 aa, Staphylococcus epidermidis
FAPSKPKGLKSYRMVFSTMNVERMNSILF

SEQ ID NO: 1741002 - protein, 19 aa, Staphylococcus epidermidis
FAQSDFYTQIESITLNDVK

SEQ ID NO: 1741003 - protein, 18 aa, Staphylococcus epidermidis
FARGGELYFDREGATQTN

SEQ ID NO: 1741004 - protein, 24 aa, Staphylococcus epidermidis
FATIGVGMPLMFAIAEFIGIRKND

SEQ ID NO: 1741005 - protein, 17 aa, Staphylococcus epidermidis
FAVFFSFIFGFPVGTLM

SEQ ID NO: 1741006 - protein, 19 aa, Staphylococcus epidermidis
FAVLMGFGNLFGVGGGTFI

SEQ ID NO: 1741007 - protein, 20 aa, Staphylococcus epidermidis
FCAPVLAGLIGWQSTVRSYL

SEQ ID NO: 1741008 - protein, 20 aa, Staphylococcus epidermidis
FCGNCGTKLPESVAETTKTT

SEQ ID NO: 1741009 - protein, 23 aa, Staphylococcus epidermidis
FCMIVPWRLAMFYKYKKLKKSLV

SEQ ID NO: 1741010 - protein, 20 aa, Staphylococcus epidermidis
FCMNCGSPIEKSETQINSSI

SEQ ID NO: 1741011 - protein, 21 aa, Staphylococcus epidermidis
FCPLLPIVTLPIMFISPGSGL

SEQ ID NO: 1741012 - protein, 20 aa, Staphylococcus epidermidis
FCVGTPIASWFMSKNFFTHV

SEQ ID NO: 1741013 - protein, 25 aa, Staphylococcus epidermidis
FCYFSILYCLGMYAFIVSNKFNLLI

SEQ ID NO: 1741014 - protein, 18 aa, Staphylococcus epidermidis
FDAFIVRMTLIPALTKLF

SEQ ID NO: 1741015 - protein, 17 aa, Staphylococcus epidermidis
FDDFGSYIWPGVMTLIF

SEQ ID NO: 1741016 - protein, 19 aa, Staphylococcus epidermidis
FDDGSLLKYTEMKWLTPDD

SEQ ID NO: 1741017 - protein, 18 aa, Staphylococcus epidermidis
FDDVPTLIHSWMNSDIHR

SEQ ID NO: 1741018 - protein, 18 aa, Staphylococcus epidermidis
FDFKSMLITLTMLIVVLS

SEQ ID NO: 1741019 - protein, 18 aa, Staphylococcus epidermidis
FDGSRLLFYYSPVAILIS

SEQ ID NO: 1741020 - protein, 18 aa, Staphylococcus epidermidis
FDHAHLWDDSAVNAIDTI

SEQ ID NO: 1741021 - protein, 19 aa, Staphylococcus epidermidis
FDIPNFTLTLAVMIGLAVG

SEQ ID NO: 1741022 - protein, 25 aa, Staphylococcus epidermidis
FDKMFPILMGFFVFLFVFLISGITL

SEQ ID NO: 1741023 - protein, 19 aa, Staphylococcus epidermidis
FDLDLAYENMREILLKADE

SEQ ID NO: 1741024 - protein, 25 aa, Staphylococcus epidermidis
FDLDWKKSRTRIPEMTYNFKRIERY

SEQ ID NO: 1741025 - protein, 20 aa, Staphylococcus epidermidis
FDLKRRGVGFNGKIFTNRYQ

SEQ ID NO: 1741026 - protein, 24 aa, Staphylococcus epidermidis
FDNIAWGSILGYFGYGYMFGSLLG

SEQ ID NO: 1741027 - protein, 26 aa, Staphylococcus epidermidis
FDNLDSGNYIIHFEKPEGMTQTTANS

SEQ ID NO: 1741028 - protein, 27 aa, Staphylococcus epidermidis
FDNLDSGNYIIHFEKPEGMTQTTANSG

SEQ ID NO: 1741029 - protein, 27 aa, Staphylococcus epidermidis
FDQGNDWLGGFKFLGLNHVGFAISKTI

SEQ ID NO: 1741030 - protein, 22 aa, Staphylococcus epidermidis
FDQRYSQSRIDNLLHELQTTLI

SEQ ID NO: 1741031 - protein, 24 aa, Staphylococcus epidermidis
FDQVSKWIIATSMKIGDSYEVIPH

SEQ ID NO: 1741032 - protein, 26 aa, Staphylococcus epidermidis
FDSIVFRNALQYSVIMAVAIFIALAF

SEQ ID NO: 1741033 - protein, 26 aa, Staphylococcus epidermidis
FDSIVFRNALQYTVIMGIAIFIALAF

SEQ ID NO: 1741034 - protein, 32 aa, Staphylococcus epidermidis
FDVFLLLFIMRFGFRKIEAIVGTLIFTVLAIF

SEQ ID NO: 1741035 - protein, 31 aa, Staphylococcus epidermidis
FDYMPELKWHYAYFVCLGVMLVITIILIIFF

SEQ ID NO: 1741036 - protein, 21 aa, Staphylococcus epidermidis
FEGVFIYPALLAIIIAIFSYI

SEQ ID NO: 1741037 - protein, 17 aa, Staphylococcus epidermidis
FEKNRQSINPDEHQRDL

SEQ ID NO: 1741038 - protein, 17 aa, Staphylococcus epidermidis
FEKYNWPTVALQLTYYV

SEQ ID NO: 1741039 - protein, 22 aa, Staphylococcus epidermidis
FELLNGCLFIIIAFIMEKSFKR

SEQ ID NO: 1741040 - protein, 17 aa, Staphylococcus epidermidis
FELLVLFIVVSFIVSII

SEQ ID NO: 1741041 - protein, 17 aa, Staphylococcus epidermidis
FEPKLNEYETLKSEGNY

SEQ ID NO: 1741042 - protein, 20 aa, Staphylococcus epidermidis
FEQLLLIFLDNAMKYDTDNK

SEQ ID NO: 1741043 - protein, 22 aa, Staphylococcus epidermidis
FESIKEIILLFLNSHQDYKMNK

SEQ ID NO: 1741044 - protein, 24 aa, Staphylococcus epidermidis
FETPEGYTPTLKHSGTNPALDSEG

SEQ ID NO: 1741045 - protein, 41 aa, Staphylococcus epidermidis
FFGHPRGLGVLFFVEFWERFSYYGMRAMLIFYMYFAIQDHG

SEQ ID NO: 1741046 - protein, 18 aa, Staphylococcus epidermidis
FFHESRLGKWIDNEVYEF

SEQ ID NO: 1741047 - protein, 27 aa, Staphylococcus epidermidis
FFIGLVAIVIGMFWFKLYQRTTNPKAD

SEQ ID NO: 1741048 - protein, 25 aa, Staphylococcus epidermidis
FFIKSRINWILWILFLNIILLGVAY

SEQ ID NO: 1741049 - protein, 23 aa, Staphylococcus epidermidis
FFIPFLLIFIIDGFKGIKETLPS

SEQ ID NO: 1741050 - protein, 20 aa, Staphylococcus epidermidis
FFITYKFYYYLPIERKLKSI

SEQ ID NO: 1741051 - protein, 18 aa, Staphylococcus epidermidis
FFKERKIGWFIFAIAYTL

SEQ ID NO: 1741052 - protein, 20 aa, Staphylococcus epidermidis
FFKYLAIFLSINLILTLTTI

SEQ ID NO: 1741053 - protein, 19 aa, Staphylococcus epidermidis
FFLFMLDWETALIALISIP

SEQ ID NO: 1741054 - protein, 24 aa, Staphylococcus epidermidis
FFLIGFIILLSLVFYFQQLTKDAS

SEQ ID NO: 1741055 - protein, 18 aa, Staphylococcus epidermidis
FFSDVFIWLPLFLYAIER

SEQ ID NO: 1741056 - protein, 17 aa, Staphylococcus epidermidis
FFSSWFLTFGYVCVVAL

SEQ ID NO: 1741057 - protein, 17 aa, Staphylococcus epidermidis
FFVAVTLHGIWDTEITL

SEQ ID NO: 1741058 - protein, 21 aa, Staphylococcus epidermidis
FFVKKRLSYFLIVGLMLSCIG

SEQ ID NO: 1741059 - protein, 18 aa, Staphylococcus epidermidis
FFYGIPFLGGSVIMSFGW

SEQ ID NO: 1741060 - protein, 19 aa, Staphylococcus epidermidis
FFYSKVRWYSIVIVLMSTL

SEQ ID NO: 1741061 - protein, 18 aa, Staphylococcus epidermidis
FGAIGIVMAILWAIIAKD

SEQ ID NO: 1741062 - protein, 19 aa, Staphylococcus epidermidis
FGAYFILALSLVFVYLISG

SEQ ID NO: 1741063 - protein, 19 aa, Staphylococcus epidermidis
FGEQRYKVIPADKRGTYSA

SEQ ID NO: 1741064 - protein, 19 aa, Staphylococcus epidermidis
FGETEFWLSLIKVITIIVF

SEQ ID NO: 1741065 - protein, 20 aa, Staphylococcus epidermidis
FGFHDGRLSWIFYVAMIIFT

SEQ ID NO: 1741066 - protein, 21 aa, Staphylococcus epidermidis
FGFNMSSFWLIFSGAVTAIPL

SEQ ID NO: 1741067 - protein, 18 aa, Staphylococcus epidermidis
FGGIVGGLVMSHLSVQAV

SEQ ID NO: 1741068 - protein, 24 aa, Staphylococcus epidermidis
FGGLIGGPVVKFLIKRYNLKPEHR

SEQ ID NO: 1741069 - protein, 20 aa, Staphylococcus epidermidis
FGGLIKGYPILGWTFFIASL

SEQ ID NO: 1741070 - protein, 42 aa, Staphylococcus epidermidis
FGGNAYAFRQCTWWVYNRRLELGLPCDPFFGNGGDWGSTAPS

SEQ ID NO: 1741071 - protein, 19 aa, Staphylococcus epidermidis
FGGTASDFWIACIAGGAAF

SEQ ID NO: 1741072 - protein, 22 aa, Staphylococcus epidermidis
FGIALIVCLFRLIKGPTTADRV

SEQ ID NO: 1741073 - protein, 17 aa, Staphylococcus epidermidis
FGKAGAFLTNYTYGLSL

SEQ ID NO: 1741074 - protein, 17 aa, Staphylococcus epidermidis
FGKNLSVVSEFKNVIVK

SEQ ID NO: 1741075 - protein, 17 aa, Staphylococcus epidermidis
FGKYIVGGIGKIKYENI

SEQ ID NO: 1741076 - protein, 26 aa, Staphylococcus epidermidis
FGLDIKWGAAITAIFSILIFISKSGQ

SEQ ID NO: 1741077 - protein, 23 aa, Staphylococcus epidermidis
FGLICLVVTQLLYFIPGSVWFLM

SEQ ID NO: 1741078 - protein, 17 aa, Staphylococcus epidermidis
FGLKLLFGATLVSFISA

SEQ ID NO: 1741079 - protein, 18 aa, Staphylococcus epidermidis
FGLLMFVGTLFKVPESLE

SEQ ID NO: 1741080 - protein, 25 aa, Staphylococcus epidermidis
FGLTVKETFLTWSLLETIISVSGIL

SEQ ID NO: 1741081 - protein, 25 aa, Staphylococcus epidermidis
FGMYEIIPGFIISVLVTYIVSKLTK

SEQ ID NO: 1741082 - protein, 24 aa, Staphylococcus epidermidis
FGNIDSPYIIKVISKYDPNKDDYT

SEQ ID NO: 1741083 - protein, 23 aa, Staphylococcus epidermidis
FGNLIAFPFAIVFIVLACQRTKY

SEQ ID NO: 1741084 - protein, 17 aa, Staphylococcus epidermidis
FGPKIVLPSGIGIAAIG

SEQ ID NO: 1741085 - protein, 26 aa, Staphylococcus epidermidis
FGSYIWPGVMTLIFLVSFIHNIIKVY

SEQ ID NO: 1741086 - protein, 20 aa, Staphylococcus epidermidis
FGVCMKPVMDPLMRKIAKRA

SEQ ID NO: 1741087 - protein, 19 aa, Staphylococcus epidermidis
FGVSKSFLKKIGMSDKIPK

SEQ ID NO: 1741088 - protein, 23 aa, Staphylococcus epidermidis
FGWRPVKKRFKQAIVSIIQELHE

SEQ ID NO: 1741089 - protein, 17 aa, Staphylococcus epidermidis
FGYLVVYCIIFLSIALF

SEQ ID NO: 1741090 - protein, 17 aa, Staphylococcus epidermidis
FGYLVVYCIIFVSIALF

SEQ ID NO: 1741091 - protein, 18 aa, Staphylococcus epidermidis
FHITKYRLIVGMVAVFLA

SEQ ID NO: 1741092 - protein, 17 aa, Staphylococcus epidermidis
FHMIWHIFIVLASLLHM

SEQ ID NO: 1741093 - protein, 42 aa, Staphylococcus epidermidis
FHSNGSWDFLIHFFVDIGWFLTNWLYKFVNFVEDVLDKIVTF

SEQ ID NO: 1741094 - protein, 42 aa, Staphylococcus epidermidis
FHTQHGPLAVFMRPDIGETFSEFRIFLAVLLSLLLVISISLV

SEQ ID NO: 1741095 - protein, 20 aa, Staphylococcus epidermidis
FHWHGLEINGKVDGGPSQVI

SEQ ID NO: 1741096 - protein, 26 aa, Staphylococcus epidermidis
FIAAMFQWTAGFSFSAGLIDYVLSLV

SEQ ID NO: 1741097 - protein, 23 aa, Staphylococcus epidermidis
FIAAYIVAFGIKFIEKKVPEGLD

SEQ ID NO: 1741098 - protein, 20 aa, Staphylococcus epidermidis
FIEQGRLKSYTIIPTSNLAI

SEQ ID NO: 1741099 - protein, 22 aa, Staphylococcus epidermidis
FIFVFLGLFGIFVGELNGLEQN

SEQ ID NO: 1741100 - protein, 17 aa, Staphylococcus epidermidis
FIGEKPVRTEVLRPTKL

SEQ ID NO: 1741101 - protein, 26 aa, Staphylococcus epidermidis
FIGFLVTCLYFEFAGNPVLHHLGIAG

SEQ ID NO: 1741102 - protein, 18 aa, Staphylococcus epidermidis
FIGHIAMEIISRSLYEQQ

SEQ ID NO: 1741103 - protein, 21 aa, Staphylococcus epidermidis
FIGIEGAVVFSSRAKRKKDVG

SEQ ID NO: 1741104 - protein, 19 aa, Staphylococcus epidermidis
FIGSFPIISAIIIILFGIL

SEQ ID NO: 1741105 - protein, 18 aa, Staphylococcus epidermidis
FIGSRKAAILSIVANIIG

SEQ ID NO: 1741106 - protein, 19 aa, Staphylococcus epidermidis
FIHDLKLSKFYKRKYQEEL

SEQ ID NO: 1741107 - protein, 17 aa, Staphylococcus epidermidis
FIHLMLIINCAKKKALS

SEQ ID NO: 1741108 - protein, 27 aa, Staphylococcus epidermidis
FIHWIWPDLPMPAAFAIAAILCPTDAV

SEQ ID NO: 1741109 - protein, 19 aa, Staphylococcus epidermidis
FIIGSGYIGVWLYHFLERV

SEQ ID NO: 1741110 - protein, 19 aa, Staphylococcus epidermidis
FIILSLILAHLFKHLLIRF

SEQ ID NO: 1741111 - protein, 19 aa, Staphylococcus epidermidis
FIILSLILAHLFKHLLIRL

SEQ ID NO: 1741112 - protein, 27 aa, Staphylococcus epidermidis
FIIMVFTAIALVAVWFIFNQLVAGIAT

SEQ ID NO: 1741113 - protein, 26 aa, Staphylococcus epidermidis
FIINAILIVVGWKFLSRTTAIYTAIT

SEQ ID NO: 1741114 - protein, 18 aa, Staphylococcus epidermidis
FIIPEYVGNPVLGVAVAT

SEQ ID NO: 1741115 - protein, 18 aa, Staphylococcus epidermidis
FIIPEYVGNPVLGVAVVT

SEQ ID NO: 1741116 - protein, 17 aa, Staphylococcus epidermidis
FIISYVTMIIFYKYLSD

SEQ ID NO: 1741117 - protein, 17 aa, Staphylococcus epidermidis
FIISYVTMILFYKHLSD

SEQ ID NO: 1741118 - protein, 17 aa, Staphylococcus epidermidis
FIISYVTMILFYKYLSN

SEQ ID NO: 1741119 - protein, 21 aa, Staphylococcus epidermidis
FIITFCLFIVWELKTNHSIIN

SEQ ID NO: 1741120 - protein, 20 aa, Staphylococcus epidermidis
FIKFPIPFLPPYLTLDFSDV

SEQ ID NO: 1741121 - protein, 19 aa, Staphylococcus epidermidis
FIKKDIKYIPLIPFIFLSF

SEQ ID NO: 1741122 - protein, 18 aa, Staphylococcus epidermidis
FILANWLFLFAGLLFIIK

SEQ ID NO: 1741123 - protein, 31 aa, Staphylococcus epidermidis
FILATPVQFIIGWQFYVGAYKNLRNGSANMD

SEQ ID NO: 1741124 - protein, 21 aa, Staphylococcus epidermidis
FILFFLMKFSHVMTPEMTDSL

SEQ ID NO: 1741125 - protein, 19 aa, Staphylococcus epidermidis
FILFPSVIIYFILIHIFQH

SEQ ID NO: 1741126 - protein, 23 aa, Staphylococcus epidermidis
FILPIVVGLFIWALTPFKPDALN

SEQ ID NO: 1741127 - protein, 25 aa, Staphylococcus epidermidis
FIMSICNKWTLFLAILLSLILLKRG

SEQ ID NO: 1741128 - protein, 23 aa, Staphylococcus epidermidis
FIMVVCGISFYAYLQSRKIKTNS

SEQ ID NO: 1741129 - protein, 17 aa, Staphylococcus epidermidis
FIMYSIVKVVFKNANLT

SEQ ID NO: 1741130 - protein, 17 aa, Staphylococcus epidermidis
FINKCILKMERDEADST

SEQ ID NO: 1741131 - protein, 17 aa, Staphylococcus epidermidis
FINKMWVNIISWTLIVI

SEQ ID NO: 1741132 - protein, 23 aa, Staphylococcus epidermidis
FINPKLGKNIPFMLGLFSGGLIF

SEQ ID NO: 1741133 - protein, 25 aa, Staphylococcus epidermidis
FIPIPMPASVIGLVLLFIALCTGIV

SEQ ID NO: 1741134 - protein, 17 aa, Staphylococcus epidermidis
FIPLFYVIFGLKTRDES

SEQ ID NO: 1741135 - protein, 22 aa, Staphylococcus epidermidis
FISIIFSMIYVRKSNSPKRKMR

SEQ ID NO: 1741136 - protein, 23 aa, Staphylococcus epidermidis
FISPGSGLFLFIGALILNVTLSM

SEQ ID NO: 1741137 - protein, 26 aa, Staphylococcus epidermidis
FISTMAIMMASIFFMYNHSVLASTRN

SEQ ID NO: 1741138 - protein, 18 aa, Staphylococcus epidermidis
FISVISILFGIEYILLSL

SEQ ID NO: 1741139 - protein, 26 aa, Staphylococcus epidermidis
FISYSRFQNILLMLLIIPTWINLLLK

SEQ ID NO: 1741140 - protein, 25 aa, Staphylococcus epidermidis
FIVAKDGLFPKWFAKENENGAPVNA

SEQ ID NO: 1741141 - protein, 26 aa, Staphylococcus epidermidis
FIVAKDGLFPKWFAKENKNKAPVNAL

SEQ ID NO: 1741142 - protein, 24 aa, Staphylococcus epidermidis
FIVKRFHLLYLIASAICFFIVPIL

SEQ ID NO: 1741143 - protein, 22 aa, Staphylococcus epidermidis
FIVSLYWHFLDVVWIFIFTAVY

SEQ ID NO: 1741144 - protein, 18 aa, Staphylococcus epidermidis
FIWALPVVFMISLSTALV

SEQ ID NO: 1741145 - protein, 25 aa, Staphylococcus epidermidis
FKASRRFSGLLARLESQDMVSSIIM

SEQ ID NO: 1741146 - protein, 24 aa, Staphylococcus epidermidis
FKDKGGRAEAFFPSKLPLINLRMN

SEQ ID NO: 1741147 - protein, 22 aa, Staphylococcus epidermidis
FKDNYRKILFITFISLLINLIG

SEQ ID NO: 1741148 - protein, 24 aa, Staphylococcus epidermidis
FKEAVSWKQIISGFFFAFAALTYL

SEQ ID NO: 1741149 - protein, 22 aa, Staphylococcus epidermidis
FKELFKNTIINIILSFIIIALV

SEQ ID NO: 1741150 - protein, 19 aa, Staphylococcus epidermidis
FKFLKALLYLKYLKKQSLY

SEQ ID NO: 1741151 - protein, 24 aa, Staphylococcus epidermidis
FKGFITVFFPLWFSVHADGVISTF

SEQ ID NO: 1741152 - protein, 22 aa, Staphylococcus epidermidis
FKGIGLPGGMALVFSLISGAGW

SEQ ID NO: 1741153 - protein, 32 aa, Staphylococcus epidermidis
FKIELNKLDLKAHKKLAAKQRIQQKANEIIQI

SEQ ID NO: 1741154 - protein, 31 aa, Staphylococcus epidermidis
FKIHDWIVHLFLNLNHFKWYIPKLNQYSLLI

SEQ ID NO: 1741155 - protein, 17 aa, Staphylococcus epidermidis
FKIPESYSIKDVTKEYA

SEQ ID NO: 1741156 - protein, 21 aa, Staphylococcus epidermidis
FKISKLAGLMTFIWVTVNDVI

SEQ ID NO: 1741157 - protein, 18 aa, Staphylococcus epidermidis
FKKLAVMLLLSIFILYLN

SEQ ID NO: 1741158 - protein, 25 aa, Staphylococcus epidermidis
FKKLDLCILIILLAIIFCFVCEIIK

SEQ ID NO: 1741159 - protein, 17 aa, Staphylococcus epidermidis
FKKLRKFITNKAVLYAI

SEQ ID NO: 1741160 - protein, 19 aa, Staphylococcus epidermidis
FKKRSFSAGTIAAFMTMFA

SEQ ID NO: 1741161 - protein, 23 aa, Staphylococcus epidermidis
FKLDEEPINIVINANSKLKERID

SEQ ID NO: 1741162 - protein, 20 aa, Staphylococcus epidermidis
FKLFSPWYYLIKFVMPVVII

SEQ ID NO: 1741163 - protein, 19 aa, Staphylococcus epidermidis
FKLKPGDIVITKGPVLYGF

SEQ ID NO: 1741164 - protein, 24 aa, Staphylococcus epidermidis
FKLLKKRSTFIIPLIIIVLMTLQA

SEQ ID NO: 1741165 - protein, 17 aa, Staphylococcus epidermidis
FKLQAMDTMTSFWIPQL

SEQ ID NO: 1741166 - protein, 21 aa, Staphylococcus epidermidis
FKLQFIVIFIISFIALVFSIF

SEQ ID NO: 1741167 - protein, 17 aa, Staphylococcus epidermidis
FKLTYQFGLIILSVLTL

SEQ ID NO: 1741168 - protein, 26 aa, Staphylococcus epidermidis
FKLYECDDCSECPLKQQCMNFNSKTN

SEQ ID NO: 1741169 - protein, 20 aa, Staphylococcus epidermidis
FKNFKDLFATPRFVLPMLIQ

SEQ ID NO: 1741170 - protein, 18 aa, Staphylococcus epidermidis
FKNGAWVIAGIGDLINTM

SEQ ID NO: 1741171 - protein, 25 aa, Staphylococcus epidermidis
FKNKTWINIISWLLIIILSGLNVYL

SEQ ID NO: 1741172 - protein, 19 aa, Staphylococcus epidermidis
FKNKWTHFFISIPVILGGS

SEQ ID NO: 1741173 - protein, 19 aa, Staphylococcus epidermidis
FKNKWTHFIISLPVIIGGS

SEQ ID NO: 1741174 - protein, 21 aa, Staphylococcus epidermidis
FKPKYLKRIVLATSISTLQGM

SEQ ID NO: 1741175 - protein, 18 aa, Staphylococcus epidermidis
FKQSRRAIIFAMISIILI

SEQ ID NO: 1741176 - protein, 21 aa, Staphylococcus epidermidis
FKRLEFTGIGLLFCQKTIDAM

SEQ ID NO: 1741177 - protein, 17 aa, Staphylococcus epidermidis
FKSLGYGVEEKRNDPNF

SEQ ID NO: 1741178 - protein, 24 aa, Staphylococcus epidermidis
FKTSRRFSGFLAKIESPDFVTSSV

SEQ ID NO: 1741179 - protein, 22 aa, Staphylococcus epidermidis
FKVATPIFKPLFAWQMSRTLLW

SEQ ID NO: 1741180 - protein, 21 aa, Staphylococcus epidermidis
FKVLIACLLVLFILIMNLRGL

SEQ ID NO: 1741181 - protein, 17 aa, Staphylococcus epidermidis
FKVPKGIEDHLFRITQE

SEQ ID NO: 1741182 - protein, 24 aa, Staphylococcus epidermidis
FKVTEGFAALNGVVFSVMYSISCL

SEQ ID NO: 1741183 - protein, 20 aa, Staphylococcus epidermidis
FKVTILGFIVSFIWVCINDV

SEQ ID NO: 1741184 - protein, 17 aa, Staphylococcus epidermidis
FKYIFIPYLLIGLFYSY

SEQ ID NO: 1741185 - protein, 18 aa, Staphylococcus epidermidis
FLAGVSFLLSAYYVYVRK

SEQ ID NO: 1741186 - protein, 34 aa, Staphylococcus epidermidis
FLAQRPFFSFSWNEFAWWLVAHLFFIILMATCLP

SEQ ID NO: 1741187 - protein, 28 aa, Staphylococcus epidermidis
FLAYIPFELCLLLKLFKPKKAFEWPLFI

SEQ ID NO: 1741188 - protein, 19 aa, Staphylococcus epidermidis
FLEKFKFTAAQTEIDDAHE

SEQ ID NO: 1741189 - protein, 18 aa, Staphylococcus epidermidis
FLELRYDTFTKRFVSILF

SEQ ID NO: 1741190 - protein, 20 aa, Staphylococcus epidermidis
FLEWSNLGVIAAVKGAKLLQ

SEQ ID NO: 1741191 - protein, 35 aa, Staphylococcus epidermidis
FLFDWKLSLICLIPVILGFLLLRFMMGDESKSFLD

SEQ ID NO: 1741192 - protein, 26 aa, Staphylococcus epidermidis
FLFKKLSWPYGLIIAAVIITSLGSLS

SEQ ID NO: 1741193 - protein, 18 aa, Staphylococcus epidermidis
FLFLKRRSILTMMKDSSQ

SEQ ID NO: 1741194 - protein, 21 aa, Staphylococcus epidermidis
FLGGLSYTIGAWFYAQKNKPY

SEQ ID NO: 1741195 - protein, 20 aa, Staphylococcus epidermidis
FLGGLSYTIGAWFYAQKNRP

SEQ ID NO: 1741196 - protein, 19 aa, Staphylococcus epidermidis
FLGGSVIMSFGWQPLLFNA

SEQ ID NO: 1741197 - protein, 25 aa, Staphylococcus epidermidis
FLGNWIGQIGLNWFVLTTYHNAVYL

SEQ ID NO: 1741198 - protein, 18 aa, Staphylococcus epidermidis
FLHFDLSIVMLIALTVCL

SEQ ID NO: 1741199 - protein, 22 aa, Staphylococcus epidermidis
FLHVLGDLFGSIGAIVAALLIW

SEQ ID NO: 1741200 - protein, 17 aa, Staphylococcus epidermidis
FLHYLHFPIGVWLLYIG

SEQ ID NO: 1741201 - protein, 19 aa, Staphylococcus epidermidis
FLIICEFFYGIPFLGGSVI

SEQ ID NO: 1741202 - protein, 19 aa, Staphylococcus epidermidis
FLILCIGIVVVLISVKKNL

SEQ ID NO: 1741203 - protein, 18 aa, Staphylococcus epidermidis
FLISICFIFAPFVLLFYS

SEQ ID NO: 1741204 - protein, 17 aa, Staphylococcus epidermidis
FLIVRPPIEFIRQYLAQ

SEQ ID NO: 1741205 - protein, 17 aa, Staphylococcus epidermidis
FLIVRPPIEYIRQYLAQ

SEQ ID NO: 1741206 - protein, 20 aa, Staphylococcus epidermidis
FLIYIAVVLVSCMVFLTFFL

SEQ ID NO: 1741207 - protein, 24 aa, Staphylococcus epidermidis
FLKHKHEIEFAGILFSFTGQSSTG

SEQ ID NO: 1741208 - protein, 27 aa, Staphylococcus epidermidis
FLLEHNHAFKGLSWHQSLFYSLFQSAT

SEQ ID NO: 1741209 - protein, 19 aa, Staphylococcus epidermidis
FLLFKRRYNRYYGEDAGDY

SEQ ID NO: 1741210 - protein, 17 aa, Staphylococcus epidermidis
FLLMIFKIMNPKQSVFI

SEQ ID NO: 1741211 - protein, 20 aa, Staphylococcus epidermidis
FLLTNSKIIVFAKKGNSDAS

SEQ ID NO: 1741212 - protein, 19 aa, Staphylococcus epidermidis
FLMSSYCLLVIGTTKIQLQ

SEQ ID NO: 1741213 - protein, 25 aa, Staphylococcus epidermidis
FLPALIGWSSMRVFGGSPILGLVLG

SEQ ID NO: 1741214 - protein, 18 aa, Staphylococcus epidermidis
FLPLFAILGNVLMSMLTL

SEQ ID NO: 1741215 - protein, 23 aa, Staphylococcus epidermidis
FLPNKLNKYSIRKFTVGTASILL

SEQ ID NO: 1741216 - protein, 24 aa, Staphylococcus epidermidis
FLPNKLNKYSIRKFTVGTASILLG

SEQ ID NO: 1741217 - protein, 25 aa, Staphylococcus epidermidis
FLRHKHATEFAGIIFSFTGQSSTGK

SEQ ID NO: 1741218 - protein, 24 aa, Staphylococcus epidermidis
FLTPKFKLGHFIGYSLLQFLIGFI

SEQ ID NO: 1741219 - protein, 20 aa, Staphylococcus epidermidis
FLTYMAIVIVSCIVFLTFFL

SEQ ID NO: 1741220 - protein, 19 aa, Staphylococcus epidermidis
FLTYMTIVIVSCIIFSIFF

SEQ ID NO: 1741221 - protein, 32 aa, Staphylococcus epidermidis
FLVILFAKFDLFKSAIGICIGVICLMLVIYTL

SEQ ID NO: 1741222 - protein, 24 aa, Staphylococcus epidermidis
FLVNCMLIVFSMLYPILIHSFKDK

SEQ ID NO: 1741223 - protein, 24 aa, Staphylococcus epidermidis
FLVTFCLPINLPVAPDQALIRGLA

SEQ ID NO: 1741224 - protein, 19 aa, Staphylococcus epidermidis
FLVVFCWQPVHFYALAIKR

SEQ ID NO: 1741225 - protein, 33 aa, Staphylococcus epidermidis
FMERRTANSIWAWLLVLVFLPLVGFILYLLLGR

SEQ ID NO: 1741226 - protein, 22 aa, Staphylococcus epidermidis
FMGIICLIYWIGSILILVLTCL

SEQ ID NO: 1741227 - protein, 19 aa, Staphylococcus epidermidis
FMILGSILVLLGIYLVTFE

SEQ ID NO: 1741228 - protein, 19 aa, Staphylococcus epidermidis
FMKAILGFTRMSVRGIDKA

SEQ ID NO: 1741229 - protein, 23 aa, Staphylococcus epidermidis
FMKRRGRELSLLQIIGLTRSNIM

SEQ ID NO: 1741230 - protein, 22 aa, Staphylococcus epidermidis
FMQGEFPVMMFGLPAAALAIYH

SEQ ID NO: 1741231 - protein, 19 aa, Staphylococcus epidermidis
FNAIDTFKDDIFKTKDALN

SEQ ID NO: 1741232 - protein, 23 aa, Staphylococcus epidermidis
FNGDGFARQTFKVHSVSQSDFDK

SEQ ID NO: 1741233 - protein, 21 aa, Staphylococcus epidermidis
FNHLACRIISAILQISALMIW

SEQ ID NO: 1741234 - protein, 24 aa, Staphylococcus epidermidis
FNIGMGWIVPALIGFIIGIIVYFM

SEQ ID NO: 1741235 - protein, 26 aa, Staphylococcus epidermidis
FNILPKIIGGIGWVLAKITRQPKFES

SEQ ID NO: 1741236 - protein, 26 aa, Staphylococcus epidermidis
FNILPKIIGGIGWVLAKVTRQPKFES

SEQ ID NO: 1741237 - protein, 23 aa, Staphylococcus epidermidis
FNINLPFINKFILKMERDEADST

SEQ ID NO: 1741238 - protein, 24 aa, Staphylococcus epidermidis
FNKEEIRTLLNIAGREGAFNEVEN

SEQ ID NO: 1741239 - protein, 19 aa, Staphylococcus epidermidis
FNKYNEVHKVASLPDTGIS

SEQ ID NO: 1741240 - protein, 24 aa, Staphylococcus epidermidis
FNKYSYRKLFIVGLALFTIGSLIC

SEQ ID NO: 1741241 - protein, 28 aa, Staphylococcus epidermidis
FNLDFMKNAPLPFDLMTAMIKKLKNGIK

SEQ ID NO: 1741242 - protein, 18 aa, Staphylococcus epidermidis
FNLFKFGKYIVGGIGKIK

SEQ ID NO: 1741243 - protein, 21 aa, Staphylococcus epidermidis
FNLPSEIAIGVILVGCCPGGT

SEQ ID NO: 1741244 - protein, 24 aa, Staphylococcus epidermidis
FNLTKPDIWITIIAGVLYFIQAYV

SEQ ID NO: 1741245 - protein, 23 aa, Staphylococcus epidermidis
FNNRNSLFLSGEWELSQTQYVVE

SEQ ID NO: 1741246 - protein, 20 aa, Staphylococcus epidermidis
FNNYFVSPIALSFDFSKKLL

SEQ ID NO: 1741247 - protein, 17 aa, Staphylococcus epidermidis
FNPDLKPGEERVKQKGE

SEQ ID NO: 1741248 - protein, 31 aa, Staphylococcus epidermidis
FNQTIKRFFIWLALTVLFAFLSFINYHNGLQ

SEQ ID NO: 1741249 - protein, 22 aa, Staphylococcus epidermidis
FNSKILLLLAFIVQQSYLHYFL

SEQ ID NO: 1741250 - protein, 18 aa, Staphylococcus epidermidis
FNVPTWIGSFIIVLLLFF

SEQ ID NO: 1741251 - protein, 19 aa, Staphylococcus epidermidis
FNVYPIKNLEDFYNIEGYK

SEQ ID NO: 1741252 - protein, 20 aa, Staphylococcus epidermidis
FNYFFTVPRFTLEMYRFEYP

SEQ ID NO: 1741253 - protein, 21 aa, Staphylococcus epidermidis
FNYKHILSVGLLWIGSFILIG

SEQ ID NO: 1741254 - protein, 19 aa, Staphylococcus epidermidis
FPALGLVLGVMIGIGAAEK

SEQ ID NO: 1741255 - protein, 21 aa, Staphylococcus epidermidis
FPFGGDIIFVRILRNNESIVP

SEQ ID NO: 1741256 - protein, 24 aa, Staphylococcus epidermidis
FPFILRGVSIIGIDSVFTPIKLRR

SEQ ID NO: 1741257 - protein, 25 aa, Staphylococcus epidermidis
FPFYILTVYFFFGRLRQLTRVRSQA

SEQ ID NO: 1741258 - protein, 22 aa, Staphylococcus epidermidis
FPGAVPPLIGWVAIDGQMSLAA

SEQ ID NO: 1741259 - protein, 21 aa, Staphylococcus epidermidis
FPGAVPPLIGWVAIDGSLSLP

SEQ ID NO: 1741260 - protein, 22 aa, Staphylococcus epidermidis
FPGAVPPLIGWVVIDGSLSLAA

SEQ ID NO: 1741261 - protein, 19 aa, Staphylococcus epidermidis
FPGYASTLFANAMVIGQLC

SEQ ID NO: 1741262 - protein, 18 aa, Staphylococcus epidermidis
FPKSIIFIAPMIVFLFVF

SEQ ID NO: 1741263 - protein, 22 aa, Staphylococcus epidermidis
FPLDFKILIGIGLLFCVGTPLT

SEQ ID NO: 1741264 - protein, 24 aa, Staphylococcus epidermidis
FPLLCPIITIILGFTLKNKISKNK

SEQ ID NO: 1741265 - protein, 24 aa, Staphylococcus epidermidis
FPNDEATRIVIMYTSLEGQEATLV

SEQ ID NO: 1741266 - protein, 20 aa, Staphylococcus epidermidis
FPPNGLELWNGKTELKHNDL

SEQ ID NO: 1741267 - protein, 19 aa, Staphylococcus epidermidis
FPSGHAMGATSFFGSAIYV

SEQ ID NO: 1741268 - protein, 17 aa, Staphylococcus epidermidis
FPVIGTILGSFVFGIGI

SEQ ID NO: 1741269 - protein, 17 aa, Staphylococcus epidermidis
FPVMASAFLIFTIVIMF

SEQ ID NO: 1741270 - protein, 17 aa, Staphylococcus epidermidis
FPVSVYIQPFLVALLFG

SEQ ID NO: 1741271 - protein, 27 aa, Staphylococcus epidermidis
FPYVEGKKVYQAFVSVEVPKIGYKGNY

SEQ ID NO: 1741272 - protein, 23 aa, Staphylococcus epidermidis
FQEKGKIVGLLQMFMTKESIAER

SEQ ID NO: 1741273 - protein, 19 aa, Staphylococcus epidermidis
FQFSIMFAFIGITLIISSQ

SEQ ID NO: 1741274 - protein, 17 aa, Staphylococcus epidermidis
FQFYGIMTIRDAFLVGL

SEQ ID NO: 1741275 - protein, 19 aa, Staphylococcus epidermidis
FQGLIPIIAGLVPAIMAVA

SEQ ID NO: 1741276 - protein, 17 aa, Staphylococcus epidermidis
FQHTRWNAYSFAAINTV

SEQ ID NO: 1741277 - protein, 22 aa, Staphylococcus epidermidis
FQIHSLWYLGMIPWIGACFTAY

SEQ ID NO: 1741278 - protein, 26 aa, Staphylococcus epidermidis
FQIVPRWFWFYIILVSIVFPFEIGKE

SEQ ID NO: 1741279 - protein, 19 aa, Staphylococcus epidermidis
FQTLIGFVFAPFAFLAGVP

SEQ ID NO: 1741280 - protein, 19 aa, Staphylococcus epidermidis
FRFPPHVAVGTSMMMIFFS

SEQ ID NO: 1741281 - protein, 20 aa, Staphylococcus epidermidis
FRIEVDLTFIAAVLTIVGYS

SEQ ID NO: 1741282 - protein, 21 aa, Staphylococcus epidermidis
FRIEVDLTFIAAVLTIVGYSI

SEQ ID NO: 1741283 - protein, 17 aa, Staphylococcus epidermidis
FRIIFSMIFMILVLIVG

SEQ ID NO: 1741284 - protein, 25 aa, Staphylococcus epidermidis
FRINRRLGGSQSYLFFGSLPVSKKD

SEQ ID NO: 1741285 - protein, 19 aa, Staphylococcus epidermidis
FRLQCIGFIVFILLYMFAN

SEQ ID NO: 1741286 - protein, 19 aa, Staphylococcus epidermidis
FRLVPTLLLNFILLLILFP

SEQ ID NO: 1741287 - protein, 22 aa, Staphylococcus epidermidis
FRPDFSKKRNAVAEIVKAQQNK

SEQ ID NO: 1741288 - protein, 19 aa, Staphylococcus epidermidis
FRQDHQWFIYDIVTLSYHF

SEQ ID NO: 1741289 - protein, 28 aa, Staphylococcus epidermidis
FRRLTKVELPIAMPVIMAGIRTAMVLII

SEQ ID NO: 1741290 - protein, 27 aa, Staphylococcus epidermidis
FRTAIFNYWWMFAISFIFFIIAELLTI

SEQ ID NO: 1741291 - protein, 21 aa, Staphylococcus epidermidis
FRVILIPVFILFALVDFGFGQ

SEQ ID NO: 1741292 - protein, 23 aa, Staphylococcus epidermidis
FRVLGRPAGFIVTFLDIFKGFIT

SEQ ID NO: 1741293 - protein, 25 aa, Staphylococcus epidermidis
FRVNRRLGGSSSYYFFYSLPVSKKD

SEQ ID NO: 1741294 - protein, 17 aa, Staphylococcus epidermidis
FRWARGMTIVAALMTVF

SEQ ID NO: 1741295 - protein, 17 aa, Staphylococcus epidermidis
FSAGFLLSIGILDLMPE

SEQ ID NO: 1741296 - protein, 26 aa, Staphylococcus epidermidis
FSAPQKRWHFILAFSSSILVGLFIKY

SEQ ID NO: 1741297 - protein, 18 aa, Staphylococcus epidermidis
FSDVPTLLATFILGPLAG

SEQ ID NO: 1741298 - protein, 18 aa, Staphylococcus epidermidis
FSDVPTLLATFLLSPIAG

SEQ ID NO: 1741299 - protein, 18 aa, Staphylococcus epidermidis
FSEVDNVLKLKNWYMKGD

SEQ ID NO: 1741300 - protein, 17 aa, Staphylococcus epidermidis
FSFMDSAFCLMTVAYVG

SEQ ID NO: 1741301 - protein, 23 aa, Staphylococcus epidermidis
FSHRGMAFITFIWIMITFIHAIK

SEQ ID NO: 1741302 - protein, 23 aa, Staphylococcus epidermidis
FSICSFIVALLNRLDNLRPQIYV

SEQ ID NO: 1741303 - protein, 21 aa, Staphylococcus epidermidis
FSIISGAGWAFGQIITFKAFE

SEQ ID NO: 1741304 - protein, 17 aa, Staphylococcus epidermidis
FSIRKFSIGTGSVLLGA

SEQ ID NO: 1741305 - protein, 23 aa, Staphylococcus epidermidis
FSKKQIHEPWLFSLPAVILMVLI

SEQ ID NO: 1741306 - protein, 18 aa, Staphylococcus epidermidis
FSLALLIGLISGVFSSVF

SEQ ID NO: 1741307 - protein, 24 aa, Staphylococcus epidermidis
FSLFIFYKILILWTLPTLIFTIAM

SEQ ID NO: 1741308 - protein, 22 aa, Staphylococcus epidermidis
FSLLLYFSFLNHWWPFTSYIFL

SEQ ID NO: 1741309 - protein, 24 aa, Staphylococcus epidermidis
FSLPQRRWVYFLALSSGALIALFI

SEQ ID NO: 1741310 - protein, 18 aa, Staphylococcus epidermidis
FSLSRLFPHSDMIYNIIE

SEQ ID NO: 1741311 - protein, 22 aa, Staphylococcus epidermidis
FSNSYWVWWLTYGVIALLLVAL

SEQ ID NO: 1741312 - protein, 19 aa, Staphylococcus epidermidis
FSPLVLYSLYWKDLTRTGA

SEQ ID NO: 1741313 - protein, 19 aa, Staphylococcus epidermidis
FSPTLLVLLMYLISMMTAY

SEQ ID NO: 1741314 - protein, 21 aa, Staphylococcus epidermidis
FSQNLREMVTESGLAALKQSG

SEQ ID NO: 1741315 - protein, 18 aa, Staphylococcus epidermidis
FSRNDYKHIVLAGKYNSR

SEQ ID NO: 1741316 - protein, 19 aa, Staphylococcus epidermidis
FSSATGHTMDFFWELATLI

SEQ ID NO: 1741317 - protein, 20 aa, Staphylococcus epidermidis
FSSATGHTMDFFWELATLIL

SEQ ID NO: 1741318 - protein, 24 aa, Staphylococcus epidermidis
FSSKAALVIFMWLPKAYAVLNTEL

SEQ ID NO: 1741319 - protein, 17 aa, Staphylococcus epidermidis
FSSPIFAIFVFGGTTSL

SEQ ID NO: 1741320 - protein, 30 aa, Staphylococcus epidermidis
FSSSILVGLFIKYFRTVSIKSYILTSLISQ

SEQ ID NO: 1741321 - protein, 26 aa, Staphylococcus epidermidis
FSTFFAFICYVSWSSAFGSHSFHKNV

SEQ ID NO: 1741322 - protein, 21 aa, Staphylococcus epidermidis
FSTLLGFVGAMVIEGRKNLAA

SEQ ID NO: 1741323 - protein, 20 aa, Staphylococcus epidermidis
FSTLLGFVGTMVIEGRKNLA

SEQ ID NO: 1741324 - protein, 28 aa, Staphylococcus epidermidis
FSTVKNGKFIPGEVKVYEVTDTNAMVDS

SEQ ID NO: 1741325 - protein, 19 aa, Staphylococcus epidermidis
FSVVTRSKWIGTLLTLILI

SEQ ID NO: 1741326 - protein, 19 aa, Staphylococcus epidermidis
FSVVTRSKWIGTLVTLIII

SEQ ID NO: 1741327 - protein, 33 aa, Staphylococcus epidermidis
FSYDISHTVPNEWKEFFYKSYKFVDDVPSVLEI

SEQ ID NO: 1741328 - protein, 17 aa, Staphylococcus epidermidis
FTANGLLSLGASPAMSE

SEQ ID NO: 1741329 - protein, 21 aa, Staphylococcus epidermidis
FTELEDLYFRGNERLLHQAFN

SEQ ID NO: 1741330 - protein, 24 aa, Staphylococcus epidermidis
FTFIELLFTLSLVLLSFSLLPTLI

SEQ ID NO: 1741331 - protein, 25 aa, Staphylococcus epidermidis
FTGMIGLTCYVIYILKVILLARKPF

SEQ ID NO: 1741332 - protein, 18 aa, Staphylococcus epidermidis
FTIAEVFRSSAVEKYFPK

SEQ ID NO: 1741333 - protein, 27 aa, Staphylococcus epidermidis
FTIGSLICAISFNFPIMMGGRVLQAIG

SEQ ID NO: 1741334 - protein, 21 aa, Staphylococcus epidermidis
FTILVCTKLNLQVGTNVAVLT

SEQ ID NO: 1741335 - protein, 31 aa, Staphylococcus epidermidis
FTINSLWVLMLIRLIHGIAFGFSSTATGTIS

SEQ ID NO: 1741336 - protein, 27 aa, Staphylococcus epidermidis
FTKDGLPLMKTRGLKNIVEPLPLSEDD

SEQ ID NO: 1741337 - protein, 21 aa, Staphylococcus epidermidis
FTKRFVSILFIFTYVVSFLPV

SEQ ID NO: 1741338 - protein, 24 aa, Staphylococcus epidermidis
FTLASLYFPLIIKNIITELEKNKV

SEQ ID NO: 1741339 - protein, 22 aa, Staphylococcus epidermidis
FTLFESFSFLNLHFPYKNKTIG

SEQ ID NO: 1741340 - protein, 17 aa, Staphylococcus epidermidis
FTLYILSYFCLKFSMLF

SEQ ID NO: 1741341 - protein, 23 aa, Staphylococcus epidermidis
FTNGGKTLLHWGFFTIESNGVIE

SEQ ID NO: 1741342 - protein, 22 aa, Staphylococcus epidermidis
FTNIKTRIALYLFENNELTNII

SEQ ID NO: 1741343 - protein, 20 aa, Staphylococcus epidermidis
FTNLMATPLNLRNDNPRINL

SEQ ID NO: 1741344 - protein, 21 aa, Staphylococcus epidermidis
FTNYLRLIWFVASLGLLAGAM

SEQ ID NO: 1741345 - protein, 25 aa, Staphylococcus epidermidis
FTPIKLRRRVWRRLARDLKPDQLHD

SEQ ID NO: 1741346 - protein, 18 aa, Staphylococcus epidermidis
FTPLSAYAFMIFILLYVP

SEQ ID NO: 1741347 - protein, 23 aa, Staphylococcus epidermidis
FTQVWPILLFLPFVVSVFIRINT

SEQ ID NO: 1741348 - protein, 21 aa, Staphylococcus epidermidis
FTYKAPSGMKAMGALANAAIA

SEQ ID NO: 1741349 - protein, 17 aa, Staphylococcus epidermidis
FVAEFSFNYIFLANLVM

SEQ ID NO: 1741350 - protein, 18 aa, Staphylococcus epidermidis
FVARGVIAIAGFVVFSVS

SEQ ID NO: 1741351 - protein, 26 aa, Staphylococcus epidermidis
FVDPSLGFTMGWLYWGMWSLVTSVDV

SEQ ID NO: 1741352 - protein, 17 aa, Staphylococcus epidermidis
FVEELLFRHLLIHELGK

SEQ ID NO: 1741353 - protein, 19 aa, Staphylococcus epidermidis
FVFDIKDLAPLIASIVCIL

SEQ ID NO: 1741354 - protein, 28 aa, Staphylococcus epidermidis
FVFSIKDLAPFIAAIVCILIFKHRKEQL

SEQ ID NO: 1741355 - protein, 18 aa, Staphylococcus epidermidis
FVFVLLFVVFPSFSRYIF

SEQ ID NO: 1741356 - protein, 23 aa, Staphylococcus epidermidis
FVGLILGIMVWLGMKSLPIFILL

SEQ ID NO: 1741357 - protein, 24 aa, Staphylococcus epidermidis
FVGLMVPHIVRFIIGTDYSKVIPL

SEQ ID NO: 1741358 - protein, 20 aa, Staphylococcus epidermidis
FVGMIIHWILFFLMIFFVFI

SEQ ID NO: 1741359 - protein, 17 aa, Staphylococcus epidermidis
FVGRGAFIFSKEIYDKP

SEQ ID NO: 1741360 - protein, 32 aa, Staphylococcus epidermidis
FVHLFGIQIPHIFMNPWFQFVLATPVQFVIGW

SEQ ID NO: 1741361 - protein, 24 aa, Staphylococcus epidermidis
FVIELVGGLLLAFYFYRDNPDLKN

SEQ ID NO: 1741362 - protein, 23 aa, Staphylococcus epidermidis
FVIGAPISNIFGALTSWLKGMQG

SEQ ID NO: 1741363 - protein, 23 aa, Staphylococcus epidermidis
FVIPFVGAFIVHKICKKVLSTYS

SEQ ID NO: 1741364 - protein, 18 aa, Staphylococcus epidermidis
FVIVTTYQFGQYAMLFLA

SEQ ID NO: 1741365 - protein, 17 aa, Staphylococcus epidermidis
FVKEVRLSKHFYEDKEI

SEQ ID NO: 1741366 - protein, 23 aa, Staphylococcus epidermidis
FVKEVRLSKHFYKNKEIEEIKHK

SEQ ID NO: 1741367 - protein, 23 aa, Staphylococcus epidermidis
FVLASLAIYWAMWPTTAEVIFII

SEQ ID NO: 1741368 - protein, 28 aa, Staphylococcus epidermidis
FVLINTYLFRQLKSIGMFIMMTTLGIYF

SEQ ID NO: 1741369 - protein, 21 aa, Staphylococcus epidermidis
FVMRDLKWIFLSYVLLSIGTT

SEQ ID NO: 1741370 - protein, 26 aa, Staphylococcus epidermidis
FVPFYSFLLFPSIILFFITSHLISHF

SEQ ID NO: 1741371 - protein, 17 aa, Staphylococcus epidermidis
FVQKWIISILIIIAIIQ

SEQ ID NO: 1741372 - protein, 17 aa, Staphylococcus epidermidis
FVQPRTPQGFEMLFNNF

SEQ ID NO: 1741373 - protein, 26 aa, Staphylococcus epidermidis
FVSIFCLLVSLTFWSHHSFFNISVYS

SEQ ID NO: 1741374 - protein, 17 aa, Staphylococcus epidermidis
FVSRYLYTVALTVPTKI

SEQ ID NO: 1741375 - protein, 17 aa, Staphylococcus epidermidis
FVTCLSMIHQISMFSLF

SEQ ID NO: 1741376 - protein, 18 aa, Staphylococcus epidermidis
FVVFIGFDMIRPALTNYF

SEQ ID NO: 1741377 - protein, 17 aa, Staphylococcus epidermidis
FVVPFLVAWILDLILRR

SEQ ID NO: 1741378 - protein, 19 aa, Staphylococcus epidermidis
FVYLCMYLLIVVIAGYSKT

SEQ ID NO: 1741379 - protein, 19 aa, Staphylococcus epidermidis
FVYLCMYLLIVVIASYSKS

SEQ ID NO: 1741380 - protein, 26 aa, Staphylococcus epidermidis
FWFKFWSVIESGGWVIFNHMEIVFVV

SEQ ID NO: 1741381 - protein, 28 aa, Staphylococcus epidermidis
FWVIMIIIGFLFVCKEIFYPESKNLNNK

SEQ ID NO: 1741382 - protein, 17 aa, Staphylococcus epidermidis
FWYLVSFSTLFSLLNVL

SEQ ID NO: 1741383 - protein, 17 aa, Staphylococcus epidermidis
FYGHLGLLAIIIIACMC

SEQ ID NO: 1741384 - protein, 17 aa, Staphylococcus epidermidis
FYGNLLIMLPMSIWAIE

SEQ ID NO: 1741385 - protein, 23 aa, Staphylococcus epidermidis
FYILGGLFKRMSFLQKLMDGTTQ

SEQ ID NO: 1741386 - protein, 19 aa, Staphylococcus epidermidis
FYLLELLQCLVFVSYFLAL

SEQ ID NO: 1741387 - protein, 17 aa, Staphylococcus epidermidis
FYMGIGTPGGNKIPTIL

SEQ ID NO: 1741388 - protein, 25 aa, Staphylococcus epidermidis
FYQTPKYSLGNYVWYDTNKDGIQGD

SEQ ID NO: 1741389 - protein, 17 aa, Staphylococcus epidermidis
FYQYRPPLERILTNLLE

SEQ ID NO: 1741390 - protein, 19 aa, Staphylococcus epidermidis
FYSQPKVGVATSFSLSQLL

SEQ ID NO: 1741391 - protein, 17 aa, Staphylococcus epidermidis
FYTTTAVNYPNFMSNGN

SEQ ID NO: 1741392 - protein, 21 aa, Staphylococcus epidermidis
FYVAAFFRFALVMIGVLSSSI

SEQ ID NO: 1741393 - protein, 18 aa, Staphylococcus epidermidis
FYVKKEKVLGMAISQHPF

SEQ ID NO: 1741394 - protein, 18 aa, Staphylococcus epidermidis
FYYKFLNSAGKLRNKTTM

SEQ ID NO: 1741395 - protein, 17 aa, Staphylococcus epidermidis
GAAHAAKYGHNRYGRTY

SEQ ID NO: 1741396 - protein, 23 aa, Staphylococcus epidermidis
GAALREVLKPHKIAFLTSPFVIM

SEQ ID NO: 1741397 - protein, 24 aa, Staphylococcus epidermidis
GAASVAVAAFFMMTNTHFAKADVS

SEQ ID NO: 1741398 - protein, 35 aa, Staphylococcus epidermidis
GADNLTIDSGFYKTPKYSVGDYVWEDTNKDGIQDD

SEQ ID NO: 1741399 - protein, 25 aa, Staphylococcus epidermidis
GAFLLNLIFAFIIIFMERRTANSIW

SEQ ID NO: 1741400 - protein, 17 aa, Staphylococcus epidermidis
GAFLTNYTYGLSLVIAN

SEQ ID NO: 1741401 - protein, 17 aa, Staphylococcus epidermidis
GAGCLLGGVVASFLFRN

SEQ ID NO: 1741402 - protein, 19 aa, Staphylococcus epidermidis
GAGMGPFILGIIIPFIGYR

SEQ ID NO: 1741403 - protein, 24 aa, Staphylococcus epidermidis
GAIEIPGLLSFLADDSFKTKVKGL

SEQ ID NO: 1741404 - protein, 35 aa, Staphylococcus epidermidis
GAILKIAAFAGAIGPLSLGLGSIVRSIGGTVKGIG

SEQ ID NO: 1741405 - protein, 32 aa, Staphylococcus epidermidis
GAIPAAFLAIIFDFILRYMERLSYKKLLISLG

SEQ ID NO: 1741406 - protein, 19 aa, Staphylococcus epidermidis
GAISGDWIKQVVAVLNVIK

SEQ ID NO: 1741407 - protein, 20 aa, Staphylococcus epidermidis
GALAAWCYNKFYNISLPSYL

SEQ ID NO: 1741408 - protein, 24 aa, Staphylococcus epidermidis
GALIAGGIAIYVAHLQNKHQNNYI

SEQ ID NO: 1741409 - protein, 17 aa, Staphylococcus epidermidis
GAMKDYHKAKVYGSKTF

SEQ ID NO: 1741410 - protein, 28 aa, Staphylococcus epidermidis
GAMVIEGRKNLAASLLIAAAIVGLFTTN

SEQ ID NO: 1741411 - protein, 17 aa, Staphylococcus epidermidis
GASFANAVLFSRLHIGK

SEQ ID NO: 1741412 - protein, 21 aa, Staphylococcus epidermidis
GATCYDILKMIGYPELVLLQI

SEQ ID NO: 1741413 - protein, 18 aa, Staphylococcus epidermidis
GATFGLAMTYAFYPEAPF

SEQ ID NO: 1741414 - protein, 25 aa, Staphylococcus epidermidis
GATKLGEVWAMLCLSLTLVAYLMLK

SEQ ID NO: 1741415 - protein, 24 aa, Staphylococcus epidermidis
GAVSASFKWYDFVYFIDTIIYLVI

SEQ ID NO: 1741416 - protein, 23 aa, Staphylococcus epidermidis
GAVYTPFMFVLAIIMATVPPLFF

SEQ ID NO: 1741417 - protein, 22 aa, Staphylococcus epidermidis
GAYLFFRSSVSLIFKSIKRAKN

SEQ ID NO: 1741418 - protein, 21 aa, Staphylococcus epidermidis
GCAGIYPAMLAIMVAPVAHVH

SEQ ID NO: 1741419 - protein, 28 aa, Staphylococcus epidermidis
GCGKSTLSKLACRFWDLEQGSITIDNHN

SEQ ID NO: 1741420 - protein, 20 aa, Staphylococcus epidermidis
GCLLGGVVASFLFRNTQPSI

SEQ ID NO: 1741421 - protein, 20 aa, Staphylococcus epidermidis
GCVVVDLLGTFVWLVVPLLL

SEQ ID NO: 1741422 - protein, 24 aa, Staphylococcus epidermidis
GDKFAKIGTFIFMFLIGTVAIAAI

SEQ ID NO: 1741423 - protein, 18 aa, Staphylococcus epidermidis
GDLLPIIFFAVFFGLGLA

SEQ ID NO: 1741424 - protein, 17 aa, Staphylococcus epidermidis
GDLRLMVLFWGATLLSL

SEQ ID NO: 1741425 - protein, 18 aa, Staphylococcus epidermidis
GDMHYRKYFPFLTLITAF

SEQ ID NO: 1741426 - protein, 21 aa, Staphylococcus epidermidis
GDNKLRQAQEIAKNEIQNLDG

SEQ ID NO: 1741427 - protein, 25 aa, Staphylococcus epidermidis
GDNPTYSLGDYVWLDKNKNGVQDDD

SEQ ID NO: 1741428 - protein, 26 aa, Staphylococcus epidermidis
GDNPTYSLGDYVWLDKNKNGVQDDDE

SEQ ID NO: 1741429 - protein, 22 aa, Staphylococcus epidermidis
GDSAPFKRQQNIINSNLGHRNQ

SEQ ID NO: 1741430 - protein, 20 aa, Staphylococcus epidermidis
GDSIALWIVAIVAIVISLIA

SEQ ID NO: 1741431 - protein, 22 aa, Staphylococcus epidermidis
GDSRFCSNCGHNIEKLNSNSNQ

SEQ ID NO: 1741432 - protein, 17 aa, Staphylococcus epidermidis
GDWLGVQHFYEWLNHVL

SEQ ID NO: 1741433 - protein, 25 aa, Staphylococcus epidermidis
GDYTIEFETPEGYTPTKQNSGSDEG

SEQ ID NO: 1741434 - protein, 23 aa, Staphylococcus epidermidis
GEDVLSFESAKVFDANHEEITNQ

SEQ ID NO: 1741435 - protein, 27 aa, Staphylococcus epidermidis
GEENFNKSTLFGTLVASLGALLLFFKR

SEQ ID NO: 1741436 - protein, 25 aa, Staphylococcus epidermidis
GEEVKFKKIPAHRKGILGLLVAVVL

SEQ ID NO: 1741437 - protein, 21 aa, Staphylococcus epidermidis
GEFRTASYDNTIAFSTSSGQG

SEQ ID NO: 1741438 - protein, 30 aa, Staphylococcus epidermidis
GEHIPSVKVEPKFNFLSVLFQITLAIVGII

SEQ ID NO: 1741439 - protein, 19 aa, Staphylococcus epidermidis
GEIPKIWHGGIAIHGGLIG

SEQ ID NO: 1741440 - protein, 31 aa, Staphylococcus epidermidis
GEKDNGVGAAKVYKDGRIEAQTPRDANNVLT

SEQ ID NO: 1741441 - protein, 21 aa, Staphylococcus epidermidis
GESFISNPLLVYMEPYASSTA

SEQ ID NO: 1741442 - protein, 17 aa, Staphylococcus epidermidis
GESITLTVIRDGKTKDI

SEQ ID NO: 1741443 - protein, 22 aa, Staphylococcus epidermidis
GESKVIWVGCFFLFGVHIIMGR

SEQ ID NO: 1741444 - protein, 26 aa, Staphylococcus epidermidis
GESRISGKTWGTILIALFALMETMIK

SEQ ID NO: 1741445 - protein, 18 aa, Staphylococcus epidermidis
GESVSIKSQRIYIDDRQV

SEQ ID NO: 1741446 - protein, 30 aa, Staphylococcus epidermidis; identical to SEQ ID NO: 1574161

SEQ ID NO: 1741447 - protein, 33 aa, Staphylococcus epidermidis
GEVIKQHWMPVAVVLMSLGGALIFMARRKKHQN

SEQ ID NO: 1741448 - protein, 21 aa, Staphylococcus epidermidis
GEVPQSLSNVILRATEKDKHN

SEQ ID NO: 1741449 - protein, 27 aa, Staphylococcus epidermidis
GFAPLLSNPYVLGFGAIVAASAGVGYL

SEQ ID NO: 1741450 - protein, 19 aa, Staphylococcus epidermidis
GFAVFFSFIFGFPIGTLMG

SEQ ID NO: 1741451 - protein, 20 aa, Staphylococcus epidermidis
GFAVFFSFIFGFPVGTLMGL

SEQ ID NO: 1741452 - protein, 17 aa, Staphylococcus epidermidis
GFGFDLSSTLVFFIVAV

SEQ ID NO: 1741453 - protein, 20 aa, Staphylococcus epidermidis
GFGGGLAYSGLVIDWNIPTN

SEQ ID NO: 1741454 - protein, 18 aa, Staphylococcus epidermidis
GFIAAIPIILFSSIFILV

SEQ ID NO: 1741455 - protein, 19 aa, Staphylococcus epidermidis
GFIEIIWVTGLDQAHSLFT

SEQ ID NO: 1741456 - protein, 17 aa, Staphylococcus epidermidis
GFILKFDTIAIILIAAV

SEQ ID NO: 1741457 - protein, 23 aa, Staphylococcus epidermidis
GFISSIFYWFVIIFIINYTTAYT

SEQ ID NO: 1741458 - protein, 24 aa, Staphylococcus epidermidis
GFITSIFYWFFLIFMINYTVAFAE

SEQ ID NO: 1741459 - protein, 20 aa, Staphylococcus epidermidis
GFLAEFSHRLPFYFAGTLGA

SEQ ID NO: 1741460 - protein, 24 aa, Staphylococcus epidermidis
GFLMKMVLAQTFILALIGTLIGLV

SEQ ID NO: 1741461 - protein, 24 aa, Staphylococcus epidermidis
GFMPNGIVGFFFALSIVIGSYQGV

SEQ ID NO: 1741462 - protein, 18 aa, Staphylococcus epidermidis
GFTHMWLYMYAYSFYLFF

SEQ ID NO: 1741463 - protein, 17 aa, Staphylococcus epidermidis
GFTSILAGVSWNITVFN

SEQ ID NO: 1741464 - protein, 25 aa, Staphylococcus epidermidis
GFVIGWTYWICWVVSSMSDLTAMGQ

SEQ ID NO: 1741465 - protein, 33 aa, Staphylococcus epidermidis
GFWMFREYFGLTIKETFLTWSLLETIISVSGII

SEQ ID NO: 1741466 - protein, 20 aa, Staphylococcus epidermidis
GFYFIYRLIAVHPKDIVNRW

SEQ ID NO: 1741467 - protein, 22 aa, Staphylococcus epidermidis
GFYILYQFLFKRAHEHHHVGNL

SEQ ID NO: 1741468 - protein, 20 aa, Staphylococcus epidermidis
GFYILYQFLFKRTHEHHTHV

SEQ ID NO: 1741469 - protein, 17 aa, Staphylococcus epidermidis
GFYQLKQVMTIPAISQV

SEQ ID NO: 1741470 - protein, 27 aa, Staphylococcus epidermidis
GFYQTPKYSLGNYVWYDTNKDGIQGDD

SEQ ID NO: 1741471 - protein, 25 aa, Staphylococcus epidermidis
GGAFYFSIGVFKNFYMMLAGQVCLA

SEQ ID NO: 1741472 - protein, 22 aa, Staphylococcus epidermidis
GGALGALIRFCLSMLNEGSTFP

SEQ ID NO: 1741473 - protein, 22 aa, Staphylococcus epidermidis
GGALGALIRFCLSMLNEGSTIP

SEQ ID NO: 1741474 - protein, 17 aa, Staphylococcus epidermidis
GGALVWLLSDTEFAAEV

SEQ ID NO: 1741475 - protein, 24 aa, Staphylococcus epidermidis
GGFIGGLLITLIGYYFKNNRQLFW

SEQ ID NO: 1741476 - protein, 26 aa, Staphylococcus epidermidis
GGFVIGWTYWVCWIVSSMSDLTAMGQ

SEQ ID NO: 1741477 - protein, 18 aa, Staphylococcus epidermidis
GGIGAVFRALITNICQSL

SEQ ID NO: 1741478 - protein, 23 aa, Staphylococcus epidermidis
GGIGCAVSMLFLSKIIDNNSRGF

SEQ ID NO: 1741479 - protein, 25 aa, Staphylococcus epidermidis
GGIGDLALVYGYQRFDTMVIIITVV

SEQ ID NO: 1741480 - protein, 29 aa, Staphylococcus epidermidis
GGKTILLCGLTIFVSFLVILFAKFDLFKS

SEQ ID NO: 1741481 - protein, 26 aa, Staphylococcus epidermidis
GGLCLDRIQQDWLLFGLLSIITSFSI

SEQ ID NO: 1741482 - protein, 25 aa, Staphylococcus epidermidis
GGLCTIIGGLIAVWCRNFIENKRKV

SEQ ID NO: 1741483 - protein, 22 aa, Staphylococcus epidermidis
GGLLIKFKIISTLIIKIKNFVN

SEQ ID NO: 1741484 - protein, 20 aa, Staphylococcus epidermidis
GGLLSAIGIAGMDRVTQFNI

SEQ ID NO: 1741485 - protein, 17 aa, Staphylococcus epidermidis
GGLTLLSIVAYSLLSTK

SEQ ID NO: 1741486 - protein, 22 aa, Staphylococcus epidermidis
GGMLPFLMLFILSVKFKLLPTR

SEQ ID NO: 1741487 - protein, 17 aa, Staphylococcus epidermidis
GGMLWALLAPIIAVGTL

SEQ ID NO: 1741488 - protein, 17 aa, Staphylococcus epidermidis
GGMLWALLAPIIAVSTV

SEQ ID NO: 1741489 - protein, 20 aa, Staphylococcus epidermidis
GGPIPISWTPFGELFSGLFM

SEQ ID NO: 1741490 - protein, 20 aa, Staphylococcus epidermidis
GGPMPISWTPFGELFSGLFM

SEQ ID NO: 1741491 - protein, 18 aa, Staphylococcus epidermidis
GGSLLIRQMLRSDMDLEP

SEQ ID NO: 1741492 - protein, 23 aa, Staphylococcus epidermidis
GGTKESAGFGFIGMVGPINAFKF

SEQ ID NO: 1741493 - protein, 17 aa, Staphylococcus epidermidis
GGTLSINTLLIVAVLGA

SEQ ID NO: 1741494 - protein, 19 aa, Staphylococcus epidermidis
GGVAWLIHPLFDFLKNMIN

SEQ ID NO: 1741495 - protein, 17 aa, Staphylococcus epidermidis
GGVSLAVLWVLLFVMAY

SEQ ID NO: 1741496 - protein, 22 aa, Staphylococcus epidermidis
GGYLTKIRTGAISGVATKYLSR

SEQ ID NO: 1741497 - protein, 27 aa, Staphylococcus epidermidis
GHHMLLRYLDWLGHALTGNLGYSFSTH

SEQ ID NO: 1741498 - protein, 17 aa, Staphylococcus epidermidis
GHILIKLLFAVALSIIG

SEQ ID NO: 1741499 - protein, 18 aa, Staphylococcus epidermidis
GHILIKLLFAVVLSIVGT

SEQ ID NO: 1741500 - protein, 25 aa, Staphylococcus epidermidis
GHKEPKRYILAWVLLGFCIVMIYQF

SEQ ID NO: 1741501 - protein, 24 aa, Staphylococcus epidermidis
GHKTWFKFFIGVLLLNLIVLLAGQ

SEQ ID NO: 1741502 - protein, 23 aa, Staphylococcus epidermidis
GHLTKAPVLLAIFGIIVTVILYT

SEQ ID NO: 1741503 - protein, 24 aa, Staphylococcus epidermidis
GHNIASFYSLLPWFIITVPIVLLL

SEQ ID NO: 1741504 - protein, 25 aa, Staphylococcus epidermidis
GHNISNFFSVLPWFIITVPLVLLLG

SEQ ID NO: 1741505 - protein, 25 aa, Staphylococcus epidermidis
GHPPFLRLYLITWMMHLILIGGSRI

SEQ ID NO: 1741506 - protein, 17 aa, Staphylococcus epidermidis
GHTGNGAFLMFIAFYFK

SEQ ID NO: 1741507 - protein, 20 aa, Staphylococcus epidermidis
GIAASGAFAFGAMAVSAIKM

SEQ ID NO: 1741508 - protein, 24 aa, Staphylococcus epidermidis
GIADANGYGAGWFINSNDHTIYHT

SEQ ID NO: 1741509 - protein, 19 aa, Staphylococcus epidermidis
GIDKVLWFFIAVIIGSLVT

SEQ ID NO: 1741510 - protein, 28 aa, Staphylococcus epidermidis
GIFFLIRYIKKWTRSYIMFNFAFSSMNL

SEQ ID NO: 1741511 - protein, 19 aa, Staphylococcus epidermidis
GIFSIPITIIWIVAITNAI

SEQ ID NO: 1741512 - protein, 17 aa, Staphylococcus epidermidis
GIFTFFLLTVFTITLKT

SEQ ID NO: 1741513 - protein, 28 aa, Staphylococcus epidermidis
GIFTSFIAGILWLIAGIMLLARKPKDDI

SEQ ID NO: 1741514 - protein, 20 aa, Staphylococcus epidermidis
GIGHTRWATHGVPNYENSHP

SEQ ID NO: 1741515 - protein, 28 aa, Staphylococcus epidermidis
GIIATFLGWKWIFIFSIVVSVISLILIK

SEQ ID NO: 1741516 - protein, 18 aa, Staphylococcus epidermidis
GIIGVIFAVWLLSLVEKR

SEQ ID NO: 1741517 - protein, 17 aa, Staphylococcus epidermidis
GIIIRSIVGLSWLYVGT

SEQ ID NO: 1741518 - protein, 17 aa, Staphylococcus epidermidis
GIIKAHDAENLIYDVTF

SEQ ID NO: 1741519 - protein, 23 aa, Staphylococcus epidermidis
GIIPILICMIILLSFIATHVLAH

SEQ ID NO: 1741520 - protein, 24 aa, Staphylococcus epidermidis
GIISFKIAVGVLITGTFSIFDAVQ

SEQ ID NO: 1741521 - protein, 22 aa, Staphylococcus epidermidis
GIIVRVKFSTIVQETGFVTGYI

SEQ ID NO: 1741522 - protein, 18 aa, Staphylococcus epidermidis
GILACINLGVSPVFAVIV

SEQ ID NO: 1741523 - protein, 18 aa, Staphylococcus epidermidis
GILPKALMRAMFQDIVDA

SEQ ID NO: 1741524 - protein, 21 aa, Staphylococcus epidermidis
GILTLWYYWIKRRKNIKKMID

SEQ ID NO: 1741525 - protein, 17 aa, Staphylococcus epidermidis
GILTLWYYWIKRRNNIK

SEQ ID NO: 1741526 - protein, 31 aa, Staphylococcus epidermidis
GIPIAACGLLAPWIAGAAMALSSVSVVTNAL

SEQ ID NO: 1741527 - protein, 30 aa, Staphylococcus epidermidis
GIRQEFLMILPALIGYLLGFPMFGILISTG

SEQ ID NO: 1741528 - protein, 25 aa, Staphylococcus epidermidis
GISKAGSIFPILSPILGWIGVFMTG

SEQ ID NO: 1741529 - protein, 26 aa, Staphylococcus epidermidis
GISPNEFKFGLSFLTRSVALARFPWL

SEQ ID NO: 1741530 - protein, 21 aa, Staphylococcus epidermidis
GISVAYIYSLYAFYMNNFSSA

SEQ ID NO: 1741531 - protein, 20 aa, Staphylococcus epidermidis
GITFSKRKLDIEIDQFIDKL

SEQ ID NO: 1741532 - protein, 19 aa, Staphylococcus epidermidis
GITQINWFAVIALSLGGMV

SEQ ID NO: 1741533 - protein, 18 aa, Staphylococcus epidermidis
GITVITCQFFVYFFSKRT

SEQ ID NO: 1741534 - protein, 17 aa, Staphylococcus epidermidis
GITWRILAPLFIAAFVG

SEQ ID NO: 1741535 - protein, 27 aa, Staphylococcus epidermidis
GIVLLVISIHWWIKYLGFKKDERLKET

SEQ ID NO: 1741536 - protein, 24 aa, Staphylococcus epidermidis
GIVMGTGFAFWSFVLAIVLIVVDV

SEQ ID NO: 1741537 - protein, 19 aa, Staphylococcus epidermidis
GIYIPSKFTHEITGTLRKH

SEQ ID NO: 1741538 - protein, 17 aa, Staphylococcus epidermidis
GKANDLLDIEKRAKQAK

SEQ ID NO: 1741539 - protein, 18 aa, Staphylococcus epidermidis
GKFGFSLLHEGGDISFDN

SEQ ID NO: 1741540 - protein, 28 aa, Staphylococcus epidermidis
GKFIAKNKWVSIVAWLIVLGVIITPLMI

SEQ ID NO: 1741541 - protein, 22 aa, Staphylococcus epidermidis
GKFLIYICYFFIMCLISLISTI

SEQ ID NO: 1741542 - protein, 26 aa, Staphylococcus epidermidis
GKGISRGKILAAMLFGMFIAILNQTL

SEQ ID NO: 1741543 - protein, 29 aa, Staphylococcus epidermidis
GKIKLLNCILCYFNIILVCVMLFTYMGYG

SEQ ID NO: 1741544 - protein, 17 aa, Staphylococcus epidermidis
GKIKPIYFIGGILGMAF

SEQ ID NO: 1741545 - protein, 21 aa, Staphylococcus epidermidis
GKIMTSRGMVLYINRNTRTAK

SEQ ID NO: 1741546 - protein, 17 aa, Staphylococcus epidermidis
GKIPGVSVLIIKDNKIF

SEQ ID NO: 1741547 - protein, 20 aa, Staphylococcus epidermidis
GKKLTFIISPQWFTNHGLTN

SEQ ID NO: 1741548 - protein, 19 aa, Staphylococcus epidermidis
GKKYLFFDNYQFDVPHYSI

SEQ ID NO: 1741549 - protein, 17 aa, Staphylococcus epidermidis
GKLALIFDDGIEAEVER

SEQ ID NO: 1741550 - protein, 18 aa, Staphylococcus epidermidis
GKLFPFVFIASGGGAILA

SEQ ID NO: 1741551 - protein, 21 aa, Staphylococcus epidermidis
GKLSFLQIFFEVMSAFGTCGL

SEQ ID NO: 1741552 - protein, 20 aa, Staphylococcus epidermidis
GKLSFLQVFFEVMSAFGTCG

SEQ ID NO: 1741553 - protein, 17 aa, Staphylococcus epidermidis
GKLTIYLGYSPGVGKTY

SEQ ID NO: 1741554 - protein, 19 aa, Staphylococcus epidermidis
GKLTIYLGYSPGVGKTYEM

SEQ ID NO: 1741555 - protein, 17 aa, Staphylococcus epidermidis
GKLTYQRFLNGYPTFNK

SEQ ID NO: 1741556 - protein, 19 aa, Staphylococcus epidermidis
GKNYLNFLISYLIYTVIAA

SEQ ID NO: 1741557 - protein, 22 aa, Staphylococcus epidermidis
GKPFKYDHHYNITFKFDGKDSG

SEQ ID NO: 1741558 - protein, 23 aa, Staphylococcus epidermidis
GKPLTDGEFQFTLSEGDHVLQTV

SEQ ID NO: 1741559 - protein, 22 aa, Staphylococcus epidermidis
GKRPIIKRYVALIGSALTLIVA

SEQ ID NO: 1741560 - protein, 25 aa, Staphylococcus epidermidis
GKRPIIKRYVALIGTLLTLVVALIN

SEQ ID NO: 1741561 - protein, 29 aa, Staphylococcus epidermidis
GKSPVAPITAATMTPAMTHAHGYGQGYGQ

SEQ ID NO: 1741562 - protein, 25 aa, Staphylococcus epidermidis
GKTETPLRHVIPFNEENRYLVMPAL

SEQ ID NO: 1741563 - protein, 26 aa, Staphylococcus epidermidis
GKTVMPRKESTPEPPTVSANEMQASV

SEQ ID NO: 1741564 - protein, 25 aa, Staphylococcus epidermidis
GKTYIKHFLLFNGLMGGLSFVLLLI

SEQ ID NO: 1741565 - protein, 21 aa, Staphylococcus epidermidis
GKTYLNYFISYFIYAIVGVIL

SEQ ID NO: 1741566 - protein, 34 aa, Staphylococcus epidermidis
GKVDSNGNFSIAIPSDYVLTGKETIKITSIDKGD

SEQ ID NO: 1741567 - protein, 39 aa, Staphylococcus epidermidis
GKVDSNGNFSIAIPSYYVLTGKETIKITSIDKGDNVSPA

SEQ ID NO: 1741568 - protein, 25 aa, Staphylococcus epidermidis
GKVFGCLGIALAMYATTPKENRKKV

SEQ ID NO: 1741569 - protein, 18 aa, Staphylococcus epidermidis
GKYAKSVILALITLVLFI

SEQ ID NO: 1741570 - protein, 17 aa, Staphylococcus epidermidis
GKYEFTGLENGDYTIEF

SEQ ID NO: 1741571 - protein, 25 aa, Staphylococcus epidermidis
GKYMAYGILVFFAFIFVILLINSST

SEQ ID NO: 1741572 - protein, 35 aa, Staphylococcus epidermidis
GKYQFDNLDSGNYIIHFEKPEGMTQTTANSGNDDE

SEQ ID NO: 1741573 - protein, 18 aa, Staphylococcus epidermidis
GLAALLVGISFGFNSNIV

SEQ ID NO: 1741574 - protein, 23 aa, Staphylococcus epidermidis
GLAAQMTYHFVLAMFPMLIFLLT

SEQ ID NO: 1741575 - protein, 24 aa, Staphylococcus epidermidis
GLDGLRAIAVIGIIIYHLNKQWLT

SEQ ID NO: 1741576 - protein, 25 aa, Staphylococcus epidermidis
GLDGLRAIAVLGIIIYHLNKKWLTG

SEQ ID NO: 1741577 - protein, 19 aa, Staphylococcus epidermidis
GLEGAAFAIVGWVGIKLVV

SEQ ID NO: 1741578 - protein, 18 aa, Staphylococcus epidermidis
GLFGSDLHNVLGLVSVIS

SEQ ID NO: 1741579 - protein, 20 aa, Staphylococcus epidermidis
GLFILWKPLAYIIGGLLLIG

SEQ ID NO: 1741580 - protein, 19 aa, Staphylococcus epidermidis
GLFLHPIAIGFTFISMVIL

SEQ ID NO: 1741581 - protein, 27 aa, Staphylococcus epidermidis
GLGAMWKFPYMAGIYGGGAFLFMFLIF

SEQ ID NO: 1741582 - protein, 27 aa, Staphylococcus epidermidis
GLGAMWKFPYMAGIYGGGAFLLMFLIF

SEQ ID NO: 1741583 - protein, 17 aa, Staphylococcus epidermidis
GLGVSTLLAERIKKLSQ

SEQ ID NO: 1741584 - protein, 29 aa, Staphylococcus epidermidis
GLHHIFHAPFWFEFGSWKNAAGDIIRGDQ

SEQ ID NO: 1741585 - protein, 35 aa, Staphylococcus epidermidis
GLIAMNRYQVMPGYKVKFIFMILVTMIVFVLINTY

SEQ ID NO: 1741586 - protein, 22 aa, Staphylococcus epidermidis
GLIGGFFLARKYMMDYLKKNPP

SEQ ID NO: 1741587 - protein, 17 aa, Staphylococcus epidermidis
GLIGSWVALILYAVTSA

SEQ ID NO: 1741588 - protein, 20 aa, Staphylococcus epidermidis
GLIHLCIGFTIYVIFLIIYQ

SEQ ID NO: 1741589 - protein, 29 aa, Staphylococcus epidermidis
GLILSISNWRRIFAFLTFIAVIVLVGVFL

SEQ ID NO: 1741590 - protein, 17 aa, Staphylococcus epidermidis
GLIPLFILLCFPFTPNT

SEQ ID NO: 1741591 - protein, 27 aa, Staphylococcus epidermidis
GLKDGKYQVMIVIPKNFSKLAMQLDEK

SEQ ID NO: 1741592 - protein, 24 aa, Staphylococcus epidermidis
GLLEEAAMLVVIFSLGELMESYAA

SEQ ID NO: 1741593 - protein, 17 aa, Staphylococcus epidermidis
GLLGGRVSEDINFGEVS

SEQ ID NO: 1741594 - protein, 24 aa, Staphylococcus epidermidis
GLLIGMALVRFRLTLMRRGIENIN

SEQ ID NO: 1741595 - protein, 19 aa, Staphylococcus epidermidis
GLLILYYICRLISEERLYR

SEQ ID NO: 1741596 - protein, 19 aa, Staphylococcus epidermidis
GLLLGCMALGIAISELVWG

SEQ ID NO: 1741597 - protein, 25 aa, Staphylococcus epidermidis
GLLLTRPTFVIPMLLQGLTYVMLFS

SEQ ID NO: 1741598 - protein, 19 aa, Staphylococcus epidermidis
GLLSISVILNAIFKDATKV

SEQ ID NO: 1741599 - protein, 24 aa, Staphylococcus epidermidis
GLLTRSYYNYSWYLYLMKNGEEEV

SEQ ID NO: 1741600 - protein, 19 aa, Staphylococcus epidermidis
GLLVKLCLNINFNSNTENQ

SEQ ID NO: 1741601 - protein, 19 aa, Staphylococcus epidermidis
GLMGLKGLPIIATIALITL

SEQ ID NO: 1741602 - protein, 17 aa, Staphylococcus epidermidis
GLNGLIKGVNWVADKLG

SEQ ID NO: 1741603 - protein, 22 aa, Staphylococcus epidermidis
GLPFNEGWDVAQQMAKKIVTNE

SEQ ID NO: 1741604 - protein, 19 aa, Staphylococcus epidermidis
GLPTISWIGFYPSIETITA

SEQ ID NO: 1741605 - protein, 26 aa, Staphylococcus epidermidis
GLRDVNVNLPQGWTKSFTINPNNNTE

SEQ ID NO: 1741606 - protein, 26 aa, Staphylococcus epidermidis
GLRDVNVNLPQGWTKTFTINPNNNTE

SEQ ID NO: 1741607 - protein, 17 aa, Staphylococcus epidermidis
GLSFLWFPIFSIIFSLI

SEQ ID NO: 1741608 - protein, 18 aa, Staphylococcus epidermidis
GLSILRFLISAGIVLLCI

SEQ ID NO: 1741609 - protein, 17 aa, Staphylococcus epidermidis
GLSIMYLLLTGMSLIVM

SEQ ID NO: 1741610 - protein, 24 aa, Staphylococcus epidermidis
GLSIPEFVIMIALASFFHPSIWNL

SEQ ID NO: 1741611 - protein, 19 aa, Staphylococcus epidermidis
GLSNFKLQFIVIFIISFIA

SEQ ID NO: 1741612 - protein, 20 aa, Staphylococcus epidermidis
GLTQINWFAVIALSVGGMIA

SEQ ID NO: 1741613 - protein, 26 aa, Staphylococcus epidermidis
GLVAFKTLLLWLGFVALGYQVSKYFN

SEQ ID NO: 1741614 - protein, 18 aa, Staphylococcus epidermidis
GLVLSITLAVIFIATIGN

SEQ ID NO: 1741615 - protein, 21 aa, Staphylococcus epidermidis
GLVNFCRLVPILLLSVWAGSI

SEQ ID NO: 1741616 - protein, 17 aa, Staphylococcus epidermidis
GLYAIPFYFRFLHVRSF

SEQ ID NO: 1741617 - protein, 19 aa, Staphylococcus epidermidis
GLYMLFLIVKKLRKYVISN

SEQ ID NO: 1741618 - protein, 19 aa, Staphylococcus epidermidis
GLYMLFLIVKKLRKYVTSS

SEQ ID NO: 1741619 - protein, 19 aa, Staphylococcus epidermidis
GMAVFEIFITTYLLKLIST

SEQ ID NO: 1741620 - protein, 20 aa, Staphylococcus epidermidis
GMGCIVPAIIGFVVGLIVYL

SEQ ID NO: 1741621 - protein, 21 aa, Staphylococcus epidermidis
GMKKLKPNHYLKIKEKLDTVK

SEQ ID NO: 1741622 - protein, 17 aa, Staphylococcus epidermidis
GMLLKRRVKTKINSASS

SEQ ID NO: 1741623 - protein, 23 aa, Staphylococcus epidermidis
GMSPKLVMNIAIAFYIIAALLGI

SEQ ID NO: 1741624 - protein, 18 aa, Staphylococcus epidermidis
GMVIHWILFFLMIFFVFI

SEQ ID NO: 1741625 - protein, 25 aa, Staphylococcus epidermidis
GMYEIIPGFIISVLITYIVSKLTKK

SEQ ID NO: 1741626 - protein, 37 aa, Staphylococcus epidermidis
GNASWTFVLSWLPIHAKWLIASFYIFMLMIMIWLSVV

SEQ ID NO: 1741627 - protein, 25 aa, Staphylococcus epidermidis
GNDDEKDADGEDVRVTITDHDDFSI

SEQ ID NO: 1741628 - protein, 22 aa, Staphylococcus epidermidis
GNFFTKYGSFFIKGIKDTILIS

SEQ ID NO: 1741629 - protein, 24 aa, Staphylococcus epidermidis
GNFLKRYTNTYSRDEEKLIQSVSK

SEQ ID NO: 1741630 - protein, 27 aa, Staphylococcus epidermidis
GNGADWIVISFGWGFAVTMGFYAVGTF

SEQ ID NO: 1741631 - protein, 30 aa, Staphylococcus epidermidis
GNGAFLMFIAFYFKKLRTQKIVFSIGLCYS

SEQ ID NO: 1741632 - protein, 17 aa, Staphylococcus epidermidis
GNGAWFIAMGYLGFLLF

SEQ ID NO: 1741633 - protein, 28 aa, Staphylococcus epidermidis
GNHIMTWISFCVGRGIFIFSKGVFDKPF

SEQ ID NO: 1741634 - protein, 26 aa, Staphylococcus epidermidis
GNHRLEEAKQLAIAHLNTLNDLNDAQ

SEQ ID NO: 1741635 - protein, 22 aa, Staphylococcus epidermidis
GNKKFSSVFIYSSIIVAIVVLI

SEQ ID NO: 1741636 - protein, 18 aa, Staphylococcus epidermidis
GNPLGLEFANSVTSGIIS

SEQ ID NO: 1741637 - protein, 26 aa, Staphylococcus epidermidis
GNSALKVLFGHALRNALIPIITIIVP

SEQ ID NO: 1741638 - protein, 24 aa, Staphylococcus epidermidis
GPASLLAIEFGWFLTEMGRQPWII

SEQ ID NO: 1741639 - protein, 23 aa, Staphylococcus epidermidis
GPFILGIIIPFIGYRHLYMAMGM

SEQ ID NO: 1741640 - protein, 27 aa, Staphylococcus epidermidis
GPFILGMIIPFLGYRNLYILMGVVVII

SEQ ID NO: 1741641 - protein, 17 aa, Staphylococcus epidermidis
GPGGLIIMNDMSEKPDS

SEQ ID NO: 1741642 - protein, 19 aa, Staphylococcus epidermidis
GPKDFIFRVLSGVAIGIVA

SEQ ID NO: 1741643 - protein, 20 aa, Staphylococcus epidermidis
GPKDFIFRVLSGVAIGIVAG

SEQ ID NO: 1741644 - protein, 17 aa, Staphylococcus epidermidis
GPLGLDKQVEWIFDVVR

SEQ ID NO: 1741645 - protein, 23 aa, Staphylococcus epidermidis
GPLKRKIKGNVLNRVNNSENEIK

SEQ ID NO: 1741646 - protein, 32 aa, Staphylococcus epidermidis
GPLLGGAILEFASWHWLFYINIPIAILAIILV

SEQ ID NO: 1741647 - protein, 17 aa, Staphylococcus epidermidis
GPMPIVLMSLIKSLFHQ

SEQ ID NO: 1741648 - protein, 20 aa, Staphylococcus epidermidis
GPVANFLAGVSFLLSAYYVY

SEQ ID NO: 1741649 - protein, 18 aa, Staphylococcus epidermidis
GPVLYGFFGHSSIAIDED

SEQ ID NO: 1741650 - protein, 17 aa, Staphylococcus epidermidis
GQAKLLDQVMENLEESI

SEQ ID NO: 1741651 - protein, 21 aa, Staphylococcus epidermidis
GQEVMQFFTPFGLWSYIGVLI

SEQ ID NO: 1741652 - protein, 18 aa, Staphylococcus epidermidis
GQGHLDEALNIATYLDDN

SEQ ID NO: 1741653 - protein, 22 aa, Staphylococcus epidermidis
GQHFLLRYIDWVGHALTGNLGY

SEQ ID NO: 1741654 - protein, 18 aa, Staphylococcus epidermidis
GQIPGVLALFILTICIIG

SEQ ID NO: 1741655 - protein, 17 aa, Staphylococcus epidermidis
GQIPGVLALFVLTICII

SEQ ID NO: 1741656 - protein, 18 aa, Staphylococcus epidermidis
GQLHPVVFSLSYFLMSFA

SEQ ID NO: 1741657 - protein, 29 aa, Staphylococcus epidermidis
GQLSNARTSLDRNVFFGTLGQSRSYTISY

SEQ ID NO: 1741658 - protein, 28 aa, Staphylococcus epidermidis
GQLTLFFWFFKLHYSFGHIINSKIFAQE

SEQ ID NO: 1741659 - protein, 28 aa, Staphylococcus epidermidis
GQLTLFFWFFKLHYSFGHIINSKIFTQE

SEQ ID NO: 1741660 - protein, 20 aa, Staphylococcus epidermidis
GQLTVIGFILFVYVAVRIYD

SEQ ID NO: 1741661 - protein, 18 aa, Staphylococcus epidermidis
GQMSIWNFLFLRRSLPLT

SEQ ID NO: 1741662 - protein, 18 aa, Staphylococcus epidermidis
GQNLDFNSIDTFKDDIFK

SEQ ID NO: 1741663 - protein, 17 aa, Staphylococcus epidermidis
GQNWSAPINGSTVRSGL

SEQ ID NO: 1741664 - protein, 17 aa, Staphylococcus epidermidis
GQTFTRNLTDWIKNSGG

SEQ ID NO: 1741665 - protein, 19 aa, Staphylococcus epidermidis
GQVCLAIFLAILLGLGISY

SEQ ID NO: 1741666 - protein, 21 aa, Staphylococcus epidermidis
GRALKLFWSNYVNFKGRSRRS

SEQ ID NO: 1741667 - protein, 18 aa, Staphylococcus epidermidis
GRFWDFIQSIQFDYLGYI

SEQ ID NO: 1741668 - protein, 19 aa, Staphylococcus epidermidis
GRGSEPLKITIRIRLTKRK

SEQ ID NO: 1741669 - protein, 30 aa, Staphylococcus epidermidis
GRKAQEAYLSYRLEQEYSKDEIFQVYLNKI

SEQ ID NO: 1741670 - protein, 33 aa, Staphylococcus epidermidis; identical to SEQ ID NO: 1575142

SEQ ID NO: 1741671 - protein, 20 aa, Staphylococcus epidermidis
GRLMKFIPHSVMIGFVNALG

SEQ ID NO: 1741672 - protein, 24 aa, Staphylococcus epidermidis
GRLQSFKVIFAIIITLAIVIGTYW

SEQ ID NO: 1741673 - protein, 24 aa, Staphylococcus epidermidis
GRLQSFKVIFAIIITLITVIGTYW

SEQ ID NO: 1741674 - protein, 29 aa, Staphylococcus epidermidis
GRNLKDGEFHFALKNDKEEVLATGVNDAQ

SEQ ID NO: 1741675 - protein, 17 aa, Staphylococcus epidermidis
GRPLKADEFDFVLKNEQ

SEQ ID NO: 1741676 - protein, 18 aa, Staphylococcus epidermidis
GRSFTIWASLSLLIQSFV

SEQ ID NO: 1741677 - protein, 29 aa, Staphylococcus epidermidis
GRSIREFISGVLLVPAIVSFIWFSVFGVL

SEQ ID NO: 1741678 - protein, 25 aa, Staphylococcus epidermidis
GRTGVKGAANGIAWVIESAHEGTGF

SEQ ID NO: 1741679 - protein, 18 aa, Staphylococcus epidermidis
GRVFEHFNGLYRFQGLRR

SEQ ID NO: 1741680 - protein, 19 aa, Staphylococcus epidermidis
GRVPAIIALVVYALLPILR

SEQ ID NO: 1741681 - protein, 18 aa, Staphylococcus epidermidis
GRYLRYFRNLTRDIQKRP

SEQ ID NO: 1741682 - protein, 24 aa, Staphylococcus epidermidis
GSAIRELLKPYGIAMLTSPFVMMT

SEQ ID NO: 1741683 - protein, 19 aa, Staphylococcus epidermidis
GSARVIVRMFGFDPDAQTD

SEQ ID NO: 1741684 - protein, 25 aa, Staphylococcus epidermidis
GSASAKWGILAPIFVPMLILVGFHP

SEQ ID NO: 1741685 - protein, 17 aa, Staphylococcus epidermidis
GSFANRLATAAKTKKSK

SEQ ID NO: 1741686 - protein, 21 aa, Staphylococcus epidermidis
GSFFRQRLGDEVLENLIEPLM

SEQ ID NO: 1741687 - protein, 20 aa, Staphylococcus epidermidis
GSFIVYCLNAPKGEFLHMLL

SEQ ID NO: 1741688 - protein, 24 aa, Staphylococcus epidermidis
GSFLKRYTNTYSRDEEKLIQAVSK

SEQ ID NO: 1741689 - protein, 17 aa, Staphylococcus epidermidis
GSFYVAAFFRFVLVMIG

SEQ ID NO: 1741690 - protein, 29 aa, Staphylococcus epidermidis
GSGFLSGLICAIVLFLIIVVIYRQPLLAL

SEQ ID NO: 1741691 - protein, 26 aa, Staphylococcus epidermidis
GSGGNFRLQNFLARIKPADYYYTTLD

SEQ ID NO: 1741692 - protein, 23 aa, Staphylococcus epidermidis
GSGISLFLGLSFLWFPIFSIIFS

SEQ ID NO: 1741693 - protein, 24 aa, Staphylococcus epidermidis
GSGKSITCKALIGLNAQRLSVSGD

SEQ ID NO: 1741694 - protein, 23 aa, Staphylococcus epidermidis
GSGKSVCINGIITSILLNTKPHE

SEQ ID NO: 1741695 - protein, 23 aa, Staphylococcus epidermidis
GSGLASLAAACFLIRDGQMKGKN

SEQ ID NO: 1741696 - protein, 19 aa, Staphylococcus epidermidis
GSIALWIVSIFAIIISLVA

SEQ ID NO: 1741697 - protein, 17 aa, Staphylococcus epidermidis
GSIFFLFMLDWETALIA

SEQ ID NO: 1741698 - protein, 19 aa, Staphylococcus epidermidis
GSILFFKFLTEFINIMIHG

SEQ ID NO: 1741699 - protein, 18 aa, Staphylococcus epidermidis
GSIVISILLGIVLFLAVI

SEQ ID NO: 1741700 - protein, 21 aa, Staphylococcus epidermidis
GSKLGGTYLWPIVAISNICQG

SEQ ID NO: 1741701 - protein, 17 aa, Staphylococcus epidermidis
GSLGSLIDLPGIYDLSP

SEQ ID NO: 1741702 - protein, 17 aa, Staphylococcus epidermidis
GSLRIARSYFSIAGMIC

SEQ ID NO: 1741703 - protein, 17 aa, Staphylococcus epidermidis
GSLSTNVSDSTSTSTSD

SEQ ID NO: 1741704 - protein, 32 aa, Staphylococcus epidermidis
GSMITSVLLFFAFRTSNNFAIQHRIIASVGQM

SEQ ID NO: 1741705 - protein, 51 aa, Staphylococcus epidermidis
GSNTREARFLPNKILNIRYKLRPVNIETPREVTFNESLKYKTYAEIYVNTN

SEQ ID NO: 1741706 - protein, 23 aa, Staphylococcus epidermidis
GSNYFRFQYFNPLNASKYYENLD

SEQ ID NO: 1741707 - protein, 23 aa, Staphylococcus epidermidis
GSSVGRKDLEFTFVENNEENIYF

SEQ ID NO: 1741708 - protein, 17 aa, Staphylococcus epidermidis
GSSVGYKHLEFTFVENK

SEQ ID NO: 1741709 - protein, 24 aa, Staphylococcus epidermidis
GSSVKGGTLLAGYQNHAIKVGETM

SEQ ID NO: 1741710 - protein, 22 aa, Staphylococcus epidermidis
GSVDFAEDWSFWGIKYGLFIQS

SEQ ID NO: 1741711 - protein, 21 aa, Staphylococcus epidermidis
GSVFLPFLISGFLFYICLPFQ

SEQ ID NO: 1741712 - protein, 18 aa, Staphylococcus epidermidis
GSVSKGIISGLDRHVPVD

SEQ ID NO: 1741713 - protein, 17 aa, Staphylococcus epidermidis
GSWRMLIIYFISGLFGN

SEQ ID NO: 1741714 - protein, 26 aa, Staphylococcus epidermidis
GTASLLIGATLVFGINGQVKAAETDN

SEQ ID NO: 1741715 - protein, 27 aa, Staphylococcus epidermidis
GTASLLIGATLVFGINGQVKAAETDNI

SEQ ID NO: 1741716 - protein, 17 aa, Staphylococcus epidermidis
GTEFKITAIFILVTTLF

SEQ ID NO: 1741717 - protein, 17 aa, Staphylococcus epidermidis
GTEFKITGIFILVTALF

SEQ ID NO: 1741718 - protein, 17 aa, Staphylococcus epidermidis
GTFDWNSFKYIKKAPKT

SEQ ID NO: 1741719 - protein, 34 aa, Staphylococcus epidermidis
GTINLKNFWIRRIKRLLPAVFVLIVVVGIATLLF

SEQ ID NO: 1741720 - protein, 22 aa, Staphylococcus epidermidis
GTISGIPTKIGTYPITVTTTDA

SEQ ID NO: 1741721 - protein, 25 aa, Staphylococcus epidermidis
GTLCPRLNYCYPMKLLKLIHYFKTV

SEQ ID NO: 1741722 - protein, 17 aa, Staphylococcus epidermidis
GTLGIGHTRWATHGVPN

SEQ ID NO: 1741723 - protein, 18 aa, Staphylococcus epidermidis
GTLIALIFYMTQLTDPIE

SEQ ID NO: 1741724 - protein, 19 aa, Staphylococcus epidermidis
GTLISAYPVGLRYVDATNS

SEQ ID NO: 1741725 - protein, 18 aa, Staphylococcus epidermidis
GTLLWVVLGKHIGIRERQ

SEQ ID NO: 1741726 - protein, 17 aa, Staphylococcus epidermidis
GTLPGMAVFEIFITTYL

SEQ ID NO: 1741727 - protein, 17 aa, Staphylococcus epidermidis
GTMGSIIVLRGLSLMGD

SEQ ID NO: 1741728 - protein, 17 aa, Staphylococcus epidermidis
GTNIVWANYFGRKHVGS

SEQ ID NO: 1741729 - protein, 24 aa, Staphylococcus epidermidis
GTNKDANIIIGMIQNMDDARALLN

SEQ ID NO: 1741730 - protein, 23 aa, Staphylococcus epidermidis
GTNKDVNIIIGMIQNMDDARALL

SEQ ID NO: 1741731 - protein, 19 aa, Staphylococcus epidermidis
GTPSEVGSYDIIVTTTDEN

SEQ ID NO: 1741732 - protein, 37 aa, Staphylococcus epidermidis
GTQTLFDKRLDAMQNFPTGWLKAMVNIPDNMNQVRIS

SEQ ID NO: 1741733 - protein, 19 aa, Staphylococcus epidermidis
GTTEGTWVNLLFKSLSLSM

SEQ ID NO: 1741734 - protein, 18 aa, Staphylococcus epidermidis
GTTILGIVSLFSWGLGYF

SEQ ID NO: 1741735 - protein, 18 aa, Staphylococcus epidermidis
GTTVLGIISLFSWGLGYF

SEQ ID NO: 1741736 - protein, 20 aa, Staphylococcus epidermidis
GTWYLNSAMNIQRKGEDLKS

SEQ ID NO: 1741737 - protein, 17 aa, Staphylococcus epidermidis
GTYAWLFLFIILFIKLA

SEQ ID NO: 1741738 - protein, 18 aa, Staphylococcus epidermidis
GTYKVYKNGVVLYKSGDY

SEQ ID NO: 1741739 - protein, 18 aa, Staphylococcus epidermidis
GTYKVYKNGVVLYKSGNY

SEQ ID NO: 1741740 - protein, 17 aa, Staphylococcus epidermidis
GTYTVEFAIPDNYTPSP

SEQ ID NO: 1741741 - protein, 33 aa, Staphylococcus epidermidis
GVALIIVIWLNFKRLEKPIAIIFSLLYILLALV

SEQ ID NO: 1741742 - protein, 18 aa, Staphylococcus epidermidis
GVFFKAYQSLVVLSLYLL

SEQ ID NO: 1741743 - protein, 17 aa, Staphylococcus epidermidis
GVFHIKFFQEIGDLAGS

SEQ ID NO: 1741744 - protein, 20 aa, Staphylococcus epidermidis
GVFSLISTIILYNFVTFSDE

SEQ ID NO: 1741745 - protein, 20 aa, Staphylococcus epidermidis
GVGGGLAWIMEGFQSGHGFI

SEQ ID NO: 1741746 - protein, 22 aa, Staphylococcus epidermidis
GVIAKIIVVWFFRKYDNHMRGS

SEQ ID NO: 1741747 - protein, 18 aa, Staphylococcus epidermidis
GVIGMLLSLFAGRLSSRI

SEQ ID NO: 1741748 - protein, 19 aa, Staphylococcus epidermidis
GVIIFGVFSFLNGNGNMPK

SEQ ID NO: 1741749 - protein, 19 aa, Staphylococcus epidermidis
GVILGCFVFPPFGIILVPL

SEQ ID NO: 1741750 - protein, 21 aa, Staphylococcus epidermidis
GVLIASFQGLIPIIAGLVPAI

SEQ ID NO: 1741751 - protein, 25 aa, Staphylococcus epidermidis
GVLIFFVSRAYRWYELDEQFVDGVK

SEQ ID NO: 1741752 - protein, 21 aa, Staphylococcus epidermidis
GVLLAFMWPPFKLKANPPRAL

SEQ ID NO: 1741753 - protein, 21 aa, Staphylococcus epidermidis
GVLLRPLFDYGNFPSSRIFNL

SEQ ID NO: 1741754 - protein, 19 aa, Staphylococcus epidermidis
GVLMKDMFEKMNVSKAVLS

SEQ ID NO: 1741755 - protein, 20 aa, Staphylococcus epidermidis
GVLMKEMFEKMDLSRSVLSR

SEQ ID NO: 1741756 - protein, 17 aa, Staphylococcus epidermidis
GVLSLISVYGFILSVGS

SEQ ID NO: 1741757 - protein, 18 aa, Staphylococcus epidermidis
GVLSSSIVNLVFLPPKFE

SEQ ID NO: 1741758 - protein, 27 aa, Staphylococcus epidermidis
GVLYIPHFLSWVVVIGIFKKLLAPDDG

SEQ ID NO: 1741759 - protein, 28 aa, Staphylococcus epidermidis
GVLYIPHFLSWVVVIGIFKKLLAPDDGL

SEQ ID NO: 1741760 - protein, 19 aa, Staphylococcus epidermidis
GVMYQYRLLLTIYFAITFW

SEQ ID NO: 1741761 - protein, 22 aa, Staphylococcus epidermidis
GVNLPLKYPFIAAISTSCVLGA

SEQ ID NO: 1741762 - protein, 19 aa, Staphylococcus epidermidis
GVNSIRDINPQIVKKPTAK

SEQ ID NO: 1741763 - protein, 32 aa, Staphylococcus epidermidis
GVPIGTMIGDWVGWRFTFLFIMLVSVVVGLLM

SEQ ID NO: 1741764 - protein, 36 aa, Staphylococcus epidermidis
GVPKYWAQNSHLIYAISLVLFLPFLVLSILLFLLGL

SEQ ID NO: 1741765 - protein, 18 aa, Staphylococcus epidermidis
GVQNLIALVNYPGISTPL

SEQ ID NO: 1741766 - protein, 25 aa, Staphylococcus epidermidis
GVQNMLKWGILVFIGFVIIATFMLI

SEQ ID NO: 1741767 - protein, 22 aa, Staphylococcus epidermidis
GVRECIPTLFGYAGVGLSFGIV

SEQ ID NO: 1741768 - protein, 29 aa, Staphylococcus epidermidis
GVVGRAYRSALNWSLNHKWIVLIVSIFIL

SEQ ID NO: 1741769 - protein, 20 aa, Staphylococcus epidermidis
GVVLFTRFICILLNQYYHLN

SEQ ID NO: 1741770 - protein, 27 aa, Staphylococcus epidermidis
GYERFMWKWKLFRIFNKQADISGDYEA

SEQ ID NO: 1741771 - protein, 31 aa, Staphylococcus epidermidis
GYFVPIVVSIAVITFIIWIVFVHPGQLEPAL

SEQ ID NO: 1741772 - protein, 27 aa, Staphylococcus epidermidis
GYIGVWLYHFLERVLIPTGLHHFIYAP

SEQ ID NO: 1741773 - protein, 18 aa, Staphylococcus epidermidis
GYIKEIKPLSIISVAFLL

SEQ ID NO: 1741774 - protein, 19 aa, Staphylococcus epidermidis
GYLKYILLIMIAWLFIFIL

SEQ ID NO: 1741775 - protein, 27 aa, Staphylococcus epidermidis
GYSNNKPVYLTHTWTTNDGAIAEESIQ

SEQ ID NO: 1741776 - protein, 19 aa, Staphylococcus epidermidis
GYVYFSWLLGLLVGMVVMN

SEQ ID NO: 1741777 - protein, 20 aa, Staphylococcus epidermidis
GYYFKAHRSLFWAFLIVFLL

SEQ ID NO: 1741778 - protein, 24 aa, Staphylococcus epidermidis
GYYFKNNRQLFWIFLIILLTIFVA

SEQ ID NO: 1741779 - protein, 36 aa, Staphylococcus epidermidis
GYYKHLENGEGLPIDGWRFYWNQQSTGTTSDQWQSL

SEQ ID NO: 1741780 - protein, 18 aa, Staphylococcus epidermidis
GYYLKSLLLALISVITIL

SEQ ID NO: 1741781 - protein, 24 aa, Staphylococcus epidermidis
GYYMATEMFGVFNPLTMAMMSPFI

SEQ ID NO: 1741782 - protein, 24 aa, Staphylococcus epidermidis
GYYMSTEMFGVFKALTTALITPFS

SEQ ID NO: 1741783 - protein, 23 aa, Staphylococcus epidermidis
HAEGNHPIDINFSKDQIDRNTAK

SEQ ID NO: 1741784 - protein, 22 aa, Staphylococcus epidermidis
HAEGSHPIDINFSKDQIDKNTA

SEQ ID NO: 1741785 - protein, 20 aa, Staphylococcus epidermidis
HALPWISFIVHYSFSIVIAI

SEQ ID NO: 1741786 - protein, 19 aa, Staphylococcus epidermidis
HALSDAGADVIIGHNSVVQ

SEQ ID NO: 1741787 - protein, 34 aa, Staphylococcus epidermidis
HANNVIWPTSNEQFNLKANYELDDSIKEGDTFTI

SEQ ID NO: 1741788 - protein, 35 aa, Staphylococcus epidermidis
HANNVIWPTSNEQFNLKANYELDDSIKEGDTFTIK

SEQ ID NO: 1741789 - protein, 20 aa, Staphylococcus epidermidis
HANPTRKSDALQELQTKFIS

SEQ ID NO: 1741790 - protein, 24 aa, Staphylococcus epidermidis
HAPPEWFYNLSLSFSFVLAQFLVL

SEQ ID NO: 1741791 - protein, 26 aa, Staphylococcus epidermidis
HAQFIPEFLGSLVIGIIAVLGHSLVP

SEQ ID NO: 1741792 - protein, 22 aa, Staphylococcus epidermidis
HAVGISNLWTHGGFMPNGIVGF

SEQ ID NO: 1741793 - protein, 26 aa, Staphylococcus epidermidis
HDIGKSMVIPSIFLVISLLGIYNNLF

SEQ ID NO: 1741794 - protein, 24 aa, Staphylococcus epidermidis
HDLKTSFEKWNFVKLAKPLIALSI

SEQ ID NO: 1741795 - protein, 31 aa, Staphylococcus epidermidis
HDSKGTLLGTLFAGLGALLLGRRRKKDNKEK

SEQ ID NO: 1741796 - protein, 17 aa, Staphylococcus epidermidis
HDTHIPNFITIIISIIS

SEQ ID NO: 1741797 - protein, 24 aa, Staphylococcus epidermidis
HDVSWGEWFLYAAPWSILMSIALY

SEQ ID NO: 1741798 - protein, 22 aa, Staphylococcus epidermidis
HEKSRKGSIFMDYRNSVKNPNL

SEQ ID NO: 1741799 - protein, 20 aa, Staphylococcus epidermidis
HELFIPAIILSLLILFFYLF

SEQ ID NO: 1741800 - protein, 22 aa, Staphylococcus epidermidis
HEVSWLFSCYGITVAIASWFSG

SEQ ID NO: 1741801 - protein, 18 aa, Staphylococcus epidermidis
HFASEVLLIAGLIINSVP

SEQ ID NO: 1741802 - protein, 26 aa, Staphylococcus epidermidis
HFDHPNRVALFIALAIMGFVGLILGI

SEQ ID NO: 1741803 - protein, 19 aa, Staphylococcus epidermidis
HFIPIIITIILCYLGFQFG

SEQ ID NO: 1741804 - protein, 19 aa, Staphylococcus epidermidis
HGKIERPSIGIGLINLSEI

SEQ ID NO: 1741805 - protein, 24 aa, Staphylococcus epidermidis
HGLKNRLTLVVIAIFIIFLILLFM

SEQ ID NO: 1741806 - protein, 21 aa, Staphylococcus epidermidis
HGQISLFLLMTFAIIVSTTFT

SEQ ID NO: 1741807 - protein, 21 aa, Staphylococcus epidermidis
HGYHAGFLFAVIITVISFLCT

SEQ ID NO: 1741808 - protein, 17 aa, Staphylococcus epidermidis
HHILFGMGILAYTLGLR

SEQ ID NO: 1741809 - protein, 21 aa, Staphylococcus epidermidis
HHYYNFFGIGAFDEDAIKTGK

SEQ ID NO: 1741810 - protein, 20 aa, Staphylococcus epidermidis
HHYYNFFGIGAFDEDAVKTG

SEQ ID NO: 1741811 - protein, 18 aa, Staphylococcus epidermidis
HIAFCIPIVVIIVLPQLY

SEQ ID NO: 1741812 - protein, 24 aa, Staphylococcus epidermidis
HIEGLKEKLKDLGLSQKEISDAEN

SEQ ID NO: 1741813 - protein, 24 aa, Staphylococcus epidermidis
HIFQGHVPWGYSIILIISSVIGAQ

SEQ ID NO: 1741814 - protein, 25 aa, Staphylococcus epidermidis
HIIIPFIIAVSIMFAIEYILISITQ

SEQ ID NO: 1741815 - protein, 26 aa, Staphylococcus epidermidis
HIIYYVELIISFISLFFIVLGNGNDK

SEQ ID NO: 1741816 - protein, 26 aa, Staphylococcus epidermidis
HIKSVQPELDKAISLLQNKENNDALV

SEQ ID NO: 1741817 - protein, 23 aa, Staphylococcus epidermidis
HILAKIAGVIAVAFTQVIMIIIM

SEQ ID NO: 1741818 - protein, 32 aa, Staphylococcus epidermidis
HILLGKFIGALLFWLTCLFITTLLLIFYSHEF

SEQ ID NO: 1741819 - protein, 26 aa, Staphylococcus epidermidis
HILNVKWTAIPAMLISSIGYILLGAP

SEQ ID NO: 1741820 - protein, 18 aa, Staphylococcus epidermidis
HISEHNWDVPYGYGERTI

SEQ ID NO: 1741821 - protein, 26 aa, Staphylococcus epidermidis
HISFPKRVFSALGIGIVLGIALHLIF

SEQ ID NO: 1741822 - protein, 19 aa, Staphylococcus epidermidis
HIYQGEALGIIGEPGSSKT

SEQ ID NO: 1741823 - protein, 24 aa, Staphylococcus epidermidis
HKAMKDYTAYMLAEILKGTFKAYG

SEQ ID NO: 1741824 - protein, 24 aa, Staphylococcus epidermidis
HKEPKRYIFAWVLLGFCIVMIYQV

SEQ ID NO: 1741825 - protein, 24 aa, Staphylococcus epidermidis
HKIYFCINLILPIFFLSSIFIMLS

SEQ ID NO: 1741826 - protein, 20 aa, Staphylococcus epidermidis
HKLSLIVYLVMGWIGIIFLP

SEQ ID NO: 1741827 - protein, 18 aa, Staphylococcus epidermidis
HKPFRSLKRVAKYNAENH

SEQ ID NO: 1741828 - protein, 24 aa, Staphylococcus epidermidis
HKSASPRMNLMSLAAEPNSGKNVN

SEQ ID NO: 1741829 - protein, 17 aa, Staphylococcus epidermidis
HKVANALTQNAFKNYTY

SEQ ID NO: 1741830 - protein, 31 aa, Staphylococcus epidermidis
HKVMHLVFFLPFYKSFRVHKLVNKKWLPYFN

SEQ ID NO: 1741831 - protein, 23 aa, Staphylococcus epidermidis
HLLRKYPNILKMTQLETDTQYNQ

SEQ ID NO: 1741832 - protein, 20 aa, Staphylococcus epidermidis
HLPNRALVILTIIGVLIGSM

SEQ ID NO: 1741833 - protein, 20 aa, Staphylococcus epidermidis
HLPNRALVLLTIIGVVIGSM

SEQ ID NO: 1741834 - protein, 19 aa, Staphylococcus epidermidis
HLQAWTIFMILKVIGTLIM

SEQ ID NO: 1741835 - protein, 19 aa, Staphylococcus epidermidis
HLTCRIISAILQISALMMW

SEQ ID NO: 1741836 - protein, 19 aa, Staphylococcus epidermidis
HLVVFTAGIGMFLSTLDSG

SEQ ID NO: 1741837 - protein, 19 aa, Staphylococcus epidermidis
HLVVLTAGIGMFLSTLDSG

SEQ ID NO: 1741838 - protein, 20 aa, Staphylococcus epidermidis
HLYMAMGMLVIIALILYYYV

SEQ ID NO: 1741839 - protein, 18 aa, Staphylococcus epidermidis
HNAVKVFVAPTIKFHVWR

SEQ ID NO: 1741840 - protein, 19 aa, Staphylococcus epidermidis
HNFNYLHSKFDARLREKDV

SEQ ID NO: 1741841 - protein, 20 aa, Staphylococcus epidermidis
HNKYSLPYFFGTVGILYNKE

SEQ ID NO: 1741842 - protein, 21 aa, Staphylococcus epidermidis
HNTEGQPAVTTGEQAGGKPAA

SEQ ID NO: 1741843 - protein, 26 aa, Staphylococcus epidermidis
HNVRMPRMLAGLIIGGALAIAGLLMQ

SEQ ID NO: 1741844 - protein, 26 aa, Staphylococcus epidermidis
HNVRMPRMLAGLVIGGALGIAGLLMQ

SEQ ID NO: 1741845 - protein, 25 aa, Staphylococcus epidermidis
HNVRMPRMLASLIIGGALAIAGLLM

SEQ ID NO: 1741846 - protein, 18 aa, Staphylococcus epidermidis
HPAIARMVGIGMILGGML

SEQ ID NO: 1741847 - protein, 18 aa, Staphylococcus epidermidis
HPIKLILPIITLVGGTVG

SEQ ID NO: 1741848 - protein, 18 aa, Staphylococcus epidermidis
HPLAEAIVTFAEDKGLSL

SEQ ID NO: 1741849 - protein, 21 aa, Staphylococcus epidermidis
HQKDIFVRSGVLLIISIAIHN

SEQ ID NO: 1741850 - protein, 18 aa, Staphylococcus epidermidis
HQLFLPIAILVGAFLLVF

SEQ ID NO: 1741851 - protein, 19 aa, Staphylococcus epidermidis
HQVFLNWFSHNPAFDYFKN

SEQ ID NO: 1741852 - protein, 26 aa, Staphylococcus epidermidis
HRGMAFITFMWIMFTFIHAIKNYSDN

SEQ ID NO: 1741853 - protein, 27 aa, Staphylococcus epidermidis
HRLKGVRKKLWLSIALIGSLQYGGLII

SEQ ID NO: 1741854 - protein, 22 aa, Staphylococcus epidermidis
HRQIPIKTIKGVKVALLSYTFG

SEQ ID NO: 1741855 - protein, 19 aa, Staphylococcus epidermidis
HRRNLIVAVMLISAFVAIL

SEQ ID NO: 1741856 - protein, 18 aa, Staphylococcus epidermidis
HSEYFAYDGIHLEYSGVK

SEQ ID NO: 1741857 - protein, 19 aa, Staphylococcus epidermidis
HSIEGLPTISWIGFYPSIE

SEQ ID NO: 1741858 - protein, 25 aa, Staphylococcus epidermidis
HSKVVYRFTTFFTMIAAFIDGVKAS

SEQ ID NO: 1741859 - protein, 22 aa, Staphylococcus epidermidis
HSNAFKGLSWHQSLFYALFQSS

SEQ ID NO: 1741860 - protein, 20 aa, Staphylococcus epidermidis
HSPFMAGIIALILGLIIFIY

SEQ ID NO: 1741861 - protein, 25 aa, Staphylococcus epidermidis
HSTSLRLFQLLLMFSTPMFVFISEF

SEQ ID NO: 1741862 - protein, 20 aa, Staphylococcus epidermidis
HSYIIFRFHHDGILSTGPND

SEQ ID NO: 1741863 - protein, 20 aa, Staphylococcus epidermidis
HSYIIFRFYHDGILSTGPND

SEQ ID NO: 1741864 - protein, 26 aa, Staphylococcus epidermidis
HTILNFPLSVSFVMGGLFLITGPTVI

SEQ ID NO: 1741865 - protein, 18 aa, Staphylococcus epidermidis
HTKMHSVQAIISRIVSCL

SEQ ID NO: 1741866 - protein, 32 aa, Staphylococcus epidermidis
HTMDFFWELATLILIMLLGHWIEMNAVGNAGD

SEQ ID NO: 1741867 - protein, 20 aa, Staphylococcus epidermidis
HTPYASIVTLIFNAILIIIA

SEQ ID NO: 1741868 - protein, 20 aa, Staphylococcus epidermidis
HTVEQTIYINPLRYSAKETN

SEQ ID NO: 1741869 - protein, 24 aa, Staphylococcus epidermidis
HTWNKFKYQVLFTGVYESEQAHRQ

SEQ ID NO: 1741870 - protein, 19 aa, Staphylococcus epidermidis
HVLPILGLILCLFATIPGI

SEQ ID NO: 1741871 - protein, 17 aa, Staphylococcus epidermidis
HVLPLVAKYLINREDEV

SEQ ID NO: 1741872 - protein, 18 aa, Staphylococcus epidermidis
HVLPVLGLILCLFATIPG

SEQ ID NO: 1741873 - protein, 26 aa, Staphylococcus epidermidis
HVSFPKRVFTALGIGIVFGIVLHLIY

SEQ ID NO: 1741874 - protein, 26 aa, Staphylococcus epidermidis
HWCEKFDVTMVIKRKQGIMIDASASN

SEQ ID NO: 1741875 - protein, 26 aa, Staphylococcus epidermidis
HWFGFPVPFRFSGFRFDVSSILVFFI

SEQ ID NO: 1741876 - protein, 21 aa, Staphylococcus epidermidis
HWVGLPLPFRFSGFGFDLSST

SEQ ID NO: 1741877 - protein, 19 aa, Staphylococcus epidermidis
HYFKLSWKTIYQVSTLGIP

SEQ ID NO: 1741878 - protein, 20 aa, Staphylococcus epidermidis
HYGIPTSKWLAVWSAIFFGN

SEQ ID NO: 1741879 - protein, 22 aa, Staphylococcus epidermidis
HYLFERRYHPFVAGIVVGLIAL

SEQ ID NO: 1741880 - protein, 20 aa, Staphylococcus epidermidis
HYSLEWFPIAVVATIIGYIV

SEQ ID NO: 1741881 - protein, 25 aa, Staphylococcus epidermidis
HYVDGFVGIILFFAIFGFFIKRVTH

SEQ ID NO: 1741882 - protein, 22 aa, Staphylococcus epidermidis
IAAFLGSFAYIYFMKGVLGFHF

SEQ ID NO: 1741883 - protein, 17 aa, Staphylococcus epidermidis
IAASGAFAFGTMAVSAI

SEQ ID NO: 1741884 - protein, 24 aa, Staphylococcus epidermidis
IAETLCALAAMLIVYLLRNQLAVD

SEQ ID NO: 1741885 - protein, 24 aa, Staphylococcus epidermidis
IAGIERKWLDQIIMFIADMLLAIP

SEQ ID NO: 1741886 - protein, 18 aa, Staphylococcus epidermidis
IAGIFPKAFGMYAQSIYD

SEQ ID NO: 1741887 - protein, 18 aa, Staphylococcus epidermidis
IAGIIAMMLLGFYQTMRA

SEQ ID NO: 1741888 - protein, 23 aa, Staphylococcus epidermidis
IAGIVGWYFWSAWSFVIMAVLII

SEQ ID NO: 1741889 - protein, 23 aa, Staphylococcus epidermidis
IAGKGHSNWSYAIVPVLGPIAGG

SEQ ID NO: 1741890 - protein, 19 aa, Staphylococcus epidermidis
IAGLGFSRGFFFAKEQENV

SEQ ID NO: 1741891 - protein, 21 aa, Staphylococcus epidermidis
IAGLIAAVALVFIYISLGFIG

SEQ ID NO: 1741892 - protein, 18 aa, Staphylococcus epidermidis
IAIALTFVGGYVDAYTFL

SEQ ID NO: 1741893 - protein, 17 aa, Staphylococcus epidermidis
IAIAVIGIFILARKTAS

SEQ ID NO: 1741894 - protein, 25 aa, Staphylococcus epidermidis
IAIFGFIKPYIINIWNAIKNSTIAI

SEQ ID NO: 1741895 - protein, 19 aa, Staphylococcus epidermidis
IAIGFTFISMVILRPMVEA

SEQ ID NO: 1741896 - protein, 20 aa, Staphylococcus epidermidis
IAIGILFYMRSNKRNSVGKV

SEQ ID NO: 1741897 - protein, 17 aa, Staphylococcus epidermidis
IAIGVILVGCCPGGTSS

SEQ ID NO: 1741898 - protein, 20 aa, Staphylococcus epidermidis
IAIIMGFIFHINRSEWMFVL

SEQ ID NO: 1741899 - protein, 21 aa, Staphylococcus epidermidis
IAISHFRFRRAFDKQDYDKSK

SEQ ID NO: 1741900 - protein, 17 aa, Staphylococcus epidermidis
IAISSLVFCILLILHHF

SEQ ID NO: 1741901 - protein, 45 aa, Staphylococcus epidermidis
IAIVILIIFAFAFRFIVKLIPVHYIFRVLSILIFIMTFKMLGVSI

SEQ ID NO: 1741902 - protein, 26 aa, Staphylococcus epidermidis
IAKALTDWCDLAFVTKLVLGQSEQPR

SEQ ID NO: 1741903 - protein, 24 aa, Staphylococcus epidermidis
IAKELRKKVLLRRKVLKKLTLNRQ

SEQ ID NO: 1741904 - protein, 17 aa, Staphylococcus epidermidis
IAKQLNGDMSTLHKVIN

SEQ ID NO: 1741905 - protein, 19 aa, Staphylococcus epidermidis
IAKQLNGDMSTLRKVINDK

SEQ ID NO: 1741906 - protein, 24 aa, Staphylococcus epidermidis
IALGEEFLFRKVVFNILLNNFSLL

SEQ ID NO: 1741907 - protein, 19 aa, Staphylococcus epidermidis
IALSFDFSKELLGRPLKAD

SEQ ID NO: 1741908 - protein, 30 aa, Staphylococcus epidermidis
IALSFDFSKKLLNRPLKADEFEFTLKNEQG

SEQ ID NO: 1741909 - protein, 17 aa, Staphylococcus epidermidis
IAMFSIFMCLMLGAQQI

SEQ ID NO: 1741910 - protein, 18 aa, Staphylococcus epidermidis
IAMFSIFMCLVLGAQQIH

SEQ ID NO: 1741911 - protein, 18 aa, Staphylococcus epidermidis
IAMISIFLSLVIGAQQVH

SEQ ID NO: 1741912 - protein, 17 aa, Staphylococcus epidermidis
IAMQALRNSVNDVNNVK

SEQ ID NO: 1741913 - protein, 19 aa, Staphylococcus epidermidis
IAMVSCLILTYIFNPTFVV

SEQ ID NO: 1741914 - protein, 23 aa, Staphylococcus epidermidis
IANDIAKYFAILPAMFMSAMPAM

SEQ ID NO: 1741915 - protein, 24 aa, Staphylococcus epidermidis
IANEVVKKDFIVDYGNKKDNTTTA

SEQ ID NO: 1741916 - protein, 25 aa, Staphylococcus epidermidis
IANEYKLPTFVLGVGLGGLIILNLL

SEQ ID NO: 1741917 - protein, 30 aa, Staphylococcus epidermidis
IANKELKLIMSLGFILGGIIGLFQGVIAIF

SEQ ID NO: 1741918 - protein, 26 aa, Staphylococcus epidermidis
IANNGYRIQPHIGLAIHESTNKDELG

SEQ ID NO: 1741919 - protein, 25 aa, Staphylococcus epidermidis
IANTILRWLSIFVIPLFGIIISKLV

SEQ ID NO: 1741920 - protein, 17 aa, Staphylococcus epidermidis
IAQFFSLAIWILLVVLI

SEQ ID NO: 1741921 - protein, 26 aa, Staphylococcus epidermidis
IAQGFGWKGSFGLNQILGVFMYPFAL

SEQ ID NO: 1741922 - protein, 17 aa, Staphylococcus epidermidis
IARKIINQFSMGIRITD

SEQ ID NO: 1741923 - protein, 18 aa, Staphylococcus epidermidis
IASFAYPNTRDVITIGPN

SEQ ID NO: 1741924 - protein, 18 aa, Staphylococcus epidermidis
IASGIARGIANGASRVIN

SEQ ID NO: 1741925 - protein, 17 aa, Staphylococcus epidermidis
IASKNESSWTLNKQIDH

SEQ ID NO: 1741926 - protein, 17 aa, Staphylococcus epidermidis
IASKVSARETFDSWMEV

SEQ ID NO: 1741927 - protein, 43 aa, Staphylococcus epidermidis
IATADIQGGGVWRLFKIPENVNRIKVQFLPNNDIQTNYQRILQ

SEQ ID NO: 1741928 - protein, 17 aa, Staphylococcus epidermidis
IATKEGSTWTLDKQESG

SEQ ID NO: 1741929 - protein, 17 aa, Staphylococcus epidermidis
IAVIGIFILARKTASSM

SEQ ID NO: 1741930 - protein, 18 aa, Staphylococcus epidermidis
IAVIVGALINIFTSSSFD

SEQ ID NO: 1741931 - protein, 17 aa, Staphylococcus epidermidis
IAVPLWGIMKKRQLKKS

SEQ ID NO: 1741932 - protein, 24 aa, Staphylococcus epidermidis
IAVSLCGIVIIFIEKGLRSKRKKT

SEQ ID NO: 1741933 - protein, 20 aa, Staphylococcus epidermidis
IAVVLARIYLRKHIPSDGLW

SEQ ID NO: 1741934 - protein, 17 aa, Staphylococcus epidermidis
IAWLFIFILMKAGLTQV

SEQ ID NO: 1741935 - protein, 21 aa, Staphylococcus epidermidis
ICAMFAICWIAYIQWETTIAS

SEQ ID NO: 1741936 - protein, 20 aa, Staphylococcus epidermidis
ICFFIVPILFIPKTHSTIIE

SEQ ID NO: 1741937 - protein, 17 aa, Staphylococcus epidermidis
ICGIVAYVLNIKGTPLS

SEQ ID NO: 1741938 - protein, 35 aa, Staphylococcus epidermidis
ICGPLLVKLTHRFASRSVLLWALIIFIFGNGLIAI

SEQ ID NO: 1741939 - protein, 23 aa, Staphylococcus epidermidis
ICGPLLVKLTHRFTSRSVLLWTL

SEQ ID NO: 1741940 - protein, 24 aa, Staphylococcus epidermidis
ICGPLLVKLTHRFTSRSVLLWTLI

SEQ ID NO: 1741941 - protein, 19 aa, Staphylococcus epidermidis
ICLLLRVSTVPSMLISSLS

SEQ ID NO: 1741942 - protein, 21 aa, Staphylococcus epidermidis
IDAKVPNHFNFNRLLVDQDND

SEQ ID NO: 1741943 - protein, 23 aa, Staphylococcus epidermidis
IDALQLRFILDWNSQSHRPQFKF

SEQ ID NO: 1741944 - protein, 25 aa, Staphylococcus epidermidis
IDDLKRPWLPPLPEAVYQEDLIETD

SEQ ID NO: 1741945 - protein, 28 aa, Staphylococcus epidermidis
IDFILRWKRYFILGVVGIIIAILTLTNK

SEQ ID NO: 1741946 - protein, 23 aa, Staphylococcus epidermidis
IDGDGPGGLIIMKDMSEKPDSSY

SEQ ID NO: 1741947 - protein, 26 aa, Staphylococcus epidermidis
IDGPDEIKKLLGVDAGIRDGYRTAMA

SEQ ID NO: 1741948 - protein, 22 aa, Staphylococcus epidermidis
IDGPTTFIWVCIVTLVAQQLEG

SEQ ID NO: 1741949 - protein, 17 aa, Staphylococcus epidermidis
IDISGFSFPSGHAMGAT

SEQ ID NO: 1741950 - protein, 19 aa, Staphylococcus epidermidis
IDKDLILAILVGVLGGLVA

SEQ ID NO: 1741951 - protein, 18 aa, Staphylococcus epidermidis
IDKKEIIGDVSLKYYPFK

SEQ ID NO: 1741952 - protein, 24 aa, Staphylococcus epidermidis
IDKREFMSVSGIGRMGYNDKYLAG

SEQ ID NO: 1741953 - protein, 19 aa, Staphylococcus epidermidis
IDLYLSIPWFAASISTVAG

SEQ ID NO: 1741954 - protein, 20 aa, Staphylococcus epidermidis
IDMQTGLVTIDYKAVYPESV

SEQ ID NO: 1741955 - protein, 19 aa, Staphylococcus epidermidis
IDMSSLEWFTHYFGNPQRI

SEQ ID NO: 1741956 - protein, 24 aa, Staphylococcus epidermidis
IDNASWRVPFIIIVGIALIAFIFG

SEQ ID NO: 1741957 - protein, 22 aa, Staphylococcus epidermidis
IDRDLICAIMVGVLGGIIALAM

SEQ ID NO: 1741958 - protein, 23 aa, Staphylococcus epidermidis
IDRERYYYYFSIMFMLIGIIGAF

SEQ ID NO: 1741959 - protein, 25 aa, Staphylococcus epidermidis
IDSDKKPSAEEIAIAQTAVKKESSD

SEQ ID NO: 1741960 - protein, 31 aa, Staphylococcus epidermidis
IDSFFNYLFGMSRFLTYILVILATGFITYSK

SEQ ID NO: 1741961 - protein, 20 aa, Staphylococcus epidermidis
IDSKLILQVLFNLVDNALKH

SEQ ID NO: 1741962 - protein, 18 aa, Staphylococcus epidermidis
IDTGWSFPSGHSNINTLF

SEQ ID NO: 1741963 - protein, 25 aa, Staphylococcus epidermidis
IDTSLLRYYFWMTIIIIMLLVGVIA

SEQ ID NO: 1741964 - protein, 19 aa, Staphylococcus epidermidis
IDTTLSIKVYYQKSKKGLT

SEQ ID NO: 1741965 - protein, 20 aa, Staphylococcus epidermidis
IDVAGSIWWVLLINILIALS

SEQ ID NO: 1741966 - protein, 21 aa, Staphylococcus epidermidis
IEAIHKIKPISTIKPQTLNEI

SEQ ID NO: 1741967 - protein, 17 aa, Staphylococcus epidermidis
IEAKDNIQHSSTRDQVN

SEQ ID NO: 1741968 - protein, 18 aa, Staphylococcus epidermidis
IEEAKIEAKDNIQHSSTR

SEQ ID NO: 1741969 - protein, 20 aa, Staphylococcus epidermidis
IEGMMLMSPMLELRKSGKDR

SEQ ID NO: 1741970 - protein, 17 aa, Staphylococcus epidermidis
IEIKTVEDWSFEEKFGK

SEQ ID NO: 1741971 - protein, 24 aa, Staphylococcus epidermidis
IEKLKSIQLREDKILSSQRSTTSM

SEQ ID NO: 1741972 - protein, 18 aa, Staphylococcus epidermidis
IEKWNADAIILKKDANQT

SEQ ID NO: 1741973 - protein, 18 aa, Staphylococcus epidermidis
IEKWNADAIILKKEANQT

SEQ ID NO: 1741974 - protein, 26 aa, Staphylococcus epidermidis
IELKKRIGNLPGYRNYLIEYKEKDTT

SEQ ID NO: 1741975 - protein, 20 aa, Staphylococcus epidermidis
IENFKFFVQYANFKDINDYK

SEQ ID NO: 1741976 - protein, 33 aa, Staphylococcus epidermidis
IENLKAKIRAVIPWSILYEILVGIFISISYNVL

SEQ ID NO: 1741977 - protein, 21 aa, Staphylococcus epidermidis
IENNGNFAASLNRNELTYTVT

SEQ ID NO: 1741978 - protein, 20 aa, Staphylococcus epidermidis
IENVFAWPGLGPLSVKAITE

SEQ ID NO: 1741979 - protein, 21 aa, Staphylococcus epidermidis
IENVFAWPGLGQLSLKAIVEH

SEQ ID NO: 1741980 - protein, 22 aa, Staphylococcus epidermidis
IEPMPAKKQILFALSVSLLNPH

SEQ ID NO: 1741981 - protein, 23 aa, Staphylococcus epidermidis
IERVEGITNFALYRVLLNGEEIG

SEQ ID NO: 1741982 - protein, 36 aa, Staphylococcus epidermidis
IERYNHAKPPKFLVRFWTLFVSFLMGLVLMTVLFFN

SEQ ID NO: 1741983 - protein, 36 aa, Staphylococcus epidermidis
IERYNHAKPPRFLVRFWTLFVSFLIGLVLMSVLFFN

SEQ ID NO: 1741984 - protein, 18 aa, Staphylococcus epidermidis
IESPILFVSVAVFSSLVF

SEQ ID NO: 1741985 - protein, 19 aa, Staphylococcus epidermidis
IETYPFKFIELRNISNEPI

SEQ ID NO: 1741986 - protein, 23 aa, Staphylococcus epidermidis
IEYASLIGCIKRSQSLAGAINTI

SEQ ID NO: 1741987 - protein, 21 aa, Staphylococcus epidermidis
IFCEIAFWFVILLGLVTRYIL

SEQ ID NO: 1741988 - protein, 17 aa, Staphylococcus epidermidis
IFCILKYGMTCTSIKMI

SEQ ID NO: 1741989 - protein, 17 aa, Staphylococcus epidermidis
IFCILLIGLLILPETSI

SEQ ID NO: 1741990 - protein, 17 aa, Staphylococcus epidermidis
IFCNFFINIGIFISLQF

SEQ ID NO: 1741991 - protein, 22 aa, Staphylococcus epidermidis
IFDLILRYMEKLSYKKLLITLG

SEQ ID NO: 1741992 - protein, 24 aa, Staphylococcus epidermidis
IFDNLPIIFALGVAIGLASGDGVA

SEQ ID NO: 1741993 - protein, 24 aa, Staphylococcus epidermidis
IFEVIKGVVLGIILAFIGYFIAKY

SEQ ID NO: 1741994 - protein, 19 aa, Staphylococcus epidermidis
IFFVLCLISMFITVITIIL

SEQ ID NO: 1741995 - protein, 20 aa, Staphylococcus epidermidis
IFFYSKVRWYSIVIVLMSTL

SEQ ID NO: 1741996 - protein, 17 aa, Staphylococcus epidermidis
IFGEAFFHQIFGDFIEE

SEQ ID NO: 1741997 - protein, 23 aa, Staphylococcus epidermidis
IFGEDRFRWSATMIGLSLAVFGI

SEQ ID NO: 1741998 - protein, 17 aa, Staphylococcus epidermidis
IFGEIIILLLIQIGGLG

SEQ ID NO: 1741999 - protein, 24 aa, Staphylococcus epidermidis
IFGLNDLNSIVINVIQKPTARKAV

SEQ ID NO: 1742000 - protein, 22 aa, Staphylococcus epidermidis
IFGMALLVCLVRLIKGPTTADR

SEQ ID NO: 1742001 - protein, 19 aa, Staphylococcus epidermidis
IFIILDIILALITAYFVSK

SEQ ID NO: 1742002 - protein, 23 aa, Staphylococcus epidermidis
IFILPIPMHFEFDSEVFMMAVIA

SEQ ID NO: 1742003 - protein, 24 aa, Staphylococcus epidermidis
IFIVAFCLFIMWELKTNHPIIDLR

SEQ ID NO: 1742004 - protein, 24 aa, Staphylococcus epidermidis
IFIVHILKSIFIIKIMADDSLRLI

SEQ ID NO: 1742005 - protein, 20 aa, Staphylococcus epidermidis
IFIVICLIVSLLSLTPILTF

SEQ ID NO: 1742006 - protein, 18 aa, Staphylococcus epidermidis
IFIVYYLFVHQKVFISLS

SEQ ID NO: 1742007 - protein, 22 aa, Staphylococcus epidermidis
IFKPTYRKPGLYKDFDDGHIYV

SEQ ID NO: 1742008 - protein, 23 aa, Staphylococcus epidermidis
IFLFLVFHLIRLASKINSQYNKV

SEQ ID NO: 1742009 - protein, 18 aa, Staphylococcus epidermidis
IFMSIYWIVGSIYYFFIK

SEQ ID NO: 1742010 - protein, 18 aa, Staphylococcus epidermidis
IFNRDGSLDKEYILVGKD

SEQ ID NO: 1742011 - protein, 17 aa, Staphylococcus epidermidis
IFSYPAFGWRPVKKRFK

SEQ ID NO: 1742012 - protein, 18 aa, Staphylococcus epidermidis
IFTFLNFSSIYRWQTTPL

SEQ ID NO: 1742013 - protein, 23 aa, Staphylococcus epidermidis
IFTNIKTRIALYLFENNELTNII

SEQ ID NO: 1742014 - protein, 17 aa, Staphylococcus epidermidis
IFVPLAIILLIAGAWYG

SEQ ID NO: 1742015 - protein, 23 aa, Staphylococcus epidermidis
IFVSWYPTVYWIINAAVVIFAFP

SEQ ID NO: 1742016 - protein, 17 aa, Staphylococcus epidermidis
IFYRPLMISTFDETFSR

SEQ ID NO: 1742017 - protein, 17 aa, Staphylococcus epidermidis
IGAFIIKLIQGYIPLED

SEQ ID NO: 1742018 - protein, 22 aa, Staphylococcus epidermidis
IGDTSFSFAAVVADDASGNGDT

SEQ ID NO: 1742019 - protein, 17 aa, Staphylococcus epidermidis
IGFFVFFFTFLISGIGL

SEQ ID NO: 1742020 - protein, 17 aa, Staphylococcus epidermidis
IGFLGSMLYLLLKKPFK

SEQ ID NO: 1742021 - protein, 18 aa, Staphylococcus epidermidis
IGFTNSDMSKGLLLKILF

SEQ ID NO: 1742022 - protein, 20 aa, Staphylococcus epidermidis
IGGLKAFLPQAIGMVLVAVI

SEQ ID NO: 1742023 - protein, 33 aa, Staphylococcus epidermidis
IGGLLISIGNWRWIFWINIPFIFIGLIGCLLLK

SEQ ID NO: 1742024 - protein, 31 aa, Staphylococcus epidermidis
IGGLLISIGNWRWIFWINIPIILIGLIGCLL

SEQ ID NO: 1742025 - protein, 17 aa, Staphylococcus epidermidis
IGIIFLPIIIIRTSWLF

SEQ ID NO: 1742026 - protein, 24 aa, Staphylococcus epidermidis
IGLDGINKFAYAKDMTRLPDGTWM

SEQ ID NO: 1742027 - protein, 25 aa, Staphylococcus epidermidis
IGLLVAGLIHLWKTNSSFRDAVIGI

SEQ ID NO: 1742028 - protein, 18 aa, Staphylococcus epidermidis
IGLLYLIIHYYRYKGFNA

SEQ ID NO: 1742029 - protein, 17 aa, Staphylococcus epidermidis
IGNAMEWFDFGVYAYTT

SEQ ID NO: 1742030 - protein, 25 aa, Staphylococcus epidermidis
IGRDLTLHAEIFFDGETTPIRKDTT

SEQ ID NO: 1742031 - protein, 19 aa, Staphylococcus epidermidis
IGRYLRYFRNLTRDIQKRP

SEQ ID NO: 1742032 - protein, 24 aa, Staphylococcus epidermidis
IGSDILYWGVIEWAFYYQVPPNGA

SEQ ID NO: 1742033 - protein, 26 aa, Staphylococcus epidermidis
IGSLIMLFIMDWKLTLLTFITIPVFV

SEQ ID NO: 1742034 - protein, 18 aa, Staphylococcus epidermidis
IGSMFPFAFLAQLISAGT

SEQ ID NO: 1742035 - protein, 19 aa, Staphylococcus epidermidis
IGSMFPFTFLAQLISAGTL

SEQ ID NO: 1742036 - protein, 17 aa, Staphylococcus epidermidis
IGTFIFVRLINLIRVKE

SEQ ID NO: 1742037 - protein, 25 aa, Staphylococcus epidermidis
IGTFLSWECVHWFMSHYEPEFYFEP

SEQ ID NO: 1742038 - protein, 23 aa, Staphylococcus epidermidis
IGTFSTVIATLVFMGINTNHASA

SEQ ID NO: 1742039 - protein, 25 aa, Staphylococcus epidermidis
IGTGSVLLGAFLFVGFQDVAHADEI

SEQ ID NO: 1742040 - protein, 18 aa, Staphylococcus epidermidis
IGTLKITIIATIVSVPIG

SEQ ID NO: 1742041 - protein, 26 aa, Staphylococcus epidermidis
IGVFFLFKYVKSWIRNEMILRFIKST

SEQ ID NO: 1742042 - protein, 20 aa, Staphylococcus epidermidis
IGVILMRFAANWFVELLNKY

SEQ ID NO: 1742043 - protein, 18 aa, Staphylococcus epidermidis
IGVSRFALMNNLEAYVVL

SEQ ID NO: 1742044 - protein, 17 aa, Staphylococcus epidermidis
IHEAYYFNFFSRLLTAL

SEQ ID NO: 1742045 - protein, 25 aa, Staphylococcus epidermidis
IHFRKSSIHVLSFIFVLMILLNPQF

SEQ ID NO: 1742046 - protein, 25 aa, Staphylococcus epidermidis
IHFRKSSIHVLSFIFVLMIVLNPQF

SEQ ID NO: 1742047 - protein, 28 aa, Staphylococcus epidermidis
IHHSASIWPIDFQRAALLSTLLLAVSMT

SEQ ID NO: 1742048 - protein, 18 aa, Staphylococcus epidermidis
IHIHKSHGINYLIITEPI

SEQ ID NO: 1742049 - protein, 24 aa, Staphylococcus epidermidis
IHIKSILSHDGFAYIMNNAIKNFS

SEQ ID NO: 1742050 - protein, 19 aa, Staphylococcus epidermidis
IHKLLIMCQLFKIYLDELV

SEQ ID NO: 1742051 - protein, 20 aa, Staphylococcus epidermidis
IHKPLRILTWLMAIIVYLTI

SEQ ID NO: 1742052 - protein, 21 aa, Staphylococcus epidermidis
IHKPLRILTWLMAIIVYLTIY

SEQ ID NO: 1742053 - protein, 19 aa, Staphylococcus epidermidis
IHLAHIPFYLLGFLAAFIV

SEQ ID NO: 1742054 - protein, 33 aa, Staphylococcus epidermidis
IHLYFINWKYAIFIKYNLGYSVWNNHKYAFLLL

SEQ ID NO: 1742055 - protein, 24 aa, Staphylococcus epidermidis
IHMSKGIYRFKVKGIYGENYQTLR

SEQ ID NO: 1742056 - protein, 18 aa, Staphylococcus epidermidis
IHNLGGGLVARLLTGQFT

SEQ ID NO: 1742057 - protein, 18 aa, Staphylococcus epidermidis
IHPHELFIPAIILSLLIL

SEQ ID NO: 1742058 - protein, 20 aa, Staphylococcus epidermidis
IHQKAEVIRGLINNNEEATK

SEQ ID NO: 1742059 - protein, 20 aa, Staphylococcus epidermidis
IHSLGFPPNGLELWNGKTEL

SEQ ID NO: 1742060 - protein, 21 aa, Staphylococcus epidermidis
IIAFICYQFWLKHTNNQELNH

SEQ ID NO: 1742061 - protein, 18 aa, Staphylococcus epidermidis
IIAIAVALIIVGLVQKFL

SEQ ID NO: 1742062 - protein, 18 aa, Staphylococcus epidermidis
IIAIIVVSVGLVFLLQIL

SEQ ID NO: 1742063 - protein, 22 aa, Staphylococcus epidermidis
IIAIVIGLFWFKLYQNTTNPKA

SEQ ID NO: 1742064 - protein, 17 aa, Staphylococcus epidermidis
IIALILGLIIFIYKKTS

SEQ ID NO: 1742065 - protein, 17 aa, Staphylococcus epidermidis
IIARVGPIKVLRIILLI

SEQ ID NO: 1742066 - protein, 18 aa, Staphylococcus epidermidis
IIASITGYGIKSFIDMNQ

SEQ ID NO: 1742067 - protein, 18 aa, Staphylococcus epidermidis
IICILMILIAVVGLRLIS

SEQ ID NO: 1742068 - protein, 17 aa, Staphylococcus epidermidis
IICRCVMGFAIGMDSPV

SEQ ID NO: 1742069 - protein, 17 aa, Staphylococcus epidermidis
IICYQFWLKHTNNQELD

SEQ ID NO: 1742070 - protein, 21 aa, Staphylococcus epidermidis
IIDASKLKKGDIVRVETGEQI

SEQ ID NO: 1742071 - protein, 27 aa, Staphylococcus epidermidis
IIDFYRKGRYGIFLFKTIVPLTVTIWI

SEQ ID NO: 1742072 - protein, 22 aa, Staphylococcus epidermidis
IIFGAFAFFWFVGIHGPSIVEP

SEQ ID NO: 1742073 - protein, 22 aa, Staphylococcus epidermidis
IIFLREGLEVLLIIMTLTTMTR

SEQ ID NO: 1742074 - protein, 23 aa, Staphylococcus epidermidis
IIFSCLFLGTLIFTFFNDRFYNM

SEQ ID NO: 1742075 - protein, 18 aa, Staphylococcus epidermidis
IIFYRPLMISTFDSTFSR

SEQ ID NO: 1742076 - protein, 24 aa, Staphylococcus epidermidis
IIGAKWVFFSSFIILLFPIFFLGQ

SEQ ID NO: 1742077 - protein, 18 aa, Staphylococcus epidermidis
IIGDVSLKYYPFKEFNYQ

SEQ ID NO: 1742078 - protein, 19 aa, Staphylococcus epidermidis
IIGFSFLWIAGKDHHILFG

SEQ ID NO: 1742079 - protein, 18 aa, Staphylococcus epidermidis
IIGGDWKGLYYFKRFFSD

SEQ ID NO: 1742080 - protein, 17 aa, Staphylococcus epidermidis
IIGIAIILLLIIAAFIV

SEQ ID NO: 1742081 - protein, 22 aa, Staphylococcus epidermidis
IIGQLLFLLSFYLMHRKTIVPI

SEQ ID NO: 1742082 - protein, 22 aa, Staphylococcus epidermidis
IIGSWLFLLGIGMLYKVVGTLN

SEQ ID NO: 1742083 - protein, 21 aa, Staphylococcus epidermidis
IIHCMTRIRIKIHDYDQVNYD

SEQ ID NO: 1742084 - protein, 17 aa, Staphylococcus epidermidis
IIHFLGGIHEIYFPYVL

SEQ ID NO: 1742085 - protein, 17 aa, Staphylococcus epidermidis
IIICFIQSMFTTMFLII

SEQ ID NO: 1742086 - protein, 21 aa, Staphylococcus epidermidis
IIIEAIRRFFAPPEVQSQEMF

SEQ ID NO: 1742087 - protein, 18 aa, Staphylococcus epidermidis
IIIFGRLSDKYSRLNIYI

SEQ ID NO: 1742088 - protein, 18 aa, Staphylococcus epidermidis
IIILITFFIGYTIHPING

SEQ ID NO: 1742089 - protein, 19 aa, Staphylococcus epidermidis
IIIPILIGNKMFGFQPSSL

SEQ ID NO: 1742090 - protein, 18 aa, Staphylococcus epidermidis
IIIPRGSIKDVVKVDKKG

SEQ ID NO: 1742091 - protein, 17 aa, Staphylococcus epidermidis
IIIPVILLVYFSFMDVH

SEQ ID NO: 1742092 - protein, 22 aa, Staphylococcus epidermidis
IIISGVLLRKAFLKMDSYVDDL

SEQ ID NO: 1742093 - protein, 25 aa, Staphylococcus epidermidis
IIIVACLKTSIGLITAFSETFTELL

SEQ ID NO: 1742094 - protein, 26 aa, Staphylococcus epidermidis
IIKDKFELGEAFPVTIAIKDDHKLTT

SEQ ID NO: 1742095 - protein, 18 aa, Staphylococcus epidermidis
IIKRSASEEVEWEAHPDS

SEQ ID NO: 1742096 - protein, 24 aa, Staphylococcus epidermidis
IILCGIVTLLMRIIPFILISRVHL

SEQ ID NO: 1742097 - protein, 24 aa, Staphylococcus epidermidis
IILGELSVILGLIIAFYMNISPGG

SEQ ID NO: 1742098 - protein, 18 aa, Staphylococcus epidermidis
IILIILITILTFILICGY

SEQ ID NO: 1742099 - protein, 26 aa, Staphylococcus epidermidis
IILILQRFTKGFLKSIAILIGLVLGT

SEQ ID NO: 1742100 - protein, 18 aa, Staphylococcus epidermidis
IILIRIFIYIVIIMGIVY

SEQ ID NO: 1742101 - protein, 24 aa, Staphylococcus epidermidis
IILKPRIENKPGFFVYETELESDW

SEQ ID NO: 1742102 - protein, 18 aa, Staphylococcus epidermidis
IILLLLILNAIFTTVNKN

SEQ ID NO: 1742103 - protein, 17 aa, Staphylococcus epidermidis
IILPPLAAMLFIKIGYH

SEQ ID NO: 1742104 - protein, 18 aa, Staphylococcus epidermidis
IILWFVFRGKERLKIFDV

SEQ ID NO: 1742105 - protein, 17 aa, Staphylococcus epidermidis
IIMALLCVYAFDLKSLF

SEQ ID NO: 1742106 - protein, 17 aa, Staphylococcus epidermidis
IIMGLYFVLKDKLVSGL

SEQ ID NO: 1742107 - protein, 17 aa, Staphylococcus epidermidis
IIMGRVYFYLAVLMNDI

SEQ ID NO: 1742108 - protein, 21 aa, Staphylococcus epidermidis
IIMLYRFLYNNQMLFTNFLST

SEQ ID NO: 1742109 - protein, 18 aa, Staphylococcus epidermidis
IIMSGLIGAILLTLGDGL

SEQ ID NO: 1742110 - protein, 17 aa, Staphylococcus epidermidis
IINCAKKKALSEVCPER

SEQ ID NO: 1742111 - protein, 18 aa, Staphylococcus epidermidis
IINICRSIGPAIAGVILA

SEQ ID NO: 1742112 - protein, 26 aa, Staphylococcus epidermidis
IINLKSFWIRRIKRLLPAVLALLIVV

SEQ ID NO: 1742113 - protein, 19 aa, Staphylococcus epidermidis
IINLPFIWLGYKQIGRKFA

SEQ ID NO: 1742114 - protein, 20 aa, Staphylococcus epidermidis
IINLPFIWLGYKQIGRKFAI

SEQ ID NO: 1742115 - protein, 30 aa, Staphylococcus epidermidis
IINLQREMWKYLSIIGVIVLFTVYLASRSI

SEQ ID NO: 1742116 - protein, 23 aa, Staphylococcus epidermidis
IINVFFLYFWIFKVTKTQTKKSA

SEQ ID NO: 1742117 - protein, 28 aa, Staphylococcus epidermidis
IIPILYRFVKRIHLGWFVLPVPIVLFIY

SEQ ID NO: 1742118 - protein, 24 aa, Staphylococcus epidermidis
IIPTFARKRLFGHQSMVWATAGIA

SEQ ID NO: 1742119 - protein, 33 aa, Staphylococcus epidermidis
IISIICLFLTLGLCTFFKFNLFSFKSLKKKELA

SEQ ID NO: 1742120 - protein, 36 aa, Staphylococcus epidermidis
IISKVHIVIPALKYDHEYTTHIELESVIPTIEDPEP

SEQ ID NO: 1742121 - protein, 25 aa, Staphylococcus epidermidis
IISRIVSCLLILFLGAAIFSLLGQH

SEQ ID NO: 1742122 - protein, 17 aa, Staphylococcus epidermidis
IISTLIIKIKNFVNAPF

SEQ ID NO: 1742123 - protein, 22 aa, Staphylococcus epidermidis
IITAFFKPAGSLFYLLVLLSFP

SEQ ID NO: 1742124 - protein, 21 aa, Staphylococcus epidermidis
IITFICYQFWLKHTNNQELYH

SEQ ID NO: 1742125 - protein, 21 aa, Staphylococcus epidermidis
IITIILCYLGFQFGLKKRDEM

SEQ ID NO: 1742126 - protein, 25 aa, Staphylococcus epidermidis
IIVAIVGMIAFVHFKYGNQTEDNTQ

SEQ ID NO: 1742127 - protein, 23 aa, Staphylococcus epidermidis
IIVFFCIFLIFSPIGKLKLGKPH

SEQ ID NO: 1742128 - protein, 23 aa, Staphylococcus epidermidis
IIVGYKYLSKRSMYLTIVATILI

SEQ ID NO: 1742129 - protein, 19 aa, Staphylococcus epidermidis
IIVQIKEIFAPLMTISINS

SEQ ID NO: 1742130 - protein, 22 aa, Staphylococcus epidermidis
IIVSCTVWQIGWIDIISYTVTI

SEQ ID NO: 1742131 - protein, 23 aa, Staphylococcus epidermidis
IIVSFCIGVLLFIGYSIIGLKYA

SEQ ID NO: 1742132 - protein, 20 aa, Staphylococcus epidermidis
IIVVIYRQPLLALIVGGSLT

SEQ ID NO: 1742133 - protein, 42 aa, Staphylococcus epidermidis
IIVYFIVCLLISFLALISMNIRILSGFLFLIAAIVTIPLVLL

SEQ ID NO: 1742134 - protein, 43 aa, Staphylococcus epidermidis
IIVYFIVCLLISFLALISMNIRILSGFLFLLAAVVTIPLVFLV

SEQ ID NO: 1742135 - protein, 20 aa, Staphylococcus epidermidis
IKAISAFSFFIYLLHPIILD

SEQ ID NO: 1742136 - protein, 18 aa, Staphylococcus epidermidis
IKAWSIYLIIKIVGTMTM

SEQ ID NO: 1742137 - protein, 38 aa, Staphylococcus epidermidis
IKDFWNRWHMTLSFWFRDCIYMRSLFYMSRKKLLKSQF

SEQ ID NO: 1742138 - protein, 21 aa, Staphylococcus epidermidis
IKDILSTAARENRELNTKEIA

SEQ ID NO: 1742139 - protein, 22 aa, Staphylococcus epidermidis
IKDLAPFIAAIVCILVFKHRKE

SEQ ID NO: 1742140 - protein, 26 aa, Staphylococcus epidermidis
IKDTLKRQLDEIEHANATSNSKAQAK

SEQ ID NO: 1742141 - protein, 23 aa, Staphylococcus epidermidis
IKEEIKSRIHINIPSLKYDHHYV

SEQ ID NO: 1742142 - protein, 36 aa, Staphylococcus epidermidis
IKEGDTFTIKYGQYIRPGGLELPAIKTQLRSKDGSI

SEQ ID NO: 1742143 - protein, 19 aa, Staphylococcus epidermidis
IKEMFKQWTKMAAQMTDGD

SEQ ID NO: 1742144 - protein, 22 aa, Staphylococcus epidermidis
IKEVQDGFKMAFNEKDGTGYAS

SEQ ID NO: 1742145 - protein, 21 aa, Staphylococcus epidermidis
IKFEMIDCGKGIPEEERQLIF

SEQ ID NO: 1742146 - protein, 20 aa, Staphylococcus epidermidis
IKFHVWRVAIQTEQHDYVGT

SEQ ID NO: 1742147 - protein, 17 aa, Staphylococcus epidermidis
IKGFVDFGGQTPDAGNT

SEQ ID NO: 1742148 - protein, 20 aa, Staphylococcus epidermidis
IKGIFFAVIGASLWGLGGTV

SEQ ID NO: 1742149 - protein, 27 aa, Staphylococcus epidermidis
IKGMLIASFQGLIPIIAGLVPAIMAVA

SEQ ID NO: 1742150 - protein, 17 aa, Staphylococcus epidermidis
IKHIISFEDIPDAIDKV

SEQ ID NO: 1742151 - protein, 21 aa, Staphylococcus epidermidis
IKHLIREPVFLFNIKAFTYIE

SEQ ID NO: 1742152 - protein, 19 aa, Staphylococcus epidermidis
IKITAWPTGIFLLLLIIVS

SEQ ID NO: 1742153 - protein, 18 aa, Staphylococcus epidermidis
IKKDDLILLVGFGGGLAY

SEQ ID NO: 1742154 - protein, 22 aa, Staphylococcus epidermidis
IKKRFKPQFIRTVVTIILALPL

SEQ ID NO: 1742155 - protein, 19 aa, Staphylococcus epidermidis
IKKWKADAIVLNKDANQTV

SEQ ID NO: 1742156 - protein, 20 aa, Staphylococcus epidermidis
IKNFKFFVQYGDFKDLKTNQ

SEQ ID NO: 1742157 - protein, 17 aa, Staphylococcus epidermidis
IKNKDWRIKTKHRKNKD

SEQ ID NO: 1742158 - protein, 20 aa, Staphylococcus epidermidis
IKNKPFELFVTGFFDNETDN

SEQ ID NO: 1742159 - protein, 21 aa, Staphylococcus epidermidis
IKNKYYIIVFVFIFLLSSILN

SEQ ID NO: 1742160 - protein, 18 aa, Staphylococcus epidermidis
IKNLEDFYNIEGYKDENF

SEQ ID NO: 1742161 - protein, 17 aa, Staphylococcus epidermidis
IKPDSNKNLVFIQNALA

SEQ ID NO: 1742162 - protein, 17 aa, Staphylococcus epidermidis
IKPIYFIGGILGMAFVT

SEQ ID NO: 1742163 - protein, 17 aa, Staphylococcus epidermidis
IKPLSIISVGFLLVQAL

SEQ ID NO: 1742164 - protein, 23 aa, Staphylococcus epidermidis
IKPYDLLPIISFITLNGRSRCCR

SEQ ID NO: 1742165 - protein, 24 aa, Staphylococcus epidermidis
IKRYYFKLNKVIGLEIKQHPLLER

SEQ ID NO: 1742166 - protein, 18 aa, Staphylococcus epidermidis
IKSLKVRFIYTMQLIVAF

SEQ ID NO: 1742167 - protein, 25 aa, Staphylococcus epidermidis
IKSLLAITCIAQFGSIIISVYHFNQ

SEQ ID NO: 1742168 - protein, 28 aa, Staphylococcus epidermidis
IKSLPFRRIISFFLVFTMLFSAGVVPLY

SEQ ID NO: 1742169 - protein, 18 aa, Staphylococcus epidermidis
IKSPRILDDVAKENKDYS

SEQ ID NO: 1742170 - protein, 17 aa, Staphylococcus epidermidis
IKTPLTHMQRLLTQLQF

SEQ ID NO: 1742171 - protein, 23 aa, Staphylococcus epidermidis
IKTQDFIIGIAIAIVILIIFAFA

SEQ ID NO: 1742172 - protein, 20 aa, Staphylococcus epidermidis
IKTVEDWSFEEKFGKDYGTL

SEQ ID NO: 1742173 - protein, 18 aa, Staphylococcus epidermidis
IKVKVIIIIALLAMSIMS

SEQ ID NO: 1742174 - protein, 23 aa, Staphylococcus epidermidis
IKVPKAMASIMPIIIIPILSSLI

SEQ ID NO: 1742175 - protein, 17 aa, Staphylococcus epidermidis
IKVRLIGVDTPETVKPN

SEQ ID NO: 1742176 - protein, 18 aa, Staphylococcus epidermidis
IKVTHFLKNFKSFKTNLY

SEQ ID NO: 1742177 - protein, 17 aa, Staphylococcus epidermidis
IKVTLAMVNVLLTAVEL

SEQ ID NO: 1742178 - protein, 17 aa, Staphylococcus epidermidis
IKYETMTFLTLPPKEVF

SEQ ID NO: 1742179 - protein, 19 aa, Staphylococcus epidermidis
IKYKRPVMDLIKERLPNTI

SEQ ID NO: 1742180 - protein, 20 aa, Staphylococcus epidermidis
IKYLCLHYGLGMLAGTLVHF

SEQ ID NO: 1742181 - protein, 17 aa, Staphylococcus epidermidis
IKYLDLEDQINSITASK

SEQ ID NO: 1742182 - protein, 18 aa, Staphylococcus epidermidis
ILAFRIIFSMIFMILVLI

SEQ ID NO: 1742183 - protein, 26 aa, Staphylococcus epidermidis
ILAGVNGDVTFYYRDGSVDVIDAENV

SEQ ID NO: 1742184 - protein, 18 aa, Staphylococcus epidermidis
ILAGVSWNITVFNIFRIL

SEQ ID NO: 1742185 - protein, 18 aa, Staphylococcus epidermidis
ILALITAYFVSKRLTKPL

SEQ ID NO: 1742186 - protein, 21 aa, Staphylococcus epidermidis
ILALTIGWIGRYLRYFRNLTR

SEQ ID NO: 1742187 - protein, 19 aa, Staphylococcus epidermidis
ILAVFKLNLGIDFSSGTRA

SEQ ID NO: 1742188 - protein, 24 aa, Staphylococcus epidermidis
ILDTHPAFYLSFITLLILFIIVLV

SEQ ID NO: 1742189 - protein, 21 aa, Staphylococcus epidermidis
ILEEFVFRKVFFGEIYNAIKG

SEQ ID NO: 1742190 - protein, 23 aa, Staphylococcus epidermidis
ILEEHKLPLGLDFEDVELVSLEV

SEQ ID NO: 1742191 - protein, 25 aa, Staphylococcus epidermidis
ILEIFYILIGLQFLYTAYRSLRSTD

SEQ ID NO: 1742192 - protein, 18 aa, Staphylococcus epidermidis
ILFASMIISIGFLAFSTL

SEQ ID NO: 1742193 - protein, 19 aa, Staphylococcus epidermidis
ILFFIIAIMMFARRNKVET

SEQ ID NO: 1742194 - protein, 17 aa, Staphylococcus epidermidis
ILFIICVVLGVISGLLS

SEQ ID NO: 1742195 - protein, 26 aa, Staphylococcus epidermidis
ILFIKLARIPFWFLIKGLTPIFFFLI

SEQ ID NO: 1742196 - protein, 18 aa, Staphylococcus epidermidis
ILFINACALILYGFTGLE

SEQ ID NO: 1742197 - protein, 17 aa, Staphylococcus epidermidis
ILGACYLIYLGIQSIRS

SEQ ID NO: 1742198 - protein, 21 aa, Staphylococcus epidermidis
ILGAGVEWGTTIVTLATFVIL

SEQ ID NO: 1742199 - protein, 26 aa, Staphylococcus epidermidis
ILGHICLSLPFAMFGLFASMFFIIIG

SEQ ID NO: 1742200 - protein, 26 aa, Staphylococcus epidermidis
ILGLLLIAFLVYLYFSVMKNHNQVEK

SEQ ID NO: 1742201 - protein, 21 aa, Staphylococcus epidermidis
ILGSMLLRMGGFKSSIARGLT

SEQ ID NO: 1742202 - protein, 18 aa, Staphylococcus epidermidis
ILIALCVGAMLSASGALL

SEQ ID NO: 1742203 - protein, 20 aa, Staphylococcus epidermidis
ILIALGTLWLGQKLAQQNFK

SEQ ID NO: 1742204 - protein, 17 aa, Staphylococcus epidermidis
ILICVTFSLLMVTPISL

SEQ ID NO: 1742205 - protein, 24 aa, Staphylococcus epidermidis
ILIFKRKWLDNRAFSKKFVPVVMA

SEQ ID NO: 1742206 - protein, 20 aa, Staphylococcus epidermidis
ILIFKRNWLDTRAFSKKFVP

SEQ ID NO: 1742207 - protein, 25 aa, Staphylococcus epidermidis
ILIGPLIHYLSWWGLGIDYIIILIG

SEQ ID NO: 1742208 - protein, 20 aa, Staphylococcus epidermidis
ILIICSIYLAFILIGSLSGK

SEQ ID NO: 1742209 - protein, 18 aa, Staphylococcus epidermidis
ILIIIIGFILKFDTIAII

SEQ ID NO: 1742210 - protein, 21 aa, Staphylococcus epidermidis
ILINHLNFWLLAIGFIILVAP

SEQ ID NO: 1742211 - protein, 17 aa, Staphylococcus epidermidis
ILINLGFFLLVIMCSIS

SEQ ID NO: 1742212 - protein, 18 aa, Staphylococcus epidermidis
ILISGVIFIIFVLLPASW

SEQ ID NO: 1742213 - protein, 27 aa, Staphylococcus epidermidis
ILISMLKLKLKWRVAVSSLLYGILNYY

SEQ ID NO: 1742214 - protein, 18 aa, Staphylococcus epidermidis
ILIVILFFLLKNFNSPEA

SEQ ID NO: 1742215 - protein, 20 aa, Staphylococcus epidermidis
ILLARKPFRVTIVLFIATLL

SEQ ID NO: 1742216 - protein, 17 aa, Staphylococcus epidermidis
ILLGIVLFLAVIIGATY

SEQ ID NO: 1742217 - protein, 18 aa, Staphylococcus epidermidis
ILLIAGAWYGLKLNKEKE

SEQ ID NO: 1742218 - protein, 20 aa, Staphylococcus epidermidis
ILLICSIVIIFGLKVPLLIA

SEQ ID NO: 1742219 - protein, 20 aa, Staphylococcus epidermidis
ILLIIYPVGLGWYLKTISYF

SEQ ID NO: 1742220 - protein, 18 aa, Staphylococcus epidermidis
ILLILAWVNQILAMNHIS

SEQ ID NO: 1742221 - protein, 25 aa, Staphylococcus epidermidis
ILLISCTFLLCFLKVDTSYTYLIII

SEQ ID NO: 1742222 - protein, 24 aa, Staphylococcus epidermidis
ILLIVVAIFVTRAIMNHNDDKVNN

SEQ ID NO: 1742223 - protein, 22 aa, Staphylococcus epidermidis
ILLLAVMWFFLIRPQQKRAKAH

SEQ ID NO: 1742224 - protein, 18 aa, Staphylococcus epidermidis
ILLLIIAAFIVKQVNGSG

SEQ ID NO: 1742225 - protein, 20 aa, Staphylococcus epidermidis
ILLLVVMYFLLIRPQQKRAK

SEQ ID NO: 1742226 - protein, 23 aa, Staphylococcus epidermidis
ILLMCLPLGIGLYLMQLFYYETR

SEQ ID NO: 1742227 - protein, 19 aa, Staphylococcus epidermidis
ILLSVCIGLVFGLIAGIER

SEQ ID NO: 1742228 - protein, 21 aa, Staphylococcus epidermidis
ILMAFVVEFGFRSYLQNILET

SEQ ID NO: 1742229 - protein, 17 aa, Staphylococcus epidermidis
ILMAIVFLFGANSFDPK

SEQ ID NO: 1742230 - protein, 17 aa, Staphylococcus epidermidis
ILMGIIIGHSLLNIVER

SEQ ID NO: 1742231 - protein, 17 aa, Staphylococcus epidermidis
ILMKNMLVYGLGGMIVP

SEQ ID NO: 1742232 - protein, 24 aa, Staphylococcus epidermidis
ILPEVSKKPQAKLELKQKADEIRA

SEQ ID NO: 1742233 - protein, 18 aa, Staphylococcus epidermidis
ILPLCLILFKGFAPGESG

SEQ ID NO: 1742234 - protein, 19 aa, Staphylococcus epidermidis
ILPMLSGAFQALGVAIGAI

SEQ ID NO: 1742235 - protein, 23 aa, Staphylococcus epidermidis
ILQGHVAWGYSIILIISSVIGAQ

SEQ ID NO: 1742236 - protein, 17 aa, Staphylococcus epidermidis
ILQGVSNNNLWFGASTM

SEQ ID NO: 1742237 - protein, 25 aa, Staphylococcus epidermidis
ILQIVFKLPIIVSVVVAILLGILVG

SEQ ID NO: 1742238 - protein, 28 aa, Staphylococcus epidermidis
ILQLQDGYRYYSFIDTIGVYSGSHLYVK

SEQ ID NO: 1742239 - protein, 19 aa, Staphylococcus epidermidis
ILRMLSIEQFAIFVVTGIL

SEQ ID NO: 1742240 - protein, 19 aa, Staphylococcus epidermidis
ILRSLRLAEKLGLKFEGIG

SEQ ID NO: 1742241 - protein, 22 aa, Staphylococcus epidermidis
ILSFKFLKALLYLKYLKKQSLY

SEQ ID NO: 1742242 - protein, 17 aa, Staphylococcus epidermidis
ILSLPLLLVMVVHISPI

SEQ ID NO: 1742243 - protein, 19 aa, Staphylococcus epidermidis
ILSWVCLALGLISFAAGLS

SEQ ID NO: 1742244 - protein, 18 aa, Staphylococcus epidermidis
ILTCIIFLGFLYQLYSKR

SEQ ID NO: 1742245 - protein, 18 aa, Staphylococcus epidermidis
ILTICIIGKLLYESLETI

SEQ ID NO: 1742246 - protein, 23 aa, Staphylococcus epidermidis
ILTICVLVIYAIYTDFVPSAVRA

SEQ ID NO: 1742247 - protein, 20 aa, Staphylococcus epidermidis
ILVALFIWRQSHLETPLLNF

SEQ ID NO: 1742248 - protein, 18 aa, Staphylococcus epidermidis
ILVGIFISISYNVLRVGL

SEQ ID NO: 1742249 - protein, 25 aa, Staphylococcus epidermidis
ILVICSCYLAFILIGSLQGKDMSNS

SEQ ID NO: 1742250 - protein, 23 aa, Staphylococcus epidermidis
ILVIFCGVAYYFLRKLDIKNKDK

SEQ ID NO: 1742251 - protein, 18 aa, Staphylococcus epidermidis
ILVVFCYLMSIYLITGLF

SEQ ID NO: 1742252 - protein, 24 aa, Staphylococcus epidermidis
ILVVIAICMAIFYLFVGLDFNIFE

SEQ ID NO: 1742253 - protein, 25 aa, Staphylococcus epidermidis
ILVVIAICMSIFYLLVGLDFDIFEY

SEQ ID NO: 1742254 - protein, 18 aa, Staphylococcus epidermidis
ILVVLFSVVTRSKWIGTL

SEQ ID NO: 1742255 - protein, 18 aa, Staphylococcus epidermidis
ILVYSMLTAFLFIDKVFV

SEQ ID NO: 1742256 - protein, 20 aa, Staphylococcus epidermidis
IMDIQRSFAVFTMASILTFI

SEQ ID NO: 1742257 - protein, 19 aa, Staphylococcus epidermidis
IMDLYRKKKYGIFLFKSLI

SEQ ID NO: 1742258 - protein, 28 aa, Staphylococcus epidermidis
IMFVVEVGMLLSLVLTFFPNLFIQENVS

SEQ ID NO: 1742259 - protein, 17 aa, Staphylococcus epidermidis
IMGGASFVRYHYFKNNQ

SEQ ID NO: 1742260 - protein, 24 aa, Staphylococcus epidermidis
IMIYICWLGIFLAFLFMNIASISD

SEQ ID NO: 1742261 - protein, 24 aa, Staphylococcus epidermidis
IMLGFLYKYIIAYFIQVYAVNPLQ

SEQ ID NO: 1742262 - protein, 17 aa, Staphylococcus epidermidis
IMLKLMLAIAFFAVSLA

SEQ ID NO: 1742263 - protein, 18 aa, Staphylococcus epidermidis
IMMSHNLWESIKESNNKR

SEQ ID NO: 1742264 - protein, 23 aa, Staphylococcus epidermidis
IMPLYRYKNFRYFIGEDEVHVRR

SEQ ID NO: 1742265 - protein, 18 aa, Staphylococcus epidermidis
IMSFGWQPLLFNALLYFI

SEQ ID NO: 1742266 - protein, 17 aa, Staphylococcus epidermidis
IMTCVFIGFIVCGRWIT

SEQ ID NO: 1742267 - protein, 27 aa, Staphylococcus epidermidis
IMVAVWCLIGYRLARFRYVSETLEKYG

SEQ ID NO: 1742268 - protein, 24 aa, Staphylococcus epidermidis
IMVIMIPLALMFGRIADRIGEKKV

SEQ ID NO: 1742269 - protein, 25 aa, Staphylococcus epidermidis
IMVIMIPLALMFGRIADRIGEKKVF

SEQ ID NO: 1742270 - protein, 18 aa, Staphylococcus epidermidis
INAMRTAQDYFPTVKKDV

SEQ ID NO: 1742271 - protein, 18 aa, Staphylococcus epidermidis
INAQVVEKESARNAIEQK

SEQ ID NO: 1742272 - protein, 17 aa, Staphylococcus epidermidis
INCGHFLQQTLSNANDN

SEQ ID NO: 1742273 - protein, 25 aa, Staphylococcus epidermidis
INDGWAKNGTYCIIRRIQIHIETWD

SEQ ID NO: 1742274 - protein, 26 aa, Staphylococcus epidermidis
INEMIPVEWERVYTMAYIDDQAGEVF

SEQ ID NO: 1742275 - protein, 25 aa, Staphylococcus epidermidis
INEREFNMYLPFINKCILKMERDEA

SEQ ID NO: 1742276 - protein, 24 aa, Staphylococcus epidermidis
INEYRPEYNKKKNAILKLYDVSDT

SEQ ID NO: 1742277 - protein, 24 aa, Staphylococcus epidermidis
INFVGCLWGLAAGISFATNMFTLP

SEQ ID NO: 1742278 - protein, 27 aa, Staphylococcus epidermidis
INGDGAPYKRRQNIINSSSGHRNQNNI

SEQ ID NO: 1742279 - protein, 23 aa, Staphylococcus epidermidis
INGMTCAACSNRIEKVLNQTQGV

SEQ ID NO: 1742280 - protein, 24 aa, Staphylococcus epidermidis
INGVICGIVAYILKIKGTALSAGF

SEQ ID NO: 1742281 - protein, 18 aa, Staphylococcus epidermidis
INHLWLFLIACLFGQLFI

SEQ ID NO: 1742282 - protein, 19 aa, Staphylococcus epidermidis
INHNKRLNFTATMTSDTNF

SEQ ID NO: 1742283 - protein, 28 aa, Staphylococcus epidermidis
INIFKAFKWRIIGFLAFLIIAILFLTLG

SEQ ID NO: 1742284 - protein, 24 aa, Staphylococcus epidermidis
INIKNVYFQYGFRNSVLKNINLNI

SEQ ID NO: 1742285 - protein, 17 aa, Staphylococcus epidermidis
INIMLKLGGVMINLLPL

SEQ ID NO: 1742286 - protein, 18 aa, Staphylococcus epidermidis
INISRIWIAIMFLIGFIA

SEQ ID NO: 1742287 - protein, 23 aa, Staphylococcus epidermidis
INKNTKLGMRYTYKNTIDNKTIY

SEQ ID NO: 1742288 - protein, 18 aa, Staphylococcus epidermidis
INKQVIWVFLIPVIVAII

SEQ ID NO: 1742289 - protein, 19 aa, Staphylococcus epidermidis
INKVEALLLDAKKQIAHAE

SEQ ID NO: 1742290 - protein, 18 aa, Staphylococcus epidermidis
INLILPIIVLSGIFILLS

SEQ ID NO: 1742291 - protein, 27 aa, Staphylococcus epidermidis
INNRLNKKFVIFFSIAYFFEGAGYIIT

SEQ ID NO: 1742292 - protein, 19 aa, Staphylococcus epidermidis
INNVKRFNQITGMNENEIR

SEQ ID NO: 1742293 - protein, 23 aa, Staphylococcus epidermidis
INPEYYAVVDFTGFEKMIDELEP

SEQ ID NO: 1742294 - protein, 23 aa, Staphylococcus epidermidis
INPEYYAVVDFTGFEKMIDELQP

SEQ ID NO: 1742295 - protein, 19 aa, Staphylococcus epidermidis
INRIGRIGGSKALNLNLGF

SEQ ID NO: 1742296 - protein, 17 aa, Staphylococcus epidermidis
INRSHILLGKFIGALLF

SEQ ID NO: 1742297 - protein, 25 aa, Staphylococcus epidermidis
INSAVTRTEVAAIIGQAKLLDQVME

SEQ ID NO: 1742298 - protein, 17 aa, Staphylococcus epidermidis
INVDTRRAIYCTPIWFI

SEQ ID NO: 1742299 - protein, 24 aa, Staphylococcus epidermidis
INVLPIVIVPLVVERKRIKEHPDV

SEQ ID NO: 1742300 - protein, 17 aa, Staphylococcus epidermidis
INYLFSRFKYIFIPYLL

SEQ ID NO: 1742301 - protein, 17 aa, Staphylococcus epidermidis
INYLYTFSVLFFVDLII

SEQ ID NO: 1742302 - protein, 19 aa, Staphylococcus epidermidis
IPEGLSIGVAFGGMASGNG

SEQ ID NO: 1742303 - protein, 18 aa, Staphylococcus epidermidis
IPFTWMMIIFSCLFLGTL

SEQ ID NO: 1742304 - protein, 18 aa, Staphylococcus epidermidis
IPGEGASGARIIRKEAQR

SEQ ID NO: 1742305 - protein, 24 aa, Staphylococcus epidermidis
IPGILKKKVSGWVLGILGLIFIIL

SEQ ID NO: 1742306 - protein, 20 aa, Staphylococcus epidermidis
IPGLIGLFIGFMFAMIGSAS

SEQ ID NO: 1742307 - protein, 17 aa, Staphylococcus epidermidis
IPGMMTGLIIGGVPPLQ

SEQ ID NO: 1742308 - protein, 20 aa, Staphylococcus epidermidis
IPGSLVFLFGRMLKTKKQIH

SEQ ID NO: 1742309 - protein, 20 aa, Staphylococcus epidermidis
IPGSLVFLFGRMLKTKLQIH

SEQ ID NO: 1742310 - protein, 35 aa, Staphylococcus epidermidis
IPGSLWIYYIRFIKGNLRWSILIVSLIPPIITQGL

SEQ ID NO: 1742311 - protein, 23 aa, Staphylococcus epidermidis
IPIIASLFIPFGVSIGLDTMALI

SEQ ID NO: 1742312 - protein, 18 aa, Staphylococcus epidermidis
IPIPMPASVIGLVLLFIA

SEQ ID NO: 1742313 - protein, 18 aa, Staphylococcus epidermidis
IPITIIWIVAITNAINLI

SEQ ID NO: 1742314 - protein, 17 aa, Staphylococcus epidermidis
IPKVLRVSYIINALNAI

SEQ ID NO: 1742315 - protein, 24 aa, Staphylococcus epidermidis
IPLAIVVIVVGGWYGLKLNKEKEI

SEQ ID NO: 1742316 - protein, 18 aa, Staphylococcus epidermidis
IPLFIICSHSLRKPFEKY

SEQ ID NO: 1742317 - protein, 18 aa, Staphylococcus epidermidis
IPLLLGLIILPVYKIFVY

SEQ ID NO: 1742318 - protein, 19 aa, Staphylococcus epidermidis
IPLSIDLAIKEGKIKKDDL

SEQ ID NO: 1742319 - protein, 21 aa, Staphylococcus epidermidis
IPLSILIALVALKLSNVSLNI

SEQ ID NO: 1742320 - protein, 18 aa, Staphylococcus epidermidis
IPLYAVGVFIPFTLAQFG

SEQ ID NO: 1742321 - protein, 17 aa, Staphylococcus epidermidis
IPNASIVTVEYDNGTDM

SEQ ID NO: 1742322 - protein, 30 aa, Staphylococcus epidermidis
IPSLCLIGMGIIGWYMWSLWSLIIALLPIS

SEQ ID NO: 1742323 - protein, 22 aa, Staphylococcus epidermidis
IPSLKYDHHYVTYIVMTNKDKL

SEQ ID NO: 1742324 - protein, 19 aa, Staphylococcus epidermidis
IPSMLSDYFDGFGSKLASF

SEQ ID NO: 1742325 - protein, 19 aa, Staphylococcus epidermidis
IPTWDIFGLHIKQLNYQGQ

SEQ ID NO: 1742326 - protein, 20 aa, Staphylococcus epidermidis
IPVILLVYFSFMDVHGHFSF

SEQ ID NO: 1742327 - protein, 26 aa, Staphylococcus epidermidis
IPVKFFKSCFLIGLILILVIDLIYLL

SEQ ID NO: 1742328 - protein, 18 aa, Staphylococcus epidermidis
IPYRKGMRAYVDDRQSNI

SEQ ID NO: 1742329 - protein, 33 aa, Staphylococcus epidermidis
IQGILTFRLYRHFYYRLFAIITVILIIFTFIPF

SEQ ID NO: 1742330 - protein, 27 aa, Staphylococcus epidermidis
IQKKGLRKYNNKLIAVTISSLALAAPL

SEQ ID NO: 1742331 - protein, 23 aa, Staphylococcus epidermidis
IQKPTARKAVNKKAEEINASINN

SEQ ID NO: 1742332 - protein, 27 aa, Staphylococcus epidermidis
IQNIWIYICWLGIFFAFTFMNIAAILD

SEQ ID NO: 1742333 - protein, 23 aa, Staphylococcus epidermidis
IQPSEFMKIILILALAKTISKHN

SEQ ID NO: 1742334 - protein, 21 aa, Staphylococcus epidermidis
IQTTPEFFQAISPYLPFTYSI

SEQ ID NO: 1742335 - protein, 20 aa, Staphylococcus epidermidis
IREVLKPHKIAFLTSPYVIM

SEQ ID NO: 1742336 - protein, 17 aa, Staphylococcus epidermidis
IRHTHCSYLLHNDVSIY

SEQ ID NO: 1742337 - protein, 25 aa, Staphylococcus epidermidis
IRIITIGAGIAWILGAIALHITMSF

SEQ ID NO: 1742338 - protein, 21 aa, Staphylococcus epidermidis
IRIITVGAVIAWILGAIALHT

SEQ ID NO: 1742339 - protein, 17 aa, Staphylococcus epidermidis
IRKNGFKAFTVMPKNLT

SEQ ID NO: 1742340 - protein, 34 aa, Staphylococcus epidermidis
IRMLFHPFKPYYIFKMRIPFTPGLIPKRRDEIAN

SEQ ID NO: 1742341 - protein, 26 aa, Staphylococcus epidermidis
IRNAYDYKISCVHIPKNGEEGLSGII

SEQ ID NO: 1742342 - protein, 27 aa, Staphylococcus epidermidis
IRSILWEHIIQLKMPFFDKNESGQLMS

SEQ ID NO: 1742343 - protein, 20 aa, Staphylococcus epidermidis
IRTGRLIAISSLVFCILLIL

SEQ ID NO: 1742344 - protein, 18 aa, Staphylococcus epidermidis
IRVNRSWKIPHEAAKISG

SEQ ID NO: 1742345 - protein, 21 aa, Staphylococcus epidermidis
IRYKLPKWLSILIVAICSSSL

SEQ ID NO: 1742346 - protein, 25 aa, Staphylococcus epidermidis
IRYYYKDILVCFVAVVFFNVTNYSV

SEQ ID NO: 1742347 - protein, 20 aa, Staphylococcus epidermidis
ISAFIGAGVLTFIHGDYIKP

SEQ ID NO: 1742348 - protein, 26 aa, Staphylococcus epidermidis
ISALGIKIVELFKISNPIARGLALGT

SEQ ID NO: 1742349 - protein, 26 aa, Staphylococcus epidermidis
ISALKPLKCLFIISFLAQLGSIVINT

SEQ ID NO: 1742350 - protein, 17 aa, Staphylococcus epidermidis
ISAMVIGILCLMISHWF

SEQ ID NO: 1742351 - protein, 28 aa, Staphylococcus epidermidis
ISCAMKSPGVSIAVGIVFYFATSILSGI

SEQ ID NO: 1742352 - protein, 21 aa, Staphylococcus epidermidis
ISCAMKSPGVSIAVGIVLYFA

SEQ ID NO: 1742353 - protein, 19 aa, Staphylococcus epidermidis
ISCSFKFDITINVYYIIIN

SEQ ID NO: 1742354 - protein, 25 aa, Staphylococcus epidermidis
ISDASGRKKPLLIAMIIFTLASLGI

SEQ ID NO: 1742355 - protein, 22 aa, Staphylococcus epidermidis
ISGIRLSSVYVISWATLASYVG

SEQ ID NO: 1742356 - protein, 19 aa, Staphylococcus epidermidis
ISGLFGNFVSLSFNTSTIS

SEQ ID NO: 1742357 - protein, 19 aa, Staphylococcus epidermidis
ISGVLLRQAFLKMDNYVDD

SEQ ID NO: 1742358 - protein, 22 aa, Staphylococcus epidermidis
ISHLKHHLVWSIEPTMLRLGLH

SEQ ID NO: 1742359 - protein, 24 aa, Staphylococcus epidermidis
ISIIVVALLLWIAVKTYKDSVLTF

SEQ ID NO: 1742360 - protein, 25 aa, Staphylococcus epidermidis
ISIQKEYWLVYGIVTLAAVIIPFFV

SEQ ID NO: 1742361 - protein, 18 aa, Staphylococcus epidermidis
ISISHHWISPFFITGVLG

SEQ ID NO: 1742362 - protein, 26 aa, Staphylococcus epidermidis
ISKILPVSMPFHIDMHNIIIVLVVFM

SEQ ID NO: 1742363 - protein, 26 aa, Staphylococcus epidermidis
ISKKPKVAGILLIIAGIIGIFTSFIA

SEQ ID NO: 1742364 - protein, 23 aa, Staphylococcus epidermidis
ISLAFGVLFDAFIVRMTLIPALT

SEQ ID NO: 1742365 - protein, 21 aa, Staphylococcus epidermidis
ISLFFVYAILYTRFSGFSFSE

SEQ ID NO: 1742366 - protein, 21 aa, Staphylococcus epidermidis
ISLFYCIVIFPITIILYTRIA

SEQ ID NO: 1742367 - protein, 25 aa, Staphylococcus epidermidis
ISLILAVVFFFGLKTYQGHKNIELM

SEQ ID NO: 1742368 - protein, 17 aa, Staphylococcus epidermidis
ISLRVAIISTIIVTILG

SEQ ID NO: 1742369 - protein, 18 aa, Staphylococcus epidermidis
ISMFSLFIFYKILILWTL

SEQ ID NO: 1742370 - protein, 28 aa, Staphylococcus epidermidis
ISMLISLYLKLMVIFGIALAIFILASIS

SEQ ID NO: 1742371 - protein, 22 aa, Staphylococcus epidermidis
ISMLNLRNGKTYTISNDKEADI

SEQ ID NO: 1742372 - protein, 24 aa, Staphylococcus epidermidis
ISMVFLRPMVEQIIYRYLIIHELG

SEQ ID NO: 1742373 - protein, 25 aa, Staphylococcus epidermidis
ISMVFLRPMVEQIIYRYLIIHELGK

SEQ ID NO: 1742374 - protein, 17 aa, Staphylococcus epidermidis
ISPRKAVEALYYNRYLK

SEQ ID NO: 1742375 - protein, 17 aa, Staphylococcus epidermidis
ISQEIYHNLLFNIIVSI

SEQ ID NO: 1742376 - protein, 17 aa, Staphylococcus epidermidis
ISRILCILLIIISVVGL

SEQ ID NO: 1742377 - protein, 17 aa, Staphylococcus epidermidis
ISRRRYRTLKKVVLKSI

SEQ ID NO: 1742378 - protein, 18 aa, Staphylococcus epidermidis
ISSAYAFYFADSRDDTFT

SEQ ID NO: 1742379 - protein, 23 aa, Staphylococcus epidermidis
ISSDIFVWFKLVLNDTSEFHNIK

SEQ ID NO: 1742380 - protein, 19 aa, Staphylococcus epidermidis
ISTFTVWGVILPVIFISIV

SEQ ID NO: 1742381 - protein, 18 aa, Staphylococcus epidermidis
ISTLLVSFIIMFVGIQVV

SEQ ID NO: 1742382 - protein, 26 aa, Staphylococcus epidermidis
ISTMMAAMCGFLFLAADPVKDGGFLS

SEQ ID NO: 1742383 - protein, 18 aa, Staphylococcus epidermidis
ISTPYALLFFDLLVVLIS

SEQ ID NO: 1742384 - protein, 27 aa, Staphylococcus epidermidis
ISTVITGVFSLWAWWKNNNFTHAAKKG

SEQ ID NO: 1742385 - protein, 17 aa, Staphylococcus epidermidis
ISYTVEFEAMRPKLVDL

SEQ ID NO: 1742386 - protein, 22 aa, Staphylococcus epidermidis
ITATKEGGIWNLDKEVPGITIE

SEQ ID NO: 1742387 - protein, 24 aa, Staphylococcus epidermidis
ITDHDDFSIDNGYFDDDSDSDSDA

SEQ ID NO: 1742388 - protein, 49 aa, Staphylococcus epidermidis
ITDLKRVAKTPGVWIILIGLAILPSFYAWFNLWAMWDPYGNTGHIKVAV

SEQ ID NO: 1742389 - protein, 24 aa, Staphylococcus epidermidis
ITDQQFFKFSFIHREPVMKENESY

SEQ ID NO: 1742390 - protein, 26 aa, Staphylococcus epidermidis
ITEIIPSFFPSIIVLFGSIFFLFMLD

SEQ ID NO: 1742391 - protein, 18 aa, Staphylococcus epidermidis
ITFGVLWVLTNVLGNENS

SEQ ID NO: 1742392 - protein, 23 aa, Staphylococcus epidermidis
ITGMTCAACSNRIEKKLNRLDDV

SEQ ID NO: 1742393 - protein, 22 aa, Staphylococcus epidermidis
ITGMTCAACSNRIEKVLNKTEG

SEQ ID NO: 1742394 - protein, 22 aa, Staphylococcus epidermidis
ITHRASATFIVLPGVKKGGYLG

SEQ ID NO: 1742395 - protein, 30 aa, Staphylococcus epidermidis
ITHSIPFTILWPILITFLIFVIFNHTEPLH

SEQ ID NO: 1742396 - protein, 28 aa, Staphylococcus epidermidis
ITHSLPFTILWPILITFFIFVIFSHTNP

SEQ ID NO: 1742397 - protein, 19 aa, Staphylococcus epidermidis
ITIARAMLKDAPIILLDEA

SEQ ID NO: 1742398 - protein, 17 aa, Staphylococcus epidermidis
ITIICYQFWLKHTNNQE

SEQ ID NO: 1742399 - protein, 17 aa, Staphylococcus epidermidis
ITISFIAIIALFCFKLY

SEQ ID NO: 1742400 - protein, 26 aa, Staphylococcus epidermidis
ITKIVLMVLMFIGRVGLISFIIMLAG

SEQ ID NO: 1742401 - protein, 24 aa, Staphylococcus epidermidis
ITKQPVDEIVHYGGEEIKTGHKDE

SEQ ID NO: 1742402 - protein, 19 aa, Staphylococcus epidermidis
ITKYVLLALITLISFIIAI

SEQ ID NO: 1742403 - protein, 26 aa, Staphylococcus epidermidis
ITLEDVFKIRACLRFDSKKDHKNIFD

SEQ ID NO: 1742404 - protein, 20 aa, Staphylococcus epidermidis
ITLFVPVELFNSWTSAQAQF

SEQ ID NO: 1742405 - protein, 35 aa, Staphylococcus epidermidis
ITLIGGILVWLGWYGFNVGSAFTFDQIAMVSFVNT

SEQ ID NO: 1742406 - protein, 30 aa, Staphylococcus epidermidis
ITLIGGILVWLGWYGFNVGSAFTLDHIAMI

SEQ ID NO: 1742407 - protein, 25 aa, Staphylococcus epidermidis
ITLLIVYVIPRFYKAIPAPLIAIIV

SEQ ID NO: 1742408 - protein, 17 aa, Staphylococcus epidermidis
ITLRGVKMDTTNNGQNW

SEQ ID NO: 1742409 - protein, 18 aa, Staphylococcus epidermidis
ITMLRKEATPHSPIVEAN

SEQ ID NO: 1742410 - protein, 18 aa, Staphylococcus epidermidis
ITPHIAVAVSGSIYNERV

SEQ ID NO: 1742411 - protein, 17 aa, Staphylococcus epidermidis
ITPRKAIEALYYNRYLK

SEQ ID NO: 1742412 - protein, 18 aa, Staphylococcus epidermidis
ITSRMGYIITKTVSIVLI

SEQ ID NO: 1742413 - protein, 19 aa, Staphylococcus epidermidis
ITSTSVALLLSNLVMNSVV

SEQ ID NO: 1742414 - protein, 18 aa, Staphylococcus epidermidis
ITTFLSMAYILAVNPQVL

SEQ ID NO: 1742415 - protein, 23 aa, Staphylococcus epidermidis
ITTKHLLASLIIQISMITFIGVA

SEQ ID NO: 1742416 - protein, 18 aa, Staphylococcus epidermidis
ITVGYLFNLFKFGKYIVG

SEQ ID NO: 1742417 - protein, 23 aa, Staphylococcus epidermidis
ITVVCCLMLVFAAGVASIVIIMV

SEQ ID NO: 1742418 - protein, 17 aa, Staphylococcus epidermidis
ITYLVVRLTILPEVKFN

SEQ ID NO: 1742419 - protein, 27 aa, Staphylococcus epidermidis
ITYTISMNWSLEVARAMTGGIGIVLTI

SEQ ID NO: 1742420 - protein, 21 aa, Staphylococcus epidermidis
IVAACVTFLFGSLRVNSIGVN

SEQ ID NO: 1742421 - protein, 17 aa, Staphylococcus epidermidis
IVAILVVYYIVRFMMQA

SEQ ID NO: 1742422 - protein, 19 aa, Staphylococcus epidermidis
IVALMAGIGFIARRTSHKA

SEQ ID NO: 1742423 - protein, 19 aa, Staphylococcus epidermidis
IVAMLKLNGWDTFHDVAQM

SEQ ID NO: 1742424 - protein, 18 aa, Staphylococcus epidermidis
IVAVLAIIAIIYIALKYA

SEQ ID NO: 1742425 - protein, 17 aa, Staphylococcus epidermidis
IVCYTNDVVKNFTANGL

SEQ ID NO: 1742426 - protein, 17 aa, Staphylococcus epidermidis
IVDVNAPTGNNRVYRVS

SEQ ID NO: 1742427 - protein, 17 aa, Staphylococcus epidermidis
IVDWVFEVFGKDILIFT

SEQ ID NO: 1742428 - protein, 25 aa, Staphylococcus epidermidis
IVFKSPRPVIIGVILQFTIMPSLAF

SEQ ID NO: 1742429 - protein, 21 aa, Staphylococcus epidermidis
IVFNYAGQVAMEIATEKTSRV

SEQ ID NO: 1742430 - protein, 29 aa, Staphylococcus epidermidis
IVFSIGLCYSILMALSRIRIGAHFTNDYC

SEQ ID NO: 1742431 - protein, 18 aa, Staphylococcus epidermidis
IVGPRHQLFLPIAILVGA

SEQ ID NO: 1742432 - protein, 18 aa, Staphylococcus epidermidis
IVGTMTMMLLGLYQTMRA

SEQ ID NO: 1742433 - protein, 20 aa, Staphylococcus epidermidis
IVIAAGWGLAVSMGVYAVGK

SEQ ID NO: 1742434 - protein, 28 aa, Staphylococcus epidermidis
IVISAILVAIGWRLIWKRQIDKHKKVML

SEQ ID NO: 1742435 - protein, 30 aa, Staphylococcus epidermidis
IVISAILVAIGWTLIWKRQVHKHKNIMLWA

SEQ ID NO: 1742436 - protein, 20 aa, Staphylococcus epidermidis
IVIVSGVIPFNIIKGIVISV

SEQ ID NO: 1742437 - protein, 18 aa, Staphylococcus epidermidis
IVKPEFSSSVIPSIAGLF

SEQ ID NO: 1742438 - protein, 18 aa, Staphylococcus epidermidis
IVKVLLLFHVPKYIVGTV

SEQ ID NO: 1742439 - protein, 25 aa, Staphylococcus epidermidis
IVLGGPGAVFWMWVIAFIGAASAFM

SEQ ID NO: 1742440 - protein, 18 aa, Staphylococcus epidermidis
IVLLCVGLILLSIFDRGL

SEQ ID NO: 1742441 - protein, 17 aa, Staphylococcus epidermidis
IVLLLSHHVFAYLFNLY

SEQ ID NO: 1742442 - protein, 26 aa, Staphylococcus epidermidis
IVLLTIPVLFLFPFVQKHFVKGINIG

SEQ ID NO: 1742443 - protein, 26 aa, Staphylococcus epidermidis
IVLLTIPVLFLFPFVQKHFVKGITIG

SEQ ID NO: 1742444 - protein, 19 aa, Staphylococcus epidermidis
IVLNPQFINHIGFQFSFLI

SEQ ID NO: 1742445 - protein, 22 aa, Staphylococcus epidermidis
IVLSGIFILLSIHFPQYGHYFM

SEQ ID NO: 1742446 - protein, 17 aa, Staphylococcus epidermidis
IVLTILAMFLIKHTPET

SEQ ID NO: 1742447 - protein, 18 aa, Staphylococcus epidermidis
IVMIYQVIVGLIFFAING

SEQ ID NO: 1742448 - protein, 22 aa, Staphylococcus epidermidis
IVNLFRAIPFIILILLLIPFTS

SEQ ID NO: 1742449 - protein, 25 aa, Staphylococcus epidermidis
IVNVLCGYSLIIAFISIYFIGATVN

SEQ ID NO: 1742450 - protein, 18 aa, Staphylococcus epidermidis
IVPIILCIIGFKSDKLIA

SEQ ID NO: 1742451 - protein, 26 aa, Staphylococcus epidermidis
IVQFSNTCFNRWQFTTILLAPLVIIS

SEQ ID NO: 1742452 - protein, 28 aa, Staphylococcus epidermidis
IVQFTQTCFHRWQFTIIMIAPLVIISAT

SEQ ID NO: 1742453 - protein, 24 aa, Staphylococcus epidermidis
IVQGHVAWGYSIALIISSIIGAQI

SEQ ID NO: 1742454 - protein, 19 aa, Staphylococcus epidermidis
IVRALRKGVLSVFNALKKG

SEQ ID NO: 1742455 - protein, 21 aa, Staphylococcus epidermidis
IVSICAIIYLAKHKFYNAERL

SEQ ID NO: 1742456 - protein, 24 aa, Staphylococcus epidermidis
IVTKRKKPFLSMMPVVAMYSLWLT

SEQ ID NO: 1742457 - protein, 22 aa, Staphylococcus epidermidis
IVTRIKAFIPLMVPLFISAFQR

SEQ ID NO: 1742458 - protein, 24 aa, Staphylococcus epidermidis
IVTRRKKPFLSMMPVVAMYSLWLT

SEQ ID NO: 1742459 - protein, 17 aa, Staphylococcus epidermidis
IVVAILFFILFLVAISS

SEQ ID NO: 1742460 - protein, 18 aa, Staphylococcus epidermidis
IVVFLPLVFVSGSVGEMF

SEQ ID NO: 1742461 - protein, 25 aa, Staphylococcus epidermidis
IVVVKPKANEIIRKKAAEQTTLINQ

SEQ ID NO: 1742462 - protein, 25 aa, Staphylococcus epidermidis
IVYDKRKIAFISFLLLLTLFVLFSI

SEQ ID NO: 1742463 - protein, 18 aa, Staphylococcus epidermidis
IWASIAIHFLFDATQLFD

SEQ ID NO: 1742464 - protein, 25 aa, Staphylococcus epidermidis
IWDREGWMIFIGWLSYFLLGFYIGT

SEQ ID NO: 1742465 - protein, 19 aa, Staphylococcus epidermidis
IWFVVPILIVIALAVPTVK

SEQ ID NO: 1742466 - protein, 25 aa, Staphylococcus epidermidis
IWMSPKLDRILGMLSGILYSGIYWV

SEQ ID NO: 1742467 - protein, 20 aa, Staphylococcus epidermidis
IWTLSIDHMSEAAKSTGIDT

SEQ ID NO: 1742468 - protein, 25 aa, Staphylococcus epidermidis
IWTVPCYLCAFIAIVYGFTGIGIKK

SEQ ID NO: 1742469 - protein, 18 aa, Staphylococcus epidermidis
IYFDYKIKPGKANTRNAI

SEQ ID NO: 1742470 - protein, 17 aa, Staphylococcus epidermidis
IYFFVFRFLILKFDIPL

SEQ ID NO: 1742471 - protein, 19 aa, Staphylococcus epidermidis
IYFYPRFKISKLAGLMTFI

SEQ ID NO: 1742472 - protein, 23 aa, Staphylococcus epidermidis
IYGIRPSLLYVFIALFVSVVIGA

SEQ ID NO: 1742473 - protein, 24 aa, Staphylococcus epidermidis
IYHSFLLKKWYLFLYLILILLTLI

SEQ ID NO: 1742474 - protein, 17 aa, Staphylococcus epidermidis
IYIVWTIGLFIGLMYGI

SEQ ID NO: 1742475 - protein, 18 aa, Staphylococcus epidermidis
IYIVWVIALFIGLMYGIL

SEQ ID NO: 1742476 - protein, 29 aa, Staphylococcus epidermidis
IYLFMLGFYRLPGLVAIIALTAYIYLTLV

SEQ ID NO: 1742477 - protein, 23 aa, Staphylococcus epidermidis
IYLFYSPRLKFDVLENPNKGNKS

SEQ ID NO: 1742478 - protein, 19 aa, Staphylococcus epidermidis
IYLIIKIVGTMTMMLLGLY

SEQ ID NO: 1742479 - protein, 18 aa, Staphylococcus epidermidis
IYNLPITFIFIATTYGFL

SEQ ID NO: 1742480 - protein, 18 aa, Staphylococcus epidermidis
IYSPFRLILLMVIAIIGM

SEQ ID NO: 1742481 - protein, 18 aa, Staphylococcus epidermidis
IYSPLRLIILMVIAILGM

SEQ ID NO: 1742482 - protein, 21 aa, Staphylococcus epidermidis
IYTIICNLLIILAAITLMYFD

SEQ ID NO: 1742483 - protein, 18 aa, Staphylococcus epidermidis
IYYFVFRFLITKFNFKTP

SEQ ID NO: 1742484 - protein, 24 aa, Staphylococcus epidermidis
KAADRKIKIQRINDATAEEIQEAN

SEQ ID NO: 1742485 - protein, 18 aa, Staphylococcus epidermidis
KAAILSIVANIIGFLIVG

SEQ ID NO: 1742486 - protein, 19 aa, Staphylococcus epidermidis
KADEFEFTLKNEQGVEVAR

SEQ ID NO: 1742487 - protein, 22 aa, Staphylococcus epidermidis
KAEANRLLQNVLTSASDEIANV

SEQ ID NO: 1742488 - protein, 19 aa, Staphylococcus epidermidis
KAEEVKRTKDALDGNHRLE

SEQ ID NO: 1742489 - protein, 18 aa, Staphylococcus epidermidis
KAFIPLFILGMLFWAIQE

SEQ ID NO: 1742490 - protein, 21 aa, Staphylococcus epidermidis
KAFKAKIKVLEYNNAKAEKKI

SEQ ID NO: 1742491 - protein, 17 aa, Staphylococcus epidermidis
KAFPVILISLLIIRTVI

SEQ ID NO: 1742492 - protein, 19 aa, Staphylococcus epidermidis
KAGIPLTIVGYILVIIFSL

SEQ ID NO: 1742493 - protein, 26 aa, Staphylococcus epidermidis
KAHHPIEFNMIWKAMLIPSMGYIVGL

SEQ ID NO: 1742494 - protein, 19 aa, Staphylococcus epidermidis
KAIFKDFGLLLTRPTFVIP

SEQ ID NO: 1742495 - protein, 25 aa, Staphylococcus epidermidis
KAIMGGAWFVRFHYFKNNQLNLYQM

SEQ ID NO: 1742496 - protein, 17 aa, Staphylococcus epidermidis
KAIQRLRNGTVSVTDVM

SEQ ID NO: 1742497 - protein, 32 aa, Staphylococcus epidermidis
KAKADPRNVGGGGAFGAFVSTDRNGMATTEAS

SEQ ID NO: 1742498 - protein, 32 aa, Staphylococcus epidermidis
KAKADPRNVGGGGAFGAFVSTDRNGMATTEES

SEQ ID NO: 1742499 - protein, 18 aa, Staphylococcus epidermidis
KAKLDANQMIDQKVEDIN

SEQ ID NO: 1742500 - protein, 17 aa, Staphylococcus epidermidis
KAKLDANQMIDQKVENI

SEQ ID NO: 1742501 - protein, 18 aa, Staphylococcus epidermidis
KAKVHRLLKQKGWEDKIK

SEQ ID NO: 1742502 - protein, 17 aa, Staphylococcus epidermidis
KALDELLSAIKSINNSI

SEQ ID NO: 1742503 - protein, 26 aa, Staphylococcus epidermidis
KALEAGKVIPHWDVFGLHINEVGYQG

SEQ ID NO: 1742504 - protein, 18 aa, Staphylococcus epidermidis
KALELARTLPQRSTTEKR

SEQ ID NO: 1742505 - protein, 22 aa, Staphylococcus epidermidis
KALFCSGMIMILSSIVFGAMST

SEQ ID NO: 1742506 - protein, 18 aa, Staphylococcus epidermidis
KALMLPVAILPAAGLLLA

SEQ ID NO: 1742507 - protein, 21 aa, Staphylococcus epidermidis
KALYYWIRYLNYNVIYRDKGD

SEQ ID NO: 1742508 - protein, 20 aa, Staphylococcus epidermidis
KANEARTAIQNEHSNNGVAQ

SEQ ID NO: 1742509 - protein, 19 aa, Staphylococcus epidermidis
KANVVDLSINHNLEGKLVS

SEQ ID NO: 1742510 - protein, 19 aa, Staphylococcus epidermidis
KARRIKQDGSYEMIDASDL

SEQ ID NO: 1742511 - protein, 27 aa, Staphylococcus epidermidis
KASPEFFAKTSFARFIISLGEKYLPFF

SEQ ID NO: 1742512 - protein, 24 aa, Staphylococcus epidermidis
KATDSLATSEVRTSTNQISNLTST

SEQ ID NO: 1742513 - protein, 20 aa, Staphylococcus epidermidis
KATIALFCTYLFSYYISKNK

SEQ ID NO: 1742514 - protein, 17 aa, Staphylococcus epidermidis
KAVDFSVLKSLKDQPSV

SEQ ID NO: 1742515 - protein, 18 aa, Staphylococcus epidermidis
KCHDYQFVFMLRLVITII

SEQ ID NO: 1742516 - protein, 19 aa, Staphylococcus epidermidis
KCHDYQFVFMLRLVITIIY

SEQ ID NO: 1742517 - protein, 21 aa, Staphylococcus epidermidis
KDFILIPAFIIFQSIIPIIIV

SEQ ID NO: 1742518 - protein, 24 aa, Staphylococcus epidermidis
KDGKEIKVRMIGMDTPETVKPNTP

SEQ ID NO: 1742519 - protein, 23 aa, Staphylococcus epidermidis
KDGLPLLKTRGLKNIVEPLPMSD

SEQ ID NO: 1742520 - protein, 18 aa, Staphylococcus epidermidis
KDHHLSLGDISRSYSDKY

SEQ ID NO: 1742521 - protein, 26 aa, Staphylococcus epidermidis
KDHSFRYAIFKGLGLGGAMTTGFLTI

SEQ ID NO: 1742522 - protein, 25 aa, Staphylococcus epidermidis
KDIEEILSHGIDVWTTLNIQHIESL

SEQ ID NO: 1742523 - protein, 21 aa, Staphylococcus epidermidis
KDIEELVIWTAQQVKLLIIFS

SEQ ID NO: 1742524 - protein, 22 aa, Staphylococcus epidermidis
KDIENRWLIPFHYVVFGLALVV

SEQ ID NO: 1742525 - protein, 22 aa, Staphylococcus epidermidis
KDIKPLPSLIMYGTEDKIVDTD

SEQ ID NO: 1742526 - protein, 19 aa, Staphylococcus epidermidis
KDKAIQYVQSLSYINDAQR

SEQ ID NO: 1742527 - protein, 17 aa, Staphylococcus epidermidis
KDKGFKVGDEIKLSQSD

SEQ ID NO: 1742528 - protein, 24 aa, Staphylococcus epidermidis
KDKMEFQMLYGFRTELSQKIANEG

SEQ ID NO: 1742529 - protein, 22 aa, Staphylococcus epidermidis
KDKYMPRMFIVRGDRLGYSNSI

SEQ ID NO: 1742530 - protein, 18 aa, Staphylococcus epidermidis
KDNFTQAINNARDVLNKT

SEQ ID NO: 1742531 - protein, 30 aa, Staphylococcus epidermidis
KDNFYIISIEIVFFYLSWDFMSHTLFTLNL

SEQ ID NO: 1742532 - protein, 24 aa, Staphylococcus epidermidis
KDQMEFQMLYGFRSELAQSIANEG

SEQ ID NO: 1742533 - protein, 17 aa, Staphylococcus epidermidis
KDQRFSLNFHYPTLSEI

SEQ ID NO: 1742534 - protein, 18 aa, Staphylococcus epidermidis
KDRDIPYLAYIVGIMVVL

SEQ ID NO: 1742535 - protein, 30 aa, Staphylococcus epidermidis
KDSRIKSYQDYFLQFNWFQPLLIGLAGLLI

SEQ ID NO: 1742536 - protein, 18 aa, Staphylococcus epidermidis
KDTTYKLSQSIPKQIYET

SEQ ID NO: 1742537 - protein, 17 aa, Staphylococcus epidermidis
KDTTYKLSQSIPKQVYE

SEQ ID NO: 1742538 - protein, 17 aa, Staphylococcus epidermidis
KDVTSQFAPKVSADGTR

SEQ ID NO: 1742539 - protein, 23 aa, Staphylococcus epidermidis
KDYGSGKERVWVYNIPVKVDKQT

SEQ ID NO: 1742540 - protein, 19 aa, Staphylococcus epidermidis
KEAAIQLVDQYVKQGEDRL

SEQ ID NO: 1742541 - protein, 19 aa, Staphylococcus epidermidis
KEATPHSPIVETNEERVNV

SEQ ID NO: 1742542 - protein, 20 aa, Staphylococcus epidermidis
KEAVITIARGQNYSIGPNLR

SEQ ID NO: 1742543 - protein, 21 aa, Staphylococcus epidermidis
KEEEIRYIFNHNKIYKNINHK

SEQ ID NO: 1742544 - protein, 18 aa, Staphylococcus epidermidis
KEEGRLRSYTIVPTSNLA

SEQ ID NO: 1742545 - protein, 21 aa, Staphylococcus epidermidis
KEERISELLGHIVWMNAIDYV

SEQ ID NO: 1742546 - protein, 28 aa, Staphylococcus epidermidis
KEFISYIITMIICVLFIYIMHHDQVYMM

SEQ ID NO: 1742547 - protein, 20 aa, Staphylococcus epidermidis
KEFITFLIAMISCLILTYIF

SEQ ID NO: 1742548 - protein, 21 aa, Staphylococcus epidermidis
KEFITFLIAMVSCLILTYIFN

SEQ ID NO: 1742549 - protein, 17 aa, Staphylococcus epidermidis
KEFPKIKSTIYQQKHQI

SEQ ID NO: 1742550 - protein, 23 aa, Staphylococcus epidermidis
KEGDKIGVPGLVRGLHDMHVKEG

SEQ ID NO: 1742551 - protein, 18 aa, Staphylococcus epidermidis
KEGFSYFFDNMNIIIIKY

SEQ ID NO: 1742552 - protein, 25 aa, Staphylococcus epidermidis
KEGGFKRLFPYSFVNKAKESYRFEN

SEQ ID NO: 1742553 - protein, 17 aa, Staphylococcus epidermidis
KEGILFHYLFSKNKQET

SEQ ID NO: 1742554 - protein, 21 aa, Staphylococcus epidermidis
KEGVSVFVFIVIIAIIINYMD

SEQ ID NO: 1742555 - protein, 20 aa, Staphylococcus epidermidis
KEILAIIAVADEVRESSKEV

SEQ ID NO: 1742556 - protein, 22 aa, Staphylococcus epidermidis
KEITLEAKGALYMKNKLQHGSQ

SEQ ID NO: 1742557 - protein, 26 aa, Staphylococcus epidermidis
KELALPDIQAVKVLAVVKPQAKNQIQ

SEQ ID NO: 1742558 - protein, 18 aa, Staphylococcus epidermidis
KELKDLGPVSAREWRLIV

SEQ ID NO: 1742559 - protein, 25 aa, Staphylococcus epidermidis
KELNFWTWMMIIPFLTSAILIGPLI

SEQ ID NO: 1742560 - protein, 19 aa, Staphylococcus epidermidis
KENKALFFANISFVVLIVL

SEQ ID NO: 1742561 - protein, 23 aa, Staphylococcus epidermidis
KENKTPSSIRNFDQALNRAESQI

SEQ ID NO: 1742562 - protein, 20 aa, Staphylococcus epidermidis
KENLFHFGMYVALTSLAGTI

SEQ ID NO: 1742563 - protein, 20 aa, Staphylococcus epidermidis
KEPKASYAYEDKTEFEKQWS

SEQ ID NO: 1742564 - protein, 18 aa, Staphylococcus epidermidis
KEQSHLMYLLEQHTSYFL

SEQ ID NO: 1742565 - protein, 21 aa, Staphylococcus epidermidis
KEQTKGLGWLAGGGGVLFATL

SEQ ID NO: 1742566 - protein, 20 aa, Staphylococcus epidermidis
KERLDTAFSNFFTYENLTEL

SEQ ID NO: 1742567 - protein, 17 aa, Staphylococcus epidermidis
KERNGFTIIKKKKEHGY

SEQ ID NO: 1742568 - protein, 31 aa, Staphylococcus epidermidis
KESILKLNPKYMVKNPIMFVVEVGMLLSLVL

SEQ ID NO: 1742569 - protein, 20 aa, Staphylococcus epidermidis
KESQISRTTFYSHYNDKEHF

SEQ ID NO: 1742570 - protein, 23 aa, Staphylococcus epidermidis
KFFKDSHPQYNRPLNTKITDIKY

SEQ ID NO: 1742571 - protein, 26 aa, Staphylococcus epidermidis
KFGPRKMITIALVWWSAFTILTGMIK

SEQ ID NO: 1742572 - protein, 24 aa, Staphylococcus epidermidis
KFIFDKRKRDVLALRNGTNVKLAY

SEQ ID NO: 1742573 - protein, 19 aa, Staphylococcus epidermidis
KFILPIVVGLIIWALTPIK

SEQ ID NO: 1742574 - protein, 17 aa, Staphylococcus epidermidis
KFKIEAPPNLKDRFQLF

SEQ ID NO: 1742575 - protein, 24 aa, Staphylococcus epidermidis
KFKRKQIHEPWLFSLPAVILMLLI

SEQ ID NO: 1742576 - protein, 24 aa, Staphylococcus epidermidis
KFKSHYDIFKDFNLNSDKPTIDNK

SEQ ID NO: 1742577 - protein, 17 aa, Staphylococcus epidermidis
KFLNFNLSIAMLIALAV

SEQ ID NO: 1742578 - protein, 18 aa, Staphylococcus epidermidis
KFLQLSINNAQMLEMTKN

SEQ ID NO: 1742579 - protein, 22 aa, Staphylococcus epidermidis
KFTRFFRMIYLRFKARKNRRKE

SEQ ID NO: 1742580 - protein, 19 aa, Staphylococcus epidermidis
KFTTFFSGFLIGLIVIYIL

SEQ ID NO: 1742581 - protein, 25 aa, Staphylococcus epidermidis
KFYKFRFILIMLIVFLMAIMVLFIS

SEQ ID NO: 1742582 - protein, 17 aa, Staphylococcus epidermidis
KGAQISLYIGVVAALLD

SEQ ID NO: 1742583 - protein, 18 aa, Staphylococcus epidermidis
KGDIITGIDGKQIKDDTD

SEQ ID NO: 1742584 - protein, 18 aa, Staphylococcus epidermidis
KGETKTKYDAMKKDNTEN

SEQ ID NO: 1742585 - protein, 21 aa, Staphylococcus epidermidis
KGIELFIMLLITLIAFVLANS

SEQ ID NO: 1742586 - protein, 21 aa, Staphylococcus epidermidis
KGIGIPGGMALVFSIISGAGW

SEQ ID NO: 1742587 - protein, 24 aa, Staphylococcus epidermidis
KGIGPHEFIEFPIVVANPKEEGKF

SEQ ID NO: 1742588 - protein, 20 aa, Staphylococcus epidermidis
KGIIPDWEPGKKVHLVGHSM

SEQ ID NO: 1742589 - protein, 25 aa, Staphylococcus epidermidis
KGIPLTSKRFIDWLNLNNIVPGFYG

SEQ ID NO: 1742590 - protein, 17 aa, Staphylococcus epidermidis
KGKDKVYVERVVDGDTF

SEQ ID NO: 1742591 - protein, 22 aa, Staphylococcus epidermidis
KGKIMTSRGMVLYINRNTRTAK

SEQ ID NO: 1742592 - protein, 17 aa, Staphylococcus epidermidis
KGLENGSYTVEFETPSG

SEQ ID NO: 1742593 - protein, 29 aa, Staphylococcus epidermidis
KGLFYSVLFWLCILSFFSVLNEMVLNVSL

SEQ ID NO: 1742594 - protein, 24 aa, Staphylococcus epidermidis
KGLTRAGAISGMIAGALVVIIWIA

SEQ ID NO: 1742595 - protein, 17 aa, Staphylococcus epidermidis
KGNKDIFTFLNFSSIYR

SEQ ID NO: 1742596 - protein, 20 aa, Staphylococcus epidermidis
KGNKKRSKTLISLVQNIVKY

SEQ ID NO: 1742597 - protein, 20 aa, Staphylococcus epidermidis
KGNPFKGVINFIFVLFVTLF

SEQ ID NO: 1742598 - protein, 19 aa, Staphylococcus epidermidis
KGNSDASALSKVKMPRKES

SEQ ID NO: 1742599 - protein, 21 aa, Staphylococcus epidermidis
KGQGWTHIWFDLLILTLFIIV

SEQ ID NO: 1742600 - protein, 30 aa, Staphylococcus epidermidis
KGQKHTGWLIVLSIIFVLLIAALLYGAYYA

SEQ ID NO: 1742601 - protein, 19 aa, Staphylococcus epidermidis
KGRRERLGMTLNELEQRTQ

SEQ ID NO: 1742602 - protein, 26 aa, Staphylococcus epidermidis
KGRSRRSEYWFAMLWHLIFMIPAIIG

SEQ ID NO: 1742603 - protein, 20 aa, Staphylococcus epidermidis
KGSGDVSYRISFKTQGAPTA

SEQ ID NO: 1742604 - protein, 18 aa, Staphylococcus epidermidis
KGSSRQNIGLKFSEVDNV

SEQ ID NO: 1742605 - protein, 17 aa, Staphylococcus epidermidis
KGTTVTLTIKRGSQEKD

SEQ ID NO: 1742606 - protein, 23 aa, Staphylococcus epidermidis
KHAHQSISIGIVFVVVIFVSVIQ

SEQ ID NO: 1742607 - protein, 25 aa, Staphylococcus epidermidis
KHDLPPMIVHYFFDLMVSMGVFCFV

SEQ ID NO: 1742608 - protein, 18 aa, Staphylococcus epidermidis
KHHGFDIKGTTRALFSTI

SEQ ID NO: 1742609 - protein, 25 aa, Staphylococcus epidermidis
KHHGLLYFIRFLFGVGEAPMYPSNA

SEQ ID NO: 1742610 - protein, 20 aa, Staphylococcus epidermidis
KHVRGPGSFLPELLDQLYNL

SEQ ID NO: 1742611 - protein, 19 aa, Staphylococcus epidermidis
KIAGFLGIDVNELVDYKLT

SEQ ID NO: 1742612 - protein, 21 aa, Staphylococcus epidermidis
KIALGIGGAITVVALSRKESR

SEQ ID NO: 1742613 - protein, 17 aa, Staphylococcus epidermidis
KIARRGAAYGGIVFSIL

SEQ ID NO: 1742614 - protein, 18 aa, Staphylococcus epidermidis
KIELGEPFIKKLSKESNY

SEQ ID NO: 1742615 - protein, 22 aa, Staphylococcus epidermidis
KIFYRDYSVLFFIILLSTVFLE

SEQ ID NO: 1742616 - protein, 18 aa, Staphylococcus epidermidis
KIGLTALGYKVDNESNKF

SEQ ID NO: 1742617 - protein, 18 aa, Staphylococcus epidermidis
KIGNLFGGMVKGVKKGLN

SEQ ID NO: 1742618 - protein, 17 aa, Staphylococcus epidermidis
KIGWFIFAIAYTLFTNF

SEQ ID NO: 1742619 - protein, 23 aa, Staphylococcus epidermidis
KIHLESFQTFLINKKVNGKEVTP

SEQ ID NO: 1742620 - protein, 17 aa, Staphylococcus epidermidis
KIIESFIPIPMPASVIG

SEQ ID NO: 1742621 - protein, 17 aa, Staphylococcus epidermidis
KIIFKGKHGELLKNNER

SEQ ID NO: 1742622 - protein, 17 aa, Staphylococcus epidermidis
KIIGLLISFIFVISPLY

SEQ ID NO: 1742623 - protein, 19 aa, Staphylococcus epidermidis
KIISIRYFLLTVFIVCSIV

SEQ ID NO: 1742624 - protein, 20 aa, Staphylococcus epidermidis
KIISVLSFMIGVMFVSLIHA

SEQ ID NO: 1742625 - protein, 18 aa, Staphylococcus epidermidis
KIKKEPKASYAYEDKTEF

SEQ ID NO: 1742626 - protein, 19 aa, Staphylococcus epidermidis
KIKSFKFFSQYGNFKDIDS

SEQ ID NO: 1742627 - protein, 17 aa, Staphylococcus epidermidis
KILPSIKKKGITTINYL

SEQ ID NO: 1742628 - protein, 20 aa, Staphylococcus epidermidis
KILSFIIRLLFGHRTFTHSL

SEQ ID NO: 1742629 - protein, 25 aa, Staphylococcus epidermidis
KIMFRKKLYLFMSIFLPVAFYLLFT

SEQ ID NO: 1742630 - protein, 39 aa, Staphylococcus epidermidis
KINEFKQLVIAFFKEHWPKMLIIIGIIVLLLILNAIFTT

SEQ ID NO: 1742631 - protein, 20 aa, Staphylococcus epidermidis
KISFKNSLQLLLKNKSKTHE

SEQ ID NO: 1742632 - protein, 19 aa, Staphylococcus epidermidis
KITKFKGLAILSSDALSSV

SEQ ID NO: 1742633 - protein, 21 aa, Staphylococcus epidermidis
KIYFSNEIFYKVIEIDITVNT

SEQ ID NO: 1742634 - protein, 20 aa, Staphylococcus epidermidis
KKAEAREAVTNSANSKIKNI

SEQ ID NO: 1742635 - protein, 19 aa, Staphylococcus epidermidis
KKAKSLAFRDVKNHFVRNE

SEQ ID NO: 1742636 - protein, 25 aa, Staphylococcus epidermidis
KKARRICWFGSITVTLILAVPLYCS

SEQ ID NO: 1742637 - protein, 20 aa, Staphylococcus epidermidis
KKDFIANVSHELRTPISLLQ

SEQ ID NO: 1742638 - protein, 18 aa, Staphylococcus epidermidis
KKDREEKKPVIPKSGKDE

SEQ ID NO: 1742639 - protein, 17 aa, Staphylococcus epidermidis
KKDREEKKPVIPSNGKV

SEQ ID NO: 1742640 - protein, 24 aa, Staphylococcus epidermidis
KKELDFWTCMMIIPIVLGSVLIGP

SEQ ID NO: 1742641 - protein, 25 aa, Staphylococcus epidermidis
KKEPKRYIVPWALLGFCIVMIYQVI

SEQ ID NO: 1742642 - protein, 25 aa, Staphylococcus epidermidis
KKGDSKIIIVKRFKNIWKANEQISG

SEQ ID NO: 1742643 - protein, 24 aa, Staphylococcus epidermidis
KKGFFKNKLIYLGIPYVIINLSIS

SEQ ID NO: 1742644 - protein, 26 aa, Staphylococcus epidermidis
KKGITYLKKRWFIIIIVFLIALGLSN

SEQ ID NO: 1742645 - protein, 24 aa, Staphylococcus epidermidis
KKGSKKRSKTLISLVQNVVKYIVW

SEQ ID NO: 1742646 - protein, 17 aa, Staphylococcus epidermidis
KKGVGYVKILFIVVTAV

SEQ ID NO: 1742647 - protein, 26 aa, Staphylococcus epidermidis
KKHLKIVLIIESYINFIIISCISMIG

SEQ ID NO: 1742648 - protein, 17 aa, Staphylococcus epidermidis
KKIAKKVFNNHAMGQSI

SEQ ID NO: 1742649 - protein, 25 aa, Staphylococcus epidermidis
KKIELGEPFIKRLSEHSNYNFETVS

SEQ ID NO: 1742650 - protein, 31 aa, Staphylococcus epidermidis
KKIHRSLLSLSIAIIGIFLGVTGLYIFRRKE

SEQ ID NO: 1742651 - protein, 17 aa, Staphylococcus epidermidis
KKIKVTLAMVNVLLTAV

SEQ ID NO: 1742652 - protein, 19 aa, Staphylococcus epidermidis
KKIWSGSFFGFVKSILSFT

SEQ ID NO: 1742653 - protein, 21 aa, Staphylococcus epidermidis
KKIYLAVIIIISLIFTLASLY

SEQ ID NO: 1742654 - protein, 19 aa, Staphylococcus epidermidis
KKKGLLGSLPFINKNKRSS

SEQ ID NO: 1742655 - protein, 27 aa, Staphylococcus epidermidis
KKKKRFKLRMPGAFMILFLLTVVAVIA

SEQ ID NO: 1742656 - protein, 32 aa, Staphylococcus epidermidis
KKKMHRSLLSLSIAIIGIFLGVTGLYIFRRKG

SEQ ID NO: 1742657 - protein, 22 aa, Staphylococcus epidermidis
KKKRLITVSSVVIAISLLIIIL

SEQ ID NO: 1742658 - protein, 22 aa, Staphylococcus epidermidis
KKKRSWVSIVIHIIVLVLTAIT

SEQ ID NO: 1742659 - protein, 22 aa, Staphylococcus epidermidis
KKKYGIFLFKSLIPIVVTVWII

SEQ ID NO: 1742660 - protein, 20 aa, Staphylococcus epidermidis
KKLIICIGLVLFSISEFMFA

SEQ ID NO: 1742661 - protein, 21 aa, Staphylococcus epidermidis
KKNALRLAKSYVKNINISNQA

SEQ ID NO: 1742662 - protein, 23 aa, Staphylococcus epidermidis
KKPFKLKLSYRFNTTSIQWKQLF

SEQ ID NO: 1742663 - protein, 19 aa, Staphylococcus epidermidis
KKPKRSLYALIMTLCGVHG

SEQ ID NO: 1742664 - protein, 20 aa, Staphylococcus epidermidis
KKPRSINAYNKAIQSLETQI

SEQ ID NO: 1742665 - protein, 21 aa, Staphylococcus epidermidis
KKQSFCNKCGKHLKTSTQRKS

SEQ ID NO: 1742666 - protein, 31 aa, Staphylococcus epidermidis
KKQSIDEISKILPVIEIKSAARNEIHQKAEV

SEQ ID NO: 1742667 - protein, 20 aa, Staphylococcus epidermidis
KKQWLGVIVSIILFTLSHGP

SEQ ID NO: 1742668 - protein, 17 aa, Staphylococcus epidermidis
KKSLEQQKTRVKLYKSG

SEQ ID NO: 1742669 - protein, 25 aa, Staphylococcus epidermidis
KKSRLRIYILLIICVVVLMLTLSLM

SEQ ID NO: 1742670 - protein, 18 aa, Staphylococcus epidermidis
KKTDELRDKERDLRNKVL

SEQ ID NO: 1742671 - protein, 21 aa, Staphylococcus epidermidis
KKTIFPFIIASGFIADTTSLP

SEQ ID NO: 1742672 - protein, 22 aa, Staphylococcus epidermidis
KKTVMLPIELKSSNSEKVANNI

SEQ ID NO: 1742673 - protein, 26 aa, Staphylococcus epidermidis
KKVKHICVMIFLVFFLIGFIILLSLV

SEQ ID NO: 1742674 - protein, 29 aa, Staphylococcus epidermidis
KKYAKFKFSYSWIHFGKIFLYSFIMMIGV

SEQ ID NO: 1742675 - protein, 24 aa, Staphylococcus epidermidis
KKYNHDWLSLGLFVLISSLAFGFA

SEQ ID NO: 1742676 - protein, 17 aa, Staphylococcus epidermidis
KKYPVVMKHNKIIPTKP

SEQ ID NO: 1742677 - protein, 18 aa, Staphylococcus epidermidis
KKYPVVMKHNKIIPTKPI

SEQ ID NO: 1742678 - protein, 19 aa, Staphylococcus epidermidis
KLEIVPIHYIHSDKPTNTP

SEQ ID NO: 1742679 - protein, 20 aa, Staphylococcus epidermidis
KLFESNKYYPIFGSSELGKD

SEQ ID NO: 1742680 - protein, 19 aa, Staphylococcus epidermidis
KLGSFEMIILPVLVPVISG

SEQ ID NO: 1742681 - protein, 18 aa, Staphylococcus epidermidis
KLGTFPIGNYNLKATKNM

SEQ ID NO: 1742682 - protein, 25 aa, Staphylococcus epidermidis
KLHPTRFAFMMSLVVLIAWILYYFV

SEQ ID NO: 1742683 - protein, 25 aa, Staphylococcus epidermidis
KLIIAKAEAKQVIKELSQKKRDAIN

SEQ ID NO: 1742684 - protein, 18 aa, Staphylococcus epidermidis
KLIKFCSFLLIFIEVFVP

SEQ ID NO: 1742685 - protein, 23 aa, Staphylococcus epidermidis
KLKKEDRKGLAMIVDEQLNALEK

SEQ ID NO: 1742686 - protein, 17 aa, Staphylococcus epidermidis
KLKVVGIVESAKYNASP

SEQ ID NO: 1742687 - protein, 18 aa, Staphylococcus epidermidis
KLKVVGIVESAKYNASPV

SEQ ID NO: 1742688 - protein, 30 aa, Staphylococcus epidermidis
KLKYKAKLFPFGPIFAGVLCVIVIIGQDVD

SEQ ID NO: 1742689 - protein, 23 aa, Staphylococcus epidermidis
KLLEGFNHAWLFASLTLFLALLL

SEQ ID NO: 1742690 - protein, 18 aa, Staphylococcus epidermidis
KLLPTRMILIGIAMFAML

SEQ ID NO: 1742691 - protein, 19 aa, Staphylococcus epidermidis
KLNAVKVKEDLNVSNEPSK

SEQ ID NO: 1742692 - protein, 17 aa, Staphylococcus epidermidis
KLNEARALLQNKEDNSA

SEQ ID NO: 1742693 - protein, 23 aa, Staphylococcus epidermidis
KLNRNTREAKGFYYINKYSDDID

SEQ ID NO: 1742694 - protein, 24 aa, Staphylococcus epidermidis
KLPGVNTSMDWDRKYPYGDTLRGI

SEQ ID NO: 1742695 - protein, 23 aa, Staphylococcus epidermidis
KLPNFLFLFLMLSMIIYFSFITL

SEQ ID NO: 1742696 - protein, 17 aa, Staphylococcus epidermidis
KLSHHFYTMGLFAVSCL

SEQ ID NO: 1742697 - protein, 30 aa, Staphylococcus epidermidis
KLSKIRPLQWIAGIYIEFLRGTPMLVQVFI

SEQ ID NO: 1742698 - protein, 23 aa, Staphylococcus epidermidis
KLSKRFQKLILLHTSAQGIYSEL

SEQ ID NO: 1742699 - protein, 26 aa, Staphylococcus epidermidis
KLSMKRQQYVLKRMRVEGKISKQQYK

SEQ ID NO: 1742700 - protein, 17 aa, Staphylococcus epidermidis
KLSNKTLGALIVGAFAL

SEQ ID NO: 1742701 - protein, 34 aa, Staphylococcus epidermidis
KLTNLVFKYKIYPVLMCIVSIFLSITVVIQNISI

SEQ ID NO: 1742702 - protein, 17 aa, Staphylococcus epidermidis
KLVKEIKINKGDKVQFL

SEQ ID NO: 1742703 - protein, 25 aa, Staphylococcus epidermidis
KLYECDDCSECPLKQQCMNFNSKTN

SEQ ID NO: 1742704 - protein, 19 aa, Staphylococcus epidermidis
KLYFERLFMNLIDNSIQHN

SEQ ID NO: 1742705 - protein, 21 aa, Staphylococcus epidermidis
KLYKHFYYKLFALLLLATIIF

SEQ ID NO: 1742706 - protein, 30 aa, Staphylococcus epidermidis; identical to SEQ ID NO: 1576927

SEQ ID NO: 1742707 - protein, 21 aa, Staphylococcus epidermidis
KMEVKELKARGNASTKADEAK

SEQ ID NO: 1742708 - protein, 28 aa, Staphylococcus epidermidis
KMLIIQSLCVLLGIWIYKMDKNESSAII

SEQ ID NO: 1742709 - protein, 17 aa, Staphylococcus epidermidis
KMMGDGVGFIPEKGEIV

SEQ ID NO: 1742710 - protein, 19 aa, Staphylococcus epidermidis
KMPIISYFIGLVLAIIGLF

SEQ ID NO: 1742711 - protein, 20 aa, Staphylococcus epidermidis
KMRSIFGLKPLHGTQVRSDD

SEQ ID NO: 1742712 - protein, 17 aa, Staphylococcus epidermidis
KNAKDKLPDTGANEDHD

SEQ ID NO: 1742713 - protein, 20 aa, Staphylococcus epidermidis
KNFSEFPALGLVLGVMIGIG

SEQ ID NO: 1742714 - protein, 26 aa, Staphylococcus epidermidis
KNGKKTWFKFFIGVLLIGLLASIINR

SEQ ID NO: 1742715 - protein, 22 aa, Staphylococcus epidermidis
KNGTKYLIFDNMSFTAPTKKPI

SEQ ID NO: 1742716 - protein, 20 aa, Staphylococcus epidermidis
KNGYTDFVAVRFGNVLGSRG

SEQ ID NO: 1742717 - protein, 18 aa, Staphylococcus epidermidis
KNHGLAFIMVILQMFFAF

SEQ ID NO: 1742718 - protein, 19 aa, Staphylococcus epidermidis
KNHGVGFSVIKEAINYHEG

SEQ ID NO: 1742719 - protein, 21 aa, Staphylococcus epidermidis
KNIIAVIAIILIIYIALQHAP

SEQ ID NO: 1742720 - protein, 17 aa, Staphylococcus epidermidis
KNISSNLTQSIETKATD

SEQ ID NO: 1742721 - protein, 19 aa, Staphylococcus epidermidis
KNISSNLTQSIETKATDSL

SEQ ID NO: 1742722 - protein, 21 aa, Staphylococcus epidermidis
KNKIISLLISFIFVMSPLYFR

SEQ ID NO: 1742723 - protein, 21 aa, Staphylococcus epidermidis
KNLAGCLFIAAAITGIVTMNL

SEQ ID NO: 1742724 - protein, 17 aa, Staphylococcus epidermidis
KNLEDFYDKEGYRDEEF

SEQ ID NO: 1742725 - protein, 17 aa, Staphylococcus epidermidis
KNLGYVMQNSGVLNRTV

SEQ ID NO: 1742726 - protein, 19 aa, Staphylococcus epidermidis
KNLPHLIGYCTQRIKQTWH

SEQ ID NO: 1742727 - protein, 24 aa, Staphylococcus epidermidis
KNLQDIKDFIARNVYNGKEYQLSD

SEQ ID NO: 1742728 - protein, 17 aa, Staphylococcus epidermidis
KNLQGMVVVLHDITNLQ

SEQ ID NO: 1742729 - protein, 17 aa, Staphylococcus epidermidis
KNLTINWFNVLSLTVII

SEQ ID NO: 1742730 - protein, 25 aa, Staphylococcus epidermidis
KNMDGKKFNGAIVINMSDDTSNAYE

SEQ ID NO: 1742731 - protein, 21 aa, Staphylococcus epidermidis
KNMLGCLPVLIQMPILMGLYM

SEQ ID NO: 1742732 - protein, 23 aa, Staphylococcus epidermidis
KNQSIEEIAMILPEVSKKPQAKL

SEQ ID NO: 1742733 - protein, 18 aa, Staphylococcus epidermidis
KNRSRIPEMTYNFKRIER

SEQ ID NO: 1742734 - protein, 25 aa, Staphylococcus epidermidis
KNSFHFLLEFLFTMWTMFFLTIAMG

SEQ ID NO: 1742735 - protein, 18 aa, Staphylococcus epidermidis
KNSIIYLFLSFIVIVASA

SEQ ID NO: 1742736 - protein, 20 aa, Staphylococcus epidermidis
KNSKTFAVNHLDNLNQAQKE

SEQ ID NO: 1742737 - protein, 17 aa, Staphylococcus epidermidis
KNSRMSWNHNHYPFDSW

SEQ ID NO: 1742738 - protein, 24 aa, Staphylococcus epidermidis
KNSTYRYLGNRANLMALWDVQDRL

SEQ ID NO: 1742739 - protein, 34 aa, Staphylococcus epidermidis
KNTNMLNKTGKDYDLQEQRGYTDSEQHNETQSNQ

SEQ ID NO: 1742740 - protein, 19 aa, Staphylococcus epidermidis
KNVDKVLDSSRFINEDQPE

SEQ ID NO: 1742741 - protein, 17 aa, Staphylococcus epidermidis
KNVKIVIVSGVIPFNII

SEQ ID NO: 1742742 - protein, 23 aa, Staphylococcus epidermidis
KNYILMIPLTFIFGATLLLISDV

SEQ ID NO: 1742743 - protein, 19 aa, Staphylococcus epidermidis
KNYKPVWIIISFIILITIL

SEQ ID NO: 1742744 - protein, 20 aa, Staphylococcus epidermidis
KPASVRRYNEAISNIRSELD

SEQ ID NO: 1742745 - protein, 19 aa, Staphylococcus epidermidis
KPGKWSIYFYGIAYAVTSL

SEQ ID NO: 1742746 - protein, 26 aa, Staphylococcus epidermidis
KPKILKKLTLGIGIFATLLTSFILGI

SEQ ID NO: 1742747 - protein, 17 aa, Staphylococcus epidermidis
KPLKDQFHYGFMLQGNG

SEQ ID NO: 1742748 - protein, 27 aa, Staphylococcus epidermidis
KPLYSKRIYQNLTFDSIVFRNALQYTV

SEQ ID NO: 1742749 - protein, 21 aa, Staphylococcus epidermidis
KPMDGLLHFLGRLFHDNYGLA

SEQ ID NO: 1742750 - protein, 32 aa, Staphylococcus epidermidis
KPNENFLQTDYRAVLYIKEQVNKELIPYIDPN

SEQ ID NO: 1742751 - protein, 33 aa, Staphylococcus epidermidis
KPNENFLQTDYRAVLYIKEQVNKELIPYIDPNS

SEQ ID NO: 1742752 - protein, 20 aa, Staphylococcus epidermidis
KPQILKALLFALLSFAVCFF

SEQ ID NO: 1742753 - protein, 17 aa, Staphylococcus epidermidis
KPTFGAAFESFKDPGQL

SEQ ID NO: 1742754 - protein, 23 aa, Staphylococcus epidermidis
KPTRYTIMVGIDLLLIILIIVTL

SEQ ID NO: 1742755 - protein, 19 aa, Staphylococcus epidermidis
KPVGCKIVVSKVEEIETLV

SEQ ID NO: 1742756 - protein, 20 aa, Staphylococcus epidermidis
KPVRTEVLRPTKLIDDKDEK

SEQ ID NO: 1742757 - protein, 18 aa, Staphylococcus epidermidis
KQAAIAKVNSELAKAQEQ

SEQ ID NO: 1742758 - protein, 17 aa, Staphylococcus epidermidis
KQAFKAANSGLNLNDND

SEQ ID NO: 1742759 - protein, 17 aa, Staphylococcus epidermidis
KQALSAKATEKLNAINA

SEQ ID NO: 1742760 - protein, 23 aa, Staphylococcus epidermidis
KQDAIQRLNVKREEVKNLINQDR

SEQ ID NO: 1742761 - protein, 19 aa, Staphylococcus epidermidis
KQDGFFFNTFVQPMKHLLQ

SEQ ID NO: 1742762 - protein, 27 aa, Staphylococcus epidermidis
KQEAINRVSAELARVQAQINAEHTTQG

SEQ ID NO: 1742763 - protein, 20 aa, Staphylococcus epidermidis
KQEAISRVNTALAEATQKIN

SEQ ID NO: 1742764 - protein, 24 aa, Staphylococcus epidermidis
KQGDKIGTPGFVRGMHDMHEKEGK

SEQ ID NO: 1742765 - protein, 20 aa, Staphylococcus epidermidis
KQHFDCAMIFISHDLTVINK

SEQ ID NO: 1742766 - protein, 23 aa, Staphylococcus epidermidis
KQHRFSFKGQIFFVSIDSMMEKI

SEQ ID NO: 1742767 - protein, 33 aa, Staphylococcus epidermidis
KQIKDKRLPQVINEAISIFKYLTNNAYTMINYS

SEQ ID NO: 1742768 - protein, 17 aa, Staphylococcus epidermidis
KQIKERLLTLLIATIQA

SEQ ID NO: 1742769 - protein, 22 aa, Staphylococcus epidermidis
KQIKFLKWFISRRFYRSGICSV

SEQ ID NO: 1742770 - protein, 25 aa, Staphylococcus epidermidis
KQIKIKLWHFILIILGIILLTSIIT

SEQ ID NO: 1742771 - protein, 17 aa, Staphylococcus epidermidis
KQIVGKVILRFWPFNNM

SEQ ID NO: 1742772 - protein, 29 aa, Staphylococcus epidermidis
KQLGSVVTCILILIACIFIKEPFVYFVIW

SEQ ID NO: 1742773 - protein, 19 aa, Staphylococcus epidermidis
KQLLAPILVLIVWNMTTNL

SEQ ID NO: 1742774 - protein, 32 aa, Staphylococcus epidermidis
KQLNNFKNLGYSYVGTDALKAPNYTETSGTPT

SEQ ID NO: 1742775 - protein, 33 aa, Staphylococcus epidermidis
KQLNNFKNLGYSYVGTDALKAPNYTETSGTPTL

SEQ ID NO: 1742776 - protein, 18 aa, Staphylococcus epidermidis
KQLPRLQKQVNIAGTFNG

SEQ ID NO: 1742777 - protein, 17 aa, Staphylococcus epidermidis
KQLSSKKYLGYGTASAL

SEQ ID NO: 1742778 - protein, 25 aa, Staphylococcus epidermidis
KQQILEIIEAIQFYDVEAHMSVKIS

SEQ ID NO: 1742779 - protein, 27 aa, Staphylococcus epidermidis
KQSIDEISKILPVIESKSAARNEIHQK

SEQ ID NO: 1742780 - protein, 36 aa, Staphylococcus epidermidis
KQSIDEVSKILPVIEIKLAARNEIHQKAEVIRGLIN

SEQ ID NO: 1742781 - protein, 25 aa, Staphylococcus epidermidis
KQSRIKIFTKDNMQVIGDITTISDK

SEQ ID NO: 1742782 - protein, 26 aa, Staphylococcus epidermidis
KQSRIKIFTKDNMQVIGDITTISDKM

SEQ ID NO: 1742783 - protein, 17 aa, Staphylococcus epidermidis
KQVGVTWIMAMTLLMSM

SEQ ID NO: 1742784 - protein, 20 aa, Staphylococcus epidermidis
KQVLPLSMIIGAWFVVLTDL

SEQ ID NO: 1742785 - protein, 20 aa, Staphylococcus epidermidis
KQVTEAFGIDISSQLETISS

SEQ ID NO: 1742786 - protein, 17 aa, Staphylococcus epidermidis
KQWDAIKEIKFVVKNHE

SEQ ID NO: 1742787 - protein, 19 aa, Staphylococcus epidermidis
KQYIRWANNIVHGNFGESI

SEQ ID NO: 1742788 - protein, 24 aa, Staphylococcus epidermidis
KQYKDFYLTAYIKRGNPDSNYTVN

SEQ ID NO: 1742789 - protein, 21 aa, Staphylococcus epidermidis
KREVLKRYWLQIFGGIAVGTI

SEQ ID NO: 1742790 - protein, 19 aa, Staphylococcus epidermidis
KRFEREVHNSSLLSHDNIV

SEQ ID NO: 1742791 - protein, 19 aa, Staphylococcus epidermidis
KRIKEVVGEDGTTRVEIWT

SEQ ID NO: 1742792 - protein, 28 aa, Staphylococcus epidermidis
KRIQFDDCSGVKNCLNKQISKTQLPDTG

SEQ ID NO: 1742793 - protein, 22 aa, Staphylococcus epidermidis
KRIYQNLTFDSIVFRNALQYSV

SEQ ID NO: 1742794 - protein, 18 aa, Staphylococcus epidermidis
KRKESRLVDVSGKTYLNY

SEQ ID NO: 1742795 - protein, 27 aa, Staphylococcus epidermidis
KRKSLLRRKSISIILVLLFLAQQITMV

SEQ ID NO: 1742796 - protein, 20 aa, Staphylococcus epidermidis
KRLIVLASSMLLFYIFLSTK

SEQ ID NO: 1742797 - protein, 21 aa, Staphylococcus epidermidis
KRLLLYVIILLTMCAFLNLMP

SEQ ID NO: 1742798 - protein, 17 aa, Staphylococcus epidermidis
KRLPMLDLPIIPIIISR

SEQ ID NO: 1742799 - protein, 32 aa, Staphylococcus epidermidis
KRLVPIMTAFFCTFLAIILLFVWPPVFNAIVT

SEQ ID NO: 1742800 - protein, 19 aa, Staphylococcus epidermidis
KRLVPIMTAFFCTILAIIL

SEQ ID NO: 1742801 - protein, 20 aa, Staphylococcus epidermidis
KRLVPIMTAFFCTILAVILL

SEQ ID NO: 1742802 - protein, 17 aa, Staphylococcus epidermidis
KRMRVEGKISKQQYKNA

SEQ ID NO: 1742803 - protein, 26 aa, Staphylococcus epidermidis
KRNKIKFSLVIGILVLISYLLFLLSG

SEQ ID NO: 1742804 - protein, 25 aa, Staphylococcus epidermidis
KRNKLKFGLIIGILVLISYLLFLLS

SEQ ID NO: 1742805 - protein, 24 aa, Staphylococcus epidermidis
KRNYKSGTIFAIVCWLVISVAIFV

SEQ ID NO: 1742806 - protein, 18 aa, Staphylococcus epidermidis
KRPIIKRHVALVGTLLTL

SEQ ID NO: 1742807 - protein, 23 aa, Staphylococcus epidermidis
KRPIIKRYVALVGTLLTLVVALI

SEQ ID NO: 1742808 - protein, 23 aa, Staphylococcus epidermidis
KRQGEPFIDLSLFSNNVYIGTTL

SEQ ID NO: 1742809 - protein, 26 aa, Staphylococcus epidermidis
KRRQREFALYMILGMEKKHLKIVLII

SEQ ID NO: 1742810 - protein, 30 aa, Staphylococcus epidermidis
KRSGIMCPEFAIGMGPKIFSFRKDETLYTI

SEQ ID NO: 1742811 - protein, 25 aa, Staphylococcus epidermidis
KRSKVKIIVLSLIFVLLLASLIGFI

SEQ ID NO: 1742812 - protein, 20 aa, Staphylococcus epidermidis
KRSYSLYLWHFPIMSFVHSY

SEQ ID NO: 1742813 - protein, 20 aa, Staphylococcus epidermidis
KRTDETISFTDNVNLQPSNT

SEQ ID NO: 1742814 - protein, 21 aa, Staphylococcus epidermidis
KRYAELQKEFQFESLTSKSET

SEQ ID NO: 1742815 - protein, 22 aa, Staphylococcus epidermidis
KRYKYPMILGILMLAITSIFHP

SEQ ID NO: 1742816 - protein, 19 aa, Staphylococcus epidermidis
KRYTILSIIFMVYFGCCMA

SEQ ID NO: 1742817 - protein, 18 aa, Staphylococcus epidermidis
KSAVIIWNAIKFAVQHPI

SEQ ID NO: 1742818 - protein, 26 aa, Staphylococcus epidermidis
KSEWVIELPEGLTLEEAMIYGTAGYT

SEQ ID NO: 1742819 - protein, 17 aa, Staphylococcus epidermidis
KSGNSIRITYLGNITLN

SEQ ID NO: 1742820 - protein, 25 aa, Staphylococcus epidermidis
KSIEYRIIPLIVCVANIGKDLTVAG

SEQ ID NO: 1742821 - protein, 18 aa, Staphylococcus epidermidis
KSIFSFVKFLYQNFSFPV

SEQ ID NO: 1742822 - protein, 19 aa, Staphylococcus epidermidis
KSIFSFVKFLYQNFSFPVL

SEQ ID NO: 1742823 - protein, 18 aa, Staphylococcus epidermidis
KSISSNLTQSIETKATDS

SEQ ID NO: 1742824 - protein, 17 aa, Staphylococcus epidermidis
KSKAFIIFMSIIVILMI

SEQ ID NO: 1742825 - protein, 22 aa, Staphylococcus epidermidis
KSKAFTLIEMLLVLLIISLLLI

SEQ ID NO: 1742826 - protein, 19 aa, Staphylococcus epidermidis
KSKAKKDIDQKLAQQINQI

SEQ ID NO: 1742827 - protein, 28 aa, Staphylococcus epidermidis
KSKEKQLKEEDIHSIPVVKRKLNSDNND

SEQ ID NO: 1742828 - protein, 23 aa, Staphylococcus epidermidis
KSKETIQLVMLIGMIVIVSLIIW

SEQ ID NO: 1742829 - protein, 21 aa, Staphylococcus epidermidis
KSKLLEMGKGFTIVVEQPKVL

SEQ ID NO: 1742830 - protein, 17 aa, Staphylococcus epidermidis
KSLKVRFIYTMQLIVAF

SEQ ID NO: 1742831 - protein, 22 aa, Staphylococcus epidermidis
KSLLYIRIVISFVVGAIVSALL

SEQ ID NO: 1742832 - protein, 23 aa, Staphylococcus epidermidis
KSMDEFLHFLGRVFQDNYGFAII

SEQ ID NO: 1742833 - protein, 19 aa, Staphylococcus epidermidis
KSNHLTLTLSIYMFTVICV

SEQ ID NO: 1742834 - protein, 39 aa, Staphylococcus epidermidis
KSNKSIIVDGQFKSVDAFKNLKIPLSISGQAGQNDSDSD

SEQ ID NO: 1742835 - protein, 18 aa, Staphylococcus epidermidis
KSPFEFGAYFILALSLVF

SEQ ID NO: 1742836 - protein, 23 aa, Staphylococcus epidermidis
KSPIFKAMMHFSIPMMIGSLLSV

SEQ ID NO: 1742837 - protein, 24 aa, Staphylococcus epidermidis
KSPLLVGVGEGFNVIASDALAMLQ

SEQ ID NO: 1742838 - protein, 18 aa, Staphylococcus epidermidis
KSRKAVVDTTPWKYRYIA

SEQ ID NO: 1742839 - protein, 18 aa, Staphylococcus epidermidis
KSSNKEVPNLVTKDQKEK

SEQ ID NO: 1742840 - protein, 19 aa, Staphylococcus epidermidis
KSTQNRPGPKAQQQKDKSE

SEQ ID NO: 1742841 - protein, 17 aa, Staphylococcus epidermidis
KSVCINGIITSILLNAK

SEQ ID NO: 1742842 - protein, 17 aa, Staphylococcus epidermidis
KSYKVRTLGVYSLGIVW

SEQ ID NO: 1742843 - protein, 18 aa, Staphylococcus epidermidis
KTASREQINEAIIAEALK

SEQ ID NO: 1742844 - protein, 18 aa, Staphylococcus epidermidis
KTATPKPPIIKVDEMNAS

SEQ ID NO: 1742845 - protein, 28 aa, Staphylococcus epidermidis
KTDGYIDLSVGASFIPYGGSSGAESETD

SEQ ID NO: 1742846 - protein, 24 aa, Staphylococcus epidermidis
KTDKSIVVDGEFNSVDALKNLKIP

SEQ ID NO: 1742847 - protein, 26 aa, Staphylococcus epidermidis
KTDRYGRTLAYVWLKNGDMFNESLVK

SEQ ID NO: 1742848 - protein, 26 aa, Staphylococcus epidermidis
KTDRYGRTLAYVWLKNGDMLNESLVK

SEQ ID NO: 1742849 - protein, 42 aa, Staphylococcus epidermidis
KTEGHKFKKSAAKTTALVGGAFTFNMLNNHQAFAASETPITS

SEQ ID NO: 1742850 - protein, 21 aa, Staphylococcus epidermidis
KTEPHNLLFLIVITVLVALAV

SEQ ID NO: 1742851 - protein, 24 aa, Staphylococcus epidermidis
KTGHSAWRYFMLIFYLVPYALFGG

SEQ ID NO: 1742852 - protein, 23 aa, Staphylococcus epidermidis
KTGHSAWRYFMLVFYLVPYILFG

SEQ ID NO: 1742853 - protein, 17 aa, Staphylococcus epidermidis
KTGIAIILAMSIASLLP

SEQ ID NO: 1742854 - protein, 24 aa, Staphylococcus epidermidis
KTIAGEVDATVNIDKQLNNLKNSG

SEQ ID NO: 1742855 - protein, 24 aa, Staphylococcus epidermidis
KTIAGEVDGTVNIDKQLNNFKNLG

SEQ ID NO: 1742856 - protein, 27 aa, Staphylococcus epidermidis
KTIEAIHKIKPITIIKPQALNEITNQL

SEQ ID NO: 1742857 - protein, 27 aa, Staphylococcus epidermidis
KTIPEFFSGQAPYLFAHRGGMAVRPEQ

SEQ ID NO: 1742858 - protein, 19 aa, Staphylococcus epidermidis
KTLTAKIYRNGSEKNIKIK

SEQ ID NO: 1742859 - protein, 17 aa, Staphylococcus epidermidis
KTMKWTNIIAILAGIYT

SEQ ID NO: 1742860 - protein, 21 aa, Staphylococcus epidermidis
KTNEILFRLTCKIYVSTYIAL

SEQ ID NO: 1742861 - protein, 18 aa, Staphylococcus epidermidis
KTNEVSHMDQYVQHPGKV

SEQ ID NO: 1742862 - protein, 31 aa, Staphylococcus epidermidis
KTNHPIIDLRLFKNMSFSSPIFAIFVFGGTT

SEQ ID NO: 1742863 - protein, 24 aa, Staphylococcus epidermidis
KTNRLSFKGQIFFVSIDSMMDQIS

SEQ ID NO: 1742864 - protein, 17 aa, Staphylococcus epidermidis
KTNSSFRDAVIGIWNSI

SEQ ID NO: 1742865 - protein, 20 aa, Staphylococcus epidermidis
KTPSKMSIQYKTAVGQKESI

SEQ ID NO: 1742866 - protein, 17 aa, Staphylococcus epidermidis
KTPTRYALKSMMAGFLL

SEQ ID NO: 1742867 - protein, 23 aa, Staphylococcus epidermidis
KTRADYYLLPWEKVIAIEQQHHT

SEQ ID NO: 1742868 - protein, 19 aa, Staphylococcus epidermidis
KTRSGKIMRRVLKAWELNL

SEQ ID NO: 1742869 - protein, 27 aa, Staphylococcus epidermidis
KTSKWNILSVLLLGFGFLSYSRKRKEK

SEQ ID NO: 1742870 - protein, 20 aa, Staphylococcus epidermidis
KTSYEKLNFVKLAKPLISLS

SEQ ID NO: 1742871 - protein, 18 aa, Staphylococcus epidermidis
KTTFTMLRDVRVQFLEKL

SEQ ID NO: 1742872 - protein, 24 aa, Staphylococcus epidermidis
KTTTKINYEVTRNSASDSTSTSIV

SEQ ID NO: 1742873 - protein, 25 aa, Staphylococcus epidermidis
KTYGYKRFEVLAALFNGVTLFIISI

SEQ ID NO: 1742874 - protein, 21 aa, Staphylococcus epidermidis
KTYRYSVPPLFAFITTLFIGI

SEQ ID NO: 1742875 - protein, 20 aa, Staphylococcus epidermidis
KVAGYLFYFAVSVGVISFIV

SEQ ID NO: 1742876 - protein, 19 aa, Staphylococcus epidermidis
KVAIVYFIVLAIFSILTGF

SEQ ID NO: 1742877 - protein, 18 aa, Staphylococcus epidermidis
KVAMPRKESTPSAPTVKA

SEQ ID NO: 1742878 - protein, 18 aa, Staphylococcus epidermidis
KVATFRLLLIDTPETKDP

SEQ ID NO: 1742879 - protein, 29 aa, Staphylococcus epidermidis
KVDFDQWLTSLRWDDVPKNYDEVRMKTTI

SEQ ID NO: 1742880 - protein, 21 aa, Staphylococcus epidermidis
KVEGLPAGMTFDETTNTISGT

SEQ ID NO: 1742881 - protein, 19 aa, Staphylococcus epidermidis
KVEIKKLKAKDEVSKATKK

SEQ ID NO: 1742882 - protein, 23 aa, Staphylococcus epidermidis
KVFPKMHIVMLLAALSMAGVPFL

SEQ ID NO: 1742883 - protein, 24 aa, Staphylococcus epidermidis
KVFPKMHIVMLLAALSMAGVPLLN

SEQ ID NO: 1742884 - protein, 24 aa, Staphylococcus epidermidis
KVFYRDYSMLFGIVLLSTIVLEIY

SEQ ID NO: 1742885 - protein, 19 aa, Staphylococcus epidermidis
KVGLTGVLFSGIFFAILTV

SEQ ID NO: 1742886 - protein, 17 aa, Staphylococcus epidermidis
KVGRLMKFIPHSVMIGF

SEQ ID NO: 1742887 - protein, 18 aa, Staphylococcus epidermidis
KVIFTPHLVFIITDMSLI

SEQ ID NO: 1742888 - protein, 17 aa, Staphylococcus epidermidis
KVINGLVMIVGAVCLIV

SEQ ID NO: 1742889 - protein, 27 aa, Staphylococcus epidermidis
KVIRNRLKRQGIRKGVKVVFSDESPIV

SEQ ID NO: 1742890 - protein, 18 aa, Staphylococcus epidermidis
KVKEIGIYHLLAISGTHI

SEQ ID NO: 1742891 - protein, 18 aa, Staphylococcus epidermidis
KVKIISLPNTDKVANDLT

SEQ ID NO: 1742892 - protein, 17 aa, Staphylococcus epidermidis
KVLLEHINKLASVEGVN

SEQ ID NO: 1742893 - protein, 19 aa, Staphylococcus epidermidis
KVMLWAAIFALTFFIIYAS

SEQ ID NO: 1742894 - protein, 39 aa, Staphylococcus epidermidis
KVNEFKQLVVAFFKEHWPKMLIIIGIIVLLLILNAIFTT

SEQ ID NO: 1742895 - protein, 18 aa, Staphylococcus epidermidis
KVNKLLKRNPTVAQVKES

SEQ ID NO: 1742896 - protein, 19 aa, Staphylococcus epidermidis
KVRFIYTMQLIVAFIAILI

SEQ ID NO: 1742897 - protein, 28 aa, Staphylococcus epidermidis
KVSADGTRVDINFARSMANGKKYIVTQA

SEQ ID NO: 1742898 - protein, 29 aa, Staphylococcus epidermidis
KVSADGTRVDINFARSMANGKKYIVTQAV

SEQ ID NO: 1742899 - protein, 23 aa, Staphylococcus epidermidis
KVSGLPEGVSFDSATNTISGTPT

SEQ ID NO: 1742900 - protein, 17 aa, Staphylococcus epidermidis
KVTGINEIAKVLPATSV

SEQ ID NO: 1742901 - protein, 25 aa, Staphylococcus epidermidis
KVTMPRKEATPEPPIVSANDKEATV

SEQ ID NO: 1742902 - protein, 26 aa, Staphylococcus epidermidis
KVYTDVKWCRMMIRQILSNSLKYSEN

SEQ ID NO: 1742903 - protein, 27 aa, Staphylococcus epidermidis
KVYTDVKWCRMMIRQVLSNSLKYSDNS

SEQ ID NO: 1742904 - protein, 20 aa, Staphylococcus epidermidis
KWAESNANIIADFYKNMKTE

SEQ ID NO: 1742905 - protein, 21 aa, Staphylococcus epidermidis
KWAESNASIIADFYKNMKTEG

SEQ ID NO: 1742906 - protein, 20 aa, Staphylococcus epidermidis
KWFGEQRTPVYVYKWEDVQI

SEQ ID NO: 1742907 - protein, 23 aa, Staphylococcus epidermidis
KWIAIPARFILNIVRTIPDLLLA

SEQ ID NO: 1742908 - protein, 20 aa, Staphylococcus epidermidis
KWKRHFPDVRLVILHSEYRS

SEQ ID NO: 1742909 - protein, 19 aa, Staphylococcus epidermidis
KWLDFPHIYLPFKDYTPSF

SEQ ID NO: 1742910 - protein, 20 aa, Staphylococcus epidermidis
KWLFFLCTLIGLVVLVALLA

SEQ ID NO: 1742911 - protein, 20 aa, Staphylococcus epidermidis
KWLTPDDHYIHGKGIQPDVK

SEQ ID NO: 1742912 - protein, 20 aa, Staphylococcus epidermidis
KWPISILVIIVIALSLIFSP

SEQ ID NO: 1742913 - protein, 20 aa, Staphylococcus epidermidis
KWSYETYGDLAVAYDDNEVV

SEQ ID NO: 1742914 - protein, 19 aa, Staphylococcus epidermidis
KWTNIIAILAGIYTLYAIY

SEQ ID NO: 1742915 - protein, 27 aa, Staphylococcus epidermidis
KWVPIMGSWRSAFKRAGDYAYATGGVI

SEQ ID NO: 1742916 - protein, 19 aa, Staphylococcus epidermidis
KWVPISIIILVAFFIGYVI

SEQ ID NO: 1742917 - protein, 20 aa, Staphylococcus epidermidis
KWWVGTAVAIAVIFGTDAII

SEQ ID NO: 1742918 - protein, 22 aa, Staphylococcus epidermidis
KYCGFNFILLLFGYLTFYRPAN

SEQ ID NO: 1742919 - protein, 18 aa, Staphylococcus epidermidis
KYDKEIFQAILPNTLRTG

SEQ ID NO: 1742920 - protein, 20 aa, Staphylococcus epidermidis
KYFDVSCVPILSKSKKKLQG

SEQ ID NO: 1742921 - protein, 19 aa, Staphylococcus epidermidis
KYFKTIRPKTYIYTNLIAQ

SEQ ID NO: 1742922 - protein, 18 aa, Staphylococcus epidermidis
KYGAWAVFLCRFVPVLRV

SEQ ID NO: 1742923 - protein, 22 aa, Staphylococcus epidermidis
KYGKYKLQVFSAYQTTTKDNYI

SEQ ID NO: 1742924 - protein, 17 aa, Staphylococcus epidermidis
KYIKPVMMMALGLVITT

SEQ ID NO: 1742925 - protein, 18 aa, Staphylococcus epidermidis
KYILRIIDHSMIYVAISG

SEQ ID NO: 1742926 - protein, 17 aa, Staphylococcus epidermidis
KYIPLLIICALSTEIFT

SEQ ID NO: 1742927 - protein, 18 aa, Staphylococcus epidermidis
KYITRVLYRLTFVGSIFL

SEQ ID NO: 1742928 - protein, 18 aa, Staphylococcus epidermidis
KYKDMYIEMDVELLTPDK

SEQ ID NO: 1742929 - protein, 23 aa, Staphylococcus epidermidis
KYKPFKKMLHKSIIDNNQEVEEK

SEQ ID NO: 1742930 - protein, 30 aa, Staphylococcus epidermidis
KYKVVIGDLDIPVRSGFSMDAKIPLNTKKL

SEQ ID NO: 1742931 - protein, 17 aa, Staphylococcus epidermidis
KYLCLHYGLGVLAGTLV

SEQ ID NO: 1742932 - protein, 19 aa, Staphylococcus epidermidis
KYLPFFTIGMGWIIPALVG

SEQ ID NO: 1742933 - protein, 19 aa, Staphylococcus epidermidis
KYNWPTVALQLTYYVTLLV

SEQ ID NO: 1742934 - protein, 18 aa, Staphylococcus epidermidis
KYSIQRQHYVLKRMLVEG

SEQ ID NO: 1742935 - protein, 20 aa, Staphylococcus epidermidis
KYTEMKWLTPDDHYIHGKGI

SEQ ID NO: 1742936 - protein, 17 aa, Staphylococcus epidermidis
KYVNRFGPKKILIFGLI

SEQ ID NO: 1742937 - protein, 19 aa, Staphylococcus epidermidis
KYYNFYGVGALDSDPIKTG

SEQ ID NO: 1742938 - protein, 19 aa, Staphylococcus epidermidis
LAAGILAFIGLILSPAIGA

SEQ ID NO: 1742939 - protein, 18 aa, Staphylococcus epidermidis
LAAGVLAFIGLILSPAIG

SEQ ID NO: 1742940 - protein, 19 aa, Staphylococcus epidermidis
LAAVMNFIGALTFTGVAGT

SEQ ID NO: 1742941 - protein, 23 aa, Staphylococcus epidermidis
LADRIKWPSIVVMAIVGLLVGPI

SEQ ID NO: 1742942 - protein, 19 aa, Staphylococcus epidermidis
LAERGSNGYSKSIIRDDGE

SEQ ID NO: 1742943 - protein, 25 aa, Staphylococcus epidermidis
LAFATRGWMAFPIMILLASGGIGMP

SEQ ID NO: 1742944 - protein, 17 aa, Staphylococcus epidermidis
LAFKEFTNPKVLKKVGL

SEQ ID NO: 1742945 - protein, 30 aa, Staphylococcus epidermidis
LAGSRLLYSFGRDGLLPAWLSHLNHKHLPN

SEQ ID NO: 1742946 - protein, 26 aa, Staphylococcus epidermidis
LAHKFGRKRILSVSLLILVITSLGAS

SEQ ID NO: 1742947 - protein, 17 aa, Staphylococcus epidermidis
LAIPSFIAGVFAIFFFA

SEQ ID NO: 1742948 - protein, 27 aa, Staphylococcus epidermidis
LAIYVFRFIWVFLWYKDFYFPKNIQYY

SEQ ID NO: 1742949 - protein, 19 aa, Staphylococcus epidermidis
LAKRWSKGYTITVAVGVVT

SEQ ID NO: 1742950 - protein, 17 aa, Staphylococcus epidermidis
LAKYQWLDLIIMIPFMT

SEQ ID NO: 1742951 - protein, 24 aa, Staphylococcus epidermidis
LALIGAALTVFSFVTANMIFGIIF

SEQ ID NO: 1742952 - protein, 17 aa, Staphylococcus epidermidis
LALILVAFFSKRTSKLG

SEQ ID NO: 1742953 - protein, 25 aa, Staphylococcus epidermidis
LALLYSRPLYYFGNIMKPLIWLMNG

SEQ ID NO: 1742954 - protein, 19 aa, Staphylococcus epidermidis
LAMIIKGFVDFGGQTPDAG

SEQ ID NO: 1742955 - protein, 18 aa, Staphylococcus epidermidis
LAPIMKFIMHILSVAVEF

SEQ ID NO: 1742956 - protein, 19 aa, Staphylococcus epidermidis
LASILILWFYFRKSIPKTF

SEQ ID NO: 1742957 - protein, 27 aa, Staphylococcus epidermidis
LASPIKRSEIIFGYVFGYGSFSVIQTI

SEQ ID NO: 1742958 - protein, 27 aa, Staphylococcus epidermidis
LATEKSKDLKLIKVLKDLNKAQLEDVT

SEQ ID NO: 1742959 - protein, 24 aa, Staphylococcus epidermidis
LATFLERFSYFLIIPFLSIYLAQN

SEQ ID NO: 1742960 - protein, 36 aa, Staphylococcus epidermidis
LAVFMRPDIGETFSEFRIFLAVLITLLLIISISLVI

SEQ ID NO: 1742961 - protein, 24 aa, Staphylococcus epidermidis
LAVIPVIICLIIFRGNAEKIEQLL

SEQ ID NO: 1742962 - protein, 19 aa, Staphylococcus epidermidis
LAVVTYYLIKWLFDVTMKY

SEQ ID NO: 1742963 - protein, 19 aa, Staphylococcus epidermidis
LAWIANILSLLFLIFGILS

SEQ ID NO: 1742964 - protein, 18 aa, Staphylococcus epidermidis
LCFLKADTSYTYLIIIYA

SEQ ID NO: 1742965 - protein, 17 aa, Staphylococcus epidermidis
LCLLGGLVGGIIGYIIG

SEQ ID NO: 1742966 - protein, 17 aa, Staphylococcus epidermidis
LCVYAFDLKSLFKEFDI

SEQ ID NO: 1742967 - protein, 19 aa, Staphylococcus epidermidis
LCYGISLTLLIIFISMYDV

SEQ ID NO: 1742968 - protein, 18 aa, Staphylococcus epidermidis
LDACITRLRVEVEDKSKV

SEQ ID NO: 1742969 - protein, 23 aa, Staphylococcus epidermidis
LDDLNKKFGIEFEDSEDIDTIGG

SEQ ID NO: 1742970 - protein, 27 aa, Staphylococcus epidermidis
LDDLREDFLYLRAIEREQYRKTLYENI

SEQ ID NO: 1742971 - protein, 23 aa, Staphylococcus epidermidis
LDDNLRKLTGLNLKGETKTKYDA

SEQ ID NO: 1742972 - protein, 24 aa, Staphylococcus epidermidis
LDDNLRKLTGLNLKGETKTKYDSM

SEQ ID NO: 1742973 - protein, 30 aa, Staphylococcus epidermidis
LDGFGQIFLMPSIIGGLLILIGIFIGSKKA

SEQ ID NO: 1742974 - protein, 24 aa, Staphylococcus epidermidis
LDGPLKYLLSLLFFILVTLGVIQV

SEQ ID NO: 1742975 - protein, 17 aa, Staphylococcus epidermidis
LDIARKIINQFSMGIRI

SEQ ID NO: 1742976 - protein, 19 aa, Staphylococcus epidermidis
LDKMVFRTKSVFTLYILSY

SEQ ID NO: 1742977 - protein, 18 aa, Staphylococcus epidermidis
LDLILRRFIHLYENDIFK

SEQ ID NO: 1742978 - protein, 21 aa, Staphylococcus epidermidis
LDMLLGLFLWQSGTISNFKKY

SEQ ID NO: 1742979 - protein, 21 aa, Staphylococcus epidermidis
LDPDIFYPLIKKLKENNDYVV

SEQ ID NO: 1742980 - protein, 23 aa, Staphylococcus epidermidis
LDPEIFYPLIKKLKENNDYVVVN

SEQ ID NO: 1742981 - protein, 26 aa, Staphylococcus epidermidis
LDSKSEWRKTLFIIGGNSTVTLDDVY

SEQ ID NO: 1742982 - protein, 28 aa, Staphylococcus epidermidis
LDTFFNEKGRIIGLLQMFMTKESIADRI

SEQ ID NO: 1742983 - protein, 25 aa, Staphylococcus epidermidis
LDVKWGAAITSIFAILIFVSRSGQK

SEQ ID NO: 1742984 - protein, 17 aa, Staphylococcus epidermidis
LDVVYLTSIVLMVLTLF

SEQ ID NO: 1742985 - protein, 21 aa, Staphylococcus epidermidis
LEALNNAKTGLRADKEELQNA

SEQ ID NO: 1742986 - protein, 23 aa, Staphylococcus epidermidis
LEELKQLDAGYHFTDINGDTPYR

SEQ ID NO: 1742987 - protein, 17 aa, Staphylococcus epidermidis
LEGAAFAIVGWVGIKLV

SEQ ID NO: 1742988 - protein, 25 aa, Staphylococcus epidermidis
LEHTGRYAYVITMLRRNGYHVIMGD

SEQ ID NO: 1742989 - protein, 24 aa, Staphylococcus epidermidis
LEILPRFNKIIVMNDGEIIENGSY

SEQ ID NO: 1742990 - protein, 18 aa, Staphylococcus epidermidis
LEKIKRQLQDEIDQGTNT

SEQ ID NO: 1742991 - protein, 21 aa, Staphylococcus epidermidis
LELIGNSILNHFIPIIITIIL

SEQ ID NO: 1742992 - protein, 27 aa, Staphylococcus epidermidis
LELNDKMKLLRDQLKTLVNPVKASLNY

SEQ ID NO: 1742993 - protein, 25 aa, Staphylococcus epidermidis
LENAGLSWKATREYQHILDDMNQFI

SEQ ID NO: 1742994 - protein, 20 aa, Staphylococcus epidermidis
LEPFCTSFFLYENYKFIFLN

SEQ ID NO: 1742995 - protein, 21 aa, Staphylococcus epidermidis
LEPFGLPALTMPFILATWIML

SEQ ID NO: 1742996 - protein, 52 aa, Staphylococcus epidermidis
LEQQKTRVKIYKSGKSWVKASINEIELLKTMGLPFLSKNEIQENVTEKTKGH

SEQ ID NO: 1742997 - protein, 52 aa, Staphylococcus epidermidis
LEQQKTRVKLYKSGKSWVKASINEIELLKTMGLPFLSKNEIQENVTEKTKGH

SEQ ID NO: 1742998 - protein, 17 aa, Staphylococcus epidermidis
LERKCPACSEVVGENDQ

SEQ ID NO: 1742999 - protein, 26 aa, Staphylococcus epidermidis
LESNARLFGIVGMLIALLAGRISEKI

SEQ ID NO: 1743000 - protein, 18 aa, Staphylococcus epidermidis
LESTVMYAGIIVDTRNFT

SEQ ID NO: 1743001 - protein, 21 aa, Staphylococcus epidermidis
LETGLLFICFQKSTQQFIDIQ

SEQ ID NO: 1743002 - protein, 17 aa, Staphylococcus epidermidis
LETIHANPTRKSDALQE

SEQ ID NO: 1743003 - protein, 20 aa, Staphylococcus epidermidis
LETRMNTFFASIVVGLIYSV

SEQ ID NO: 1743004 - protein, 20 aa, Staphylococcus epidermidis
LEYIPFNFLIDNVWLGSLKL

SEQ ID NO: 1743005 - protein, 24 aa, Staphylococcus epidermidis
LFAFWGVMIVTSFLVRDFSQGTSQ

SEQ ID NO: 1743006 - protein, 17 aa, Staphylococcus epidermidis
LFAWQMSRTLLWIYLIV

SEQ ID NO: 1743007 - protein, 25 aa, Staphylococcus epidermidis
LFDDAKRLYEFYGEVEQAPLINDLT

SEQ ID NO: 1743008 - protein, 25 aa, Staphylococcus epidermidis
LFDPKLGAMIGLWFNTMMAFTAYFI

SEQ ID NO: 1743009 - protein, 18 aa, Staphylococcus epidermidis
LFFFGESSVKGFATMLLL

SEQ ID NO: 1743010 - protein, 18 aa, Staphylococcus epidermidis
LFFIFKYKQPMFGKLSSQ

SEQ ID NO: 1743011 - protein, 20 aa, Staphylococcus epidermidis
LFFLCILSTIVVIIGLKKNE

SEQ ID NO: 1743012 - protein, 18 aa, Staphylococcus epidermidis
LFFMYYWIIFGIGCYFGQ

SEQ ID NO: 1743013 - protein, 28 aa, Staphylococcus epidermidis
LFFNQPFDEWFYRALVVLVVSCSCALVL

SEQ ID NO: 1743014 - protein, 22 aa, Staphylococcus epidermidis
LFGELFGWVAGWALLAEYFIAV

SEQ ID NO: 1743015 - protein, 22 aa, Staphylococcus epidermidis
LFGKAVILEVIFSMSGIGKLLI

SEQ ID NO: 1743016 - protein, 30 aa, Staphylococcus epidermidis
LFGKGSWYIPKWLGSVLPKIDIEGKALDQD

SEQ ID NO: 1743017 - protein, 18 aa, Staphylococcus epidermidis
LFHASGIIAAVVAGLVHG

SEQ ID NO: 1743018 - protein, 20 aa, Staphylococcus epidermidis
LFHDIFKPTFIPIIPLLGLS

SEQ ID NO: 1743019 - protein, 19 aa, Staphylococcus epidermidis
LFIAAAITGIVTMNLIAMI

SEQ ID NO: 1743020 - protein, 23 aa, Staphylococcus epidermidis
LFIAAIFHWTAGFSFSAGLIDFV

SEQ ID NO: 1743021 - protein, 31 aa, Staphylococcus epidermidis
LFIAFLLVCLHFEFAGNPVLHHLGIDGGNME

SEQ ID NO: 1743022 - protein, 17 aa, Staphylococcus epidermidis
LFIFVFILVNILLVMIY

SEQ ID NO: 1743023 - protein, 18 aa, Staphylococcus epidermidis
LFIIIAFIMEKSFKRKYK

SEQ ID NO: 1743024 - protein, 19 aa, Staphylococcus epidermidis
LFIKKPLRTLTWLMAIIVY

SEQ ID NO: 1743025 - protein, 25 aa, Staphylococcus epidermidis
LFIKLARIPFWFLIKGLTLIFFFLV

SEQ ID NO: 1743026 - protein, 20 aa, Staphylococcus epidermidis
LFIPMMLMLLLGAFTKSAQF

SEQ ID NO: 1743027 - protein, 28 aa, Staphylococcus epidermidis
LFKPKKAFEWPLFIIFGLVFLLLVPNTF

SEQ ID NO: 1743028 - protein, 18 aa, Staphylococcus epidermidis
LFLCISILFMLFNRNIAI

SEQ ID NO: 1743029 - protein, 22 aa, Staphylococcus epidermidis
LFLEPTRFGYLIIIAVSVVVGA

SEQ ID NO: 1743030 - protein, 17 aa, Staphylococcus epidermidis
LFLFIRIFGEAFFHQIF

SEQ ID NO: 1743031 - protein, 24 aa, Staphylococcus epidermidis
LFLFLIFHLIRLASKIDNQFNKVF

SEQ ID NO: 1743032 - protein, 18 aa, Staphylococcus epidermidis
LFLGIMVFLAGCDYSKPE

SEQ ID NO: 1743033 - protein, 23 aa, Staphylococcus epidermidis
LFLHVICICIAYWALNSIRLDQF

SEQ ID NO: 1743034 - protein, 24 aa, Staphylococcus epidermidis
LFLIACLFGQLFIENMTIYNSLMI

SEQ ID NO: 1743035 - protein, 17 aa, Staphylococcus epidermidis
LFLNCLFFSILTLLELR

SEQ ID NO: 1743036 - protein, 17 aa, Staphylococcus epidermidis
LFLPIFIFYTVARPVDR

SEQ ID NO: 1743037 - protein, 19 aa, Staphylococcus epidermidis
LFLQFDRLIAVLGGVTPFL

SEQ ID NO: 1743038 - protein, 25 aa, Staphylococcus epidermidis
LFLSFMAGVLWLIAGIMLLVRKPQT

SEQ ID NO: 1743039 - protein, 21 aa, Staphylococcus epidermidis
LFLSICLLFSPIILIVYSLLN

SEQ ID NO: 1743040 - protein, 17 aa, Staphylococcus epidermidis
LFLTFGLVIAQFNDIQK

SEQ ID NO: 1743041 - protein, 28 aa, Staphylococcus epidermidis
LFLTIIGAFLFFRSSVSLIFKTLKHIKH

SEQ ID NO: 1743042 - protein, 18 aa, Staphylococcus epidermidis
LFNSKLLLLLAFVIQQAF

SEQ ID NO: 1743043 - protein, 25 aa, Staphylococcus epidermidis
LFNYLRLKPAPLFIATILYGMSTVV

SEQ ID NO: 1743044 - protein, 26 aa, Staphylococcus epidermidis
LFPYFMIFLPFFKRNKYWGFLKTIPW

SEQ ID NO: 1743045 - protein, 18 aa, Staphylococcus epidermidis
LFREYLWKKVLMKHIKNI

SEQ ID NO: 1743046 - protein, 26 aa, Staphylococcus epidermidis
LFRVNRRLGGSSSYYFFYSLPVSQRD

SEQ ID NO: 1743047 - protein, 17 aa, Staphylococcus epidermidis
LFSDSLATIVGSVFGTT

SEQ ID NO: 1743048 - protein, 24 aa, Staphylococcus epidermidis
LFSGNEIQFKWGKEYPSNNYTPEK

SEQ ID NO: 1743049 - protein, 19 aa, Staphylococcus epidermidis
LFSILKFIFATALFIFVIF

SEQ ID NO: 1743050 - protein, 17 aa, Staphylococcus epidermidis
LFSLPVYKVLIYNQFHF

SEQ ID NO: 1743051 - protein, 25 aa, Staphylococcus epidermidis
LFSMGRSGIMPTVFSKLHSKYKTPY

SEQ ID NO: 1743052 - protein, 24 aa, Staphylococcus epidermidis
LFSSDRKNIRWKYVGLLLVIQLIF

SEQ ID NO: 1743053 - protein, 24 aa, Staphylococcus epidermidis
LFSSRIPRTVSILLSGSSLALAGL

SEQ ID NO: 1743054 - protein, 17 aa, Staphylococcus epidermidis
LFTLYSFQIYKKVILIA

SEQ ID NO: 1743055 - protein, 19 aa, Staphylococcus epidermidis
LFTNYGLIALIFILLKVFV

SEQ ID NO: 1743056 - protein, 18 aa, Staphylococcus epidermidis
LFTSLRSKYYLFVSDPVV

SEQ ID NO: 1743057 - protein, 22 aa, Staphylococcus epidermidis
LFTYKAPSGMKAMGALANAAIA

SEQ ID NO: 1743058 - protein, 18 aa, Staphylococcus epidermidis
LFVKQVTEAFGIDISSQL

SEQ ID NO: 1743059 - protein, 22 aa, Staphylococcus epidermidis
LFVRSRINWIMWIIFLNLVMLG

SEQ ID NO: 1743060 - protein, 17 aa, Staphylococcus epidermidis
LFWYCKKIKKDPKSSYS

SEQ ID NO: 1743061 - protein, 27 aa, Staphylococcus epidermidis
LFYSVLFWLCILSFFSVLNEMVLNVSL

SEQ ID NO: 1743062 - protein, 30 aa, Staphylococcus epidermidis
LGAELKHPFKIKRLVGQSAMSYGALGKNAI

SEQ ID NO: 1743063 - protein, 19 aa, Staphylococcus epidermidis
LGAGVQWGTMLVTIATFVV

SEQ ID NO: 1743064 - protein, 34 aa, Staphylococcus epidermidis
LGAIALHITMSFPLSISFVIGGLFLITGPTVIQP

SEQ ID NO: 1743065 - protein, 18 aa, Staphylococcus epidermidis
LGAMIMGPLVGWLMKKVD

SEQ ID NO: 1743066 - protein, 19 aa, Staphylococcus epidermidis
LGAYVLWGILPMYWELINH

SEQ ID NO: 1743067 - protein, 23 aa, Staphylococcus epidermidis
LGCTLPAFMLVVSASLNDNSVTA

SEQ ID NO: 1743068 - protein, 24 aa, Staphylococcus epidermidis
LGDAFKYAAPVAGALGYTVEDTSI

SEQ ID NO: 1743069 - protein, 25 aa, Staphylococcus epidermidis
LGDLLGVQHFYDWINHVLKTGHSPW

SEQ ID NO: 1743070 - protein, 25 aa, Staphylococcus epidermidis
LGFDKKAIFPFIIASGFIADTTSLP

SEQ ID NO: 1743071 - protein, 24 aa, Staphylococcus epidermidis
LGFVLSLLATLGFTTLVMQDGFLG

SEQ ID NO: 1743072 - protein, 27 aa, Staphylococcus epidermidis
LGGIHEIYFPYVLMRPLLFLAVILGGM

SEQ ID NO: 1743073 - protein, 17 aa, Staphylococcus epidermidis
LGIEHAGAIDLNAACAG

SEQ ID NO: 1743074 - protein, 19 aa, Staphylococcus epidermidis
LGIFSQWLADRIKWPSIVV

SEQ ID NO: 1743075 - protein, 20 aa, Staphylococcus epidermidis
LGIFSQWLASRIKWPSIVVM

SEQ ID NO: 1743076 - protein, 20 aa, Staphylococcus epidermidis
LGIISGRYAYTISDYSIQIF

SEQ ID NO: 1743077 - protein, 17 aa, Staphylococcus epidermidis
LGINISVSIIFSYHAII

SEQ ID NO: 1743078 - protein, 23 aa, Staphylococcus epidermidis
LGKIKSIYFIGGILGMAFVTSNI

SEQ ID NO: 1743079 - protein, 23 aa, Staphylococcus epidermidis
LGKKLIICIGLVFFSVSEFMFAA

SEQ ID NO: 1743080 - protein, 17 aa, Staphylococcus epidermidis
LGLEIANISNWRFAMLV

SEQ ID NO: 1743081 - protein, 18 aa, Staphylococcus epidermidis
LGLFQFPWILFLLGIIFN

SEQ ID NO: 1743082 - protein, 17 aa, Staphylococcus epidermidis
LGLGGAMTTGFLTIFVL

SEQ ID NO: 1743083 - protein, 17 aa, Staphylococcus epidermidis
LGLGHDIFQSYSLTIYM

SEQ ID NO: 1743084 - protein, 18 aa, Staphylococcus epidermidis
LGLILCLFATIPGIVLWN

SEQ ID NO: 1743085 - protein, 18 aa, Staphylococcus epidermidis
LGLIPIYLGIKVAIFDDC

SEQ ID NO: 1743086 - protein, 20 aa, Staphylococcus epidermidis
LGLMIPLLILISMVVFSLAI

SEQ ID NO: 1743087 - protein, 17 aa, Staphylococcus epidermidis
LGLNDPIFIQWWDWLNQ

SEQ ID NO: 1743088 - protein, 17 aa, Staphylococcus epidermidis
LGLSPTDSYNFLVTSSQ

SEQ ID NO: 1743089 - protein, 20 aa, Staphylococcus epidermidis
LGLSVLFLLFTFVKEVRLSK

SEQ ID NO: 1743090 - protein, 18 aa, Staphylococcus epidermidis
LGLWSMNSDKIWLKLFSY

SEQ ID NO: 1743091 - protein, 21 aa, Staphylococcus epidermidis
LGNQYGGKLALIFDDGIEAEV

SEQ ID NO: 1743092 - protein, 41 aa, Staphylococcus epidermidis
LGQIGKEGAAVGIGGLNNAFGFKLDTYHNTSPPKSDAKAKA

SEQ ID NO: 1743093 - protein, 40 aa, Staphylococcus epidermidis
LGQIGKEGAAVGIGGLNNAFGFKLDTYHNTSTPRSDAKAK

SEQ ID NO: 1743094 - protein, 26 aa, Staphylococcus epidermidis
LGRLFKNILRFIGLVILLDILMFLSI

SEQ ID NO: 1743095 - protein, 20 aa, Staphylococcus epidermidis
LGTAAFWTILAILFIGGPYI

SEQ ID NO: 1743096 - protein, 19 aa, Staphylococcus epidermidis
LGVIICKLLGLDNYASSAI

SEQ ID NO: 1743097 - protein, 20 aa, Staphylococcus epidermidis
LGVNIICYIIFMAYCINFNA

SEQ ID NO: 1743098 - protein, 26 aa, Staphylococcus epidermidis
LGYEVTAQKIVAPWVAATDIATLQKI

SEQ ID NO: 1743099 - protein, 23 aa, Staphylococcus epidermidis
LGYFLKRINYLKATDSQVLSTLV

SEQ ID NO: 1743100 - protein, 17 aa, Staphylococcus epidermidis
LHIDLVGSIWFVLLTAI

SEQ ID NO: 1743101 - protein, 22 aa, Staphylococcus epidermidis
LHIISFGILVLYIINAFINYLR

SEQ ID NO: 1743102 - protein, 21 aa, Staphylococcus epidermidis
LHILLGFTVFACWPFTRLVHV

SEQ ID NO: 1743103 - protein, 18 aa, Staphylococcus epidermidis
LHINSSQTISLWKYVFLS

SEQ ID NO: 1743104 - protein, 18 aa, Staphylococcus epidermidis
LHLEREVSWLKNKDNKNN

SEQ ID NO: 1743105 - protein, 18 aa, Staphylococcus epidermidis
LHNRAIIQYGTYARLHIF

SEQ ID NO: 1743106 - protein, 20 aa, Staphylococcus epidermidis
LIAAFIVGIALFFEVGLVLL

SEQ ID NO: 1743107 - protein, 19 aa, Staphylococcus epidermidis
LIAAIPIVLFLLCLTVFKM

SEQ ID NO: 1743108 - protein, 24 aa, Staphylococcus epidermidis
LIAAMIMPRIWPLKNIPDEYAKDV

SEQ ID NO: 1743109 - protein, 23 aa, Staphylococcus epidermidis
LIAAVLYGGYYAYNHYVKNDDTE

SEQ ID NO: 1743110 - protein, 19 aa, Staphylococcus epidermidis
LIAIIIAVLLLFLVNTFLI

SEQ ID NO: 1743111 - protein, 18 aa, Staphylococcus epidermidis
LIAIIVAILLLFLVNNFL

SEQ ID NO: 1743112 - protein, 21 aa, Staphylococcus epidermidis
LIAILFKFNLAHVATLASVTA

SEQ ID NO: 1743113 - protein, 36 aa, Staphylococcus epidermidis
LIAIPLVMLLAPFLFDWTWSQSVYRGLVLLVAASPC

SEQ ID NO: 1743114 - protein, 19 aa, Staphylococcus epidermidis
LIAISSFIFCILLIIHHFV

SEQ ID NO: 1743115 - protein, 19 aa, Staphylococcus epidermidis
LIALFALMETMIKVVAPLL

SEQ ID NO: 1743116 - protein, 17 aa, Staphylococcus epidermidis
LIALFLILKSQLSPEKQ

SEQ ID NO: 1743117 - protein, 17 aa, Staphylococcus epidermidis
LIALLPITISSIVVGFT

SEQ ID NO: 1743118 - protein, 42 aa, Staphylococcus epidermidis
LIAMNQYHIMPGYKVKFMFMIIMTMMLFVLINTYLFRQLKSI

SEQ ID NO: 1743119 - protein, 17 aa, Staphylococcus epidermidis
LICTGFASQLLVTKSLF

SEQ ID NO: 1743120 - protein, 22 aa, Staphylococcus epidermidis
LIDGSFGWKGLLSAVSKGIIGM

SEQ ID NO: 1743121 - protein, 18 aa, Staphylococcus epidermidis
LIDSLKFINKAQFTHAND

SEQ ID NO: 1743122 - protein, 24 aa, Staphylococcus epidermidis
LIFAILVLRLGYLQIAQGSQYKQL

SEQ ID NO: 1743123 - protein, 33 aa, Staphylococcus epidermidis
LIFALIIPFLYRFVKRIHLGWFVLPVPIVLFIY

SEQ ID NO: 1743124 - protein, 38 aa, Staphylococcus epidermidis
LIFKHRKEQLAGLKFSISLKVIERLLLALILPLIILMI

SEQ ID NO: 1743125 - protein, 23 aa, Staphylococcus epidermidis
LIFLILSAIFTFFLAKPKYEAST

SEQ ID NO: 1743126 - protein, 26 aa, Staphylococcus epidermidis
LIFLKERFNKFEWLAIIFALIGVLYM

SEQ ID NO: 1743127 - protein, 17 aa, Staphylococcus epidermidis
LIFLYILVYRGIVTSVL

SEQ ID NO: 1743128 - protein, 28 aa, Staphylococcus epidermidis
LIFNQLYVVFKMIFWFNPALYISKTMMD

SEQ ID NO: 1743129 - protein, 24 aa, Staphylococcus epidermidis
LIGIMCVINYALVRHIAFDKYQSQ

SEQ ID NO: 1743130 - protein, 18 aa, Staphylococcus epidermidis
LIGLFYGLFILWKPLAYI

SEQ ID NO: 1743131 - protein, 18 aa, Staphylococcus epidermidis
LIGLILMAMNTFQPKNYQ

SEQ ID NO: 1743132 - protein, 25 aa, Staphylococcus epidermidis
LIGLVIGFGLCWPYVLLPYGFGQIF

SEQ ID NO: 1743133 - protein, 18 aa, Staphylococcus epidermidis
LIGSIILLAPIARLIATG

SEQ ID NO: 1743134 - protein, 18 aa, Staphylococcus epidermidis
LIHRVLFIVFSKGEKPIL

SEQ ID NO: 1743135 - protein, 20 aa, Staphylococcus epidermidis
LIIHYYRYKGFNAFLDIYLN

SEQ ID NO: 1743136 - protein, 36 aa, Staphylococcus epidermidis
LIILGFLLHYIFKINEKWLLMICVLVIIINASWNTI

SEQ ID NO: 1743137 - protein, 19 aa, Staphylococcus epidermidis
LIIPRCVAILGIISALITI

SEQ ID NO: 1743138 - protein, 19 aa, Staphylococcus epidermidis
LIISGLFLLMIFKIMNPKQ

SEQ ID NO: 1743139 - protein, 18 aa, Staphylococcus epidermidis
LIITFPILRKFKVATPIF

SEQ ID NO: 1743140 - protein, 17 aa, Staphylococcus epidermidis
LIITTALRWEAVGKNVE

SEQ ID NO: 1743141 - protein, 23 aa, Staphylococcus epidermidis
LIKILFEVVSAFGTVGLTMDLTS

SEQ ID NO: 1743142 - protein, 23 aa, Staphylococcus epidermidis
LILALPFPIILAIMFNEIKDSKL

SEQ ID NO: 1743143 - protein, 24 aa, Staphylococcus epidermidis
LILDICFLSTIPLISIYITYFLSF

SEQ ID NO: 1743144 - protein, 24 aa, Staphylococcus epidermidis
LILHVVCICVAYWALNSIKLDQLF

SEQ ID NO: 1743145 - protein, 17 aa, Staphylococcus epidermidis
LILLCFLISICFIFAPF

SEQ ID NO: 1743146 - protein, 24 aa, Staphylococcus epidermidis
LILLCITIYISFVIGTIPIHFKDI

SEQ ID NO: 1743147 - protein, 27 aa, Staphylococcus epidermidis
LILLMVIAIIGMAGWLFYAHQLLERKT

SEQ ID NO: 1743148 - protein, 17 aa, Staphylococcus epidermidis
LILPEAVPVQFNMMTLI

SEQ ID NO: 1743149 - protein, 17 aa, Staphylococcus epidermidis
LILSMSLSLCWDVGKLD

SEQ ID NO: 1743150 - protein, 25 aa, Staphylococcus epidermidis
LIMLPMSIWAMERFFKERKIGWFIF

SEQ ID NO: 1743151 - protein, 27 aa, Staphylococcus epidermidis
LIMLVSMGGVLGFGGYRVASGAISPGT

SEQ ID NO: 1743152 - protein, 24 aa, Staphylococcus epidermidis
LIMQNGREVYKWAVSTVPKEVNQL

SEQ ID NO: 1743153 - protein, 18 aa, Staphylococcus epidermidis
LIMRCCDVMLAFPSYVVT

SEQ ID NO: 1743154 - protein, 17 aa, Staphylococcus epidermidis
LIPTLIINFLLLIMLFP

SEQ ID NO: 1743155 - protein, 23 aa, Staphylococcus epidermidis
LIRFSDFRTPRYFILLISSLVLA

SEQ ID NO: 1743156 - protein, 18 aa, Staphylococcus epidermidis
LIRPLIMKYRIQFIEQHT

SEQ ID NO: 1743157 - protein, 19 aa, Staphylococcus epidermidis
LISFAERYLPFFTIGMGCI

SEQ ID NO: 1743158 - protein, 26 aa, Staphylococcus epidermidis
LISIILFFAHSYRFASTVFILSILLL

SEQ ID NO: 1743159 - protein, 17 aa, Staphylococcus epidermidis
LISLFVTVITIIFNRTA

SEQ ID NO: 1743160 - protein, 19 aa, Staphylococcus epidermidis
LISVKGFPLALGALYLPLL

SEQ ID NO: 1743161 - protein, 18 aa, Staphylococcus epidermidis
LITMAFLPFMALYLSDMV

SEQ ID NO: 1743162 - protein, 18 aa, Staphylococcus epidermidis
LITRIRAFIPIMIPLFIS

SEQ ID NO: 1743163 - protein, 23 aa, Staphylococcus epidermidis
LITRIRAFIPIMIPLFISAFQRA

SEQ ID NO: 1743164 - protein, 17 aa, Staphylococcus epidermidis
LIVAIVVAILFFILFLV

SEQ ID NO: 1743165 - protein, 18 aa, Staphylococcus epidermidis
LIVCEFFYGIPFLGGSVI

SEQ ID NO: 1743166 - protein, 18 aa, Staphylococcus epidermidis
LIVFRFPPHVAVGTSMMM

SEQ ID NO: 1743167 - protein, 18 aa, Staphylococcus epidermidis
LIVGILSYVLLAAILGSL

SEQ ID NO: 1743168 - protein, 17 aa, Staphylococcus epidermidis
LIVISILLLLFWSTEKV

SEQ ID NO: 1743169 - protein, 23 aa, Staphylococcus epidermidis
LIVLCGVVTLLVRVIPFIMISRV

SEQ ID NO: 1743170 - protein, 23 aa, Staphylococcus epidermidis
LIVLCGVVTLLVRVIPFVMISRV

SEQ ID NO: 1743171 - protein, 27 aa, Staphylococcus epidermidis
LIVLLDWKLTVLILLISPVIFGIIFPL

SEQ ID NO: 1743172 - protein, 17 aa, Staphylococcus epidermidis
LIVSRYLYSVALNVPSK

SEQ ID NO: 1743173 - protein, 26 aa, Staphylococcus epidermidis
LIYLFAHEWLKVSFMSMFWSVVQVVL

SEQ ID NO: 1743174 - protein, 19 aa, Staphylococcus epidermidis
LKADEFDFVLKNEQGKEVA

SEQ ID NO: 1743175 - protein, 33 aa, Staphylococcus epidermidis; identical to SEQ ID NO: 1583790

SEQ ID NO: 1743176 - protein, 20 aa, Staphylococcus epidermidis
LKAQGFTNGFLMKMVLAQTF

SEQ ID NO: 1743177 - protein, 23 aa, Staphylococcus epidermidis
LKDKTMKLQVLFGQADKKDNANN

SEQ ID NO: 1743178 - protein, 20 aa, Staphylococcus epidermidis
LKDPRSLLKAYPYMLSGGML

SEQ ID NO: 1743179 - protein, 19 aa, Staphylococcus epidermidis
LKEIELEADHVKQMINTNL

SEQ ID NO: 1743180 - protein, 17 aa, Staphylococcus epidermidis
LKENIYMHFSRTYIRLM

SEQ ID NO: 1743181 - protein, 21 aa, Staphylococcus epidermidis
LKFIFATALFIFVIFTLYREL

SEQ ID NO: 1743182 - protein, 21 aa, Staphylococcus epidermidis
LKFSISLKVIERLLLALILPL

SEQ ID NO: 1743183 - protein, 19 aa, Staphylococcus epidermidis
LKFSSILLAISLNSIIDIY

SEQ ID NO: 1743184 - protein, 18 aa, Staphylococcus epidermidis
LKGILAYSTISQLGMIMS

SEQ ID NO: 1743185 - protein, 22 aa, Staphylococcus epidermidis
LKGTFKAYGSAYGHGVSGVNLG

SEQ ID NO: 1743186 - protein, 21 aa, Staphylococcus epidermidis
LKGTFKAYGSAYGHGVSGVNM

SEQ ID NO: 1743187 - protein, 18 aa, Staphylococcus epidermidis
LKHLWGRFRPYEITDKAG

SEQ ID NO: 1743188 - protein, 17 aa, Staphylococcus epidermidis
LKHLWGRFRPYEITGKA

SEQ ID NO: 1743189 - protein, 17 aa, Staphylococcus epidermidis
LKIKTYETITVKDICKE

SEQ ID NO: 1743190 - protein, 20 aa, Staphylococcus epidermidis
LKILGVFLILLSFIALIYIS

SEQ ID NO: 1743191 - protein, 17 aa, Staphylococcus epidermidis
LKITIIATIVSVPIGLG

SEQ ID NO: 1743192 - protein, 17 aa, Staphylococcus epidermidis
LKKAIAKIDKGQTNDDV

SEQ ID NO: 1743193 - protein, 17 aa, Staphylococcus epidermidis
LKKGDIVRVETGEQIPN

SEQ ID NO: 1743194 - protein, 19 aa, Staphylococcus epidermidis
LKKHPEVINYTKLTHGKQY

SEQ ID NO: 1743195 - protein, 17 aa, Staphylococcus epidermidis
LKKIKGFGEKTFEKLKE

SEQ ID NO: 1743196 - protein, 25 aa, Staphylococcus epidermidis
LKKYWLEIFGGIAIGTVSALMLIYL

SEQ ID NO: 1743197 - protein, 20 aa, Staphylococcus epidermidis
LKLDVEFASILGLTKDKSLI

SEQ ID NO: 1743198 - protein, 21 aa, Staphylococcus epidermidis
LKLIFATALFIFVIFTLYREL

SEQ ID NO: 1743199 - protein, 19 aa, Staphylococcus epidermidis
LKLMFRRLLFLLIVGIITS

SEQ ID NO: 1743200 - protein, 18 aa, Staphylococcus epidermidis
LKLQMPIPKVLRVSYIIN

SEQ ID NO: 1743201 - protein, 20 aa, Staphylococcus epidermidis
LKLSNNQSFEYIASDGGQLK

SEQ ID NO: 1743202 - protein, 25 aa, Staphylococcus epidermidis
LKMMIPNIFSFFASVLVLWIYFRRS

SEQ ID NO: 1743203 - protein, 22 aa, Staphylococcus epidermidis
LKNGKYQVMIVIPKDFTKLAMQ

SEQ ID NO: 1743204 - protein, 26 aa, Staphylococcus epidermidis
LKNIIFCLLGTLIIALGVNMFVIPGN

SEQ ID NO: 1743205 - protein, 20 aa, Staphylococcus epidermidis
LKNLFINLIITFVIAFIINY

SEQ ID NO: 1743206 - protein, 23 aa, Staphylococcus epidermidis
LKNRLNDIARDWASLSYLQNLVE

SEQ ID NO: 1743207 - protein, 18 aa, Staphylococcus epidermidis
LKPGFTLEFNDRPDGFKA

SEQ ID NO: 1743208 - protein, 20 aa, Staphylococcus epidermidis
LKQQFDHALSNARKVLAKET

SEQ ID NO: 1743209 - protein, 19 aa, Staphylococcus epidermidis
LKRKESRLVDVSGKTYLNY

SEQ ID NO: 1743210 - protein, 18 aa, Staphylococcus epidermidis
LKRLDYFSYYALNSPLIY

SEQ ID NO: 1743211 - protein, 18 aa, Staphylococcus epidermidis
LKRLDYFSYYALNSPMLY

SEQ ID NO: 1743212 - protein, 22 aa, Staphylococcus epidermidis
LKRNKLAVIGMIGLLLIVIMAF

SEQ ID NO: 1743213 - protein, 20 aa, Staphylococcus epidermidis
LKSIWFNIIQSFMIMTCVLI

SEQ ID NO: 1743214 - protein, 28 aa, Staphylococcus epidermidis
LKSKESKKRFTAIMLICAMFAICWIAYI

SEQ ID NO: 1743215 - protein, 23 aa, Staphylococcus epidermidis
LKTELSFVEPMISRLELDEANNK

SEQ ID NO: 1743216 - protein, 22 aa, Staphylococcus epidermidis
LKTELSFVEPMISRLELDQAND

SEQ ID NO: 1743217 - protein, 19 aa, Staphylococcus epidermidis
LKTSFSIILIIALIIWSFI

SEQ ID NO: 1743218 - protein, 24 aa, Staphylococcus epidermidis
LKVGRLMKFIPRPVMIGFVNALGI

SEQ ID NO: 1743219 - protein, 24 aa, Staphylococcus epidermidis
LKVHAHRLLPILVAIFIISNIVGM

SEQ ID NO: 1743220 - protein, 24 aa, Staphylococcus epidermidis
LKVHGHRLLPILVAIFIISNLVGM

SEQ ID NO: 1743221 - protein, 19 aa, Staphylococcus epidermidis
LKVIERLLLALILPLIILM

SEQ ID NO: 1743222 - protein, 25 aa, Staphylococcus epidermidis
LKVKALKINNRWKFDSSISNISINP

SEQ ID NO: 1743223 - protein, 25 aa, Staphylococcus epidermidis
LKWTKERPKGWGIKLSFNLVGGTIT

SEQ ID NO: 1743224 - protein, 21 aa, Staphylococcus epidermidis
LKYSFSIFFFSSFTMTFINII

SEQ ID NO: 1743225 - protein, 20 aa, Staphylococcus epidermidis
LKYSFSIFFLSSFTMTFINI

SEQ ID NO: 1743226 - protein, 17 aa, Staphylococcus epidermidis
LLAFIWPPFKLNPNPPK

SEQ ID NO: 1743227 - protein, 24 aa, Staphylococcus epidermidis
LLAIMCVINYALVRHIAFDKYDSQ

SEQ ID NO: 1743228 - protein, 19 aa, Staphylococcus epidermidis
LLAIPSFIIALVILSLMSN

SEQ ID NO: 1743229 - protein, 19 aa, Staphylococcus epidermidis
LLAIPSFIIALVILSLVNN

SEQ ID NO: 1743230 - protein, 20 aa, Staphylococcus epidermidis
LLAIVIKWLSFIPITLFTAL

SEQ ID NO: 1743231 - protein, 25 aa, Staphylococcus epidermidis
LLASILILWFYFRKSIPKTFDISSI

SEQ ID NO: 1743232 - protein, 21 aa, Staphylococcus epidermidis
LLDKFKFSAAQTEIDDANELM

SEQ ID NO: 1743233 - protein, 18 aa, Staphylococcus epidermidis
LLEHINKLASVEGVNDAF

SEQ ID NO: 1743234 - protein, 18 aa, Staphylococcus epidermidis
LLERGKTVIIISHKLSTI

SEQ ID NO: 1743235 - protein, 20 aa, Staphylococcus epidermidis
LLERSHLANFEFIIAKGDLN

SEQ ID NO: 1743236 - protein, 18 aa, Staphylococcus epidermidis
LLFEWSRINEMLDKQLYL

SEQ ID NO: 1743237 - protein, 38 aa, Staphylococcus epidermidis
LLFIFPLGLFLMWRYAHWKIWLKLVVSSVYTIGLVLTV

SEQ ID NO: 1743238 - protein, 38 aa, Staphylococcus epidermidis
LLFIFPLGLFLMWRYAHWKNWLKLIVSSVYIISLVLIL

SEQ ID NO: 1743239 - protein, 19 aa, Staphylococcus epidermidis
LLFKVLPLVFSQMHFGAIF

SEQ ID NO: 1743240 - protein, 22 aa, Staphylococcus epidermidis
LLFSKPKFKAVFDYIVGFVLIG

SEQ ID NO: 1743241 - protein, 25 aa, Staphylococcus epidermidis
LLGAFIFRFIALFLISIIANFWWIQ

SEQ ID NO: 1743242 - protein, 27 aa, Staphylococcus epidermidis
LLGGAILEFATWHWLFFINIPIAIIAI

SEQ ID NO: 1743243 - protein, 18 aa, Staphylococcus epidermidis
LLGGLVGGIIGYIIGAIN

SEQ ID NO: 1743244 - protein, 24 aa, Staphylococcus epidermidis
LLGILLFAYYAWKAPAFTESKLED

SEQ ID NO: 1743245 - protein, 18 aa, Staphylococcus epidermidis
LLGQWWHWFSQLLHLNLG

SEQ ID NO: 1743246 - protein, 20 aa, Staphylococcus epidermidis
LLHDGIRNAYDYKISCVHIP

SEQ ID NO: 1743247 - protein, 23 aa, Staphylococcus epidermidis
LLHDVFIIIAIFSLFRIEVDLTF

SEQ ID NO: 1743248 - protein, 22 aa, Staphylococcus epidermidis
LLHDVFIIIAIFSLFRLEVDLT

SEQ ID NO: 1743249 - protein, 21 aa, Staphylococcus epidermidis
LLHELQTTLINRVNATHEINH

SEQ ID NO: 1743250 - protein, 18 aa, Staphylococcus epidermidis
LLHLPSPLTTTISFVVSF

SEQ ID NO: 1743251 - protein, 23 aa, Staphylococcus epidermidis
LLICMVLAYAFLLGLFILGLVTS

SEQ ID NO: 1743252 - protein, 17 aa, Staphylococcus epidermidis
LLICTGFSSQLLVTKSL

SEQ ID NO: 1743253 - protein, 17 aa, Staphylococcus epidermidis
LLIFGLLIIAGYGAYRI

SEQ ID NO: 1743254 - protein, 18 aa, Staphylococcus epidermidis
LLIGIILIFAGIMMSQMN

SEQ ID NO: 1743255 - protein, 23 aa, Staphylococcus epidermidis
LLIGMALVRFRLTLMRRGIENIN

SEQ ID NO: 1743256 - protein, 17 aa, Staphylococcus epidermidis
LLIIILIAVFKPFSDES

SEQ ID NO: 1743257 - protein, 29 aa, Staphylococcus epidermidis
LLIILSLYLKWWILFGVSIALLIIVAIAL

SEQ ID NO: 1743258 - protein, 18 aa, Staphylococcus epidermidis
LLIKRKSLLRRKSISIIL

SEQ ID NO: 1743259 - protein, 26 aa, Staphylococcus epidermidis
LLISCIMKSPGVSIAVGIIFYFAVSI

SEQ ID NO: 1743260 - protein, 19 aa, Staphylococcus epidermidis
LLISFIFVMSPLYFRFTIY

SEQ ID NO: 1743261 - protein, 17 aa, Staphylococcus epidermidis
LLIVVTFMTFMMTYLTN

SEQ ID NO: 1743262 - protein, 24 aa, Staphylococcus epidermidis
LLIVYIIPKFFKAIPAPLIAIIVL

SEQ ID NO: 1743263 - protein, 18 aa, Staphylococcus epidermidis
LLKAAWKSIQMFIVQALP

SEQ ID NO: 1743264 - protein, 23 aa, Staphylococcus epidermidis
LLKQTDHNFEWLIVDDGSKDDTE

SEQ ID NO: 1743265 - protein, 32 aa, Staphylococcus epidermidis
LLKTEGFAILPLCIDLLILISIIVFYYIGGYL

SEQ ID NO: 1743266 - protein, 22 aa, Staphylococcus epidermidis
LLLIKHRYIFKLQTGRFFILQL

SEQ ID NO: 1743267 - protein, 25 aa, Staphylococcus epidermidis
LLLIKYRYIFKLQTGRFFILKLSHH

SEQ ID NO: 1743268 - protein, 18 aa, Staphylococcus epidermidis
LLLMMFVHLLPLHLPAIV

SEQ ID NO: 1743269 - protein, 17 aa, Staphylococcus epidermidis
LLLSLLAGLFFEHLSWG

SEQ ID NO: 1743270 - protein, 23 aa, Staphylococcus epidermidis
LLLVSCLILLISVFIRTPNEFRL

SEQ ID NO: 1743271 - protein, 17 aa, Staphylococcus epidermidis
LLLYLVVSSFIIFVLVE

SEQ ID NO: 1743272 - protein, 23 aa, Staphylococcus epidermidis
LLMCLPLGIGLFLMQVFYYERRY

SEQ ID NO: 1743273 - protein, 17 aa, Staphylococcus epidermidis
LLMNKFKIDPAVASGPF

SEQ ID NO: 1743274 - protein, 24 aa, Staphylococcus epidermidis
LLMVYEMIAMFLIFALLHKYFYSN

SEQ ID NO: 1743275 - protein, 17 aa, Staphylococcus epidermidis
LLPLIFALIIPILYRFV

SEQ ID NO: 1743276 - protein, 18 aa, Staphylococcus epidermidis
LLPSNPFLDFTGQRTTST

SEQ ID NO: 1743277 - protein, 23 aa, Staphylococcus epidermidis
LLRRFKLKARMFIQIKDIFAPLM

SEQ ID NO: 1743278 - protein, 22 aa, Staphylococcus epidermidis
LLSFAVCFFVARYASVLTTKIN

SEQ ID NO: 1743279 - protein, 19 aa, Staphylococcus epidermidis
LLSFLKLIFATALFIFVIF

SEQ ID NO: 1743280 - protein, 22 aa, Staphylococcus epidermidis
LLSLFIRIQFQTVKAKNDSVHQ

SEQ ID NO: 1743281 - protein, 18 aa, Staphylococcus epidermidis
LLTGTLLLVWLADQNTTY

SEQ ID NO: 1743282 - protein, 17 aa, Staphylococcus epidermidis
LLTLDFYQPIFGKNKSD

SEQ ID NO: 1743283 - protein, 24 aa, Staphylococcus epidermidis
LLTLFLKFDRLIAVLGGVTPFLVA

SEQ ID NO: 1743284 - protein, 22 aa, Staphylococcus epidermidis
LLTVIFVVGIIFSKSKAVDYST

SEQ ID NO: 1743285 - protein, 25 aa, Staphylococcus epidermidis
LLVACGFVGAVAWTIYQLTVGMDLG

SEQ ID NO: 1743286 - protein, 29 aa, Staphylococcus epidermidis
LLVALAVYLFRFVWVYVLYPYFYLSVSPF

SEQ ID NO: 1743287 - protein, 27 aa, Staphylococcus epidermidis
LLVCGCIPKLGALANIIPLPVLGGAMI

SEQ ID NO: 1743288 - protein, 17 aa, Staphylococcus epidermidis
LLVICAIMMSLIKNKMS

SEQ ID NO: 1743289 - protein, 18 aa, Staphylococcus epidermidis
LLVISISLVIASTYSIIK

SEQ ID NO: 1743290 - protein, 18 aa, Staphylococcus epidermidis
LLVLFILIMNLRGLTESA

SEQ ID NO: 1743291 - protein, 18 aa, Staphylococcus epidermidis
LLVSFIIMFVGIQVVIEN

SEQ ID NO: 1743292 - protein, 19 aa, Staphylococcus epidermidis
LLVVPFFSLVILFSLGIDY

SEQ ID NO: 1743293 - protein, 20 aa, Staphylococcus epidermidis
LLWFFFKDHINIIGVLIGLM

SEQ ID NO: 1743294 - protein, 25 aa, Staphylococcus epidermidis
LLYAGRISLAIGFTSTIGMLVIGIT

SEQ ID NO: 1743295 - protein, 18 aa, Staphylococcus epidermidis
LLYGVYIFIRIKKWISQR

SEQ ID NO: 1743296 - protein, 18 aa, Staphylococcus epidermidis
LLYNFTLIPLFGMIQQSV

SEQ ID NO: 1743297 - protein, 40 aa, Staphylococcus epidermidis
LLYVALRISLIKVLKPYYPFPIIVDDAFVHFDKHRKERML

SEQ ID NO: 1743298 - protein, 17 aa, Staphylococcus epidermidis
LMCVGLAIITWIVSLFN

SEQ ID NO: 1743299 - protein, 27 aa, Staphylococcus epidermidis
LMERYRIPRLLGITIIYVAIVGIITLI

SEQ ID NO: 1743300 - protein, 21 aa, Staphylococcus epidermidis
LMFALPIYLSYHISDGLQQYV

SEQ ID NO: 1743301 - protein, 21 aa, Staphylococcus epidermidis
LMFALPIYLSYHVSDGLQYYV

SEQ ID NO: 1743302 - protein, 25 aa, Staphylococcus epidermidis
LMGFTEQYLIWSIFRLISGITSGTV

SEQ ID NO: 1743303 - protein, 17 aa, Staphylococcus epidermidis
LMGNAFAAFTVITASIG

SEQ ID NO: 1743304 - protein, 20 aa, Staphylococcus epidermidis
LMIFMLWSLLSWKVAVIYFV

SEQ ID NO: 1743305 - protein, 17 aa, Staphylococcus epidermidis
LMIGFFVQKFDPRYPKL

SEQ ID NO: 1743306 - protein, 17 aa, Staphylococcus epidermidis
LMISHWFKSKDNTHSNE

SEQ ID NO: 1743307 - protein, 23 aa, Staphylococcus epidermidis
LMKRLKIPMFPIVARKSKGTNDI

SEQ ID NO: 1743308 - protein, 18 aa, Staphylococcus epidermidis
LMLFLKIIGVSIFPTALI

SEQ ID NO: 1743309 - protein, 17 aa, Staphylococcus epidermidis
LMLHKSGLYKYEASTNI

SEQ ID NO: 1743310 - protein, 22 aa, Staphylococcus epidermidis
LMLKKVTYRWYNLIVEKMKETM

SEQ ID NO: 1743311 - protein, 24 aa, Staphylococcus epidermidis
LMNISESLAIFSLILLLVVVFILL

SEQ ID NO: 1743312 - protein, 17 aa, Staphylococcus epidermidis
LMNPLMIFMLWSLLSWK

SEQ ID NO: 1743313 - protein, 25 aa, Staphylococcus epidermidis
LMNPLMVFMLWALLGWKVAIVYFIV

SEQ ID NO: 1743314 - protein, 23 aa, Staphylococcus epidermidis
LMRVTEFVMLFPFLIFAIVLNAA

SEQ ID NO: 1743315 - protein, 42 aa, Staphylococcus epidermidis
LMSLITFIVLVIFKRSIIMPLYMMFSILLTYYVSMSIANLIF

SEQ ID NO: 1743316 - protein, 24 aa, Staphylococcus epidermidis
LMVLTAIALVIVWFIFNQIVAGIA

SEQ ID NO: 1743317 - protein, 22 aa, Staphylococcus epidermidis
LMVRHKIKPFKIFDKPQYERTY

SEQ ID NO: 1743318 - protein, 19 aa, Staphylococcus epidermidis
LNAFFSEIIKVMSRFIGSF

SEQ ID NO: 1743319 - protein, 20 aa, Staphylococcus epidermidis
LNALAKQLIKTFENTPDVTH

SEQ ID NO: 1743320 - protein, 27 aa, Staphylococcus epidermidis
LNAPKGEFLHMLLGVFLATLVSFVVAA

SEQ ID NO: 1743321 - protein, 26 aa, Staphylococcus epidermidis
LNDLKGRIAVAIAFQNIMLILSAFIM

SEQ ID NO: 1743322 - protein, 25 aa, Staphylococcus epidermidis
LNEKEAFRMISLLKNEFRGVRNKTP

SEQ ID NO: 1743323 - protein, 17 aa, Staphylococcus epidermidis
LNEQFGIEFEDSEDIDT

SEQ ID NO: 1743324 - protein, 25 aa, Staphylococcus epidermidis
LNFHSRFALEILLTIANHYNRNLRL

SEQ ID NO: 1743325 - protein, 17 aa, Staphylococcus epidermidis
LNFIAWSLLYSAIVLVM

SEQ ID NO: 1743326 - protein, 22 aa, Staphylococcus epidermidis
LNFNLSIAMLIALAVCLIPTTI

SEQ ID NO: 1743327 - protein, 22 aa, Staphylococcus epidermidis
LNGESRFKQALDNALNDVDGLN

SEQ ID NO: 1743328 - protein, 25 aa, Staphylococcus epidermidis
LNGFSWPIVLVLLILFYFYSHYLFA

SEQ ID NO: 1743329 - protein, 22 aa, Staphylococcus epidermidis
LNGKELLGYARFRHDAEGDFGR

SEQ ID NO: 1743330 - protein, 19 aa, Staphylococcus epidermidis
LNGLGIYIGRFLRLHTVYL

SEQ ID NO: 1743331 - protein, 21 aa, Staphylococcus epidermidis
LNGQISYKTNAPFRGDGSQKT

SEQ ID NO: 1743332 - protein, 25 aa, Staphylococcus epidermidis
LNGTMWMFIGFMIFGIVSSLVAAIV

SEQ ID NO: 1743333 - protein, 18 aa, Staphylococcus epidermidis
LNGVELLDADKQNAHQSI

SEQ ID NO: 1743334 - protein, 17 aa, Staphylococcus epidermidis
LNHAKALNEVMRQLENE

SEQ ID NO: 1743335 - protein, 20 aa, Staphylococcus epidermidis
LNHGVKWLSNFNIILGAVLL

SEQ ID NO: 1743336 - protein, 21 aa, Staphylococcus epidermidis
LNIGCSMMDILYLKILLFSND

SEQ ID NO: 1743337 - protein, 24 aa, Staphylococcus epidermidis
LNIKGTPLSAGFGYTGLVGPINAL

SEQ ID NO: 1743338 - protein, 28 aa, Staphylococcus epidermidis
LNILMCLCSLTFFFFFSIMNIIAFDNEK

SEQ ID NO: 1743339 - protein, 28 aa, Staphylococcus epidermidis
LNIPDIKRPWLPPLPEIVYQSELIETDF

SEQ ID NO: 1743340 - protein, 17 aa, Staphylococcus epidermidis
LNKSRIRIEKDLKNNIT

SEQ ID NO: 1743341 - protein, 18 aa, Staphylococcus epidermidis
LNLAKGIHPWLGLILTVI

SEQ ID NO: 1743342 - protein, 30 aa, Staphylococcus epidermidis
LNLIKMIIIPIVFCALALSISNLGDSKKVG

SEQ ID NO: 1743343 - protein, 27 aa, Staphylococcus epidermidis
LNLKSIRKKLWLATGIVGIIQYTGLVA

SEQ ID NO: 1743344 - protein, 25 aa, Staphylococcus epidermidis
LNNIYTLPIKIPSFIPKEPIKKSGE

SEQ ID NO: 1743345 - protein, 18 aa, Staphylococcus epidermidis
LNPFWTILLSLIFLHEKV

SEQ ID NO: 1743346 - protein, 23 aa, Staphylococcus epidermidis
LNQEKAKMLAEVISRIQNDKSDA

SEQ ID NO: 1743347 - protein, 23 aa, Staphylococcus epidermidis
LNQLAPYFKGFDGSFVLYNEREQ

SEQ ID NO: 1743348 - protein, 18 aa, Staphylococcus epidermidis
LNSAGKLRNKTTMDSNDL

SEQ ID NO: 1743349 - protein, 20 aa, Staphylococcus epidermidis
LNSIFDVFFTLTWIIITISL

SEQ ID NO: 1743350 - protein, 24 aa, Staphylococcus epidermidis
LNSIPRFVQSTINVVRNFFSNEHA

SEQ ID NO: 1743351 - protein, 25 aa, Staphylococcus epidermidis
LNSIVRKKAKALKEIELEADHVKQM

SEQ ID NO: 1743352 - protein, 23 aa, Staphylococcus epidermidis
LNSSMKYSVNWYYENLNKHLRQD

SEQ ID NO: 1743353 - protein, 20 aa, Staphylococcus epidermidis
LNVFVFNYFFTVPRFTLEMY

SEQ ID NO: 1743354 - protein, 26 aa, Staphylococcus epidermidis
LNVFVFNYFFTVPRFTLEMYRFEYPI

SEQ ID NO: 1743355 - protein, 25 aa, Staphylococcus epidermidis
LNYSKIHVGYLFEAKTNFYGNKLYF

SEQ ID NO: 1743356 - protein, 21 aa, Staphylococcus epidermidis
LPATAKLEFNNVLLTGKPLTD

SEQ ID NO: 1743357 - protein, 18 aa, Staphylococcus epidermidis
LPATSVKSKAKKDIDQKL

SEQ ID NO: 1743358 - protein, 25 aa, Staphylococcus epidermidis
LPAVALFLVVFCWQPIHFYALAIKR

SEQ ID NO: 1743359 - protein, 18 aa, Staphylococcus epidermidis
LPFAVLEAMGGKENIKHL

SEQ ID NO: 1743360 - protein, 24 aa, Staphylococcus epidermidis
LPFGHSMLYLSSIMDIYNGEIVAY

SEQ ID NO: 1743361 - protein, 17 aa, Staphylococcus epidermidis
LPFRFSGFGFDLSSTLV

SEQ ID NO: 1743362 - protein, 26 aa, Staphylococcus epidermidis
LPGETFRNSFDWLGLNKKYLTRTLAD

SEQ ID NO: 1743363 - protein, 19 aa, Staphylococcus epidermidis
LPGQFYLVRIYRIVMLIIT

SEQ ID NO: 1743364 - protein, 19 aa, Staphylococcus epidermidis
LPGSLIGSFLSRYLTLDSF

SEQ ID NO: 1743365 - protein, 26 aa, Staphylococcus epidermidis
LPIAISMRITKGFKQLIALSIILGEL

SEQ ID NO: 1743366 - protein, 26 aa, Staphylococcus epidermidis
LPIAISMRLTKGFKQLIALSVVLGES

SEQ ID NO: 1743367 - protein, 24 aa, Staphylococcus epidermidis
LPIDFKKLMILGSLVSLATAIVPM

SEQ ID NO: 1743368 - protein, 25 aa, Staphylococcus epidermidis
LPIIIIRTSWLFILFIFLGGLSYTI

SEQ ID NO: 1743369 - protein, 20 aa, Staphylococcus epidermidis
LPIILGFLITIFWGALNPLL

SEQ ID NO: 1743370 - protein, 23 aa, Staphylococcus epidermidis
LPIIPIIISRYWVQLISNVPKEM

SEQ ID NO: 1743371 - protein, 20 aa, Staphylococcus epidermidis
LPIIPIIVSRYWVQLISNVP

SEQ ID NO: 1743372 - protein, 21 aa, Staphylococcus epidermidis
LPIIPIIVSRYWVQLISNVPK

SEQ ID NO: 1743373 - protein, 20 aa, Staphylococcus epidermidis
LPILGLIPFILWGAMGWATQ

SEQ ID NO: 1743374 - protein, 20 aa, Staphylococcus epidermidis
LPIVIVPLVTERKRIKEHPD

SEQ ID NO: 1743375 - protein, 20 aa, Staphylococcus epidermidis
LPIVIVPLVTERKRIKKHPD

SEQ ID NO: 1743376 - protein, 17 aa, Staphylococcus epidermidis
LPIYLSYHVSDGLQYYV

SEQ ID NO: 1743377 - protein, 17 aa, Staphylococcus epidermidis
LPLILIILYLIAGIYAF

SEQ ID NO: 1743378 - protein, 18 aa, Staphylococcus epidermidis
LPLLLFFLNGYLKISLHY

SEQ ID NO: 1743379 - protein, 20 aa, Staphylococcus epidermidis
LPLNEAWEVAQQMAKKIVTN

SEQ ID NO: 1743380 - protein, 24 aa, Staphylococcus epidermidis
LPLSLRLNDWYTIAISMLTLGIAL

SEQ ID NO: 1743381 - protein, 17 aa, Staphylococcus epidermidis
LPLTFKFGPENSNTIIM

SEQ ID NO: 1743382 - protein, 18 aa, Staphylococcus epidermidis
LPLYPVLPAITFVLVLLV

SEQ ID NO: 1743383 - protein, 22 aa, Staphylococcus epidermidis
LPLYSRDDFIGHIAMEIISRSL

SEQ ID NO: 1743384 - protein, 17 aa, Staphylococcus epidermidis
LPMLSGAFQTLGVAIGA

SEQ ID NO: 1743385 - protein, 18 aa, Staphylococcus epidermidis
LPNVEDFDTLAGRGAKGI

SEQ ID NO: 1743386 - protein, 19 aa, Staphylococcus epidermidis
LPPHVPILLVFTILLFYGK

SEQ ID NO: 1743387 - protein, 22 aa, Staphylococcus epidermidis
LPPKEVFLASVLIGTLGAVMDV

SEQ ID NO: 1743388 - protein, 20 aa, Staphylococcus epidermidis
LPPLAAMLFIKIGYHPIAGL

SEQ ID NO: 1743389 - protein, 32 aa, Staphylococcus epidermidis
LPQVFKSMLIPIVIIITMCFVHLPTAIIMIVT

SEQ ID NO: 1743390 - protein, 31 aa, Staphylococcus epidermidis
LPSKRNILLMFCPLLPFIGFAFIFLIPSKGI

SEQ ID NO: 1743391 - protein, 19 aa, Staphylococcus epidermidis
LPTILKLTSFYLNTVQNNE

SEQ ID NO: 1743392 - protein, 20 aa, Staphylococcus epidermidis
LPTLIFTIAMGFFVTIILNS

SEQ ID NO: 1743393 - protein, 30 aa, Staphylococcus epidermidis
LPTRSNKLTIVRGVDHWHSLSKDPNPEYPI

SEQ ID NO: 1743394 - protein, 21 aa, Staphylococcus epidermidis
LPTTILFSWISLFMAQWVVEN

SEQ ID NO: 1743395 - protein, 20 aa, Staphylococcus epidermidis
LPTYRFPSFKTLWRSTWEKA

SEQ ID NO: 1743396 - protein, 22 aa, Staphylococcus epidermidis
LPVIGFILYLFLGRTVSKKKME

SEQ ID NO: 1743397 - protein, 18 aa, Staphylococcus epidermidis
LPVIIQIPILMGLYMSLK

SEQ ID NO: 1743398 - protein, 17 aa, Staphylococcus epidermidis
LPVRRADYVKSYYTIFL

SEQ ID NO: 1743399 - protein, 21 aa, Staphylococcus epidermidis
LPVTDNAGGSGLRDVNVNLPQ

SEQ ID NO: 1743400 - protein, 17 aa, Staphylococcus epidermidis
LPVVLYSGFLVFNKMFK

SEQ ID NO: 1743401 - protein, 22 aa, Staphylococcus epidermidis
LPWICLYGLTGLLIPASLATAL

SEQ ID NO: 1743402 - protein, 17 aa, Staphylococcus epidermidis
LQAIKFQLLVVFIHTTA

SEQ ID NO: 1743403 - protein, 19 aa, Staphylococcus epidermidis
LQAMDTMTSFWIPQLGGQK

SEQ ID NO: 1743404 - protein, 18 aa, Staphylococcus epidermidis
LQANIGWNEPHHEVDSSE

SEQ ID NO: 1743405 - protein, 21 aa, Staphylococcus epidermidis
LQCLLAIFIMTLINGLTPLIG

SEQ ID NO: 1743406 - protein, 23 aa, Staphylococcus epidermidis
LQFPKENWWIFVVLLLLVGNVEV

SEQ ID NO: 1743407 - protein, 23 aa, Staphylococcus epidermidis
LQFPKENWWVFIVLLLLVGNIEV

SEQ ID NO: 1743408 - protein, 17 aa, Staphylococcus epidermidis
LQIAKNDAIKIIDVLVK

SEQ ID NO: 1743409 - protein, 24 aa, Staphylococcus epidermidis
LQIKLELDSLVAVHEQIYKSLSKK

SEQ ID NO: 1743410 - protein, 17 aa, Staphylococcus epidermidis
LQISALMIWGFLVIISL

SEQ ID NO: 1743411 - protein, 19 aa, Staphylococcus epidermidis
LQKILDRFIEQGRLKSYTI

SEQ ID NO: 1743412 - protein, 17 aa, Staphylococcus epidermidis
LQKQVNIAGTFNGVLHL

SEQ ID NO: 1743413 - protein, 24 aa, Staphylococcus epidermidis
LQLKRASLQFSFLTNLIAAFVACG

SEQ ID NO: 1743414 - protein, 21 aa, Staphylococcus epidermidis
LQMIVMPLIFVSIVAAFSKIQ

SEQ ID NO: 1743415 - protein, 34 aa, Staphylococcus epidermidis; identical to SEQ ID NO: 1578056

SEQ ID NO: 1743416 - protein, 25 aa, Staphylococcus epidermidis
LQMSYNHTWNILGYVLNGFVFSILG

SEQ ID NO: 1743417 - protein, 22 aa, Staphylococcus epidermidis
LQPKGTFKGWWEMYLKQVKGNL

SEQ ID NO: 1743418 - protein, 24 aa, Staphylococcus epidermidis
LQQRFENIVAFILLVILVKLILYL

SEQ ID NO: 1743419 - protein, 17 aa, Staphylococcus epidermidis
LQQVQFGTFEYTESAVA

SEQ ID NO: 1743420 - protein, 23 aa, Staphylococcus epidermidis
LQREAEQLINFSLRQMDKLPDDV

SEQ ID NO: 1743421 - protein, 24 aa, Staphylococcus epidermidis
LQWLLDTFVSFGLVLGFILMFILK

SEQ ID NO: 1743422 - protein, 19 aa, Staphylococcus epidermidis
LRDAEALDQSMQTLRDLVN

SEQ ID NO: 1743423 - protein, 19 aa, Staphylococcus epidermidis
LREFYIFRFVIGKQPYKLQ

SEQ ID NO: 1743424 - protein, 20 aa, Staphylococcus epidermidis
LREFYIFRFVIGKQPYKLQF

SEQ ID NO: 1743425 - protein, 26 aa, Staphylococcus epidermidis
LREGVKVCTNCGTPVNQHHQSHSQPQ

SEQ ID NO: 1743426 - protein, 19 aa, Staphylococcus epidermidis
LREIFDKRIRTEEDVEKEL

SEQ ID NO: 1743427 - protein, 23 aa, Staphylococcus epidermidis
LRENPKWLVKLLILIVLALITAF

SEQ ID NO: 1743428 - protein, 21 aa, Staphylococcus epidermidis
LRFILRTALGYGIFAYCLHFL

SEQ ID NO: 1743429 - protein, 21 aa, Staphylococcus epidermidis
LRHITFPTVFFIVLLTGLITL

SEQ ID NO: 1743430 - protein, 20 aa, Staphylococcus epidermidis
LRHQPKWILKSIIMIVLAII

SEQ ID NO: 1743431 - protein, 21 aa, Staphylococcus epidermidis
LRHQPKWILKSIIVIVLAIIS

SEQ ID NO: 1743432 - protein, 27 aa, Staphylococcus epidermidis
LRISKNGTRYLFFDNMSFTAPTKQPII

SEQ ID NO: 1743433 - protein, 18 aa, Staphylococcus epidermidis
LRKILNRFKEEGRLRSYT

SEQ ID NO: 1743434 - protein, 26 aa, Staphylococcus epidermidis
LRKNGFKDIYMLKGGYKKWTGKIKSK

SEQ ID NO: 1743435 - protein, 19 aa, Staphylococcus epidermidis
LRKRQRLFGEYDVNHINQY

SEQ ID NO: 1743436 - protein, 23 aa, Staphylococcus epidermidis
LRKSSLNLLSLIFIIMYIVYPGY

SEQ ID NO: 1743437 - protein, 30 aa, Staphylococcus epidermidis
LRLIILMVIAILGMAGWLFYAHQLIEKKTA

SEQ ID NO: 1743438 - protein, 18 aa, Staphylococcus epidermidis
LRLNATILDVKPYPSEQA

SEQ ID NO: 1743439 - protein, 18 aa, Staphylococcus epidermidis
LRLPRILIALCVGAMLSA

SEQ ID NO: 1743440 - protein, 25 aa, Staphylococcus epidermidis
LRQSFNIPALKTWQQVKKSAGNDAP

SEQ ID NO: 1743441 - protein, 17 aa, Staphylococcus epidermidis
LRRIGFTNSDMSKGLLL

SEQ ID NO: 1743442 - protein, 21 aa, Staphylococcus epidermidis
LRRLSIKNVRRLSSFSDIFVN

SEQ ID NO: 1743443 - protein, 20 aa, Staphylococcus epidermidis
LRSDMDLEPILAVDDDPDKR

SEQ ID NO: 1743444 - protein, 22 aa, Staphylococcus epidermidis
LRTSKNRGFHFFYISICLFLMT

SEQ ID NO: 1743445 - protein, 22 aa, Staphylococcus epidermidis
LRYSIGLLIFVCLWTFVLSLLL

SEQ ID NO: 1743446 - protein, 17 aa, Staphylococcus epidermidis
LSASKLTLTFGVSKSFL

SEQ ID NO: 1743447 - protein, 18 aa, Staphylococcus epidermidis
LSDIFGISLNELITGEKE

SEQ ID NO: 1743448 - protein, 25 aa, Staphylococcus epidermidis
LSFATWRMVFIILTVFGLLMFVGTL

SEQ ID NO: 1743449 - protein, 18 aa, Staphylococcus epidermidis
LSFILYVIHYFKEQFKGY

SEQ ID NO: 1743450 - protein, 17 aa, Staphylococcus epidermidis
LSFKEAIQHKGIYDRGA

SEQ ID NO: 1743451 - protein, 17 aa, Staphylococcus epidermidis
LSFKFLKALLYLKYLKK

SEQ ID NO: 1743452 - protein, 21 aa, Staphylococcus epidermidis
LSFKFLKALLYLKYLKKQSLY

SEQ ID NO: 1743453 - protein, 18 aa, Staphylococcus epidermidis
LSFSRNFGKEAAMIAGYE

SEQ ID NO: 1743454 - protein, 19 aa, Staphylococcus epidermidis
LSFSRNFGKEAAMIAGYQH

SEQ ID NO: 1743455 - protein, 19 aa, Staphylococcus epidermidis
LSFSRNFGKEAAMIAGYQN

SEQ ID NO: 1743456 - protein, 18 aa, Staphylococcus epidermidis
LSFYNWQMSLTLFLIMPI

SEQ ID NO: 1743457 - protein, 19 aa, Staphylococcus epidermidis
LSGVVKLGWEVMFPPRTPS

SEQ ID NO: 1743458 - protein, 22 aa, Staphylococcus epidermidis
LSGYQKGWIDSMIMRMIDIGLS

SEQ ID NO: 1743459 - protein, 20 aa, Staphylococcus epidermidis
LSHNHYGFYIAFSISTLLYP

SEQ ID NO: 1743460 - protein, 22 aa, Staphylococcus epidermidis
LSHSDYGFYIAFSISTLLYPYL

SEQ ID NO: 1743461 - protein, 24 aa, Staphylococcus epidermidis
LSIDFKKLMIIGSLISVATASVPM

SEQ ID NO: 1743462 - protein, 25 aa, Staphylococcus epidermidis
LSIIEWVLLVKIFKRKIPFLDKVIL

SEQ ID NO: 1743463 - protein, 18 aa, Staphylococcus epidermidis
LSILRFLISAGIVLLCIY

SEQ ID NO: 1743464 - protein, 23 aa, Staphylococcus epidermidis
LSKDRTTLIVAHRLSTITHADKI

SEQ ID NO: 1743465 - protein, 22 aa, Staphylococcus epidermidis
LSKEIYFSIQLIMLIYIGISIT

SEQ ID NO: 1743466 - protein, 29 aa, Staphylococcus epidermidis
LSKFKPLSWLASIYIEFLRGTPMLVQVFI

SEQ ID NO: 1743467 - protein, 21 aa, Staphylococcus epidermidis
LSKFYILVLFAGLFHLMNHAV

SEQ ID NO: 1743468 - protein, 21 aa, Staphylococcus epidermidis
LSKNQKGMIVQQDWNGKNNKF

SEQ ID NO: 1743469 - protein, 24 aa, Staphylococcus epidermidis
LSKSKKKLQGMVVVLHDITNLQKL

SEQ ID NO: 1743470 - protein, 21 aa, Staphylococcus epidermidis
LSKVKRFGMITLMSIIIGVIT

SEQ ID NO: 1743471 - protein, 18 aa, Staphylococcus epidermidis
LSLEKNKDTELLLLKEEY

SEQ ID NO: 1743472 - protein, 17 aa, Staphylococcus epidermidis
LSLFIVFFGISWGPVLW

SEQ ID NO: 1743473 - protein, 25 aa, Staphylococcus epidermidis
LSLIISVILYFSFVTLKYAHHLHGN

SEQ ID NO: 1743474 - protein, 20 aa, Staphylococcus epidermidis
LSLILKFSHILLPFMFGPMI

SEQ ID NO: 1743475 - protein, 28 aa, Staphylococcus epidermidis
LSLITTQGWIRISFIDGLPLKEYSLEWF

SEQ ID NO: 1743476 - protein, 27 aa, Staphylococcus epidermidis
LSLLLKMLHVILPFMFGPILAALLCVK

SEQ ID NO: 1743477 - protein, 17 aa, Staphylococcus epidermidis
LSLVEKWVVPKGLKVSR

SEQ ID NO: 1743478 - protein, 17 aa, Staphylococcus epidermidis
LSMMLIPGSLVFLFGRM

SEQ ID NO: 1743479 - protein, 22 aa, Staphylococcus epidermidis
LSMSLSLCWDVGKLDDVFNQTI

SEQ ID NO: 1743480 - protein, 22 aa, Staphylococcus epidermidis
LSNKELLELAGALETRSEHPLA

SEQ ID NO: 1743481 - protein, 27 aa, Staphylococcus epidermidis
LSNTTEAFSGYYQRYQANFFAIWFELG

SEQ ID NO: 1743482 - protein, 18 aa, Staphylococcus epidermidis
LSPFQFSIMFAFIGITLI

SEQ ID NO: 1743483 - protein, 18 aa, Staphylococcus epidermidis
LSQIIFLFFVYLIPQMIV

SEQ ID NO: 1743484 - protein, 19 aa, Staphylococcus epidermidis
LSQRPYIFADSIKNNIAMY

SEQ ID NO: 1743485 - protein, 17 aa, Staphylococcus epidermidis
LSRILCILLIIISVVGL

SEQ ID NO: 1743486 - protein, 20 aa, Staphylococcus epidermidis
LSSMLYRVFLDISSFSSKGI

SEQ ID NO: 1743487 - protein, 27 aa, Staphylococcus epidermidis
LSTSIRRTEIVSGYLIGYGIFAIIQTL

SEQ ID NO: 1743488 - protein, 18 aa, Staphylococcus epidermidis
LSVFCTFVGRKEKVRGDS

SEQ ID NO: 1743489 - protein, 18 aa, Staphylococcus epidermidis
LSVFSLKTFMFVLLMVLM

SEQ ID NO: 1743490 - protein, 28 aa, Staphylococcus epidermidis
LSVILVITIVISFLFYFITTEKKVDKDT

SEQ ID NO: 1743491 - protein, 17 aa, Staphylococcus epidermidis
LSVKFKLLPTRMILIGI

SEQ ID NO: 1743492 - protein, 17 aa, Staphylococcus epidermidis
LSWYPTLYWVINAAVVI

SEQ ID NO: 1743493 - protein, 18 aa, Staphylococcus epidermidis
LTAGAISGDWIKQVVAVL

SEQ ID NO: 1743494 - protein, 18 aa, Staphylococcus epidermidis
LTAIILRIEILLEYINRQ

SEQ ID NO: 1743495 - protein, 32 aa, Staphylococcus epidermidis
LTALSQGVALVFRLNQSLTFWSAGGVSGTTWG

SEQ ID NO: 1743496 - protein, 26 aa, Staphylococcus epidermidis
LTAWGIGGLIGSFGIGFIIDRFKNTR

SEQ ID NO: 1743497 - protein, 28 aa, Staphylococcus epidermidis
LTDETSHLFSFFISYHFNQFDLSFQRLF

SEQ ID NO: 1743498 - protein, 18 aa, Staphylococcus epidermidis
LTDRVIRSVAFFLTALPS

SEQ ID NO: 1743499 - protein, 19 aa, Staphylococcus epidermidis
LTFLPDFWYITASVVGYLL

SEQ ID NO: 1743500 - protein, 19 aa, Staphylococcus epidermidis
LTGIFPILSLVMGILIALL

SEQ ID NO: 1743501 - protein, 18 aa, Staphylococcus epidermidis
LTGMEMLESLILGVLFST

SEQ ID NO: 1743502 - protein, 23 aa, Staphylococcus epidermidis
LTGPESYILPVFVITMTYAGIYF

SEQ ID NO: 1743503 - protein, 20 aa, Staphylococcus epidermidis
LTHKSCRVKGEFKFDKEFLL

SEQ ID NO: 1743504 - protein, 18 aa, Staphylococcus epidermidis
LTHKSCRVKGEFKSEKEL

SEQ ID NO: 1743505 - protein, 20 aa, Staphylococcus epidermidis
LTIFVALQIRIFTIKEDNIY

SEQ ID NO: 1743506 - protein, 30 aa, Staphylococcus epidermidis
LTILAAALSIFSFFTANLIFGIIFALLTVI

SEQ ID NO: 1743507 - protein, 17 aa, Staphylococcus epidermidis
LTINEIVKEQGQNVTND

SEQ ID NO: 1743508 - protein, 18 aa, Staphylococcus epidermidis
LTIVGAYLFFRSSVSLIF

SEQ ID NO: 1743509 - protein, 19 aa, Staphylococcus epidermidis
LTKKRIFKMSPIHHHFELS

SEQ ID NO: 1743510 - protein, 27 aa, Staphylococcus epidermidis
LTLAESYSFGGSIALLSLLLFIASGIY

SEQ ID NO: 1743511 - protein, 19 aa, Staphylococcus epidermidis
LTLAITVGYLFNLFKFGKY

SEQ ID NO: 1743512 - protein, 19 aa, Staphylococcus epidermidis
LTLFLIMPIALFFIILSKF

SEQ ID NO: 1743513 - protein, 19 aa, Staphylococcus epidermidis
LTLFLIMRFIQGLTSGGAI

SEQ ID NO: 1743514 - protein, 22 aa, Staphylococcus epidermidis
LTLGIALLIVWGVRSYYLHRTY

SEQ ID NO: 1743515 - protein, 17 aa, Staphylococcus epidermidis
LTLKHTNIFFVVGIIIT

SEQ ID NO: 1743516 - protein, 17 aa, Staphylococcus epidermidis
LTLLSIVAYSLLSTKSL

SEQ ID NO: 1743517 - protein, 39 aa, Staphylococcus epidermidis
LTLSVLLFFKGKKAFWFIFIGGFLLTFLLYANVVYFRFF

SEQ ID NO: 1743518 - protein, 21 aa, Staphylococcus epidermidis
LTMNFMITFLFVISATVIGVF

SEQ ID NO: 1743519 - protein, 18 aa, Staphylococcus epidermidis
LTNDKKPASVRRYNEAIS

SEQ ID NO: 1743520 - protein, 50 aa, Staphylococcus epidermidis
LTPDAYSQKGAISLNTRLDSNRSFRFIGKVNLGNRYEGYSPDGVAGGDGI

SEQ ID NO: 1743521 - protein, 71 aa, Staphylococcus epidermidis
LTPDAYSQKGAISLNTRLDSNRSFRFTGKVNLGNRYEGYSPDGVVGGDGIGFAFSPGPLGQIGKEGAAVGI

SEQ ID NO: 1743522 - protein, 22 aa, Staphylococcus epidermidis
LTQLKSQYGIKQFNFVAHSMGN

SEQ ID NO: 1743523 - protein, 24 aa, Staphylococcus epidermidis
LTRGPALGFNIIFVGMHKELIDAY

SEQ ID NO: 1743524 - protein, 26 aa, Staphylococcus epidermidis
LTSLSVSLPSFFIGLILLFIFNQKLN

SEQ ID NO: 1743525 - protein, 27 aa, Staphylococcus epidermidis
LTTALRKQFFKHYKLDRHTRSDSDKYT

SEQ ID NO: 1743526 - protein, 20 aa, Staphylococcus epidermidis
LTTFPLKKGQTYTIEQLLKQ

SEQ ID NO: 1743527 - protein, 26 aa, Staphylococcus epidermidis
LTTIIFVIFFSFKYIYGDFRNLDPDY

SEQ ID NO: 1743528 - protein, 33 aa, Staphylococcus epidermidis
LTTIILVIAYKLMWFNGHMTFTLTITTMITSCL

SEQ ID NO: 1743529 - protein, 23 aa, Staphylococcus epidermidis
LTTKEKYFLLIFISNAIFGVIQD

SEQ ID NO: 1743530 - protein, 26 aa, Staphylococcus epidermidis
LTTTVTGLPSGLSFDQTTNTIIGTPS

SEQ ID NO: 1743531 - protein, 26 aa, Staphylococcus epidermidis
LTTTVTGLPSGLSFDQTTNTITGTPS

SEQ ID NO: 1743532 - protein, 18 aa, Staphylococcus epidermidis
LTVFICSLMIGKTPSYLG

SEQ ID NO: 1743533 - protein, 29 aa, Staphylococcus epidermidis
LTVLGSYFFFRSTVSLVFKTIQHFRNGNI

SEQ ID NO: 1743534 - protein, 17 aa, Staphylococcus epidermidis
LTVNLAHEFMKTYEHKY

SEQ ID NO: 1743535 - protein, 17 aa, Staphylococcus epidermidis
LTVPISGLIFFFESNAF

SEQ ID NO: 1743536 - protein, 17 aa, Staphylococcus epidermidis
LTYQFGLIILSVLTLTT

SEQ ID NO: 1743537 - protein, 18 aa, Staphylococcus epidermidis
LVAIMYWVVCFIISIIQG

SEQ ID NO: 1743538 - protein, 24 aa, Staphylococcus epidermidis
LVALMRYGGGVSYQLIEDESPFIA

SEQ ID NO: 1743539 - protein, 25 aa, Staphylococcus epidermidis
LVASILVLWLYFRKSIPRKFDAVNI

SEQ ID NO: 1743540 - protein, 19 aa, Staphylococcus epidermidis
LVCHLVALMRYGGGVSYQL

SEQ ID NO: 1743541 - protein, 17 aa, Staphylococcus epidermidis
LVCSLMIIFGLKLPLLI

SEQ ID NO: 1743542 - protein, 17 aa, Staphylococcus epidermidis
LVDGAREIMGMGLNKLG

SEQ ID NO: 1743543 - protein, 22 aa, Staphylococcus epidermidis
LVDNASKMSITYTRNRKTTQQE

SEQ ID NO: 1743544 - protein, 25 aa, Staphylococcus epidermidis
LVFILCLLVIIGLSFLLSSYVPLTG

SEQ ID NO: 1743545 - protein, 37 aa, Staphylococcus epidermidis
LVFKYKKEQLAGLKFSISLKVIERLILALILPLIILM

SEQ ID NO: 1743546 - protein, 26 aa, Staphylococcus epidermidis
LVFYHLKLDVEFASILGLTKDKSLIQ

SEQ ID NO: 1743547 - protein, 26 aa, Staphylococcus epidermidis
LVFYHLKLDVEFASILGLTKDKSLLQ

SEQ ID NO: 1743548 - protein, 17 aa, Staphylococcus epidermidis
LVGEQYLSVILPGETFR

SEQ ID NO: 1743549 - protein, 18 aa, Staphylococcus epidermidis
LVGLIITTALRWEAVGKN

SEQ ID NO: 1743550 - protein, 23 aa, Staphylococcus epidermidis
LVGPRPLLMEYLPLYNQEQKKRH

SEQ ID NO: 1743551 - protein, 20 aa, Staphylococcus epidermidis
LVGVGEGFNVIASDALAMLQ

SEQ ID NO: 1743552 - protein, 21 aa, Staphylococcus epidermidis
LVIAGGILMAIVFLFGANSFD

SEQ ID NO: 1743553 - protein, 21 aa, Staphylococcus epidermidis
LVIAGSFIFSAGVNAFIISGN

SEQ ID NO: 1743554 - protein, 17 aa, Staphylococcus epidermidis
LVIAIPLAIVVIVVGGW

SEQ ID NO: 1743555 - protein, 23 aa, Staphylococcus epidermidis
LVIGKLFFKKDIRQYGSGNTGAT

SEQ ID NO: 1743556 - protein, 25 aa, Staphylococcus epidermidis
LVILKAAVESPVLFVSIAVFSSLVF

SEQ ID NO: 1743557 - protein, 26 aa, Staphylococcus epidermidis
LVILSISILLLMGFILYFHHLTSEAS

SEQ ID NO: 1743558 - protein, 17 aa, Staphylococcus epidermidis
LVIVRRYNPYIVLFISV

SEQ ID NO: 1743559 - protein, 17 aa, Staphylococcus epidermidis
LVIVRRYNPYIVLSVAI

SEQ ID NO: 1743560 - protein, 25 aa, Staphylococcus epidermidis
LVKIEAIKSLFSFKQPPLAHVKPAT

SEQ ID NO: 1743561 - protein, 17 aa, Staphylococcus epidermidis
LVLFKLPMNTVVVNSII

SEQ ID NO: 1743562 - protein, 24 aa, Staphylococcus epidermidis
LVLMLPLLIVVSFMTFMMTYLTKG

SEQ ID NO: 1743563 - protein, 17 aa, Staphylococcus epidermidis
LVLVFLPLIGFILYLLL

SEQ ID NO: 1743564 - protein, 28 aa, Staphylococcus epidermidis
LVNEIEIPKWLLFFSVLLSIIGSIFQLI

SEQ ID NO: 1743565 - protein, 25 aa, Staphylococcus epidermidis
LVPFVGSDSWRHFLLPIITIVMIDG

SEQ ID NO: 1743566 - protein, 22 aa, Staphylococcus epidermidis
LVPLFTGRLVDKFSVSSINWGM

SEQ ID NO: 1743567 - protein, 22 aa, Staphylococcus epidermidis
LVPLFTGRLVDKFSVSSMNWGM

SEQ ID NO: 1743568 - protein, 22 aa, Staphylococcus epidermidis
LVPSLGATFFKNGVKNREQKGG

SEQ ID NO: 1743569 - protein, 25 aa, Staphylococcus epidermidis
LVPVLFLLLFAWKKVPAIPTLLVGS

SEQ ID NO: 1743570 - protein, 21 aa, Staphylococcus epidermidis
LVQAKQRLEQIANEADPTQGM

SEQ ID NO: 1743571 - protein, 18 aa, Staphylococcus epidermidis
LVQFPELIIMGLSEGVIP

SEQ ID NO: 1743572 - protein, 23 aa, Staphylococcus epidermidis
LVQNVVKYIVWFIVLTTILSKFG

SEQ ID NO: 1743573 - protein, 22 aa, Staphylococcus epidermidis
LVRGVLGLLAFLNVALELSGHN

SEQ ID NO: 1743574 - protein, 20 aa, Staphylococcus epidermidis
LVSCMVFLTFFLSVNQSAHS

SEQ ID NO: 1743575 - protein, 17 aa, Staphylococcus epidermidis
LVSIAVIVGLKISIKPA

SEQ ID NO: 1743576 - protein, 18 aa, Staphylococcus epidermidis
LVSLTAISSIMVNVLVGE

SEQ ID NO: 1743577 - protein, 18 aa, Staphylococcus epidermidis
LVSNIFKYRQRIIDKANS

SEQ ID NO: 1743578 - protein, 23 aa, Staphylococcus epidermidis
LVTSVLPEWAFGLFGAVIFGAIL

SEQ ID NO: 1743579 - protein, 19 aa, Staphylococcus epidermidis
LVVLIAWILYYFVNIKLTN

SEQ ID NO: 1743580 - protein, 19 aa, Staphylococcus epidermidis
LVVLIAWILYYFVNINLTN

SEQ ID NO: 1743581 - protein, 17 aa, Staphylococcus epidermidis
LVVLSFLLVLPVTNVLY

SEQ ID NO: 1743582 - protein, 24 aa, Staphylococcus epidermidis
LVVVDLWNAKSFRKLSLHSKLVLT

SEQ ID NO: 1743583 - protein, 17 aa, Staphylococcus epidermidis
LWFAPIAAIVILVIFSL

SEQ ID NO: 1743584 - protein, 18 aa, Staphylococcus epidermidis
LWIAYQFYQPIAKRLIVF

SEQ ID NO: 1743585 - protein, 17 aa, Staphylococcus epidermidis
LWLVLLFAGGGLSLILL

SEQ ID NO: 1743586 - protein, 28 aa, Staphylococcus epidermidis
LYAQDIAKTLIHWCDKAFVTKLVLGQSE

SEQ ID NO: 1743587 - protein, 17 aa, Staphylococcus epidermidis
LYEKCKVDHREMKRDVL

SEQ ID NO: 1743588 - protein, 23 aa, Staphylococcus epidermidis
LYENYKFIFLNSHSCYFSHTIHK

SEQ ID NO: 1743589 - protein, 17 aa, Staphylococcus epidermidis
LYFAFLGILKIGAIVGP

SEQ ID NO: 1743590 - protein, 17 aa, Staphylococcus epidermidis
LYFIFCILLIGLLILPE

SEQ ID NO: 1743591 - protein, 23 aa, Staphylococcus epidermidis
LYGETFNVFGLLLFIIGIILFTI

SEQ ID NO: 1743592 - protein, 17 aa, Staphylococcus epidermidis
LYILLLIHYVCIMYFVY

SEQ ID NO: 1743593 - protein, 22 aa, Staphylococcus epidermidis
LYITLITVIAMISIYMLSLKMD

SEQ ID NO: 1743594 - protein, 26 aa, Staphylococcus epidermidis
LYLIARITPIFAISEGWVWTITIVGL

SEQ ID NO: 1743595 - protein, 19 aa, Staphylococcus epidermidis
LYLIISLFTGFFGILFNTA

SEQ ID NO: 1743596 - protein, 19 aa, Staphylococcus epidermidis
LYLVARMTPIFAISEGWVW

SEQ ID NO: 1743597 - protein, 19 aa, Staphylococcus epidermidis
LYQHYYYKLFAIATWILLI

SEQ ID NO: 1743598 - protein, 25 aa, Staphylococcus epidermidis
LYVKPELKHTIELYHDNEKQDRKEF

SEQ ID NO: 1743599 - protein, 18 aa, Staphylococcus epidermidis
LYWYIGIIVFYFIMAILT

SEQ ID NO: 1743600 - protein, 20 aa, Staphylococcus epidermidis
LYYDSARKFNDALWNDPKEV

SEQ ID NO: 1743601 - protein, 18 aa, Staphylococcus epidermidis
MAFAIPINDVRKIAQQLE

SEQ ID NO: 1743602 - protein, 19 aa, Staphylococcus epidermidis
MAFFSVMLDYFWNDPISWT

SEQ ID NO: 1743603 - protein, 19 aa, Staphylococcus epidermidis
MAFIPFVGMIIHWILFFLM

SEQ ID NO: 1743604 - protein, 20 aa, Staphylococcus epidermidis
MAFVTEFGFRSYLQNILETK

SEQ ID NO: 1743605 - protein, 17 aa, Staphylococcus epidermidis
MAGAIVLFGFNSPIKSI

SEQ ID NO: 1743606 - protein, 17 aa, Staphylococcus epidermidis
MAGRVFEHFNGLYRFQG

SEQ ID NO: 1743607 - protein, 21 aa, Staphylococcus epidermidis
MAIDRWPWLKWGPINMMNITS

SEQ ID NO: 1743608 - protein, 17 aa, Staphylococcus epidermidis
MALVFSIISGAGWAFGQ

SEQ ID NO: 1743609 - protein, 25 aa, Staphylococcus epidermidis
MANGKKYIVTQAVRPTGTGNVYTEY

SEQ ID NO: 1743610 - protein, 35 aa, Staphylococcus epidermidis
MAPSEAIHFCFTYRHALRLVSPDTLFAQFTTELIQ

SEQ ID NO: 1743611 - protein, 21 aa, Staphylococcus epidermidis
MATTEASSAAKLNVQPTDNSF

SEQ ID NO: 1743612 - protein, 20 aa, Staphylococcus epidermidis
MCFVHLPTAIIMVITAPFIP

SEQ ID NO: 1743613 - protein, 23 aa, Staphylococcus epidermidis
MDDARALLNGIARLKDAQAKAHN

SEQ ID NO: 1743614 - protein, 25 aa, Staphylococcus epidermidis
MDKYSTRHLYIFSMAIFLIGSIIAA

SEQ ID NO: 1743615 - protein, 24 aa, Staphylococcus epidermidis
MDSFIGGPFTDWVKLLMNDLHVLP

SEQ ID NO: 1743616 - protein, 18 aa, Staphylococcus epidermidis
MDVQRSFAVFTMASLITF

SEQ ID NO: 1743617 - protein, 25 aa, Staphylococcus epidermidis
MEGKETRFGIGLSALFTTITTAFTT

SEQ ID NO: 1743618 - protein, 30 aa, Staphylococcus epidermidis
MEKKHLRLIILIELLIQFIISAILSIVGGY

SEQ ID NO: 1743619 - protein, 23 aa, Staphylococcus epidermidis
MEKVWYWLVSLAMILAIAMSGHA

SEQ ID NO: 1743620 - protein, 20 aa, Staphylococcus epidermidis
MELNVPLIIGLNMVDVATQR

SEQ ID NO: 1743621 - protein, 26 aa, Staphylococcus epidermidis
MERRSAGSIWAWLLVLVILPIVGFIL

SEQ ID NO: 1743622 - protein, 27 aa, Staphylococcus epidermidis
MERRTANSIWAWLLVLVFLPLIGFILY

SEQ ID NO: 1743623 - protein, 19 aa, Staphylococcus epidermidis
MESRGIILRINRNTRTTKG

SEQ ID NO: 1743624 - protein, 23 aa, Staphylococcus epidermidis
MFFFQRVSGILAFVFIAMHLWQT

SEQ ID NO: 1743625 - protein, 20 aa, Staphylococcus epidermidis
MFFLLAFCMIVPWRCAMLYK

SEQ ID NO: 1743626 - protein, 21 aa, Staphylococcus epidermidis
MFFLLAFCMIVPWRLAMFYKY

SEQ ID NO: 1743627 - protein, 17 aa, Staphylococcus epidermidis
MFFNNLFFWCANQMIVQ

SEQ ID NO: 1743628 - protein, 19 aa, Staphylococcus epidermidis
MFGPMIAAILCVKVFKLEI

SEQ ID NO: 1743629 - protein, 18 aa, Staphylococcus epidermidis
MFLGLFGLYLRRKLEESP

SEQ ID NO: 1743630 - protein, 19 aa, Staphylococcus epidermidis
MFLGLFGLYLRRKLEESPI

SEQ ID NO: 1743631 - protein, 19 aa, Staphylococcus epidermidis
MFNSSFLVRAFHVVATAGM

SEQ ID NO: 1743632 - protein, 33 aa, Staphylococcus epidermidis
MFVHLFGIQIPHIFMNPWFQFVLATPVQFVIGW

SEQ ID NO: 1743633 - protein, 26 aa, Staphylococcus epidermidis
MGGAVGASFKWYDFVYFIDTIIYLII

SEQ ID NO: 1743634 - protein, 20 aa, Staphylococcus epidermidis
MGGLTFLISIIITSVIAIIF

SEQ ID NO: 1743635 - protein, 18 aa, Staphylococcus epidermidis
MGGPINKVAFLFGSALIA

SEQ ID NO: 1743636 - protein, 18 aa, Staphylococcus epidermidis
MGIPWKVGLTGVLFSGIF

SEQ ID NO: 1743637 - protein, 18 aa, Staphylococcus epidermidis
MGLALVVAFILGLLLLIP

SEQ ID NO: 1743638 - protein, 17 aa, Staphylococcus epidermidis
MGLSLIIVFILGLFLLI

SEQ ID NO: 1743639 - protein, 17 aa, Staphylococcus epidermidis
MGLSLVIVFVLGLLLLI

SEQ ID NO: 1743640 - protein, 17 aa, Staphylococcus epidermidis
MGMGFISAFLSSIMNNM

SEQ ID NO: 1743641 - protein, 21 aa, Staphylococcus epidermidis
MGPLVGWLMKKVDQFVQPRTP

SEQ ID NO: 1743642 - protein, 29 aa, Staphylococcus epidermidis
MGVIYKAQLYLAPYSPKGYIEKLGQNLSN

SEQ ID NO: 1743643 - protein, 21 aa, Staphylococcus epidermidis
MGWPPSGRVLVHWFSVSERGS

SEQ ID NO: 1743644 - protein, 24 aa, Staphylococcus epidermidis
MHIDLRLLFVYTIVSVFVTQTYFG

SEQ ID NO: 1743645 - protein, 17 aa, Staphylococcus epidermidis
MHPTFKNREKVIVSRIA

SEQ ID NO: 1743646 - protein, 19 aa, Staphylococcus epidermidis
MHVSSWIKGILVIVAVLLI

SEQ ID NO: 1743647 - protein, 34 aa, Staphylococcus epidermidis
MIAAILCVKVFKLEIKWPFWLSQTGLIFLGIQIG

SEQ ID NO: 1743648 - protein, 17 aa, Staphylococcus epidermidis
MIAARILLESGAEGTRV

SEQ ID NO: 1743649 - protein, 39 aa, Staphylococcus epidermidis
MIAVCGLSLVGIDFLAIMGFASAISVLFAVLAALTLLPA

SEQ ID NO: 1743650 - protein, 20 aa, Staphylococcus epidermidis
MIDASDLKKGHIVRVATGEQ

SEQ ID NO: 1743651 - protein, 21 aa, Staphylococcus epidermidis
MIENLLKLGRFSNIQVTVNNF

SEQ ID NO: 1743652 - protein, 17 aa, Staphylococcus epidermidis
MIGIIVIIFQFVNHSGP

SEQ ID NO: 1743653 - protein, 30 aa, Staphylococcus epidermidis
MIGVPFGSFLGGFANWRTVFGVMIGLAVIT

SEQ ID NO: 1743654 - protein, 19 aa, Staphylococcus epidermidis
MIHKAGVTLFKLVPQYMFI

SEQ ID NO: 1743655 - protein, 27 aa, Staphylococcus epidermidis
MIIFGLKLPLLIAFAVIFAGLSFGYIY

SEQ ID NO: 1743656 - protein, 24 aa, Staphylococcus epidermidis
MIIFSCLFLGTLIFTFFNDRFYNM

SEQ ID NO: 1743657 - protein, 25 aa, Staphylococcus epidermidis
MIIFSCLFLGTLIFTFFNDRFYNMP

SEQ ID NO: 1743658 - protein, 26 aa, Staphylococcus epidermidis
MIISCFGSLIGWQFTIAEVFRSSAVE

SEQ ID NO: 1743659 - protein, 17 aa, Staphylococcus epidermidis
MILEAIYFYPRFKISKL

SEQ ID NO: 1743660 - protein, 26 aa, Staphylococcus epidermidis
MILGICIGVGMILREFYIFRFVIGKQ

SEQ ID NO: 1743661 - protein, 26 aa, Staphylococcus epidermidis
MILGICIGVGMMLREFYIFRFVIGKQ

SEQ ID NO: 1743662 - protein, 17 aa, Staphylococcus epidermidis
MILVLCFAKQYGESINS

SEQ ID NO: 1743663 - protein, 21 aa, Staphylococcus epidermidis
MIMIIPTWINLLLKTYAFIGL

SEQ ID NO: 1743664 - protein, 27 aa, Staphylococcus epidermidis
MINQIMPVTMPFHLSIGNLLSVVVIFL

SEQ ID NO: 1743665 - protein, 18 aa, Staphylococcus epidermidis
MINWADDRFRYYVMKQGS

SEQ ID NO: 1743666 - protein, 24 aa, Staphylococcus epidermidis
MIPESIELGGWVILLGGIAIGLVL

SEQ ID NO: 1743667 - protein, 27 aa, Staphylococcus epidermidis
MISSYHIFRIFFILFVIAPLIGYFINI

SEQ ID NO: 1743668 - protein, 26 aa, Staphylococcus epidermidis
MISSYHIFRIFFILFVIAPLIGYFLK

SEQ ID NO: 1743669 - protein, 18 aa, Staphylococcus epidermidis
MIVAFNFNTFRIGFFGMD

SEQ ID NO: 1743670 - protein, 19 aa, Staphylococcus epidermidis
MIVPCLAIAVIVTIFMGRQ

SEQ ID NO: 1743671 - protein, 19 aa, Staphylococcus epidermidis
MKAKYRMQAEDLDLTMEFN

SEQ ID NO: 1743672 - protein, 18 aa, Staphylococcus epidermidis
MKAMRDSIMNQEQIRKNS

SEQ ID NO: 1743673 - protein, 25 aa, Staphylococcus epidermidis
MKDVELPLALPLIISGIRLSSVYVI

SEQ ID NO: 1743674 - protein, 17 aa, Staphylococcus epidermidis
MKEALIEAGGTRIRPIL

SEQ ID NO: 1743675 - protein, 17 aa, Staphylococcus epidermidis
MKELPLGYYQKRQTGKL

SEQ ID NO: 1743676 - protein, 17 aa, Staphylococcus epidermidis
MKFSHVMTPEMTDSLTT

SEQ ID NO: 1743677 - protein, 18 aa, Staphylococcus epidermidis
MKGVLGFHFDHPNRVALF

SEQ ID NO: 1743678 - protein, 19 aa, Staphylococcus epidermidis
MKHLLQWLGNDVFNNDYGL

SEQ ID NO: 1743679 - protein, 19 aa, Staphylococcus epidermidis
MKHRHLFNFSRGRHFLKNM

SEQ ID NO: 1743680 - protein, 25 aa, Staphylococcus epidermidis
MKILKSELLLAFSTSSSEAVLPVIM

SEQ ID NO: 1743681 - protein, 24 aa, Staphylococcus epidermidis
MKKSEFSPQLVFYMGGGMIIGSML

SEQ ID NO: 1743682 - protein, 19 aa, Staphylococcus epidermidis
MKLYATLRGMFKIEDQSLI

SEQ ID NO: 1743683 - protein, 22 aa, Staphylococcus epidermidis
MKMFFIGGVFSLISTIILYNFV

SEQ ID NO: 1743684 - protein, 27 aa, Staphylococcus epidermidis
MKMRVVRKRIAVFGGILLAAILILIVL

SEQ ID NO: 1743685 - protein, 26 aa, Staphylococcus epidermidis
MKTGHSAWRYFMLIFYLVPYVLFGGL

SEQ ID NO: 1743686 - protein, 24 aa, Staphylococcus epidermidis
MKVTREGLALGVYIILTGSRSNAI

SEQ ID NO: 1743687 - protein, 24 aa, Staphylococcus epidermidis
MLIFRRKFTKEQRGSIVPNYVMGL

SEQ ID NO: 1743688 - protein, 27 aa, Staphylococcus epidermidis
MLISIILAYIFKWLGLVDDVLLMVIII

SEQ ID NO: 1743689 - protein, 20 aa, Staphylococcus epidermidis
MLLNTIKAISAFSFFIYLLH

SEQ ID NO: 1743690 - protein, 21 aa, Staphylococcus epidermidis
MLLPFLCALILVFTKNKNQTS

SEQ ID NO: 1743691 - protein, 22 aa, Staphylococcus epidermidis
MLLPFVCALILVFAKNKNQISK

SEQ ID NO: 1743692 - protein, 24 aa, Staphylococcus epidermidis
MLLTKITSFIPFLAPFELLVRSQS

SEQ ID NO: 1743693 - protein, 17 aa, Staphylococcus epidermidis
MLNKTGKDYDLQEQRGY

SEQ ID NO: 1743694 - protein, 17 aa, Staphylococcus epidermidis
MLTAFLFIDKVFVNIIY

SEQ ID NO: 1743695 - protein, 17 aa, Staphylococcus epidermidis
MLVITIILIIFFKRKKW

SEQ ID NO: 1743696 - protein, 27 aa, Staphylococcus epidermidis
MMATNLGWRSIFIVSIVLTILAMFLIK

SEQ ID NO: 1743697 - protein, 22 aa, Staphylococcus epidermidis
MMPVVAMYSLWLTKKYKKNVSY

SEQ ID NO: 1743698 - protein, 19 aa, Staphylococcus epidermidis
MMTLVALGISVAYIYSLYA

SEQ ID NO: 1743699 - protein, 24 aa, Staphylococcus epidermidis
MNEDYKNLLSLKDIYKNKGIDVLN

SEQ ID NO: 1743700 - protein, 30 aa, Staphylococcus epidermidis
MNLLIKFHPTRFAFLMALVVLIAWILYYFV

SEQ ID NO: 1743701 - protein, 25 aa, Staphylococcus epidermidis
MNRSEISIAVGIVFFLITSLLSSIL

SEQ ID NO: 1743702 - protein, 19 aa, Staphylococcus epidermidis
MNSDKIWLKLFSYITPYFY

SEQ ID NO: 1743703 - protein, 23 aa, Staphylococcus epidermidis
MNTVELSRIIGIIVDNAIEASEN

SEQ ID NO: 1743704 - protein, 17 aa, Staphylococcus epidermidis
MNYIVPTLIITFGTLIL

SEQ ID NO: 1743705 - protein, 20 aa, Staphylococcus epidermidis
MPASVIGLVLLFIALCTGIV

SEQ ID NO: 1743706 - protein, 31 aa, Staphylococcus epidermidis
MPNIGAFIAWGFIAAIFIKNGWFPNKDLAQL

SEQ ID NO: 1743707 - protein, 21 aa, Staphylococcus epidermidis
MPWELSVIYSPFRLILLMVIA

SEQ ID NO: 1743708 - protein, 20 aa, Staphylococcus epidermidis
MRKIKELFVAHKVEQQYNKN

SEQ ID NO: 1743709 - protein, 24 aa, Staphylococcus epidermidis
MRKMKSAIESLAISLGDALAPMLY

SEQ ID NO: 1743710 - protein, 17 aa, Staphylococcus epidermidis
MRLDGLSLMFGLIISLI

SEQ ID NO: 1743711 - protein, 17 aa, Staphylococcus epidermidis
MRTAQDYFPTVKKDVAQ

SEQ ID NO: 1743712 - protein, 26 aa, Staphylococcus epidermidis
MRTILTLKGYRYVAAVVSFMEVLVYV

SEQ ID NO: 1743713 - protein, 19 aa, Staphylococcus epidermidis
MRVYIKIPLLLGLITLPIY

SEQ ID NO: 1743714 - protein, 19 aa, Staphylococcus epidermidis
MRVYIKIPLLLGLITLPVY

SEQ ID NO: 1743715 - protein, 18 aa, Staphylococcus epidermidis
MRYMPGLDGLRAIAVIGI

SEQ ID NO: 1743716 - protein, 26 aa, Staphylococcus epidermidis
MSCSARLPVYALFVGVFFKAYQSLVV

SEQ ID NO: 1743717 - protein, 29 aa, Staphylococcus epidermidis
MSGKTYLKHFLWFNGLTGVFAFILLLTQQ

SEQ ID NO: 1743718 - protein, 18 aa, Staphylococcus epidermidis
MSISRFAYTPILPFMQQD

SEQ ID NO: 1743719 - protein, 18 aa, Staphylococcus epidermidis
MSLLGEKIFWPSKKSTSH

SEQ ID NO: 1743720 - protein, 25 aa, Staphylococcus epidermidis
MSNIHIWKPAIDFFSILSKANMPLS

SEQ ID NO: 1743721 - protein, 24 aa, Staphylococcus epidermidis
MSPLMWINFGCIWVLEHSLHLNPH

SEQ ID NO: 1743722 - protein, 20 aa, Staphylococcus epidermidis
MSPTILVLLMYLIAMMTAYV

SEQ ID NO: 1743723 - protein, 20 aa, Staphylococcus epidermidis
MSRNLLWFYLIVLICVMVAS

SEQ ID NO: 1743724 - protein, 23 aa, Staphylococcus epidermidis
MSVGMCAYYIRLIRSNLLEQYRS

SEQ ID NO: 1743725 - protein, 21 aa, Staphylococcus epidermidis
MSVSIAGPIGFVGLIVPHIVK

SEQ ID NO: 1743726 - protein, 24 aa, Staphylococcus epidermidis
MSYDHPWEIWLAVLTNIAMALPAL

SEQ ID NO: 1743727 - protein, 23 aa, Staphylococcus epidermidis
MSYNHTWSILGYVLNGFVFSILG

SEQ ID NO: 1743728 - protein, 19 aa, Staphylococcus epidermidis
MTAFLLVLIYRTYRVTKED

SEQ ID NO: 1743729 - protein, 21 aa, Staphylococcus epidermidis
MTARPVISFIHDLKLSKFYKR

SEQ ID NO: 1743730 - protein, 18 aa, Staphylococcus epidermidis
MTGLGMGISEYAGKAARE

SEQ ID NO: 1743731 - protein, 18 aa, Staphylococcus epidermidis
MTHAHGYGQGYGQGSASE

SEQ ID NO: 1743732 - protein, 18 aa, Staphylococcus epidermidis
MTIKSSAVSIVIMNILVS

SEQ ID NO: 1743733 - protein, 22 aa, Staphylococcus epidermidis
MTKNKMSAFVLPNFKELFKNTI

SEQ ID NO: 1743734 - protein, 24 aa, Staphylococcus epidermidis
MTMLIRRLGSILGIKMIMKQMVSS

SEQ ID NO: 1743735 - protein, 23 aa, Staphylococcus epidermidis
MTPPYIGSMGWMLTMQRNGLLDQ

SEQ ID NO: 1743736 - protein, 18 aa, Staphylococcus epidermidis
MTQGWWFPVMASVFLIFT

SEQ ID NO: 1743737 - protein, 32 aa, Staphylococcus epidermidis; identical to SEQ ID NO: 1584130

SEQ ID NO: 1743738 - protein, 18 aa, Staphylococcus epidermidis
MTTLFIISILAILAILFL

SEQ ID NO: 1743739 - protein, 19 aa, Staphylococcus epidermidis
MVCVGLFYHHLPMLLNTFL

SEQ ID NO: 1743740 - protein, 22 aa, Staphylococcus epidermidis
MVKYPVIMIPIFLTAAISGIAS

SEQ ID NO: 1743741 - protein, 22 aa, Staphylococcus epidermidis
MVQNLWWGAGYNIVAVPLAAGV

SEQ ID NO: 1743742 - protein, 24 aa, Staphylococcus epidermidis
MVSASILLPFGFLIGYYIGIHPLS

SEQ ID NO: 1743743 - protein, 23 aa, Staphylococcus epidermidis
MVSSIIMFIKLVFMIDYVLFHLI

SEQ ID NO: 1743744 - protein, 17 aa, Staphylococcus epidermidis
MWLIFQTTFTWIGTPLS

SEQ ID NO: 1743745 - protein, 30 aa, Staphylococcus epidermidis
MYANHLFIKRRTKEFALFQLIGLTRGNILR

SEQ ID NO: 1743746 - protein, 29 aa, Staphylococcus epidermidis
MYANHLFIKRRTKEFALYQLIGLTRRNIL

SEQ ID NO: 1743747 - protein, 18 aa, Staphylococcus epidermidis
MYFCPTLIGFFFIVGQRF

SEQ ID NO: 1743748 - protein, 19 aa, Staphylococcus epidermidis
MYLGLRIFLIVQIIIIIIS

SEQ ID NO: 1743749 - protein, 23 aa, Staphylococcus epidermidis
MYLLEQHTSYFLDAELTELRDNY

SEQ ID NO: 1743750 - protein, 23 aa, Staphylococcus epidermidis
MYLYEHFTSLKGFYDASFGLGGD

SEQ ID NO: 1743751 - protein, 19 aa, Staphylococcus epidermidis
NAACAGFTYGLQLATSLIS

SEQ ID NO: 1743752 - protein, 27 aa, Staphylococcus epidermidis
NAARSGRPIQFLVGFDVEDSHHNPETL

SEQ ID NO: 1743753 - protein, 22 aa, Staphylococcus epidermidis
NACPEFFAKTSFAQALISFAER

SEQ ID NO: 1743754 - protein, 21 aa, Staphylococcus epidermidis
NADRILKEQNPSVANVNNALN

SEQ ID NO: 1743755 - protein, 24 aa, Staphylococcus epidermidis
NAEELVHLSIHFKKRTTSYEIDNI

SEQ ID NO: 1743756 - protein, 24 aa, Staphylococcus epidermidis
NAELRTGPNAAYPVIYKIDKGESF

SEQ ID NO: 1743757 - protein, 23 aa, Staphylococcus epidermidis
NAELRTGPNAAYPVIYKIEKGDS

SEQ ID NO: 1743758 - protein, 22 aa, Staphylococcus epidermidis
NAESFIAFIGLVWAMIKFLPLI

SEQ ID NO: 1743759 - protein, 24 aa, Staphylococcus epidermidis
NAFNVKIGWLILRVLAVIFVWLTY

SEQ ID NO: 1743760 - protein, 23 aa, Staphylococcus epidermidis
NAFVPSVVGLICASYVINDILKD

SEQ ID NO: 1743761 - protein, 22 aa, Staphylococcus epidermidis
NAHSLLSWVVTLFFIALSFYLV

SEQ ID NO: 1743762 - protein, 18 aa, Staphylococcus epidermidis
NAIELLRITQFPNAIYER

SEQ ID NO: 1743763 - protein, 18 aa, Staphylococcus epidermidis
NAKNDIEGKAADRKIKIQ

SEQ ID NO: 1743764 - protein, 20 aa, Staphylococcus epidermidis
NAKRELRKILNRFKEEGRLR

SEQ ID NO: 1743765 - protein, 17 aa, Staphylococcus epidermidis
NAKRQKAEQAIQKANKV

SEQ ID NO: 1743766 - protein, 22 aa, Staphylococcus epidermidis
NALELRFILDWNSQSTRDNIRY

SEQ ID NO: 1743767 - protein, 31 aa, Staphylococcus epidermidis
NALSFHFANLLARFGIILGVFLNSVGMTIYM

SEQ ID NO: 1743768 - protein, 21 aa, Staphylococcus epidermidis
NAPHPFVRMKAVEPEEDESSK

SEQ ID NO: 1743769 - protein, 31 aa, Staphylococcus epidermidis
NAQKAAIINQIRASKDIKIINQIVDNAIELN

SEQ ID NO: 1743770 - protein, 22 aa, Staphylococcus epidermidis
NAQPVLDKSAIERLTQTVNTTK

SEQ ID NO: 1743771 - protein, 24 aa, Staphylococcus epidermidis
NASKEYLKDLGLPKTILDSSKITG

SEQ ID NO: 1743772 - protein, 28 aa, Staphylococcus epidermidis
NATNLKLRRIVPLGIIFFILILIVILFF

SEQ ID NO: 1743773 - protein, 25 aa, Staphylococcus epidermidis
NAVIQKPIRTVQEVNNALKQVNQLN

SEQ ID NO: 1743774 - protein, 18 aa, Staphylococcus epidermidis
NAVKMLIIDFMFLIIGGM

SEQ ID NO: 1743775 - protein, 17 aa, Staphylococcus epidermidis
NDFKLKPGDIVITKGPV

SEQ ID NO: 1743776 - protein, 18 aa, Staphylococcus epidermidis
NDFPELFTDTLVNSITAN

SEQ ID NO: 1743777 - protein, 18 aa, Staphylococcus epidermidis
NDFPELFTDTLVNSLVAN

SEQ ID NO: 1743778 - protein, 24 aa, Staphylococcus epidermidis
NDFYSRLTGILGFLVQISPITIVI

SEQ ID NO: 1743779 - protein, 19 aa, Staphylococcus epidermidis
NDHGGFNGIEKEFTVNPNS

SEQ ID NO: 1743780 - protein, 21 aa, Staphylococcus epidermidis
NDIAKYFAILPAMFMAAMPAM

SEQ ID NO: 1743781 - protein, 20 aa, Staphylococcus epidermidis
NDIIQLIVFRGLQGIGAAML

SEQ ID NO: 1743782 - protein, 21 aa, Staphylococcus epidermidis
NDIVLGLIFLVGSFFFFSDQT

SEQ ID NO: 1743783 - protein, 17 aa, Staphylococcus epidermidis
NDLSTTQFVIWLQNGVW

SEQ ID NO: 1743784 - protein, 17 aa, Staphylococcus epidermidis
NDSYWKEFKVEGTRATT

SEQ ID NO: 1743785 - protein, 24 aa, Staphylococcus epidermidis
NDTFARATINLSVENKGHNQSKDT

SEQ ID NO: 1743786 - protein, 17 aa, Staphylococcus epidermidis
NDTRAAIFISPIWFIFL

SEQ ID NO: 1743787 - protein, 19 aa, Staphylococcus epidermidis
NEAIQRLTAKKEEIKNQIS

SEQ ID NO: 1743788 - protein, 23 aa, Staphylococcus epidermidis
NEENRYLVMPALSDELKIVGLKT

SEQ ID NO: 1743789 - protein, 19 aa, Staphylococcus epidermidis
NEFIEFPIVAANPEDEGTF

SEQ ID NO: 1743790 - protein, 20 aa, Staphylococcus epidermidis
NEIAKVLPATSVKSKAKKDI

SEQ ID NO: 1743791 - protein, 24 aa, Staphylococcus epidermidis
NELTYTVTLPENFEYVENSTEASF

SEQ ID NO: 1743792 - protein, 18 aa, Staphylococcus epidermidis
NESVPRGRILDRNGKVLV

SEQ ID NO: 1743793 - protein, 20 aa, Staphylococcus epidermidis
NETETTFTIDVEDTTKPTVE

SEQ ID NO: 1743794 - protein, 34 aa, Staphylococcus epidermidis
NETLNKWCFWLFMIGFNVCFLPQFILGLDGMPRR

SEQ ID NO: 1743795 - protein, 21 aa, Staphylococcus epidermidis
NEVVKKDFIVDYGNKKDNTTT

SEQ ID NO: 1743796 - protein, 28 aa, Staphylococcus epidermidis
NEYLVHLTFVPLLFLGRYTNMIYTLASA

SEQ ID NO: 1743797 - protein, 24 aa, Staphylococcus epidermidis
NEYRIPRTLLGILIGSSLAISGSV

SEQ ID NO: 1743798 - protein, 25 aa, Staphylococcus epidermidis
NEYRIPRTLLGLVIGSSLAISGAVI

SEQ ID NO: 1743799 - protein, 26 aa, Staphylococcus epidermidis
NFGRVRLTMIGLWLNIIGSLLIIITD

SEQ ID NO: 1743800 - protein, 28 aa, Staphylococcus epidermidis
NFIFLIGIFCFLKGFIGFFIGGDSNYLY

SEQ ID NO: 1743801 - protein, 17 aa, Staphylococcus epidermidis
NFIKRLVGKPGDQIEYK

SEQ ID NO: 1743802 - protein, 18 aa, Staphylococcus epidermidis
NFIKRSVLNTVLKKIRGT

SEQ ID NO: 1743803 - protein, 20 aa, Staphylococcus epidermidis
NFMYLTVGWYYRAISVSKMI

SEQ ID NO: 1743804 - protein, 34 aa, Staphylococcus epidermidis
NFTYVRKRKFQIFKWLAIGASILGLLLIAFLVYL

SEQ ID NO: 1743805 - protein, 18 aa, Staphylococcus epidermidis
NGGIKRIKEVVGEDGTTR

SEQ ID NO: 1743806 - protein, 19 aa, Staphylococcus epidermidis
NGHFLKRAFQHTRWNAYSF

SEQ ID NO: 1743807 - protein, 26 aa, Staphylococcus epidermidis
NGHGGFLNEDFRLFSTDNKNGKLTYQ

SEQ ID NO: 1743808 - protein, 18 aa, Staphylococcus epidermidis
NGIICGIVAYVLNIKGTP

SEQ ID NO: 1743809 - protein, 17 aa, Staphylococcus epidermidis
NGIISLFLLTAGFITLY

SEQ ID NO: 1743810 - protein, 23 aa, Staphylococcus epidermidis
NGISKWVILYGRRKFAAMILTGM

SEQ ID NO: 1743811 - protein, 24 aa, Staphylococcus epidermidis
NGISKWVILYGRRKFAAMILTGMV

SEQ ID NO: 1743812 - protein, 24 aa, Staphylococcus epidermidis
NGKKTWFKFFIGVLLISLLASIIN

SEQ ID NO: 1743813 - protein, 27 aa, Staphylococcus epidermidis
NGKMEELKAAVAKAPLVRQNSNYINED

SEQ ID NO: 1743814 - protein, 24 aa, Staphylococcus epidermidis
NGKNYRIGKPTSFESASEEYTQFN

SEQ ID NO: 1743815 - protein, 17 aa, Staphylococcus epidermidis
NGLGIYIGRFLRLHTVY

SEQ ID NO: 1743816 - protein, 18 aa, Staphylococcus epidermidis
NGNAPYGVILGRTTDGWN

SEQ ID NO: 1743817 - protein, 24 aa, Staphylococcus epidermidis
NGNKKTWIIISIVAVIIIALIALF

SEQ ID NO: 1743818 - protein, 18 aa, Staphylococcus epidermidis
NGQNWSAPINGSTVNSGL

SEQ ID NO: 1743819 - protein, 25 aa, Staphylococcus epidermidis
NGSYDVLMKAFQIDAPVNPGNSGGA

SEQ ID NO: 1743820 - protein, 45 aa, Staphylococcus epidermidis
NHDGKKKGGLMKILLPLIAAVLILGAIAIFGGMALNNHNDSKNDD

SEQ ID NO: 1743821 - protein, 22 aa, Staphylococcus epidermidis
NHKEANGWFVGYVETKDNTYYF

SEQ ID NO: 1743822 - protein, 23 aa, Staphylococcus epidermidis
NHLIGAIAYILGMVLFTMLMGNA

SEQ ID NO: 1743823 - protein, 23 aa, Staphylococcus epidermidis
NHRRRALSYWSIGSWGGSGFASL

SEQ ID NO: 1743824 - protein, 28 aa, Staphylococcus epidermidis
NHSIINLRLFKSISFSSSIFAIFVFGGT

SEQ ID NO: 1743825 - protein, 21 aa, Staphylococcus epidermidis
NHSSKKWYRPLGYDAEDINLN

SEQ ID NO: 1743826 - protein, 29 aa, Staphylococcus epidermidis
NHVLKTGHSPWRYLIVMFYFVPYILFSLL

SEQ ID NO: 1743827 - protein, 27 aa, Staphylococcus epidermidis
NIAKFKILPSLKRKGISTIDYLILTHP

SEQ ID NO: 1743828 - protein, 17 aa, Staphylococcus epidermidis
NIAVAFGALIGGLMYGA

SEQ ID NO: 1743829 - protein, 22 aa, Staphylococcus epidermidis
NIFFVLCLISLFVTVITIIFNR

SEQ ID NO: 1743830 - protein, 19 aa, Staphylococcus epidermidis
NIGCSMMDILYLKILLFSN

SEQ ID NO: 1743831 - protein, 18 aa, Staphylococcus epidermidis
NIGFLSQRPYIFADSIKN

SEQ ID NO: 1743832 - protein, 18 aa, Staphylococcus epidermidis
NIIGGFILFFLMKFSHVM

SEQ ID NO: 1743833 - protein, 19 aa, Staphylococcus epidermidis
NIIGSMVIVVWGSSIWSQI

SEQ ID NO: 1743834 - protein, 42 aa, Staphylococcus epidermidis
NIIKANITFAIAIKFIALLLVIPGWLTLWIAILSDMGATLLV

SEQ ID NO: 1743835 - protein, 19 aa, Staphylococcus epidermidis
NIILPTLVTILAIDIGVNV

SEQ ID NO: 1743836 - protein, 23 aa, Staphylococcus epidermidis
NIIPELIGVLLLTHATYTALLLV

SEQ ID NO: 1743837 - protein, 23 aa, Staphylococcus epidermidis
NIIPELIGVLLLTHATYTTLLLV

SEQ ID NO: 1743838 - protein, 22 aa, Staphylococcus epidermidis
NIKDIKMWVLGLVGTIAGSLIV

SEQ ID NO: 1743839 - protein, 20 aa, Staphylococcus epidermidis
NIKERVKYIALYDSMPKPNR

SEQ ID NO: 1743840 - protein, 22 aa, Staphylococcus epidermidis
NILGSWLLLLGIGMLYKTVGTL

SEQ ID NO: 1743841 - protein, 33 aa, Staphylococcus epidermidis
NIMIKGEGFNNIWFDLSILLVFIIGFTVLNIIG

SEQ ID NO: 1743842 - protein, 19 aa, Staphylococcus epidermidis
NIMKALRDSIADNIDVLQS

SEQ ID NO: 1743843 - protein, 22 aa, Staphylococcus epidermidis
NINNIRPIVVKKPTANNEIDAK

SEQ ID NO: 1743844 - protein, 26 aa, Staphylococcus epidermidis
NINQFIWNKNGFFKSQNNIEHRMNSS

SEQ ID NO: 1743845 - protein, 27 aa, Staphylococcus epidermidis
NINYAHSIPFYKGGYFVFIYKNKSHTS

SEQ ID NO: 1743846 - protein, 23 aa, Staphylococcus epidermidis
NIPSHLNLALTVFGFIMLISIIL

SEQ ID NO: 1743847 - protein, 18 aa, Staphylococcus epidermidis
NIPYHIYFIFLLAIMCVI

SEQ ID NO: 1743848 - protein, 17 aa, Staphylococcus epidermidis
NISESYCSNLFARYLNM

SEQ ID NO: 1743849 - protein, 31 aa, Staphylococcus epidermidis
NITYVMVGLIISLGSSILLLKVASKHYKNRK

SEQ ID NO: 1743850 - protein, 23 aa, Staphylococcus epidermidis
NIVPELIGVLLLTHATYTTILLI

SEQ ID NO: 1743851 - protein, 26 aa, Staphylococcus epidermidis
NIWLDCVTIIIALSIMFFLDVKLTIA

SEQ ID NO: 1743852 - protein, 17 aa, Staphylococcus epidermidis
NKCILKMERDEADSTED

SEQ ID NO: 1743853 - protein, 19 aa, Staphylococcus epidermidis
NKDYLLYWVELGQGHLDEA

SEQ ID NO: 1743854 - protein, 24 aa, Staphylococcus epidermidis
NKEIIPSNYTWASYTKYNKLKETA

SEQ ID NO: 1743855 - protein, 23 aa, Staphylococcus epidermidis
NKEVIKLSVSIGVGYLTQDDRKS

SEQ ID NO: 1743856 - protein, 19 aa, Staphylococcus epidermidis
NKFNKFYLSVAFITFANGG

SEQ ID NO: 1743857 - protein, 28 aa, Staphylococcus epidermidis
NKFWNKWIACLFVAFSVFTSYTAYCNSN

SEQ ID NO: 1743858 - protein, 19 aa, Staphylococcus epidermidis
NKHQCTWWAYKRRVQLGKP

SEQ ID NO: 1743859 - protein, 26 aa, Staphylococcus epidermidis
NKIKTSRFLLGLTIPSVLSLITLILQ

SEQ ID NO: 1743860 - protein, 18 aa, Staphylococcus epidermidis
NKILLDAKKQIGLAHTNN

SEQ ID NO: 1743861 - protein, 17 aa, Staphylococcus epidermidis
NKITNLRPVVAKKQSAI

SEQ ID NO: 1743862 - protein, 21 aa, Staphylococcus epidermidis
NKKEALWSINENINGISLDSI

SEQ ID NO: 1743863 - protein, 17 aa, Staphylococcus epidermidis
NKKEAVITIARGQNYTI

SEQ ID NO: 1743864 - protein, 17 aa, Staphylococcus epidermidis
NKKKIKVTLAMVNVLLT

SEQ ID NO: 1743865 - protein, 27 aa, Staphylococcus epidermidis
NKKLFKKLNILLGKSYSLKELDYLVNL

SEQ ID NO: 1743866 - protein, 18 aa, Staphylococcus epidermidis
NKKMVKFMLVFETENMSV

SEQ ID NO: 1743867 - protein, 19 aa, Staphylococcus epidermidis
NKKMVKFMLVFETENMSVN

SEQ ID NO: 1743868 - protein, 20 aa, Staphylococcus epidermidis
NKLKVAYKIYHHQYNTPDFD

SEQ ID NO: 1743869 - protein, 24 aa, Staphylococcus epidermidis
NKPIKFSNQYLKDFLFKEKTTSSG

SEQ ID NO: 1743870 - protein, 25 aa, Staphylococcus epidermidis
NKQVKLKLWQLILLLLAVIILTAGI

SEQ ID NO: 1743871 - protein, 30 aa, Staphylococcus epidermidis
NKSPYKRWTVWKIAIVGGILTFPQMAVLTF

SEQ ID NO: 1743872 - protein, 19 aa, Staphylococcus epidermidis
NKSQKWYLIIILNTINIIQ

SEQ ID NO: 1743873 - protein, 24 aa, Staphylococcus epidermidis
NKSSKKWYLPFGYDAEDINLNNIS

SEQ ID NO: 1743874 - protein, 27 aa, Staphylococcus epidermidis
NKTGKDYDLQEQRGYTDSEQHNETQSN

SEQ ID NO: 1743875 - protein, 31 aa, Staphylococcus epidermidis
NKTIDSGFYKPIYNLGDYVWEDTNKDGIQDD

SEQ ID NO: 1743876 - protein, 17 aa, Staphylococcus epidermidis
NKVCHVQGITALNVNDL

SEQ ID NO: 1743877 - protein, 23 aa, Staphylococcus epidermidis
NKYELKAIIAPGMISIMSFFTTL

SEQ ID NO: 1743878 - protein, 25 aa, Staphylococcus epidermidis
NKYLGIPIFLGIMWLIFQTTFTWIG

SEQ ID NO: 1743879 - protein, 18 aa, Staphylococcus epidermidis
NLAIGVVVGVVFSAIFFA

SEQ ID NO: 1743880 - protein, 25 aa, Staphylococcus epidermidis
NLAIKHPLFEYARSFDFIIITEVGL

SEQ ID NO: 1743881 - protein, 24 aa, Staphylococcus epidermidis
NLANDIHPWIGLVLTFIMLAVMYN

SEQ ID NO: 1743882 - protein, 19 aa, Staphylococcus epidermidis
NLDLFRGTTILGIVSLFSW

SEQ ID NO: 1743883 - protein, 28 aa, Staphylococcus epidermidis
NLDNTITRFSIRKYQGFGAASVAVAAFF

SEQ ID NO: 1743884 - protein, 27 aa, Staphylococcus epidermidis
NLDSKSGWRKTLFEIAGKDRITLEDVF

SEQ ID NO: 1743885 - protein, 18 aa, Staphylococcus epidermidis
NLEINLFGIESWGQQGKI

SEQ ID NO: 1743886 - protein, 26 aa, Staphylococcus epidermidis
NLFRKAIVTSCFFTIVAFILFLVLGN

SEQ ID NO: 1743887 - protein, 17 aa, Staphylococcus epidermidis
NLFSLLASILVLWFYFR

SEQ ID NO: 1743888 - protein, 19 aa, Staphylococcus epidermidis
NLIFAFIIIFMERRSAGSI

SEQ ID NO: 1743889 - protein, 26 aa, Staphylococcus epidermidis
NLIIVGLFVICMFVSISMGTSVGTVA

SEQ ID NO: 1743890 - protein, 18 aa, Staphylococcus epidermidis
NLKCFKNDLIKFIEQGEK

SEQ ID NO: 1743891 - protein, 21 aa, Staphylococcus epidermidis
NLLAIVIKWLSFIPITLFTAL

SEQ ID NO: 1743892 - protein, 30 aa, Staphylococcus epidermidis
NLLGARLFGELEFWFSIIKVVTIVAMVIVG

SEQ ID NO: 1743893 - protein, 17 aa, Staphylococcus epidermidis
NLLGGAMSHWVGLENVF

SEQ ID NO: 1743894 - protein, 25 aa, Staphylococcus epidermidis
NLLLLPRLGAALTVVITVTGQIIMG

SEQ ID NO: 1743895 - protein, 25 aa, Staphylococcus epidermidis
NLLLLPRLGAALTVVMTVTGQILMG

SEQ ID NO: 1743896 - protein, 18 aa, Staphylococcus epidermidis
NLLMFCPLLPIVTLPIMF

SEQ ID NO: 1743897 - protein, 18 aa, Staphylococcus epidermidis
NLLMHGFIALIMVGVTIY

SEQ ID NO: 1743898 - protein, 25 aa, Staphylococcus epidermidis
NLMIPCKPDHPFVYWATLKNAASLL

SEQ ID NO: 1743899 - protein, 18 aa, Staphylococcus epidermidis
NLNHFKWYIPKLNQYSLL

SEQ ID NO: 1743900 - protein, 24 aa, Staphylococcus epidermidis
NLSHLEYWLIISIIVETIVVSILL

SEQ ID NO: 1743901 - protein, 26 aa, Staphylococcus epidermidis
NLSMKMMPIAFTLMAVIIAILGFSIM

SEQ ID NO: 1743902 - protein, 17 aa, Staphylococcus epidermidis
NLTSYAYPSSKEVMTIG

SEQ ID NO: 1743903 - protein, 25 aa, Staphylococcus epidermidis
NMGRVIRQNIIFSMAVVAFLVVVSL

SEQ ID NO: 1743904 - protein, 20 aa, Staphylococcus epidermidis
NMIGCLPVIIQIPILMGLYM

SEQ ID NO: 1743905 - protein, 23 aa, Staphylococcus epidermidis
NMLIQRLKAGKVYKKERLDTAFS

SEQ ID NO: 1743906 - protein, 24 aa, Staphylococcus epidermidis
NMLNQRIGDHMAYKVKTDLRRQVI

SEQ ID NO: 1743907 - protein, 17 aa, Staphylococcus epidermidis
NMLPLVIAGGILMAIVF

SEQ ID NO: 1743908 - protein, 17 aa, Staphylococcus epidermidis
NMSSLNAGIGFGGIVGG

SEQ ID NO: 1743909 - protein, 23 aa, Staphylococcus epidermidis
NMVKYPVIMVPIFITAALSGIAS

SEQ ID NO: 1743910 - protein, 17 aa, Staphylococcus epidermidis
NNAHLWDDSAVDAIDTM

SEQ ID NO: 1743911 - protein, 23 aa, Staphylococcus epidermidis
NNAISEINKLTALNDAQRQKAIE

SEQ ID NO: 1743912 - protein, 24 aa, Staphylococcus epidermidis
NNAVTRTEVAAIIGQAKLLNHAME

SEQ ID NO: 1743913 - protein, 25 aa, Staphylococcus epidermidis
NNDALKAARLELENKINQTVQTDGM

SEQ ID NO: 1743914 - protein, 26 aa, Staphylococcus epidermidis
NNFLKLTISLVILWIGSYLVMTDHMT

SEQ ID NO: 1743915 - protein, 17 aa, Staphylococcus epidermidis
NNGKVVIPRGVITYLKN

SEQ ID NO: 1743916 - protein, 18 aa, Staphylococcus epidermidis
NNHHFGFYIAFAISALIF

SEQ ID NO: 1743917 - protein, 26 aa, Staphylococcus epidermidis
NNINQFIWNKNGFFKSQNNTEHRLNS

SEQ ID NO: 1743918 - protein, 25 aa, Staphylococcus epidermidis
NNKEHAFNTLAHIVIWDTDQQPLVF

SEQ ID NO: 1743919 - protein, 18 aa, Staphylococcus epidermidis
NNMSGISKFISAIVVLLL

SEQ ID NO: 1743920 - protein, 25 aa, Staphylococcus epidermidis
NNSDLPTLFALLAFTISSIPGILKK

SEQ ID NO: 1743921 - protein, 17 aa, Staphylococcus epidermidis
NNVKAHMSVKISQLGSE

SEQ ID NO: 1743922 - protein, 19 aa, Staphylococcus epidermidis
NNVKAHMSVKISQLGSEFD

SEQ ID NO: 1743923 - protein, 19 aa, Staphylococcus epidermidis
NNVPFRILIFYIGSLAVIM

SEQ ID NO: 1743924 - protein, 18 aa, Staphylococcus epidermidis
NPEMGLSLIIVFILGLFL

SEQ ID NO: 1743925 - protein, 19 aa, Staphylococcus epidermidis
NPGPGLGILLAYMIFGKGT

SEQ ID NO: 1743926 - protein, 24 aa, Staphylococcus epidermidis
NPPFFFSVLLPIVFISALIGILQY

SEQ ID NO: 1743927 - protein, 27 aa, Staphylococcus epidermidis
NQEDFLKDKTMHLQLVFGQADKDDENK

SEQ ID NO: 1743928 - protein, 17 aa, Staphylococcus epidermidis
NQFDLSFQRLFIQGYIQ

SEQ ID NO: 1743929 - protein, 26 aa, Staphylococcus epidermidis
NQGQLFKSGMRVGREILATSANTIYL

SEQ ID NO: 1743930 - protein, 25 aa, Staphylococcus epidermidis
NQLKEGQSFCNKCGTHIKQSNQNHS

SEQ ID NO: 1743931 - protein, 19 aa, Staphylococcus epidermidis
NQLNIAMQALRNSVNDVNN

SEQ ID NO: 1743932 - protein, 21 aa, Staphylococcus epidermidis
NQMIKELFDYVDVDNEEDYYT

SEQ ID NO: 1743933 - protein, 28 aa, Staphylococcus epidermidis
NQSAQLGATVKPGSAPTQDTEVKPNPDQ

SEQ ID NO: 1743934 - protein, 36 aa, Staphylococcus epidermidis
NQSASYLIKKWALDRIKQIQLETMNSIRDAHTVQDV

SEQ ID NO: 1743935 - protein, 26 aa, Staphylococcus epidermidis
NQSGQLGATVKPGSATNQDTEVKPNP

SEQ ID NO: 1743936 - protein, 19 aa, Staphylococcus epidermidis
NQTGIFYNTFVKPMDGLLH

SEQ ID NO: 1743937 - protein, 22 aa, Staphylococcus epidermidis
NQTRISSFYGVIIYIIILFLFI

SEQ ID NO: 1743938 - protein, 21 aa, Staphylococcus epidermidis
NRALMNLGWETVFNPEPFNPI

SEQ ID NO: 1743939 - protein, 25 aa, Staphylococcus epidermidis
NRANAIINKPIRSVEEVNNALHEVK

SEQ ID NO: 1743940 - protein, 18 aa, Staphylococcus epidermidis
NRFYTSATLANFLINTVA

SEQ ID NO: 1743941 - protein, 18 aa, Staphylococcus epidermidis
NRIKAFFISLEVSFVVLS

SEQ ID NO: 1743942 - protein, 20 aa, Staphylococcus epidermidis
NRISLFIVKLILGMIIMSIV

SEQ ID NO: 1743943 - protein, 18 aa, Staphylococcus epidermidis
NRITKLVEELLMLTKDRV

SEQ ID NO: 1743944 - protein, 37 aa, Staphylococcus epidermidis
NRKNIQWKSIFILVILNLFLAWFFIYFPWGRTGVKGA

SEQ ID NO: 1743945 - protein, 25 aa, Staphylococcus epidermidis
NRLKKACREFIAFMNVNKIYFSNEI

SEQ ID NO: 1743946 - protein, 25 aa, Staphylococcus epidermidis
NRLSYKYRRFVSPVTMRAKASNQLN

SEQ ID NO: 1743947 - protein, 19 aa, Staphylococcus epidermidis
NRMYLFLFVRSFVRGRDAF

SEQ ID NO: 1743948 - protein, 27 aa, Staphylococcus epidermidis
NRNALSYKYRRFITPVTMRVKASDKLN

SEQ ID NO: 1743949 - protein, 23 aa, Staphylococcus epidermidis
NRPYFHMIWHIFIVIASLLHMVG

SEQ ID NO: 1743950 - protein, 24 aa, Staphylococcus epidermidis
NRVKHPLVDFEIFKNKGYTGATIS

SEQ ID NO: 1743951 - protein, 30 aa, Staphylococcus epidermidis
NRVRPEVKVLNSLSGFTMVNGGQVGLLNSV

SEQ ID NO: 1743952 - protein, 23 aa, Staphylococcus epidermidis
NRYKHILNQAHLLGEKHIAEHKL

SEQ ID NO: 1743953 - protein, 19 aa, Staphylococcus epidermidis
NSDIHRSRMLNNKYDEMGG

SEQ ID NO: 1743954 - protein, 27 aa, Staphylococcus epidermidis
NSDKGWFKSIIMIVAIAPWAYVGFDNI

SEQ ID NO: 1743955 - protein, 18 aa, Staphylococcus epidermidis
NSDMALATIKAVQSVTEQ

SEQ ID NO: 1743956 - protein, 25 aa, Staphylococcus epidermidis
NSEFQMIQFIPLFAVPQVFFSGIFP

SEQ ID NO: 1743957 - protein, 18 aa, Staphylococcus epidermidis
NSEKFMVNQAVKKGVTKD

SEQ ID NO: 1743958 - protein, 24 aa, Staphylococcus epidermidis
NSGIEWYKFTFVMIGIFLVPIICQ

SEQ ID NO: 1743959 - protein, 26 aa, Staphylococcus epidermidis
NSGTYADGVMRADLDGATLTYTPKAV

SEQ ID NO: 1743960 - protein, 26 aa, Staphylococcus epidermidis
NSGTYASGVMRADLDGATLTYTPKAV

SEQ ID NO: 1743961 - protein, 17 aa, Staphylococcus epidermidis
NSIDTFKDDIFKTKDAL

SEQ ID NO: 1743962 - protein, 18 aa, Staphylococcus epidermidis
NSIFDRPSLLDKLHSRGS

SEQ ID NO: 1743963 - protein, 24 aa, Staphylococcus epidermidis
NSITANKGITTWIQQYNHSLLSSN

SEQ ID NO: 1743964 - protein, 25 aa, Staphylococcus epidermidis
NSITASKINHQWSLNKQVQGITIEP

SEQ ID NO: 1743965 - protein, 21 aa, Staphylococcus epidermidis
NSKFIDWGVLLVLGIFVGSYI

SEQ ID NO: 1743966 - protein, 18 aa, Staphylococcus epidermidis
NSLIKLIIKRDLNQDPEV

SEQ ID NO: 1743967 - protein, 18 aa, Staphylococcus epidermidis
NSLIPIITFLGADIVSIL

SEQ ID NO: 1743968 - protein, 32 aa, Staphylococcus epidermidis
NSMVTRVISRWAQEFNIYFKRYNSDQFVAYLN

SEQ ID NO: 1743969 - protein, 26 aa, Staphylococcus epidermidis
NSNHKGHEYMYYWFGLPSDQTPTGPV

SEQ ID NO: 1743970 - protein, 37 aa, Staphylococcus epidermidis
NSQTNAISFAPRMHSSNLVKMKAMSIANNKTGTISGI

SEQ ID NO: 1743971 - protein, 24 aa, Staphylococcus epidermidis
NSTYKIYLALMAFDQNLLSLNHTE

SEQ ID NO: 1743972 - protein, 23 aa, Staphylococcus epidermidis
NSVIKELFNHVSVEDEESYYKHH

SEQ ID NO: 1743973 - protein, 17 aa, Staphylococcus epidermidis
NTDRVTSVLTYTANKTS

SEQ ID NO: 1743974 - protein, 18 aa, Staphylococcus epidermidis
NTFGMPWTIFIFHPHHDN

SEQ ID NO: 1743975 - protein, 22 aa, Staphylococcus epidermidis
NTGIRMFKRYAVITTSAKILGR

SEQ ID NO: 1743976 - protein, 18 aa, Staphylococcus epidermidis
NTGKIVLQPQFLLTNSKI

SEQ ID NO: 1743977 - protein, 21 aa, Staphylococcus epidermidis
NTGLSVFLFGFIKRLLIPFGL

SEQ ID NO: 1743978 - protein, 26 aa, Staphylococcus epidermidis
NTIQKSDFTAGRMTNKIKYDSSQNSI

SEQ ID NO: 1743979 - protein, 19 aa, Staphylococcus epidermidis
NTKIEPIKIEARDNSGQAV

SEQ ID NO: 1743980 - protein, 18 aa, Staphylococcus epidermidis
NTLLEPFGLPALTMPFIL

SEQ ID NO: 1743981 - protein, 18 aa, Staphylococcus epidermidis
NTLLKLSDIFGISLNELI

SEQ ID NO: 1743982 - protein, 17 aa, Staphylococcus epidermidis
NTMMAFTAYFIVWLTLP

SEQ ID NO: 1743983 - protein, 26 aa, Staphylococcus epidermidis
NTMNKRINFIFGFIVFIFAIVVLRLG

SEQ ID NO: 1743984 - protein, 43 aa, Staphylococcus epidermidis
NTPTKKNHYSIRKFTVGTASIIVGSFLFFGQAHAEENPQGTTG

SEQ ID NO: 1743985 - protein, 27 aa, Staphylococcus epidermidis
NTTFKSDIPLSAKLIIFLVLAIGTIDG

SEQ ID NO: 1743986 - protein, 26 aa, Staphylococcus epidermidis
NTYIPLPAIAKLVFNNVLTGKPLTNG

SEQ ID NO: 1743987 - protein, 35 aa, Staphylococcus epidermidis
NTYLLRQLKSIGMFIMIVILAVYFIAMNYLNPSGS

SEQ ID NO: 1743988 - protein, 25 aa, Staphylococcus epidermidis
NVAKMKESFKVLAETLGQQVVPAII

SEQ ID NO: 1743989 - protein, 25 aa, Staphylococcus epidermidis
NVDKIKRANGLSSNNIHNGQTLVIP

SEQ ID NO: 1743990 - protein, 26 aa, Staphylococcus epidermidis
NVDNHLWLIPGLCICGIALFTSLTIA

SEQ ID NO: 1743991 - protein, 20 aa, Staphylococcus epidermidis
NVDSILRWESIILDPIGPML

SEQ ID NO: 1743992 - protein, 26 aa, Staphylococcus epidermidis
NVENTEIYKLFGWMSLFVLIIFIFFT

SEQ ID NO: 1743993 - protein, 24 aa, Staphylococcus epidermidis
NVKEIPKDATIIWYDFENATDEEN

SEQ ID NO: 1743994 - protein, 31 aa, Staphylococcus epidermidis
NVKRTSYRLLHWRLKDTITLILLIPIGLILF

SEQ ID NO: 1743995 - protein, 26 aa, Staphylococcus epidermidis
NVLQFWDVFKVLSPLTWSLIFLTFIF

SEQ ID NO: 1743996 - protein, 17 aa, Staphylococcus epidermidis
NVLSHRIFMAIIYTVAI

SEQ ID NO: 1743997 - protein, 24 aa, Staphylococcus epidermidis
NVNMEFINWILSSVVLWIGASLFL

SEQ ID NO: 1743998 - protein, 27 aa, Staphylococcus epidermidis
NVQPTDNSFQYFVIDYNGDTKVMTVTY

SEQ ID NO: 1743999 - protein, 18 aa, Staphylococcus epidermidis
NVQWPDVWQAILETLYMT

SEQ ID NO: 1744000 - protein, 19 aa, Staphylococcus epidermidis
NVSAWSIYLVIKIAGIIAM

SEQ ID NO: 1744001 - protein, 19 aa, Staphylococcus epidermidis
NVSELSGWNIVDLKINDQI

SEQ ID NO: 1744002 - protein, 19 aa, Staphylococcus epidermidis
NVSPAITISVIDKTPPAVK

SEQ ID NO: 1744003 - protein, 18 aa, Staphylococcus epidermidis
NVTETTFTIEVEDTTKPT

SEQ ID NO: 1744004 - protein, 20 aa, Staphylococcus epidermidis
NVVELITFRGLQGIGAAMLQ

SEQ ID NO: 1744005 - protein, 17 aa, Staphylococcus epidermidis
NYAEALSMMLIPGSLVF

SEQ ID NO: 1744006 - protein, 26 aa, Staphylococcus epidermidis
NYAKSWLKHLLSYIIGTGILHLIVYL

SEQ ID NO: 1744007 - protein, 23 aa, Staphylococcus epidermidis
NYDEVRMKTTIYNWHKEGDEYEA

SEQ ID NO: 1744008 - protein, 20 aa, Staphylococcus epidermidis
NYDTIGLWAPILLLLARVLQ

SEQ ID NO: 1744009 - protein, 24 aa, Staphylococcus epidermidis
NYEQIFTMRYFKMFIDSIWYAILI

SEQ ID NO: 1744010 - protein, 25 aa, Staphylococcus epidermidis
NYLKFKPTSMCIATILYGMSTVMTY

SEQ ID NO: 1744011 - protein, 20 aa, Staphylococcus epidermidis
NYLPFFNIGMGWIVPALIGF

SEQ ID NO: 1744012 - protein, 20 aa, Staphylococcus epidermidis
NYRKYFPLFTLITSFASVAW

SEQ ID NO: 1744013 - protein, 22 aa, Staphylococcus epidermidis
NYSGVFIYKDLKSIEDTNNAIT

SEQ ID NO: 1744014 - protein, 26 aa, Staphylococcus epidermidis
NYSIGPNLRKYFSLSNGSDLPNRDFT

SEQ ID NO: 1744015 - protein, 17 aa, Staphylococcus epidermidis
NYSPDILIISAIVLLLS

SEQ ID NO: 1744016 - protein, 19 aa, Staphylococcus epidermidis
NYTNLSFKILPMNESTQDH

SEQ ID NO: 1744017 - protein, 24 aa, Staphylococcus epidermidis
NYVFPICLSIIISTLLRTVVHQFD

SEQ ID NO: 1744018 - protein, 21 aa, Staphylococcus epidermidis
PAAIGFVLGGIFIRVLDYVIP

SEQ ID NO: 1744019 - protein, 18 aa, Staphylococcus epidermidis
PAARVFYTIVSFIVNLFR

SEQ ID NO: 1744020 - protein, 24 aa, Staphylococcus epidermidis
PALVSSVLPDWAFGLFGAVIFGAI

SEQ ID NO: 1744021 - protein, 21 aa, Staphylococcus epidermidis
PASIIGLIVWFFAGLHSGGNA

SEQ ID NO: 1744022 - protein, 17 aa, Staphylococcus epidermidis
PASITAYNQRYQQFSNE

SEQ ID NO: 1744023 - protein, 18 aa, Staphylococcus epidermidis
PASTYSRNALFNHIFTWV

SEQ ID NO: 1744024 - protein, 20 aa, Staphylococcus epidermidis
PDGTWMADIALQIPKNIAAS

SEQ ID NO: 1744025 - protein, 20 aa, Staphylococcus epidermidis
PDLIMLMQLSQLFSVSTDYL

SEQ ID NO: 1744026 - protein, 21 aa, Staphylococcus epidermidis
PDQLHDIKHIISFEDIPDAID

SEQ ID NO: 1744027 - protein, 18 aa, Staphylococcus epidermidis
PDTKVIKGYEQFLYRLMI

SEQ ID NO: 1744028 - protein, 18 aa, Staphylococcus epidermidis
PDVRLVILHSEYRSIIRP

SEQ ID NO: 1744029 - protein, 19 aa, Staphylococcus epidermidis
PEASRLVLQAGALAQGGEV

SEQ ID NO: 1744030 - protein, 20 aa, Staphylococcus epidermidis
PEDRKGEGIGYYGLSVTLAS

SEQ ID NO: 1744031 - protein, 21 aa, Staphylococcus epidermidis
PEEFPHGALWQSIFWAVLILL

SEQ ID NO: 1744032 - protein, 21 aa, Staphylococcus epidermidis
PEEYRYGFYVTPYLNRINGVF

SEQ ID NO: 1744033 - protein, 20 aa, Staphylococcus epidermidis
PEFDDLKLLVQTLHEAGADV

SEQ ID NO: 1744034 - protein, 21 aa, Staphylococcus epidermidis
PEGRSIVKLAYKQHIDLPQEV

SEQ ID NO: 1744035 - protein, 20 aa, Staphylococcus epidermidis
PEHLKQVFDRFYKVDAARKR

SEQ ID NO: 1744036 - protein, 30 aa, Staphylococcus epidermidis
PEHSFWKSIESIGSLSFKFMVPILAGYIAV

SEQ ID NO: 1744037 - protein, 21 aa, Staphylococcus epidermidis
PEIVVKWLSFIPITLFTALVI

SEQ ID NO: 1744038 - protein, 25 aa, Staphylococcus epidermidis
PEKSWDTGLYYFGFIGEKPVRTEVL

SEQ ID NO: 1744039 - protein, 21 aa, Staphylococcus epidermidis
PELSNDFVVLDFTYDLPLTTY

SEQ ID NO: 1744040 - protein, 24 aa, Staphylococcus epidermidis
PELTRNSMDAFPIVAYSFSSNNQK

SEQ ID NO: 1744041 - protein, 24 aa, Staphylococcus epidermidis
PELTRNSMDAFPMVAYSFTSNQHD

SEQ ID NO: 1744042 - protein, 17 aa, Staphylococcus epidermidis
PEMLGVFQGLTFVVTIS

SEQ ID NO: 1744043 - protein, 40 aa, Staphylococcus epidermidis
PESERGPVKIPGYRYTRMTMSDGITKYIYKKVSNNQTTPS

SEQ ID NO: 1744044 - protein, 21 aa, Staphylococcus epidermidis
PETLLPVNLYVKPELKHTIEL

SEQ ID NO: 1744045 - protein, 19 aa, Staphylococcus epidermidis
PEVVYYIVIKAAFIHLMLI

SEQ ID NO: 1744046 - protein, 19 aa, Staphylococcus epidermidis
PEYPMFYTTTAVNYPNFMS

SEQ ID NO: 1744047 - protein, 24 aa, Staphylococcus epidermidis
PFADMAILLGINWLAILLYVEAVV

SEQ ID NO: 1744048 - protein, 26 aa, Staphylococcus epidermidis
PFDKKREFDPNLAPGTEKVVQKGEPG

SEQ ID NO: 1744049 - protein, 17 aa, Staphylococcus epidermidis
PFFGVAFVVMIFAIGGV

SEQ ID NO: 1744050 - protein, 18 aa, Staphylococcus epidermidis
PFFIGGLCLAIAAMALPY

SEQ ID NO: 1744051 - protein, 17 aa, Staphylococcus epidermidis
PFIDDFVSFKSFTPKST

SEQ ID NO: 1744052 - protein, 27 aa, Staphylococcus epidermidis
PFILAPIVNVWIFKFFVDVLNMNSFSI

SEQ ID NO: 1744053 - protein, 24 aa, Staphylococcus epidermidis
PFINPKLGKNIPFMLGLFSGGLIF

SEQ ID NO: 1744054 - protein, 25 aa, Staphylococcus epidermidis
PFIPLFIVGISYVFSSAIVAILVKY

SEQ ID NO: 1744055 - protein, 27 aa, Staphylococcus epidermidis
PFIVAKDGLFPKWFAKENKNKAPVNAL

SEQ ID NO: 1744056 - protein, 18 aa, Staphylococcus epidermidis
PFKNEYLVHLTFVPLLFL

SEQ ID NO: 1744057 - protein, 20 aa, Staphylococcus epidermidis
PFLMFMPVWMGSMITSVLLF

SEQ ID NO: 1744058 - protein, 18 aa, Staphylococcus epidermidis
PFTPLLIAAVLYFILTFA

SEQ ID NO: 1744059 - protein, 21 aa, Staphylococcus epidermidis
PFVGSDSWQHFVLPIFTIVVI

SEQ ID NO: 1744060 - protein, 22 aa, Staphylococcus epidermidis
PFYFRFLHVRSFRKNKKSGQPA

SEQ ID NO: 1744061 - protein, 17 aa, Staphylococcus epidermidis
PGEKIPVDGEVIKGSTS

SEQ ID NO: 1744062 - protein, 19 aa, Staphylococcus epidermidis
PGILTGFILSLSRALGETA

SEQ ID NO: 1744063 - protein, 52 aa, Staphylococcus epidermidis
PGISTPLEVPVKVWVYNFDFPQPIYKIQVGDTFPKGTWVGYYKHLENGEGLP

SEQ ID NO: 1744064 - protein, 24 aa, Staphylococcus epidermidis
PGNYFITVKFGDKVEQFEIRSKPT

SEQ ID NO: 1744065 - protein, 17 aa, Staphylococcus epidermidis
PGPLGIVMGTGFAFWSF

SEQ ID NO: 1744066 - protein, 22 aa, Staphylococcus epidermidis
PGSVWFLMIVRLLNGLATAVAT

SEQ ID NO: 1744067 - protein, 20 aa, Staphylococcus epidermidis
PGSYLLGIHWGFGYTGIILV

SEQ ID NO: 1744068 - protein, 18 aa, Staphylococcus epidermidis
PHHFKLEIVPIHYIHSDK

SEQ ID NO: 1744069 - protein, 27 aa, Staphylococcus epidermidis
PHKSASPRMNLMSLAAEPNSGKNVNDK

SEQ ID NO: 1744070 - protein, 18 aa, Staphylococcus epidermidis
PIAGAIVLYGFNDAVRST

SEQ ID NO: 1744071 - protein, 18 aa, Staphylococcus epidermidis
PIAKRLIVFLPFPKTVAY

SEQ ID NO: 1744072 - protein, 22 aa, Staphylococcus epidermidis
PIASILVSLIILKSAYGIAKSS

SEQ ID NO: 1744073 - protein, 28 aa, Staphylococcus epidermidis
PIDAHSYASWVIVVGISLILVAIVSIFL

SEQ ID NO: 1744074 - protein, 23 aa, Staphylococcus epidermidis
PIFEEMVFRGILMRYFEKQYGIL

SEQ ID NO: 1744075 - protein, 21 aa, Staphylococcus epidermidis
PIFIGICLIVSLLSLTSILTF

SEQ ID NO: 1744076 - protein, 18 aa, Staphylococcus epidermidis
PIHVRWYGIIIACGILLG

SEQ ID NO: 1744077 - protein, 25 aa, Staphylococcus epidermidis
PIIEECIFRGILIKVMFQKKQWLGV

SEQ ID NO: 1744078 - protein, 21 aa, Staphylococcus epidermidis
PIIGFILYLFLGRTVSKKKME

SEQ ID NO: 1744079 - protein, 21 aa, Staphylococcus epidermidis
PILLCVFAFKSEKLIATMVII

SEQ ID NO: 1744080 - protein, 19 aa, Staphylococcus epidermidis
PILVKKPAANDVINKKVSE

SEQ ID NO: 1744081 - protein, 18 aa, Staphylococcus epidermidis
PIMFLIGLVAAHYQHPSI

SEQ ID NO: 1744082 - protein, 22 aa, Staphylococcus epidermidis
PINDPKLSFSIVYTNQPVPPPW

SEQ ID NO: 1744083 - protein, 27 aa, Staphylococcus epidermidis
PINSESQFIGDSLSEDTIVTQSKNTNM

SEQ ID NO: 1744084 - protein, 18 aa, Staphylococcus epidermidis
PIVGSFSSIIPWEKLGDE

SEQ ID NO: 1744085 - protein, 27 aa, Staphylococcus epidermidis
PIVLFLLCLTVFKMKGIYAAITTLVVT

SEQ ID NO: 1744086 - protein, 20 aa, Staphylococcus epidermidis
PIVVGLIIWALTPIKPDALN

SEQ ID NO: 1744087 - protein, 18 aa, Staphylococcus epidermidis
PIYFIGGILGMAFVTSNI

SEQ ID NO: 1744088 - protein, 21 aa, Staphylococcus epidermidis
PKADIPGIIYSTIGFGSLLYG

SEQ ID NO: 1744089 - protein, 17 aa, Staphylococcus epidermidis
PKANEAVVTNESTKPKT

SEQ ID NO: 1744090 - protein, 20 aa, Staphylococcus epidermidis
PKDETTVHDSLNFKEDFNNV

SEQ ID NO: 1744091 - protein, 24 aa, Staphylococcus epidermidis
PKDLKMYRMVFNTISVERMNSILF

SEQ ID NO: 1744092 - protein, 18 aa, Staphylococcus epidermidis
PKFAYAFMAAIRMVPLII

SEQ ID NO: 1744093 - protein, 20 aa, Staphylococcus epidermidis
PKGAFNFKLLNLTGENYKTL

SEQ ID NO: 1744094 - protein, 19 aa, Staphylococcus epidermidis
PKIAYAFMAAIRMVPLIIS

SEQ ID NO: 1744095 - protein, 25 aa, Staphylococcus epidermidis
PKILKKATLGIGIFATLLTSLILGI

SEQ ID NO: 1744096 - protein, 22 aa, Staphylococcus epidermidis
PKLAFEIPLRYKIMGIVGSVWG

SEQ ID NO: 1744097 - protein, 18 aa, Staphylococcus epidermidis
PKLRYTAVEKGDINLIDA

SEQ ID NO: 1744098 - protein, 26 aa, Staphylococcus epidermidis
PKLYEYKTMSSYNFKQGDKIGTPGFV

SEQ ID NO: 1744099 - protein, 22 aa, Staphylococcus epidermidis
PKNMKYAVLATEDNRFYHHGAL

SEQ ID NO: 1744100 - protein, 22 aa, Staphylococcus epidermidis
PKPKEGIGTWIGKDIKTLTHHY

SEQ ID NO: 1744101 - protein, 23 aa, Staphylococcus epidermidis
PKPKQGVGTWIGKNIDFMTKHYG

SEQ ID NO: 1744102 - protein, 26 aa, Staphylococcus epidermidis
PKTIAGEVDGTVNIDKQLNNFKNLGY

SEQ ID NO: 1744103 - protein, 39 aa, Staphylococcus epidermidis
PKTRRSVGAIILQLALLFIAQLYYHFTKGISSEREPVLS

SEQ ID NO: 1744104 - protein, 25 aa, Staphylococcus epidermidis
PLAGVTLISGLAIMSSRKKKKDKKV

SEQ ID NO: 1744105 - protein, 19 aa, Staphylococcus epidermidis
PLASILVSLIILKSAYGIS

SEQ ID NO: 1744106 - protein, 23 aa, Staphylococcus epidermidis
PLFVSMVVGIVFLKVTGISYQQY

SEQ ID NO: 1744107 - protein, 27 aa, Staphylococcus epidermidis
PLGDWLGVQHFYEWLNYVMKTGHSAWR

SEQ ID NO: 1744108 - protein, 22 aa, Staphylococcus epidermidis
PLGEMAIGLGLILGVFAYAASF

SEQ ID NO: 1744109 - protein, 31 aa, Staphylococcus epidermidis
PLGLEISKLSNWRFAMLVIIVISFIALISIS

SEQ ID NO: 1744110 - protein, 42 aa, Staphylococcus epidermidis
PLGQIGKEGAAVGIGGLNNAFGFKLDTYHNTSTPKSDAKAKA

SEQ ID NO: 1744111 - protein, 25 aa, Staphylococcus epidermidis
PLHLPAIVMNPWFQFILATPVQFII

SEQ ID NO: 1744112 - protein, 23 aa, Staphylococcus epidermidis
PLKIGESASHLFENTSINPEPTI

SEQ ID NO: 1744113 - protein, 18 aa, Staphylococcus epidermidis
PLMHLYKLIESFLNEPLE

SEQ ID NO: 1744114 - protein, 18 aa, Staphylococcus epidermidis
PLNHKRSLKGFLHQYQIV

SEQ ID NO: 1744115 - protein, 26 aa, Staphylococcus epidermidis
PLNPEVIKWAKDVYGKRVLDTWWMTE

SEQ ID NO: 1744116 - protein, 18 aa, Staphylococcus epidermidis
PLQRLIKLLGDIFIPILP

SEQ ID NO: 1744117 - protein, 25 aa, Staphylococcus epidermidis
PLSFKVHILLGFTIFALWPFTRLVH

SEQ ID NO: 1744118 - protein, 19 aa, Staphylococcus epidermidis
PLSHLNIDSGLSFPSGHSN

SEQ ID NO: 1744119 - protein, 21 aa, Staphylococcus epidermidis
PLTDGEFQFTLSEGDHVLQTA

SEQ ID NO: 1744120 - protein, 20 aa, Staphylococcus epidermidis
PLTHMQRLLTQLQFSKNKEE

SEQ ID NO: 1744121 - protein, 21 aa, Staphylococcus epidermidis
PLTNGEFQFTLSEGDHVLQTV

SEQ ID NO: 1744122 - protein, 19 aa, Staphylococcus epidermidis
PLTPVKRQNAIATINAKAD

SEQ ID NO: 1744123 - protein, 30 aa, Staphylococcus epidermidis
PLVVYAVSAGYKWFFAYPDQHIETVNTLTI

SEQ ID NO: 1744124 - protein, 21 aa, Staphylococcus epidermidis
PLYLQNLRGFSALDSGLLMLP

SEQ ID NO: 1744125 - protein, 17 aa, Staphylococcus epidermidis
PMILFSLHINGVKMYSL

SEQ ID NO: 1744126 - protein, 20 aa, Staphylococcus epidermidis
PMLWANFFWVWGHPEVYIVI

SEQ ID NO: 1744127 - protein, 24 aa, Staphylococcus epidermidis
PNENRTANLQSMFTNIDTKNHTVE

SEQ ID NO: 1744128 - protein, 19 aa, Staphylococcus epidermidis
PNGLWIDLWQDFIAHDHEN

SEQ ID NO: 1744129 - protein, 25 aa, Staphylococcus epidermidis
PNKNRVTIKQGNALPTNLAGGSTSH

SEQ ID NO: 1744130 - protein, 24 aa, Staphylococcus epidermidis
PNKTSWWLVIPVGLVYAVIYYFVF

SEQ ID NO: 1744131 - protein, 27 aa, Staphylococcus epidermidis
PNLFILLTCRFIMGFAIGMDSPVAFTF

SEQ ID NO: 1744132 - protein, 17 aa, Staphylococcus epidermidis
PNLTTFPLKKGQTYTIE

SEQ ID NO: 1744133 - protein, 25 aa, Staphylococcus epidermidis
PNMIYYIVACIGFIFIGLGLGFFAT

SEQ ID NO: 1744134 - protein, 25 aa, Staphylococcus epidermidis
PNMLIQRLKAGKVYKKERLETAFSN

SEQ ID NO: 1744135 - protein, 18 aa, Staphylococcus epidermidis
PNNSEYSYLLNDLGYDAT

SEQ ID NO: 1744136 - protein, 29 aa, Staphylococcus epidermidis
PNPEYPILFTPAAKDYANFMSDNTDPYGV

SEQ ID NO: 1744137 - protein, 19 aa, Staphylococcus epidermidis
PNVAKQLSYAKFLNGKMEE

SEQ ID NO: 1744138 - protein, 20 aa, Staphylococcus epidermidis
PNVQWPEVWQAILETLYMTV

SEQ ID NO: 1744139 - protein, 31 aa, Staphylococcus epidermidis
PNYNYGGTVSRVTANTGAYVVSRINQVNYDA

SEQ ID NO: 1744140 - protein, 20 aa, Staphylococcus epidermidis
PNYVMGLSFITEGAIPFAAA

SEQ ID NO: 1744141 - protein, 19 aa, Staphylococcus epidermidis
PPFKLKANPPRALKATIDT

SEQ ID NO: 1744142 - protein, 20 aa, Staphylococcus epidermidis
PPLFFGASWETWVYQGLAVL

SEQ ID NO: 1744143 - protein, 18 aa, Staphylococcus epidermidis
PPLTWPFIFATWIMLFAG

SEQ ID NO: 1744144 - protein, 19 aa, Staphylococcus epidermidis
PPNRMGNLAIKKGWPSMMY

SEQ ID NO: 1744145 - protein, 25 aa, Staphylococcus epidermidis
PQFINHIGFQFSFLISLFIILAKPY

SEQ ID NO: 1744146 - protein, 26 aa, Staphylococcus epidermidis
PQFINHIGFQFSFLISLFIILAKPYI

SEQ ID NO: 1744147 - protein, 26 aa, Staphylococcus epidermidis
PQFINHIGFQFSFLISLFIILTKSYI

SEQ ID NO: 1744148 - protein, 17 aa, Staphylococcus epidermidis
PQKTSEHKVEYDKKAKY

SEQ ID NO: 1744149 - protein, 29 aa, Staphylococcus epidermidis
PQLIRRFYWRYELGTHMLLNLIVGSAVML

SEQ ID NO: 1744150 - protein, 27 aa, Staphylococcus epidermidis
PQPFDLNIPFTKSLTGRNLKDGEFHFA

SEQ ID NO: 1744151 - protein, 31 aa, Staphylococcus epidermidis
PQPPRHRRPRFPWFKTILVALIAGIIGALLV

SEQ ID NO: 1744152 - protein, 18 aa, Staphylococcus epidermidis
PQWYKWFFEHIVAHTTGL

SEQ ID NO: 1744153 - protein, 18 aa, Staphylococcus epidermidis
PQWYKWFFENIVSHSTGL

SEQ ID NO: 1744154 - protein, 17 aa, Staphylococcus epidermidis
PQYFIPITASLTTHYRV

SEQ ID NO: 1744155 - protein, 18 aa, Staphylococcus epidermidis
PRAGRALFSDSLATIVGA

SEQ ID NO: 1744156 - protein, 19 aa, Staphylococcus epidermidis
PRNGDILAMAGKQIDKQGK

SEQ ID NO: 1744157 - protein, 20 aa, Staphylococcus epidermidis
PSFIAGVFAIFFFAFQLNLF

SEQ ID NO: 1744158 - protein, 19 aa, Staphylococcus epidermidis
PSGVLGLIGIVGYVSYYSI

SEQ ID NO: 1744159 - protein, 22 aa, Staphylococcus epidermidis
PSHFYKLVCVGIASYIGSQTFV

SEQ ID NO: 1744160 - protein, 24 aa, Staphylococcus epidermidis
PSKGILICLTFMILNAILSFKLKK

SEQ ID NO: 1744161 - protein, 24 aa, Staphylococcus epidermidis
PSKHWFRKVDWVLVLIITVLAMIS

SEQ ID NO: 1744162 - protein, 18 aa, Staphylococcus epidermidis
PSLLDRIHGNKHHNGQLA

SEQ ID NO: 1744163 - protein, 23 aa, Staphylococcus epidermidis
PSPEKLLFRFLDGLTFGVLTVFL

SEQ ID NO: 1744164 - protein, 20 aa, Staphylococcus epidermidis
PSQHKLEVGLGRDISGEPVS

SEQ ID NO: 1744165 - protein, 20 aa, Staphylococcus epidermidis
PSVIGGLLIIIGIFIGSRKA

SEQ ID NO: 1744166 - protein, 20 aa, Staphylococcus epidermidis
PSVIIYFILIHIFQHSFLLN

SEQ ID NO: 1744167 - protein, 28 aa, Staphylococcus epidermidis
PSVKGFKRTRISMFIWLIFLLPLPFLLS

SEQ ID NO: 1744168 - protein, 20 aa, Staphylococcus epidermidis
PSVLGNYSFIWSASKLKTDT

SEQ ID NO: 1744169 - protein, 18 aa, Staphylococcus epidermidis
PTFIPIIPLLGLSVGSLI

SEQ ID NO: 1744170 - protein, 25 aa, Staphylococcus epidermidis
PTGSSLKPFLAYGPAIENMQWATNH

SEQ ID NO: 1744171 - protein, 27 aa, Staphylococcus epidermidis
PTGTGNVYTEYWLTRDGTTNTNDFYRG

SEQ ID NO: 1744172 - protein, 18 aa, Staphylococcus epidermidis
PTHRKPGLYKDFDDGHIY

SEQ ID NO: 1744173 - protein, 20 aa, Staphylococcus epidermidis
PTIFFKHMLNDVIITQPFSL

SEQ ID NO: 1744174 - protein, 20 aa, Staphylococcus epidermidis
PTIFNFSLALLIGLISGVFS

SEQ ID NO: 1744175 - protein, 18 aa, Staphylococcus epidermidis
PTIKKGKKKTNVPNLVTQ

SEQ ID NO: 1744176 - protein, 17 aa, Staphylococcus epidermidis
PTILKLTSFYLNTAQNN

SEQ ID NO: 1744177 - protein, 23 aa, Staphylococcus epidermidis
PTLKRMKFGQSIREEGPQSHMKK

SEQ ID NO: 1744178 - protein, 26 aa, Staphylococcus epidermidis
PTLYIELIIGIALIFAGVMMSQINIP

SEQ ID NO: 1744179 - protein, 17 aa, Staphylococcus epidermidis
PTNYTNLSFKILPMNES

SEQ ID NO: 1744180 - protein, 23 aa, Staphylococcus epidermidis
PTPPSAKRSYSWVVLGRLLAIVI

SEQ ID NO: 1744181 - protein, 17 aa, Staphylococcus epidermidis
PTQIFFIQFTILVFCMA

SEQ ID NO: 1744182 - protein, 24 aa, Staphylococcus epidermidis
PTTIGGLLSAIGIAGMDRVTQFNI

SEQ ID NO: 1744183 - protein, 18 aa, Staphylococcus epidermidis
PTYTNADVGHTFKYNVEE

SEQ ID NO: 1744184 - protein, 23 aa, Staphylococcus epidermidis
PVAHWVWGGGWISKLGAIDYAGG

SEQ ID NO: 1744185 - protein, 20 aa, Staphylococcus epidermidis
PVFLIFFFYHKFRYKTKKIP

SEQ ID NO: 1744186 - protein, 19 aa, Staphylococcus epidermidis
PVIIGGSFSAFFITSVNSF

SEQ ID NO: 1744187 - protein, 18 aa, Staphylococcus epidermidis
PVLLELKAYLKNRVTNFR

SEQ ID NO: 1744188 - protein, 18 aa, Staphylococcus epidermidis
PVSKEIMNYIVPTLIITF

SEQ ID NO: 1744189 - protein, 29 aa, Staphylococcus epidermidis
PVSRLTEKVLGWFSWVFLLILTIITMFIA

SEQ ID NO: 1744190 - protein, 26 aa, Staphylococcus epidermidis
PVTSIAPLCFSMAMAERTGGSGNASS

SEQ ID NO: 1744191 - protein, 23 aa, Staphylococcus epidermidis
PVVEAKPSALSEIQQQATNQKAQ

SEQ ID NO: 1744192 - protein, 27 aa, Staphylococcus epidermidis
PWVFSRVFIALAITFGVLWVLTNVLGN

SEQ ID NO: 1744193 - protein, 29 aa, Staphylococcus epidermidis
PYFKPLHMALRLFMLLTLISGFWELIKEF

SEQ ID NO: 1744194 - protein, 19 aa, Staphylococcus epidermidis
PYGNAKFFYSNVISAGLII

SEQ ID NO: 1744195 - protein, 26 aa, Staphylococcus epidermidis
PYGVILGRTTDGWNRNVIDSKVAGIY

SEQ ID NO: 1744196 - protein, 20 aa, Staphylococcus epidermidis
PYLAFFPIVAILVVYYIVRF

SEQ ID NO: 1744197 - protein, 19 aa, Staphylococcus epidermidis
PYQGAPMFKEKFLKEHPEI

SEQ ID NO: 1744198 - protein, 17 aa, Staphylococcus epidermidis
QAFKLFWTNYFNFKGRS

SEQ ID NO: 1744199 - protein, 22 aa, Staphylococcus epidermidis
QAGATVKPGSAPNQDTEVKPNP

SEQ ID NO: 1744200 - protein, 20 aa, Staphylococcus epidermidis
QAIAMWPGFSRSGSTISTGV

SEQ ID NO: 1744201 - protein, 32 aa, Staphylococcus epidermidis
QAKAHNDIKETLKRQLDEIEHANATSNSKDQT

SEQ ID NO: 1744202 - protein, 29 aa, Staphylococcus epidermidis
QALDKARPKIEAIVPQVSKKRDALNAIQE

SEQ ID NO: 1744203 - protein, 24 aa, Staphylococcus epidermidis
QANVAKKPSARMELDSKFEDLKRQ

SEQ ID NO: 1744204 - protein, 28 aa, Staphylococcus epidermidis
QAPPQWLYHFSLSLSFVIAQGLILVIFY

SEQ ID NO: 1744205 - protein, 36 aa, Staphylococcus epidermidis
QDDNEKGISGVKVTLKDEKGNIISTTTTDENGKYQF

SEQ ID NO: 1744206 - protein, 34 aa, Staphylococcus epidermidis
QDDNEKGISGVKVTLKNKNGDTIGTTTTDSNGKY

SEQ ID NO: 1744207 - protein, 67 aa, Staphylococcus epidermidis
QDDSEKGISGVKVTLKDKNGNAIGTTTTDVSGHYQFKGLENGSYTVEFETPSGYTPTKANSGQDITV

SEQ ID NO: 1744208 - protein, 17 aa, Staphylococcus epidermidis
QDGLWTVDINLKIPDKI

SEQ ID NO: 1744209 - protein, 26 aa, Staphylococcus epidermidis
QDITRFIVRVLIPFALIISLFLISQG

SEQ ID NO: 1744210 - protein, 17 aa, Staphylococcus epidermidis
QDLQRKANEQKEQINQT

SEQ ID NO: 1744211 - protein, 24 aa, Staphylococcus epidermidis
QDLSEYGISLVFVEDVIESLPEHV

SEQ ID NO: 1744212 - protein, 18 aa, Staphylococcus epidermidis
QEIFQFFTSHGIYSITGI

SEQ ID NO: 1744213 - protein, 30 aa, Staphylococcus epidermidis
QEIKDVRAITRFKIPEGYSIKDVTKEYAKF

SEQ ID NO: 1744214 - protein, 25 aa, Staphylococcus epidermidis
QEIKDVRAITRFKIPESYSIKDVTK

SEQ ID NO: 1744215 - protein, 23 aa, Staphylococcus epidermidis
QEIRIKLTSNEPIKDSEWSVTGY

SEQ ID NO: 1744216 - protein, 23 aa, Staphylococcus epidermidis
QELNLKLKIVDVNAPTGNNRVYR

SEQ ID NO: 1744217 - protein, 21 aa, Staphylococcus epidermidis
QELYHLFKVSLISFMILFIGL

SEQ ID NO: 1744218 - protein, 19 aa, Staphylococcus epidermidis
QERQCPKCHKVVNVDDKFC

SEQ ID NO: 1744219 - protein, 24 aa, Staphylococcus epidermidis
QESGFTAGRVINKIKYDSSQKSIK

SEQ ID NO: 1744220 - protein, 22 aa, Staphylococcus epidermidis
QETNKILAVRFIDADTLTALQP

SEQ ID NO: 1744221 - protein, 19 aa, Staphylococcus epidermidis
QEVMQFFTPFGLWSYIGVI

SEQ ID NO: 1744222 - protein, 18 aa, Staphylococcus epidermidis
QFEFFRRDLLKEKMTTKN

SEQ ID NO: 1744223 - protein, 42 aa, Staphylococcus epidermidis
QFGTFEYTESAVAKVRYVDANTGKDIIPPKTIAGEVDATVNI

SEQ ID NO: 1744224 - protein, 42 aa, Staphylococcus epidermidis
QFGTFEYTESAVAKVRYVDANTGKDIIPPKTIAGEVDGTVNI

SEQ ID NO: 1744225 - protein, 17 aa, Staphylococcus epidermidis
QFKEIAIALTFVGGYVD

SEQ ID NO: 1744226 - protein, 23 aa, Staphylococcus epidermidis
QFKPLRFVVYSLLQFILGFIACF

SEQ ID NO: 1744227 - protein, 21 aa, Staphylococcus epidermidis
QFKRYARNAVTEFRTSEKLLI

SEQ ID NO: 1744228 - protein, 19 aa, Staphylococcus epidermidis
QFNQLKFSSILLAISLNSI

SEQ ID NO: 1744229 - protein, 23 aa, Staphylococcus epidermidis
QFRPLPIYRKGLLSVLVVVILAM

SEQ ID NO: 1744230 - protein, 25 aa, Staphylococcus epidermidis
QFVRLHRRVGAFSMVLLILHPVLFI

SEQ ID NO: 1744231 - protein, 21 aa, Staphylococcus epidermidis
QGDSIALWIVAIVAIVISLIA

SEQ ID NO: 1744232 - protein, 26 aa, Staphylococcus epidermidis
QGIAKAGSVFPILSPILGWIGVFMTG

SEQ ID NO: 1744233 - protein, 17 aa, Staphylococcus epidermidis
QGLALIIGVDRLLDMVR

SEQ ID NO: 1744234 - protein, 17 aa, Staphylococcus epidermidis
QGNGLLNGGLQGNKNEG

SEQ ID NO: 1744235 - protein, 24 aa, Staphylococcus epidermidis
QHDQLGAGVKPGTGTDQNTQVKPD

SEQ ID NO: 1744236 - protein, 24 aa, Staphylococcus epidermidis
QHHKGKDILYAWSPFIILTVIVMI

SEQ ID NO: 1744237 - protein, 25 aa, Staphylococcus epidermidis
QHIPNNLVLLPFVFVLLFVVFPSFS

SEQ ID NO: 1744238 - protein, 19 aa, Staphylococcus epidermidis
QHPLASAIMKRAEEANISY

SEQ ID NO: 1744239 - protein, 17 aa, Staphylococcus epidermidis
QHTFWFKFWSVIESGGW

SEQ ID NO: 1744240 - protein, 19 aa, Staphylococcus epidermidis
QIEGITFLLACYNESETVR

SEQ ID NO: 1744241 - protein, 18 aa, Staphylococcus epidermidis
QIIKRASITDGYRKIYRE

SEQ ID NO: 1744242 - protein, 24 aa, Staphylococcus epidermidis
QISDSKKAAPLIVAKRKKDKNEET

SEQ ID NO: 1744243 - protein, 25 aa, Staphylococcus epidermidis
QIYLGKAGFFFMLGVIQALIVSIGD

SEQ ID NO: 1744244 - protein, 32 aa, Staphylococcus epidermidis
QKEEKKPTVWIVLLSIIFVLLIAAVLYGGYYA

SEQ ID NO: 1744245 - protein, 23 aa, Staphylococcus epidermidis
QKFLRIGFIVLTILAAALSIFSF

SEQ ID NO: 1744246 - protein, 18 aa, Staphylococcus epidermidis
QKGGLGVVGRAYRSALNW

SEQ ID NO: 1744247 - protein, 17 aa, Staphylococcus epidermidis
QKGKFGIIYTNVGTYEG

SEQ ID NO: 1744248 - protein, 24 aa, Staphylococcus epidermidis
QKKPQARQALIAKVNEKQSAINTD

SEQ ID NO: 1744249 - protein, 24 aa, Staphylococcus epidermidis
QKKVPMKVLHEIQDFEVPKGIEDH

SEQ ID NO: 1744250 - protein, 23 aa, Staphylococcus epidermidis
QKKVPMKVVHEIQDFKVPKGIED

SEQ ID NO: 1744251 - protein, 18 aa, Staphylococcus epidermidis
QKLKRSNLLVPLDHKKIP

SEQ ID NO: 1744252 - protein, 20 aa, Staphylococcus epidermidis
QKPNESYAEYAKRIANSKVW

SEQ ID NO: 1744253 - protein, 24 aa, Staphylococcus epidermidis
QKPTARKAISDKASQLNNSINNTP

SEQ ID NO: 1744254 - protein, 24 aa, Staphylococcus epidermidis
QKPTRYTIMVGIDLLLIILILVTL

SEQ ID NO: 1744255 - protein, 20 aa, Staphylococcus epidermidis
QKQFNYRKNELFTIKLITFS

SEQ ID NO: 1744256 - protein, 31 aa, Staphylococcus epidermidis
QKQSIKDMISHAALRTEVKQLLQQAKILDEA

SEQ ID NO: 1744257 - protein, 31 aa, Staphylococcus epidermidis
QKQSLKDMISHAALRTEVKQLLQQAKVLDEA

SEQ ID NO: 1744258 - protein, 27 aa, Staphylococcus epidermidis
QKSKFRYIWTSLISFIFFVGVIIGISY

SEQ ID NO: 1744259 - protein, 23 aa, Staphylococcus epidermidis
QKSTRYTIMVGIDLVLIVLILVT

SEQ ID NO: 1744260 - protein, 17 aa, Staphylococcus epidermidis
QKVKSAFDYVNDLLGNN

SEQ ID NO: 1744261 - protein, 17 aa, Staphylococcus epidermidis
QKWLISFILVCNIFGTI

SEQ ID NO: 1744262 - protein, 19 aa, Staphylococcus epidermidis
QLDAFRLSLEKNKDTELLL

SEQ ID NO: 1744263 - protein, 19 aa, Staphylococcus epidermidis
QLDKLHLEREVSWLKNKDN

SEQ ID NO: 1744264 - protein, 18 aa, Staphylococcus epidermidis
QLEHLDRIRLSFFTYHRS

SEQ ID NO: 1744265 - protein, 25 aa, Staphylococcus epidermidis
QLHTNRIYFILSFVFMVTVPNTIYS

SEQ ID NO: 1744266 - protein, 24 aa, Staphylococcus epidermidis
QLHTNRIYFILSFVLMVTVPNTIY

SEQ ID NO: 1744267 - protein, 38 aa, Staphylococcus epidermidis
QLIYAETSLNGFERLNHARPRALEYIKSLEKINNAQKS

SEQ ID NO: 1744268 - protein, 18 aa, Staphylococcus epidermidis
QLLAPIIVLIIWNMTTHL

SEQ ID NO: 1744269 - protein, 23 aa, Staphylococcus epidermidis
QLLGASLWGVFALGNWPGVANKV

SEQ ID NO: 1744270 - protein, 19 aa, Staphylococcus epidermidis
QLLIALVVLIGFSLFMSNI

SEQ ID NO: 1744271 - protein, 18 aa, Staphylococcus epidermidis
QLLLFILSIFIVYYLFVH

SEQ ID NO: 1744272 - protein, 20 aa, Staphylococcus epidermidis
QLLYVIMSFIIVFFMAFIMN

SEQ ID NO: 1744273 - protein, 30 aa, Staphylococcus epidermidis
QLNNARTSLDRNVFFGPLGQSRSYTISYKL

SEQ ID NO: 1744274 - protein, 25 aa, Staphylococcus epidermidis
QLNNLKNSGYSYVSTDALQNSNYSE

SEQ ID NO: 1744275 - protein, 22 aa, Staphylococcus epidermidis
QLNQRLTDTINLLQPLANKESL

SEQ ID NO: 1744276 - protein, 25 aa, Staphylococcus epidermidis
QLQRLNRLFAKFGALIFIFLIAMFY

SEQ ID NO: 1744277 - protein, 18 aa, Staphylococcus epidermidis
QLSIAFVVNCLLLTLGAA

SEQ ID NO: 1744278 - protein, 24 aa, Staphylococcus epidermidis
QMLPGFILRSNWLGHMSKIESTQF

SEQ ID NO: 1744279 - protein, 17 aa, Staphylococcus epidermidis
QMLPGGYQKWAYGWNPF

SEQ ID NO: 1744280 - protein, 17 aa, Staphylococcus epidermidis
QMLPSKRNILLMFCPLL

SEQ ID NO: 1744281 - protein, 17 aa, Staphylococcus epidermidis
QMMFCTIAVSILSGSIA

SEQ ID NO: 1744282 - protein, 29 aa, Staphylococcus epidermidis
QMQAWGWRIPFILGLFLGLFGLYLRRKLE

SEQ ID NO: 1744283 - protein, 20 aa, Staphylococcus epidermidis
QMRRLELSRLLLMKPELVIF

SEQ ID NO: 1744284 - protein, 24 aa, Staphylococcus epidermidis
QMYLYEHFTSLKGFYDASFGLGGD

SEQ ID NO: 1744285 - protein, 23 aa, Staphylococcus epidermidis
QNAFKNYTYRKVISKGAHQIDGK

SEQ ID NO: 1744286 - protein, 25 aa, Staphylococcus epidermidis
QNGFKEIEAIKGLTSKEKTQFDKQL

SEQ ID NO: 1744287 - protein, 19 aa, Staphylococcus epidermidis
QNITGSFDLIATPKRETAI

SEQ ID NO: 1744288 - protein, 24 aa, Staphylococcus epidermidis
QNIYRIIWIFALFLSLAIMYYFLN

SEQ ID NO: 1744289 - protein, 23 aa, Staphylococcus epidermidis
QNKEDIKRSSAYINADPAKVTAY

SEQ ID NO: 1744290 - protein, 24 aa, Staphylococcus epidermidis
QNLTLNFMIVFLFIISATVIGVFL

SEQ ID NO: 1744291 - protein, 18 aa, Staphylococcus epidermidis
QNPELLKANIDQATQSVQ

SEQ ID NO: 1744292 - protein, 39 aa, Staphylococcus epidermidis
QNPKYAKYFSTVKNGKFIPGEVKVYEVTDTNAMVDSFNP

SEQ ID NO: 1744293 - protein, 17 aa, Staphylococcus epidermidis
QNPRNGDILAMAGKQID

SEQ ID NO: 1744294 - protein, 19 aa, Staphylococcus epidermidis
QNRIDEINQAFSATDEEKE

SEQ ID NO: 1744295 - protein, 24 aa, Staphylococcus epidermidis
QNRIKIFTKDDIQVVGDITTIANK

SEQ ID NO: 1744296 - protein, 27 aa, Staphylococcus epidermidis
QNRVLFDSRLNGMGPYPTGKLSAMVNI

SEQ ID NO: 1744297 - protein, 22 aa, Staphylococcus epidermidis
QNRYYRRGSANYKTNTVADDAK

SEQ ID NO: 1744298 - protein, 21 aa, Staphylococcus epidermidis
QNSIRLFCRYMLADHWEKNQN

SEQ ID NO: 1744299 - protein, 18 aa, Staphylococcus epidermidis
QNVKQMWTEEEFKPSKDL

SEQ ID NO: 1744300 - protein, 22 aa, Staphylococcus epidermidis
QNYPMEVTIANEVVKKDFIVDY

SEQ ID NO: 1744301 - protein, 25 aa, Staphylococcus epidermidis
QPASEGDAAGMLFAPKQVINGVQVG

SEQ ID NO: 1744302 - protein, 18 aa, Staphylococcus epidermidis
QPEALKKPQATSELNQNA

SEQ ID NO: 1744303 - protein, 19 aa, Staphylococcus epidermidis
QPEIRRALEQLGRGNFLKR

SEQ ID NO: 1744304 - protein, 23 aa, Staphylococcus epidermidis
QPFTWMIVAFCFIFLSLFIFTCF

SEQ ID NO: 1744305 - protein, 24 aa, Staphylococcus epidermidis
QPKHLPHGSYFRAVDTAANTVAST

SEQ ID NO: 1744306 - protein, 21 aa, Staphylococcus epidermidis
QPQIMLAIVMWLMGSITSTLT

SEQ ID NO: 1744307 - protein, 19 aa, Staphylococcus epidermidis
QPRTVLLIISAMITAFTFI

SEQ ID NO: 1744308 - protein, 18 aa, Staphylococcus epidermidis
QQAKESIRNTAEQRKQAI

SEQ ID NO: 1744309 - protein, 25 aa, Staphylococcus epidermidis
QQEIRIKLTSNEPIKDSEWSITGYP

SEQ ID NO: 1744310 - protein, 17 aa, Staphylococcus epidermidis
QQIKGMLIASFQGLIPI

SEQ ID NO: 1744311 - protein, 19 aa, Staphylococcus epidermidis
QQKSEVYVIKELDILNNAQ

SEQ ID NO: 1744312 - protein, 23 aa, Staphylococcus epidermidis
QQRRDPVGVGFYFSIGHSTVVFL

SEQ ID NO: 1744313 - protein, 24 aa, Staphylococcus epidermidis
QREHGGTLSDLFKGGKDNMISSIT

SEQ ID NO: 1744314 - protein, 25 aa, Staphylococcus epidermidis
QRIQQKANEIIQIIEANNNASAQAK

SEQ ID NO: 1744315 - protein, 21 aa, Staphylococcus epidermidis
QRKFIEWLIILSIFMVSIPNK

SEQ ID NO: 1744316 - protein, 23 aa, Staphylococcus epidermidis
QRKKALLFEWARINEMLDKQLYL

SEQ ID NO: 1744317 - protein, 20 aa, Staphylococcus epidermidis
QRLSAFQLLLLVFFSSTFTT

SEQ ID NO: 1744318 - protein, 19 aa, Staphylococcus epidermidis
QRLTDTINLLQPLANKESL

SEQ ID NO: 1744319 - protein, 23 aa, Staphylococcus epidermidis
QRNSEFTPQWYVEYDGNWYVYKD

SEQ ID NO: 1744320 - protein, 18 aa, Staphylococcus epidermidis
QRPGMFFKVEGFFYSHLD

SEQ ID NO: 1744321 - protein, 18 aa, Staphylococcus epidermidis
QRRYEWFGDIIAQLRADV

SEQ ID NO: 1744322 - protein, 23 aa, Staphylococcus epidermidis
QRSKWDILCYVFVACEVVVTIIL

SEQ ID NO: 1744323 - protein, 24 aa, Staphylococcus epidermidis
QRTLGAAVGWFWLVFTGGLNVLGA

SEQ ID NO: 1744324 - protein, 18 aa, Staphylococcus epidermidis
QRTPVYVYKWEDVQIQHG

SEQ ID NO: 1744325 - protein, 22 aa, Staphylococcus epidermidis
QSAGLSESLNFQVQKDKTNEVS

SEQ ID NO: 1744326 - protein, 17 aa, Staphylococcus epidermidis
QSMFTTMFLIIFIYTIL

SEQ ID NO: 1744327 - protein, 17 aa, Staphylococcus epidermidis
QSMTVRLGIATGKDLAQ

SEQ ID NO: 1744328 - protein, 20 aa, Staphylococcus epidermidis
QSNHPLAISIVDFAKSKNVS

SEQ ID NO: 1744329 - protein, 18 aa, Staphylococcus epidermidis
QSYILLGYPMKAQKDAHG

SEQ ID NO: 1744330 - protein, 18 aa, Staphylococcus epidermidis
QSYLLLGYPMKAQKGAQS

SEQ ID NO: 1744331 - protein, 18 aa, Staphylococcus epidermidis
QTAKKWWVGTAVAIAVIF

SEQ ID NO: 1744332 - protein, 19 aa, Staphylococcus epidermidis
QTILLKVRLPRVIEAVLTG

SEQ ID NO: 1744333 - protein, 18 aa, Staphylococcus epidermidis
QTLIKYGNIYAQVYSDQE

SEQ ID NO: 1744334 - protein, 25 aa, Staphylococcus epidermidis
QTLMPLTLLAMIAFYIAIFSIMKPD

SEQ ID NO: 1744335 - protein, 17 aa, Staphylococcus epidermidis
QTPRDANNVLTIDAPNN

SEQ ID NO: 1744336 - protein, 20 aa, Staphylococcus epidermidis
QTQAHAEEFERVTTGTVDTG

SEQ ID NO: 1744337 - protein, 28 aa, Staphylococcus epidermidis
QTQAHAEEFERVTTGTVDTGGQPARADQ

SEQ ID NO: 1744338 - protein, 22 aa, Staphylococcus epidermidis
QTSFRLKMHLIYQKNVILCTIP

SEQ ID NO: 1744339 - protein, 24 aa, Staphylococcus epidermidis
QVFKDIFPLSAVIIILYALDLLAR

SEQ ID NO: 1744340 - protein, 22 aa, Staphylococcus epidermidis
QVFSTRYLKMFIDSIWYAALIT

SEQ ID NO: 1744341 - protein, 19 aa, Staphylococcus epidermidis
QVIYYIFGAIMAFLIMIIS

SEQ ID NO: 1744342 - protein, 21 aa, Staphylococcus epidermidis
QVYGFFAIVFIIPFIVHIGYI

SEQ ID NO: 1744343 - protein, 28 aa, Staphylococcus epidermidis
QYKNQYPVIFVHGFVGLVGEDSFDLYPN

SEQ ID NO: 1744344 - protein, 24 aa, Staphylococcus epidermidis
QYLPLSWRRPLSIALFVILLATLF

SEQ ID NO: 1744345 - protein, 18 aa, Staphylococcus epidermidis
QYLSVILPGETFRNSFDW

SEQ ID NO: 1744346 - protein, 20 aa, Staphylococcus epidermidis
QYVVEWVTLLLLLFIIIIYI

SEQ ID NO: 1744347 - protein, 20 aa, Staphylococcus epidermidis
RAFTLIEMLLVLLIISLLLI

SEQ ID NO: 1744348 - protein, 20 aa, Staphylococcus epidermidis
RAGAVVPILLGMIAAFNMSK

SEQ ID NO: 1744349 - protein, 19 aa, Staphylococcus epidermidis
RAIIQYGTYARLHIFSRSH

SEQ ID NO: 1744350 - protein, 21 aa, Staphylococcus epidermidis
RAKIPAYLGSSFAFITPIITG

SEQ ID NO: 1744351 - protein, 23 aa, Staphylococcus epidermidis
RANARKALNEKAQEQNVAIDNNP

SEQ ID NO: 1744352 - protein, 22 aa, Staphylococcus epidermidis
RANRNFRFFQIFTAALQSFSHG

SEQ ID NO: 1744353 - protein, 24 aa, Staphylococcus epidermidis
RARHFGLMSACFGVGMVAGPVAGG

SEQ ID NO: 1744354 - protein, 19 aa, Staphylococcus epidermidis
RASITDGYRKIYREFELYS

SEQ ID NO: 1744355 - protein, 17 aa, Staphylococcus epidermidis
RCGLTAIILRIEILLEY

SEQ ID NO: 1744356 - protein, 20 aa, Staphylococcus epidermidis
RDLYNRTSRYSSRAPKRKDF

SEQ ID NO: 1744357 - protein, 40 aa, Staphylococcus epidermidis
RDNLDLKAASREQINEAIIAEALKKDFSNPDYGVDTPLAL

SEQ ID NO: 1744358 - protein, 28 aa, Staphylococcus epidermidis
RDRLPLSELYEGVGILETPFGYLISLDK

SEQ ID NO: 1744359 - protein, 35 aa, Staphylococcus epidermidis
REDERDTFNWARWLPHMTLSALNIRGFVYNQRTRD

SEQ ID NO: 1744360 - protein, 25 aa, Staphylococcus epidermidis
REEVKRKISEANANIRSYLLQNNPI

SEQ ID NO: 1744361 - protein, 25 aa, Staphylococcus epidermidis
REFISGVLLVPALVSFVWFSVFGVL

SEQ ID NO: 1744362 - protein, 22 aa, Staphylococcus epidermidis
REFSDGSLIKYTEMKWLTPDGH

SEQ ID NO: 1744363 - protein, 18 aa, Staphylococcus epidermidis
REIDALKLFSKNQSEYVT

SEQ ID NO: 1744364 - protein, 22 aa, Staphylococcus epidermidis
REIRAGRLIAISSFIFCILLII

SEQ ID NO: 1744365 - protein, 22 aa, Staphylococcus epidermidis
REKERMKKLLSFKPSDNKNIFE

SEQ ID NO: 1744366 - protein, 29 aa, Staphylococcus epidermidis
REQINEAIIAEALKKDFSNPDYGVDTPLA

SEQ ID NO: 1744367 - protein, 19 aa, Staphylococcus epidermidis
REVLKRYWLQIFGGIAVGT

SEQ ID NO: 1744368 - protein, 20 aa, Staphylococcus epidermidis
REVMTLPSIKVVEHPDLFVE

SEQ ID NO: 1744369 - protein, 22 aa, Staphylococcus epidermidis
REWMSTWTLYYWGWWLSWSPFV

SEQ ID NO: 1744370 - protein, 17 aa, Staphylococcus epidermidis
RFDKSRILDHQDDLAQK

SEQ ID NO: 1744371 - protein, 18 aa, Staphylococcus epidermidis
RFGPKKILIFGLICLVVT

SEQ ID NO: 1744372 - protein, 18 aa, Staphylococcus epidermidis
RFNQITGMNENEIRYLFN

SEQ ID NO: 1744373 - protein, 23 aa, Staphylococcus epidermidis
RFPKKRTLLIYQVILCISLLTMA

SEQ ID NO: 1744374 - protein, 27 aa, Staphylococcus epidermidis
RFTLEMYRFEYPITFATSIFASIFTSA

SEQ ID NO: 1744375 - protein, 27 aa, Staphylococcus epidermidis
RFTLEMYRFEYPITFVTSIFASIFTSA

SEQ ID NO: 1744376 - protein, 25 aa, Staphylococcus epidermidis
RFYICIVNLSILLIIFILSYFNNTK

SEQ ID NO: 1744377 - protein, 19 aa, Staphylococcus epidermidis
RGKVLSIVMMDRGMIPLGS

SEQ ID NO: 1744378 - protein, 20 aa, Staphylococcus epidermidis
RGTPMLVQVFIVFFGTTAAL

SEQ ID NO: 1744379 - protein, 22 aa, Staphylococcus epidermidis
RGTVNPAKWLKGHGGGGKVGGS

SEQ ID NO: 1744380 - protein, 24 aa, Staphylococcus epidermidis
RHEYEVMKKIGLEQSLIKQIINKQ

SEQ ID NO: 1744381 - protein, 18 aa, Staphylococcus epidermidis
RHLKRYKDIEEILSHGID

SEQ ID NO: 1744382 - protein, 20 aa, Staphylococcus epidermidis
RHLVLFPGILLQGAAIAALV

SEQ ID NO: 1744383 - protein, 24 aa, Staphylococcus epidermidis
RHPNDLNMPFGFKKKALIKDGKDQ

SEQ ID NO: 1744384 - protein, 20 aa, Staphylococcus epidermidis
RHRSSAFKLWGGKIIAYIVL

SEQ ID NO: 1744385 - protein, 22 aa, Staphylococcus epidermidis
RIALGIGGAVAAVALTRKDSRD

SEQ ID NO: 1744386 - protein, 21 aa, Staphylococcus epidermidis
RIGELSTLIYLIFPILAIFVD

SEQ ID NO: 1744387 - protein, 29 aa, Staphylococcus epidermidis
RIGGSKALNLNLGFAQWGFKQKPNESYAE

SEQ ID NO: 1744388 - protein, 20 aa, Staphylococcus epidermidis
RIIIATGIMFTGTLTYQTME

SEQ ID NO: 1744389 - protein, 19 aa, Staphylococcus epidermidis
RIIPANMIGAMFASVIAAI

SEQ ID NO: 1744390 - protein, 17 aa, Staphylococcus epidermidis
RIIVGLRGMLLKRRVKT

SEQ ID NO: 1744391 - protein, 20 aa, Staphylococcus epidermidis
RIKQTWHWFVISFVIGLVFI

SEQ ID NO: 1744392 - protein, 20 aa, Staphylococcus epidermidis
RILPKIPYKVYVIIFTLISF

SEQ ID NO: 1744393 - protein, 23 aa, Staphylococcus epidermidis
RILRPAEIVKYLIITFLVLVANS

SEQ ID NO: 1744394 - protein, 28 aa, Staphylococcus epidermidis
RISHLVLTRTGLYIIDSQLLKGHVYNGI

SEQ ID NO: 1744395 - protein, 20 aa, Staphylococcus epidermidis
RISIARAFLKQAPIILLDEA

SEQ ID NO: 1744396 - protein, 20 aa, Staphylococcus epidermidis
RITVLEIIGGVLGILMIAFG

SEQ ID NO: 1744397 - protein, 26 aa, Staphylococcus epidermidis
RIYKKIKHVCVGIFLVILSISILLLM

SEQ ID NO: 1744398 - protein, 17 aa, Staphylococcus epidermidis
RKAQRMAKTEIPDEIET

SEQ ID NO: 1744399 - protein, 21 aa, Staphylococcus epidermidis
RKASLQYSFLMNIIASFVACG

SEQ ID NO: 1744400 - protein, 20 aa, Staphylococcus epidermidis
RKAVEALYYNRYLKQHDQVI

SEQ ID NO: 1744401 - protein, 18 aa, Staphylococcus epidermidis
RKEATPLSPIVEANEERV

SEQ ID NO: 1744402 - protein, 26 aa, Staphylococcus epidermidis
RKEFSVSKRAGHGVFQVMSGTLHNTV

SEQ ID NO: 1744403 - protein, 19 aa, Staphylococcus epidermidis
RKGVLSVFNALKKGVSVIF

SEQ ID NO: 1744404 - protein, 26 aa, Staphylococcus epidermidis
RKHLKLGETFFGYLIWYSIGRFFVEG

SEQ ID NO: 1744405 - protein, 19 aa, Staphylococcus epidermidis
RKIINQFSMGIRITDQQFF

SEQ ID NO: 1744406 - protein, 17 aa, Staphylococcus epidermidis
RKISLPNVEDFDTLAGR

SEQ ID NO: 1744407 - protein, 30 aa, Staphylococcus epidermidis
RKKDLKRFRVKGGHAESFFPSKLPLINLRM

SEQ ID NO: 1744408 - protein, 19 aa, Staphylococcus epidermidis
RKKPFLSMMPVVAMYSLWL

SEQ ID NO: 1744409 - protein, 20 aa, Staphylococcus epidermidis
RKKPFLSMMPVVAMYSLWLT

SEQ ID NO: 1744410 - protein, 17 aa, Staphylococcus epidermidis
RKLDIEIDQFIDKLEAF

SEQ ID NO: 1744411 - protein, 22 aa, Staphylococcus epidermidis
RKNCWLWYIWDIIFDVIYYSII

SEQ ID NO: 1744412 - protein, 18 aa, Staphylococcus epidermidis
RKNGYKNIYMLKGGYKKW

SEQ ID NO: 1744413 - protein, 24 aa, Staphylococcus epidermidis
RKNGYKNIYMLKGGYKKWTGKIKS

SEQ ID NO: 1744414 - protein, 40 aa, Staphylococcus epidermidis
RKNIQWKSILILVILNLFLAWFFIYFDWGRNGVKGAANGI

SEQ ID NO: 1744415 - protein, 26 aa, Staphylococcus epidermidis
RKNKRLRKLPFIILIFLIILIALIVY

SEQ ID NO: 1744416 - protein, 24 aa, Staphylococcus epidermidis
RKNYKFRVATYMSINLLSGYNIPF

SEQ ID NO: 1744417 - protein, 28 aa, Staphylococcus epidermidis
RKQNESPLRYLIAISIVILVVLGAFQLG

SEQ ID NO: 1744418 - protein, 19 aa, Staphylococcus epidermidis
RKRRRKARHKDWKERDRQE

SEQ ID NO: 1744419 - protein, 18 aa, Staphylococcus epidermidis
RKYFPFLTLITAFASLAW

SEQ ID NO: 1744420 - protein, 20 aa, Staphylococcus epidermidis
RKYSRISIVISKIITLFIYS

SEQ ID NO: 1744421 - protein, 18 aa, Staphylococcus epidermidis
RLAPEIMYNNIVKHQAQD

SEQ ID NO: 1744422 - protein, 23 aa, Staphylococcus epidermidis
RLDNLRPQIYVILNTKKDQEGKR

SEQ ID NO: 1744423 - protein, 18 aa, Staphylococcus epidermidis
RLGRYCTFTKVTIDEENN

SEQ ID NO: 1744424 - protein, 19 aa, Staphylococcus epidermidis
RLGRYCTFTKVTIDEENNS

SEQ ID NO: 1744425 - protein, 18 aa, Staphylococcus epidermidis
RLINFMILIITKYWITYF

SEQ ID NO: 1744426 - protein, 17 aa, Staphylococcus epidermidis
RLLKIKTYETITVKDIC

SEQ ID NO: 1744427 - protein, 21 aa, Staphylococcus epidermidis
RLLKNPFNYIGLLFILIIPIF

SEQ ID NO: 1744428 - protein, 22 aa, Staphylococcus epidermidis
RLLPAVLALLIVVGFATLVLEP

SEQ ID NO: 1744429 - protein, 24 aa, Staphylococcus epidermidis
RLLPKARRLGISWMAIGLLGAVGV

SEQ ID NO: 1744430 - protein, 24 aa, Staphylococcus epidermidis
RLLRDFKVGLFILTVSLILINNFY

SEQ ID NO: 1744431 - protein, 25 aa, Staphylococcus epidermidis
RLLRDFKVGLFILTVSLILINNFYF

SEQ ID NO: 1744432 - protein, 20 aa, Staphylococcus epidermidis
RLMAMLIYLLSLFTGIIGPL

SEQ ID NO: 1744433 - protein, 19 aa, Staphylococcus epidermidis
RLNQVLALIVLFLLIILPL

SEQ ID NO: 1744434 - protein, 19 aa, Staphylococcus epidermidis
RLPDYLKIITLIEVVIIFI

SEQ ID NO: 1744435 - protein, 19 aa, Staphylococcus epidermidis
RLSDKYSRLNIYIFGLTIF

SEQ ID NO: 1744436 - protein, 22 aa, Staphylococcus epidermidis
RLSEEEARAYLKYIKAENDLKY

SEQ ID NO: 1744437 - protein, 25 aa, Staphylococcus epidermidis
RLSKAKAKAIQYVQSLSYINDAQRH

SEQ ID NO: 1744438 - protein, 26 aa, Staphylococcus epidermidis
RLSLARLLLRPSADFWILDEPTTALD

SEQ ID NO: 1744439 - protein, 21 aa, Staphylococcus epidermidis
RLSVSGDIFFKHQNLNTITEK

SEQ ID NO: 1744440 - protein, 17 aa, Staphylococcus epidermidis
RLSWIFYVAMIIFTIMI

SEQ ID NO: 1744441 - protein, 26 aa, Staphylococcus epidermidis
RLTLMRRGIENINMFTFIQLLTPFVT

SEQ ID NO: 1744442 - protein, 28 aa, Staphylococcus epidermidis
RLVTLAIITIIALLFVGCTMEIGGNIKE

SEQ ID NO: 1744443 - protein, 23 aa, Staphylococcus epidermidis
RMIELPLSLSVIIGGIRIALVVA

SEQ ID NO: 1744444 - protein, 17 aa, Staphylococcus epidermidis
RMKAPMLNLEVLKYPTY

SEQ ID NO: 1744445 - protein, 21 aa, Staphylococcus epidermidis
RMQREHVHMSLIIDEYGGTAG

SEQ ID NO: 1744446 - protein, 24 aa, Staphylococcus epidermidis
RMRHYRTVLPITLFKQKNYAASSI

SEQ ID NO: 1744447 - protein, 21 aa, Staphylococcus epidermidis
RMRKLPFIILIILIILISIIV

SEQ ID NO: 1744448 - protein, 18 aa, Staphylococcus epidermidis
RNAKSDIDIKAADKKIKI

SEQ ID NO: 1744449 - protein, 19 aa, Staphylococcus epidermidis
RNALFNHIFTWVFTAIGFF

SEQ ID NO: 1744450 - protein, 19 aa, Staphylococcus epidermidis
RNALQVAISIFCMSIPIIM

SEQ ID NO: 1744451 - protein, 24 aa, Staphylococcus epidermidis
RNDNPRINLLAATEDTKPKTYIKP

SEQ ID NO: 1744452 - protein, 24 aa, Staphylococcus epidermidis
RNDNPRINLLAATEDTKPKTYKKP

SEQ ID NO: 1744453 - protein, 20 aa, Staphylococcus epidermidis
RNFGKEAAMIAGYEHSTMHD

SEQ ID NO: 1744454 - protein, 19 aa, Staphylococcus epidermidis
RNFGKEAAMIAGYQNSINH

SEQ ID NO: 1744455 - protein, 24 aa, Staphylococcus epidermidis
RNGVKGAANGIAWVIESAHQGTGF

SEQ ID NO: 1744456 - protein, 19 aa, Staphylococcus epidermidis
RNIFKYIYHNFIFLIGIFC

SEQ ID NO: 1744457 - protein, 27 aa, Staphylococcus epidermidis
RNKRIVAYIVCSISLLIQAPLLSAHVQ

SEQ ID NO: 1744458 - protein, 24 aa, Staphylococcus epidermidis
RNRKRKRFGDKVNEEELANHEHQR

SEQ ID NO: 1744459 - protein, 18 aa, Staphylococcus epidermidis
RNSLGMTYESYFNQYKVY

SEQ ID NO: 1744460 - protein, 27 aa, Staphylococcus epidermidis
RNTMNKRINFVFGFIVLIFAILVLRLG

SEQ ID NO: 1744461 - protein, 23 aa, Staphylococcus epidermidis
RNVKSQSNIFGWIFIAFALLIII

SEQ ID NO: 1744462 - protein, 18 aa, Staphylococcus epidermidis
RNWLDTRAFSKKFVPVVM

SEQ ID NO: 1744463 - protein, 21 aa, Staphylococcus epidermidis
RPANWLKKGINLFLLAVFPAN

SEQ ID NO: 1744464 - protein, 23 aa, Staphylococcus epidermidis
RPDVKGREAILHVHARNKPLDET

SEQ ID NO: 1744465 - protein, 22 aa, Staphylococcus epidermidis
RPENHLSIDTGWSFPSGHSNIN

SEQ ID NO: 1744466 - protein, 19 aa, Staphylococcus epidermidis
RPFRFRKLVLMLVVSVIVL

SEQ ID NO: 1744467 - protein, 21 aa, Staphylococcus epidermidis
RPIGVYILLMLGMSTVTIIFG

SEQ ID NO: 1744468 - protein, 17 aa, Staphylococcus epidermidis
RPLRFKKLAVMLLLSIF

SEQ ID NO: 1744469 - protein, 18 aa, Staphylococcus epidermidis
RPLYLGAMGTFLIGSIVA

SEQ ID NO: 1744470 - protein, 29 aa, Staphylococcus epidermidis
RPTGTGNVYTEYWLTRDGTTNTNDFYRGT

SEQ ID NO: 1744471 - protein, 20 aa, Staphylococcus epidermidis
RQLLYVIMSFVIVFFMAFIM

SEQ ID NO: 1744472 - protein, 21 aa, Staphylococcus epidermidis
RQNIGLKFSEVDNVLKLKNWY

SEQ ID NO: 1744473 - protein, 21 aa, Staphylococcus epidermidis
RQNIKHYGMFLFSLLLSIVLY

SEQ ID NO: 1744474 - protein, 17 aa, Staphylococcus epidermidis
RQPKFESFFGVEMMFLG

SEQ ID NO: 1744475 - protein, 17 aa, Staphylococcus epidermidis
RQQNIINSNLGHRNQNN

SEQ ID NO: 1744476 - protein, 18 aa, Staphylococcus epidermidis
RQRQRLFGKHDVNHINQY

SEQ ID NO: 1744477 - protein, 27 aa, Staphylococcus epidermidis
RQSKEVFQLLMWMGFIILISLIVWILA

SEQ ID NO: 1744478 - protein, 22 aa, Staphylococcus epidermidis
RQSKNFWQDAWSQLKRNKLAVI

SEQ ID NO: 1744479 - protein, 25 aa, Staphylococcus epidermidis
RQSLPLSKLYTGVGVLQSDDEGMVI

SEQ ID NO: 1744480 - protein, 20 aa, Staphylococcus epidermidis
RQVFLTGILIFFIGTIVGGF

SEQ ID NO: 1744481 - protein, 17 aa, Staphylococcus epidermidis
RRDRIETVPSYYNDYDQ

SEQ ID NO: 1744482 - protein, 25 aa, Staphylococcus epidermidis
RRKKEFALNMVLGMEKKHLRLIILI

SEQ ID NO: 1744483 - protein, 20 aa, Staphylococcus epidermidis
RRLTIKNVRRLSSFSDIFVN

SEQ ID NO: 1744484 - protein, 17 aa, Staphylococcus epidermidis
RRNTLYTAIVLLIALVL

SEQ ID NO: 1744485 - protein, 20 aa, Staphylococcus epidermidis
RRPMPLRAFNPVSSFRWARG

SEQ ID NO: 1744486 - protein, 26 aa, Staphylococcus epidermidis
RRQPSLPIKFVIGALMAGASYIMMGI

SEQ ID NO: 1744487 - protein, 26 aa, Staphylococcus epidermidis
RRQRHKRIQYTIITLLVLLIVIFLLY

SEQ ID NO: 1744488 - protein, 19 aa, Staphylococcus epidermidis
RSAKKMRYMPGLDGLRAIA

SEQ ID NO: 1744489 - protein, 23 aa, Staphylococcus epidermidis
RSDDEFYSFVAVTVVFYLIFTFI

SEQ ID NO: 1744490 - protein, 17 aa, Staphylococcus epidermidis
RSDITLRVHEQRSKVRF

SEQ ID NO: 1744491 - protein, 23 aa, Staphylococcus epidermidis
RSILVPLKAVLGFVLSLLATLGF

SEQ ID NO: 1744492 - protein, 19 aa, Staphylococcus epidermidis
RSLDKFKSHYDIFKDFNLN

SEQ ID NO: 1744493 - protein, 17 aa, Staphylococcus epidermidis
RSLFHVVAPIAAITFII

SEQ ID NO: 1744494 - protein, 22 aa, Staphylococcus epidermidis
RSRGMFRLVSGMTFANNPLNMM

SEQ ID NO: 1744495 - protein, 17 aa, Staphylococcus epidermidis
RSRNILRASDVQGNAYI

SEQ ID NO: 1744496 - protein, 23 aa, Staphylococcus epidermidis
RSRRRDFWWPFLINTILSGIIGV

SEQ ID NO: 1744497 - protein, 17 aa, Staphylococcus epidermidis
RSVAFFLTALPSYWIAS

SEQ ID NO: 1744498 - protein, 20 aa, Staphylococcus epidermidis
RTAILLAAVMNFIGALTFTG

SEQ ID NO: 1744499 - protein, 21 aa, Staphylococcus epidermidis
RTEVAQKLAVAKELNSAMSNL

SEQ ID NO: 1744500 - protein, 24 aa, Staphylococcus epidermidis
RTILTLKGYRYIAAAVSFLEVLVY

SEQ ID NO: 1744501 - protein, 30 aa, Staphylococcus epidermidis
RTITLPLLRPGIFSGWILIFCISMRELVAS

SEQ ID NO: 1744502 - protein, 27 aa, Staphylococcus epidermidis
RTKLLEYRKPIILMAMALVFTTVIGVG

SEQ ID NO: 1744503 - protein, 21 aa, Staphylococcus epidermidis
RTNRNFRFFQIFTAALQSFSH

SEQ ID NO: 1744504 - protein, 21 aa, Staphylococcus epidermidis
RTRPTSFMIPGFFVITVSVIT

SEQ ID NO: 1744505 - protein, 25 aa, Staphylococcus epidermidis
RTRRSIGAIVLQLALLFIAQLYFHF

SEQ ID NO: 1744506 - protein, 25 aa, Staphylococcus epidermidis
RTRRSIGAIVLQLALLFITQLYFHF

SEQ ID NO: 1744507 - protein, 19 aa, Staphylococcus epidermidis
RTSYRLLHWQYKDTITVLL

SEQ ID NO: 1744508 - protein, 17 aa, Staphylococcus epidermidis
RTVRYGYTAAFILVILQ

SEQ ID NO: 1744509 - protein, 17 aa, Staphylococcus epidermidis
RTVRYGYTASFILVILQ

SEQ ID NO: 1744510 - protein, 24 aa, Staphylococcus epidermidis
RTVTDLRPAGIITCDDERIDAVSD

SEQ ID NO: 1744511 - protein, 20 aa, Staphylococcus epidermidis
RTYIKIPLLLGLIILPVYKI

SEQ ID NO: 1744512 - protein, 20 aa, Staphylococcus epidermidis
RTYVLSIFIILLLTLIFANF

SEQ ID NO: 1744513 - protein, 17 aa, Staphylococcus epidermidis
RTYYYRVPFSYKDIIFV

SEQ ID NO: 1744514 - protein, 22 aa, Staphylococcus epidermidis
RVDESYKYRIKGVVGNNETIND

SEQ ID NO: 1744515 - protein, 17 aa, Staphylococcus epidermidis
RVDGCNDFQIFWKIVLP

SEQ ID NO: 1744516 - protein, 24 aa, Staphylococcus epidermidis
RVFPEIVTALIFIKAVGPGSFSGV

SEQ ID NO: 1744517 - protein, 21 aa, Staphylococcus epidermidis
RVGPIKVLRIILFINACALIL

SEQ ID NO: 1744518 - protein, 21 aa, Staphylococcus epidermidis
RVGPIKVLRIILLINAMALVL

SEQ ID NO: 1744519 - protein, 18 aa, Staphylococcus epidermidis
RVGYKSIEFSFIKRTDET

SEQ ID NO: 1744520 - protein, 17 aa, Staphylococcus epidermidis
RVHFSRIIGKPGESIEI

SEQ ID NO: 1744521 - protein, 18 aa, Staphylococcus epidermidis
RVKEAGGHIPEDLDVQVT

SEQ ID NO: 1744522 - protein, 18 aa, Staphylococcus epidermidis
RVLGRPAGFVVTFLDIFK

SEQ ID NO: 1744523 - protein, 19 aa, Staphylococcus epidermidis
RVTMPRKEATPHSPIVEAN

SEQ ID NO: 1744524 - protein, 19 aa, Staphylococcus epidermidis
RVTMPRKEATPHSPIVETN

SEQ ID NO: 1744525 - protein, 18 aa, Staphylococcus epidermidis
RVTNFRFSLFTKITTSTY

SEQ ID NO: 1744526 - protein, 18 aa, Staphylococcus epidermidis
RVTVFMGAQSLVFYTIIN

SEQ ID NO: 1744527 - protein, 18 aa, Staphylococcus epidermidis
RWLIISISIFIIMMLILN

SEQ ID NO: 1744528 - protein, 18 aa, Staphylococcus epidermidis
RWWLMNLVLGIMYFIIWI

SEQ ID NO: 1744529 - protein, 19 aa, Staphylococcus epidermidis
RYGRTYKGIIPDWEPGKKV

SEQ ID NO: 1744530 - protein, 25 aa, Staphylococcus epidermidis
RYINTLFIMSWIQLVAGLTRANQPW

SEQ ID NO: 1744531 - protein, 24 aa, Staphylococcus epidermidis
RYKVIDKLGGGGMSIVYLAEDTIL

SEQ ID NO: 1744532 - protein, 26 aa, Staphylococcus epidermidis
RYLNKRMSLKISFSIILITGLIIWSF

SEQ ID NO: 1744533 - protein, 21 aa, Staphylococcus epidermidis
RYLVAIIACLLWFFFKDHINI

SEQ ID NO: 1744534 - protein, 23 aa, Staphylococcus epidermidis
RYLVYKFRPLKVIATDEDITSPI

SEQ ID NO: 1744535 - protein, 17 aa, Staphylococcus epidermidis
RYMPGLDGLRAIAVLGI

SEQ ID NO: 1744536 - protein, 18 aa, Staphylococcus epidermidis
RYNEAISNIRSELDTAKA

SEQ ID NO: 1744537 - protein, 25 aa, Staphylococcus epidermidis
RYQLILRLSLKIDVNLMKDYFYHVL

SEQ ID NO: 1744538 - protein, 18 aa, Staphylococcus epidermidis
RYRTLKKVVLKSIWFNII

SEQ ID NO: 1744539 - protein, 21 aa, Staphylococcus epidermidis
RYSIGLLVFVCIWTFILSFIL

SEQ ID NO: 1744540 - protein, 21 aa, Staphylococcus epidermidis
RYVNADSGLQANYNSALNYGS

SEQ ID NO: 1744541 - protein, 23 aa, Staphylococcus epidermidis
RYVNADSGLQANYNSALNYGSQI

SEQ ID NO: 1744542 - protein, 18 aa, Staphylococcus epidermidis
SAAKDVWINGFSPQYTMS

SEQ ID NO: 1744543 - protein, 26 aa, Staphylococcus epidermidis
SAAYFYSLYEMIQWLTHHVNEPHLYF

SEQ ID NO: 1744544 - protein, 24 aa, Staphylococcus epidermidis
SAGKLRKKETVSIKHERSESNTYR

SEQ ID NO: 1744545 - protein, 17 aa, Staphylococcus epidermidis
SAGMGIGLVFYGAAEPM

SEQ ID NO: 1744546 - protein, 25 aa, Staphylococcus epidermidis
SAGYIFRFGFNLVDGVNNITEITIQ

SEQ ID NO: 1744547 - protein, 24 aa, Staphylococcus epidermidis
SAGYRAQLTLSIGVGEGTENLIDL

SEQ ID NO: 1744548 - protein, 25 aa, Staphylococcus epidermidis
SAILPRGYPVSVLILLGLMIGALFN

SEQ ID NO: 1744549 - protein, 26 aa, Staphylococcus epidermidis
SAKLFGELEFWFAIIKIATIIALIVV

SEQ ID NO: 1744550 - protein, 26 aa, Staphylococcus epidermidis
SAKLFGELEFWFAIIKIVTIIALIVI

SEQ ID NO: 1744551 - protein, 20 aa, Staphylococcus epidermidis
SALFPILLIVPLFDILMYFN

SEQ ID NO: 1744552 - protein, 20 aa, Staphylococcus epidermidis
SALFPILLVVPLFDILMYFN

SEQ ID NO: 1744553 - protein, 20 aa, Staphylococcus epidermidis
SAMMTEAFVASNYAFAVIFI

SEQ ID NO: 1744554 - protein, 24 aa, Staphylococcus epidermidis
SANEMQASVSIVPAVESDKLKVHY

SEQ ID NO: 1744555 - protein, 28 aa, Staphylococcus epidermidis
SAQAKLAAKALVSKILDDAYEEINEANH

SEQ ID NO: 1744556 - protein, 24 aa, Staphylococcus epidermidis
SARETFDSWMEVDYLDSYDSGAPN

SEQ ID NO: 1744557 - protein, 24 aa, Staphylococcus epidermidis
SARETFDSWMEVDYLDSYDSGTPN

SEQ ID NO: 1744558 - protein, 19 aa, Staphylococcus epidermidis
SASIKASESASTSKKLSES

SEQ ID NO: 1744559 - protein, 20 aa, Staphylococcus epidermidis
SASKRYGLAIKDLGNTAKLA

SEQ ID NO: 1744560 - protein, 26 aa, Staphylococcus epidermidis
SCTHSGCGCMLGCLTISLISFLLSLL

SEQ ID NO: 1744561 - protein, 44 aa, Staphylococcus epidermidis
SDDKKKGGFMKILLPLIAAILILGAIAIFGGMALNNHNDSKSDD

SEQ ID NO: 1744562 - protein, 23 aa, Staphylococcus epidermidis
SDDSTKMVIKYLDLEDQINSITA

SEQ ID NO: 1744563 - protein, 20 aa, Staphylococcus epidermidis
SDFSTASLLVNEFSKDQKEE

SEQ ID NO: 1744564 - protein, 25 aa, Staphylococcus epidermidis
SDGLSEFYALVLFAGLFHLMNHAIF

SEQ ID NO: 1744565 - protein, 22 aa, Staphylococcus epidermidis
SDGLWHHRFMMIVLTLLMIASI

SEQ ID NO: 1744566 - protein, 29 aa, Staphylococcus epidermidis
SDILTSFKLPGLIKYGFNINERYIKSLSY

SEQ ID NO: 1744567 - protein, 21 aa, Staphylococcus epidermidis
SDKFAGISWSHWLGTDHLGRD

SEQ ID NO: 1744568 - protein, 28 aa, Staphylococcus epidermidis
SDKFRVNFKIVLPGAILTIIILFLLTNG

SEQ ID NO: 1744569 - protein, 21 aa, Staphylococcus epidermidis
SDKNAKDKLPDTGANEDHDSK

SEQ ID NO: 1744570 - protein, 19 aa, Staphylococcus epidermidis
SDLKKRYAQRLLQFPHAHN

SEQ ID NO: 1744571 - protein, 24 aa, Staphylococcus epidermidis
SDLNLSALFHKINFNFTAIGEMKL

SEQ ID NO: 1744572 - protein, 23 aa, Staphylococcus epidermidis
SDPMKAVISVNVLKFENTELHAL

SEQ ID NO: 1744573 - protein, 20 aa, Staphylococcus epidermidis
SDSTFLLWLAIGLVFGSAPP

SEQ ID NO: 1744574 - protein, 17 aa, Staphylococcus epidermidis
SDSTRTSTSDSASTSKS

SEQ ID NO: 1744575 - protein, 26 aa, Staphylococcus epidermidis
SDVFGRKRVAMILMIGYFIASMISVF

SEQ ID NO: 1744576 - protein, 22 aa, Staphylococcus epidermidis
SDVNVWLSFVLLAFVFIVGPTV

SEQ ID NO: 1744577 - protein, 24 aa, Staphylococcus epidermidis
SDVVPWPTLFFGMFFNNLFFWCAN

SEQ ID NO: 1744578 - protein, 17 aa, Staphylococcus epidermidis
SDWLRKKTGSLRIARSY

SEQ ID NO: 1744579 - protein, 20 aa, Staphylococcus epidermidis
SDYVKSYYFLFCIVIIIALV

SEQ ID NO: 1744580 - protein, 26 aa, Staphylococcus epidermidis
SEDHLKFSLFLAMLIACLLIQAATNM

SEQ ID NO: 1744581 - protein, 25 aa, Staphylococcus epidermidis
SEDHLKFSLFLAMLVACLLIQAATN

SEQ ID NO: 1744582 - protein, 21 aa, Staphylococcus epidermidis
SEDYSRLAGVSDIDSTSDSVV

SEQ ID NO: 1744583 - protein, 21 aa, Staphylococcus epidermidis
SEEEARAYLNYIKEEDDLTHV

SEQ ID NO: 1744584 - protein, 29 aa, Staphylococcus epidermidis
SEEKILLALLLYRFAYYFVPVLIALVLST

SEQ ID NO: 1744585 - protein, 27 aa, Staphylococcus epidermidis
SEEKILLALVLYRFAYYFVPVMIALIL

SEQ ID NO: 1744586 - protein, 32 aa, Staphylococcus epidermidis
SEEWGRPWVFSRVFLALGITFLALWVLTNVFG

SEQ ID NO: 1744587 - protein, 18 aa, Staphylococcus epidermidis
SEIAHKPIVLSLNIIGQT

SEQ ID NO: 1744588 - protein, 20 aa, Staphylococcus epidermidis
SEIKKNSSYERIYDKAKKQG

SEQ ID NO: 1744589 - protein, 21 aa, Staphylococcus epidermidis
SEIKQLYPFIFNTLYNAIAQL

SEQ ID NO: 1744590 - protein, 21 aa, Staphylococcus epidermidis
SEIKTSQALLILDAIIVLSFI

SEQ ID NO: 1744591 - protein, 17 aa, Staphylococcus epidermidis
SEIKYNSKNTFKYETYV

SEQ ID NO: 1744592 - protein, 21 aa, Staphylococcus epidermidis
SEIQLTLSFAMIGLALGQFLF

SEQ ID NO: 1744593 - protein, 20 aa, Staphylococcus epidermidis
SEIRIPRDLGAVLVGMALAV

SEQ ID NO: 1744594 - protein, 24 aa, Staphylococcus epidermidis
SEKARRLLIQLSQFFRSNLNGARN

SEQ ID NO: 1744595 - protein, 20 aa, Staphylococcus epidermidis
SEKEAYEQAIAKGQEIINAE

SEQ ID NO: 1744596 - protein, 21 aa, Staphylococcus epidermidis
SEKEAYEQAIAKGQEIINSEN

SEQ ID NO: 1744597 - protein, 20 aa, Staphylococcus epidermidis
SEKHKGKAIAFTVGGMSVGA

SEQ ID NO: 1744598 - protein, 20 aa, Staphylococcus epidermidis
SEKHKGKAIAFTVGGMSVGT

SEQ ID NO: 1744599 - protein, 39 aa, Staphylococcus epidermidis
SEKLNEAIPVFAGVIVLLAFVLLVFVFRSILVPLKAVLG

SEQ ID NO: 1744600 - protein, 21 aa, Staphylococcus epidermidis
SEKLNKLLLIISLLSIFQVVE

SEQ ID NO: 1744601 - protein, 21 aa, Staphylococcus epidermidis
SELLKIAIILYIPFMIEKKMP

SEQ ID NO: 1744602 - protein, 22 aa, Staphylococcus epidermidis
SELLKIAIILYIPFMIEKKMPA

SEQ ID NO: 1744603 - protein, 22 aa, Staphylococcus epidermidis
SELMLNRILKHLIRAEDKGMLA

SEQ ID NO: 1744604 - protein, 22 aa, Staphylococcus epidermidis
SENTMILGWIFYFFLGGYIGYN

SEQ ID NO: 1744605 - protein, 17 aa, Staphylococcus epidermidis
SEPTNYTNLSFKILPMN

SEQ ID NO: 1744606 - protein, 25 aa, Staphylococcus epidermidis
SEPVNLNYSSPFMSLLSMPADSSSN

SEQ ID NO: 1744607 - protein, 26 aa, Staphylococcus epidermidis
SEPVNLNYSSPFMSLLSMPADSSSNN

SEQ ID NO: 1744608 - protein, 23 aa, Staphylococcus epidermidis
SESIRYYLHPVIAKLFDIILTVF

SEQ ID NO: 1744609 - protein, 22 aa, Staphylococcus epidermidis
SESKIFFKLILPLSKRSILSGI

SEQ ID NO: 1744610 - protein, 20 aa, Staphylococcus epidermidis
SESNTYRLGDEVRSQTFSHI

SEQ ID NO: 1744611 - protein, 20 aa, Staphylococcus epidermidis
SESSAIILLMFFIGIIVLSI

SEQ ID NO: 1744612 - protein, 17 aa, Staphylococcus epidermidis
SESYCSNLFARYLNMNF

SEQ ID NO: 1744613 - protein, 23 aa, Staphylococcus epidermidis
SETELPVALSFFSGKRLVPIMTA

SEQ ID NO: 1744614 - protein, 24 aa, Staphylococcus epidermidis
SETTRISDALIRMQREHVHMSLII

SEQ ID NO: 1744615 - protein, 23 aa, Staphylococcus epidermidis
SFAARFTIPYSKKYHVFIVIMMI

SEQ ID NO: 1744616 - protein, 21 aa, Staphylococcus epidermidis
SFAQSDFYTQIESITLRGVKM

SEQ ID NO: 1744617 - protein, 17 aa, Staphylococcus epidermidis
SFARIALSFSAGVFLYV

SEQ ID NO: 1744618 - protein, 24 aa, Staphylococcus epidermidis
SFDLYPNYWGGKKYNVKEKLTEQG

SEQ ID NO: 1744619 - protein, 28 aa, Staphylococcus epidermidis
SFFTFSWSEYFWWMVAHIIFMVLMAICI

SEQ ID NO: 1744620 - protein, 18 aa, Staphylococcus epidermidis
SFFWLIGIFIFYLIMAIL

SEQ ID NO: 1744621 - protein, 18 aa, Staphylococcus epidermidis
SFGIPFWLSSLILVVLIL

SEQ ID NO: 1744622 - protein, 18 aa, Staphylococcus epidermidis
SFIKRTDETISFTDNVNL

SEQ ID NO: 1744623 - protein, 19 aa, Staphylococcus epidermidis
SFILLLNLRHRDVTKSLFD

SEQ ID NO: 1744624 - protein, 20 aa, Staphylococcus epidermidis
SFILVLFIFLFSWVPNVSHA

SEQ ID NO: 1744625 - protein, 17 aa, Staphylococcus epidermidis
SFISLILYRFELNLRSA

SEQ ID NO: 1744626 - protein, 19 aa, Staphylococcus epidermidis
SFIVFIGFDMIRPALTNYF

SEQ ID NO: 1744627 - protein, 20 aa, Staphylococcus epidermidis
SFLMGLVLMTVLFFNNLGMV

SEQ ID NO: 1744628 - protein, 23 aa, Staphylococcus epidermidis
SFLNHWWPFTSYIFLGLGLLSIL

SEQ ID NO: 1744629 - protein, 18 aa, Staphylococcus epidermidis
SFLSRYLTLDSFNLYFGI

SEQ ID NO: 1744630 - protein, 18 aa, Staphylococcus epidermidis
SFMTVVPLIAFGIVSFFA

SEQ ID NO: 1744631 - protein, 21 aa, Staphylococcus epidermidis
SFNIPTWLGALIMTIIIYLTL

SEQ ID NO: 1744632 - protein, 18 aa, Staphylococcus epidermidis
SFTFFKGIGIIFLLFGIL

SEQ ID NO: 1744633 - protein, 26 aa, Staphylococcus epidermidis
SFVACGFFLFMFGGTASDFWIACIAG

SEQ ID NO: 1744634 - protein, 17 aa, Staphylococcus epidermidis
SFVESFIILISLLIILG

SEQ ID NO: 1744635 - protein, 20 aa, Staphylococcus epidermidis
SFVVAALIMKFTKEPKQDLE

SEQ ID NO: 1744636 - protein, 29 aa, Staphylococcus epidermidis
SFWFPEIPNWISALFCVLILMSFNLLSAK

SEQ ID NO: 1744637 - protein, 23 aa, Staphylococcus epidermidis
SGAPLPQFWRSAGAINSSVANDF

SEQ ID NO: 1744638 - protein, 17 aa, Staphylococcus epidermidis
SGCIMIIVSIVFGAVST

SEQ ID NO: 1744639 - protein, 40 aa, Staphylococcus epidermidis
SGFLFYICLPFQNLLEKWGFPRWASILTIFIGLIAIIAIV

SEQ ID NO: 1744640 - protein, 25 aa, Staphylococcus epidermidis
SGGKDVDIDLGFSQWGLKQQPNESY

SEQ ID NO: 1744641 - protein, 23 aa, Staphylococcus epidermidis
SGHFLWPAILAFALTGIGLPLLG

SEQ ID NO: 1744642 - protein, 18 aa, Staphylococcus epidermidis
SGHFRNAMNNEETSLYEG

SEQ ID NO: 1744643 - protein, 20 aa, Staphylococcus epidermidis
SGHYQFKGLENGSYTVEFET

SEQ ID NO: 1744644 - protein, 17 aa, Staphylococcus epidermidis
SGIAFFITYKFYYYLPI

SEQ ID NO: 1744645 - protein, 17 aa, Staphylococcus epidermidis
SGIFIALATFLRPVGGV

SEQ ID NO: 1744646 - protein, 25 aa, Staphylococcus epidermidis
SGILAFHIDPIFAIIIMGFSAMMTE

SEQ ID NO: 1744647 - protein, 17 aa, Staphylococcus epidermidis
SGITIISMILCYVVIKI

SEQ ID NO: 1744648 - protein, 18 aa, Staphylococcus epidermidis
SGITIISMILCYVVIKIT

SEQ ID NO: 1744649 - protein, 17 aa, Staphylococcus epidermidis
SGKSVCINGIITSILLN

SEQ ID NO: 1744650 - protein, 19 aa, Staphylococcus epidermidis
SGLALFFGLSFLWLPFFSI

SEQ ID NO: 1744651 - protein, 30 aa, Staphylococcus epidermidis
SGLFSKRFWPSLKFLLPIIIGMGLAIAILS

SEQ ID NO: 1744652 - protein, 26 aa, Staphylococcus epidermidis
SGLKPLKCLFIISFLAQLGSIVINTY

SEQ ID NO: 1744653 - protein, 20 aa, Staphylococcus epidermidis
SGLPDGVSFDSATNTITGTP

SEQ ID NO: 1744654 - protein, 17 aa, Staphylococcus epidermidis
SGLYKYEASTNIKNLDQ

SEQ ID NO: 1744655 - protein, 20 aa, Staphylococcus epidermidis
SGLYMLFLFVKKLRKYVTSN

SEQ ID NO: 1744656 - protein, 17 aa, Staphylococcus epidermidis
SGNENIVSFTVNIKPLN

SEQ ID NO: 1744657 - protein, 26 aa, Staphylococcus epidermidis
SGTPSSRNAGSFTKTVTVAYQNGQTE

SEQ ID NO: 1744658 - protein, 21 aa, Staphylococcus epidermidis
SGVEVLIHIGIDTVKLNGKGF

SEQ ID NO: 1744659 - protein, 19 aa, Staphylococcus epidermidis
SGVGGAGITRLYKDGTVKH

SEQ ID NO: 1744660 - protein, 24 aa, Staphylococcus epidermidis
SGWGEWKVVTVFWTVGLISGLIGL

SEQ ID NO: 1744661 - protein, 18 aa, Staphylococcus epidermidis
SGYFPGYIDAIIMRICDV

SEQ ID NO: 1744662 - protein, 29 aa, Staphylococcus epidermidis
SGYFVPIVVGIAIVTFIVWIVFVHTGQFE

SEQ ID NO: 1744663 - protein, 25 aa, Staphylococcus epidermidis
SGYLVEYFNWRSLFHVVAPIAAITF

SEQ ID NO: 1744664 - protein, 18 aa, Staphylococcus epidermidis
SHGTVSIYDALRQSFNIP

SEQ ID NO: 1744665 - protein, 19 aa, Staphylococcus epidermidis
SHGTVSIYDALRQSFNIPA

SEQ ID NO: 1744666 - protein, 18 aa, Staphylococcus epidermidis
SHILLPFMFGPMIAAILC

SEQ ID NO: 1744667 - protein, 21 aa, Staphylococcus epidermidis
SHIPMIYSYFLNYGLLVISSI

SEQ ID NO: 1744668 - protein, 18 aa, Staphylococcus epidermidis
SHIRHKRNAVSFRNADQS

SEQ ID NO: 1744669 - protein, 25 aa, Staphylococcus epidermidis
SHLLIGRTYFYLGLLNYDISEDGLK

SEQ ID NO: 1744670 - protein, 28 aa, Staphylococcus epidermidis
SHRRKYVRKKLWLSIALIGSLQYGGLIT

SEQ ID NO: 1744671 - protein, 21 aa, Staphylococcus epidermidis
SHSYIAWKLNPAGSISIMISL

SEQ ID NO: 1744672 - protein, 20 aa, Staphylococcus epidermidis
SHTSEELYHRSSRSQSNSLK

SEQ ID NO: 1744673 - protein, 24 aa, Staphylococcus epidermidis
SIASWRMIFIFLTIITLIVILGIL

SEQ ID NO: 1744674 - protein, 25 aa, Staphylococcus epidermidis
SIATGIACGFIFYPLTMLISKRHKE

SEQ ID NO: 1744675 - protein, 19 aa, Staphylococcus epidermidis
SIEDLNWFVPHSANARMIE

SEQ ID NO: 1744676 - protein, 21 aa, Staphylococcus epidermidis
SIFCMSIPIIMGGLVVIENVF

SEQ ID NO: 1744677 - protein, 25 aa, Staphylococcus epidermidis
SIFFTPRIGIIVGLILGVIAGVIWE

SEQ ID NO: 1744678 - protein, 18 aa, Staphylococcus epidermidis
SIFGESFFNQIFGNLIDR

SEQ ID NO: 1744679 - protein, 24 aa, Staphylococcus epidermidis
SIFLESFLFFSGFYYPLYLAGQGK

SEQ ID NO: 1744680 - protein, 18 aa, Staphylococcus epidermidis
SIHEAYVFNFFSRLLTAL

SEQ ID NO: 1744681 - protein, 25 aa, Staphylococcus epidermidis
SIIALSMMVSFVFIKNQIYFEDHQN

SEQ ID NO: 1744682 - protein, 22 aa, Staphylococcus epidermidis
SIIANFWWIQAIGAIYLIYMSI

SEQ ID NO: 1744683 - protein, 23 aa, Staphylococcus epidermidis
SIIGNKLNNQWSLNNNIPGIEID

SEQ ID NO: 1744684 - protein, 29 aa, Staphylococcus epidermidis
SIIGVLLIACLAYLYFFVMKNEEQVEKGY

SEQ ID NO: 1744685 - protein, 27 aa, Staphylococcus epidermidis
SIILGLLVLMSIVLTYMVWNFTPDLNN

SEQ ID NO: 1744686 - protein, 26 aa, Staphylococcus epidermidis
SIILLLMCVRWWIKYLNFKKNEHLKD

SEQ ID NO: 1744687 - protein, 30 aa, Staphylococcus epidermidis
SIITIIALFSFKLYQHYYYKLFAIATWILL

SEQ ID NO: 1744688 - protein, 25 aa, Staphylococcus epidermidis
SIIWLVGSFLFGWYISNFGNYNKTY

SEQ ID NO: 1744689 - protein, 23 aa, Staphylococcus epidermidis
SIKNHRKDIRLSDTDKIDPMVIT

SEQ ID NO: 1744690 - protein, 25 aa, Staphylococcus epidermidis
SIKSDLWSAFYIFTAFNVVYAIFLF

SEQ ID NO: 1744691 - protein, 22 aa, Staphylococcus epidermidis
SILFFLAAWFFARKPSKILDYI

SEQ ID NO: 1744692 - protein, 19 aa, Staphylococcus epidermidis
SILICVTFSLLMVTPISLV

SEQ ID NO: 1744693 - protein, 24 aa, Staphylococcus epidermidis
SILKSPYTYLAFILVIGMTVFQAS

SEQ ID NO: 1744694 - protein, 27 aa, Staphylococcus epidermidis
SILVVGNPLGVDFKGSVSKGIISGLDR

SEQ ID NO: 1744695 - protein, 18 aa, Staphylococcus epidermidis
SIMLGIAVSPIWVIMLSS

SEQ ID NO: 1744696 - protein, 20 aa, Staphylococcus epidermidis
SIMMGMKISLSKLAINVILA

SEQ ID NO: 1744697 - protein, 20 aa, Staphylococcus epidermidis
SINLIRIVIGISIYTHAGNL

SEQ ID NO: 1744698 - protein, 18 aa, Staphylococcus epidermidis
SINLPILGLIPFILWGAM

SEQ ID NO: 1744699 - protein, 21 aa, Staphylococcus epidermidis
SIPSNGRWYDHIGIDKDRREG

SEQ ID NO: 1744700 - protein, 26 aa, Staphylococcus epidermidis
SIQEPKLSFIISFLYLMVGFITAFFS

SEQ ID NO: 1744701 - protein, 24 aa, Staphylococcus epidermidis
SIRIMPGFLMFYFFIKSTKTNQFI

SEQ ID NO: 1744702 - protein, 30 aa, Staphylococcus epidermidis
SIRKYAIGTFSTVIATLVFMGINPNHASAD

SEQ ID NO: 1744703 - protein, 19 aa, Staphylococcus epidermidis
SISEFMFAAGQTFTILIIS

SEQ ID NO: 1744704 - protein, 20 aa, Staphylococcus epidermidis
SISVSLRVPAVKKIELEPMF

SEQ ID NO: 1744705 - protein, 18 aa, Staphylococcus epidermidis
SIVLYFSFTTLKYSHSIN

SEQ ID NO: 1744706 - protein, 18 aa, Staphylococcus epidermidis
SIVTLIFNAILIIIATLK

SEQ ID NO: 1744707 - protein, 24 aa, Staphylococcus epidermidis
SIWSQIRLRRAIKRQGKNPNELLP

SEQ ID NO: 1744708 - protein, 25 aa, Staphylococcus epidermidis
SIYNTRISSLYGILILLFVLSIIIL

SEQ ID NO: 1744709 - protein, 19 aa, Staphylococcus epidermidis
SKAKKDIDQKLAQQINQIQ

SEQ ID NO: 1744710 - protein, 31 aa, Staphylococcus epidermidis
SKDVLTTTVTGLPSGLSFDQTTNTIIGTPSE

SEQ ID NO: 1744711 - protein, 29 aa, Staphylococcus epidermidis
SKEANKKSGARPGPKVNEGHNNDLTDDHE

SEQ ID NO: 1744712 - protein, 23 aa, Staphylococcus epidermidis
SKEPRLEPRLGNQYGGKLALIFD

SEQ ID NO: 1744713 - protein, 23 aa, Staphylococcus epidermidis
SKEPRLEPRLGNQYGGKLSLIFD

SEQ ID NO: 1744714 - protein, 20 aa, Staphylococcus epidermidis
SKGFFKSAFVSPDQIIKSQH

SEQ ID NO: 1744715 - protein, 18 aa, Staphylococcus epidermidis
SKIFCFSTITSMIVMLSM

SEQ ID NO: 1744716 - protein, 17 aa, Staphylococcus epidermidis
SKIMMPLLFIFLLIIVA

SEQ ID NO: 1744717 - protein, 19 aa, Staphylococcus epidermidis
SKINQQWTLNKDNFGIKIN

SEQ ID NO: 1744718 - protein, 24 aa, Staphylococcus epidermidis
SKIRQNIIISLTIVAFLIVNALTG

SEQ ID NO: 1744719 - protein, 24 aa, Staphylococcus epidermidis
SKKAYKPLWIIISFALLIGILLLP

SEQ ID NO: 1744720 - protein, 25 aa, Staphylococcus epidermidis
SKKFKIFSLLSMIVIAGLAIFRFIH

SEQ ID NO: 1744721 - protein, 25 aa, Staphylococcus epidermidis
SKKIFLKVIITILILLIIFFGVMYF

SEQ ID NO: 1744722 - protein, 21 aa, Staphylococcus epidermidis
SKKILLSYIFFVIFTPLVAFM

SEQ ID NO: 1744723 - protein, 21 aa, Staphylococcus epidermidis
SKKTYQGIFSFNVLGLQDIHR

SEQ ID NO: 1744724 - protein, 35 aa, Staphylococcus epidermidis
SKKVGSCGWKAILYFEIITTIAIGLGLIIGNLFKP

SEQ ID NO: 1744725 - protein, 20 aa, Staphylococcus epidermidis
SKLAALKVMDAFNADLKPDF

SEQ ID NO: 1744726 - protein, 17 aa, Staphylococcus epidermidis
SKLDPLPSISFSDTDFS

SEQ ID NO: 1744727 - protein, 25 aa, Staphylococcus epidermidis
SKLFKKEFVVSFVIAILVVAISTGL

SEQ ID NO: 1744728 - protein, 24 aa, Staphylococcus epidermidis
SKLIEFVGFLGISYVTFKSVQLIM

SEQ ID NO: 1744729 - protein, 17 aa, Staphylococcus epidermidis
SKLILQVLFNLIDNALK

SEQ ID NO: 1744730 - protein, 21 aa, Staphylococcus epidermidis
SKLLLLLAFVIQQAFLYYFNH

SEQ ID NO: 1744731 - protein, 19 aa, Staphylococcus epidermidis
SKLNQLVAQYKAIDLSPKT

SEQ ID NO: 1744732 - protein, 21 aa, Staphylococcus epidermidis
SKLPKEVRNDHRFYPSKQEQQ

SEQ ID NO: 1744733 - protein, 21 aa, Staphylococcus epidermidis
SKLTLTFGVSKSFLKKIGMSD

SEQ ID NO: 1744734 - protein, 17 aa, Staphylococcus epidermidis
SKMSIQYKTAVGQKEDV

SEQ ID NO: 1744735 - protein, 24 aa, Staphylococcus epidermidis
SKNEKLRYLLNIAKLEDIKNTRYT

SEQ ID NO: 1744736 - protein, 25 aa, Staphylococcus epidermidis
SKNEKLRYLLNIGKLEELRATRYTF

SEQ ID NO: 1744737 - protein, 18 aa, Staphylococcus epidermidis
SKNESSWTLNKQIDHVNI

SEQ ID NO: 1744738 - protein, 42 aa, Staphylococcus epidermidis
SKNGVLTFRSSDYLKDLPLSGELKAIVYYNQYVQSNFSKSVP

SEQ ID NO: 1744739 - protein, 22 aa, Staphylococcus epidermidis
SKNIKTNVAMNWYFIAASVVVL

SEQ ID NO: 1744740 - protein, 35 aa, Staphylococcus epidermidis
SKNTNMLNKTGKDYDLQEQRGYTDSEQHNETQSNQ

SEQ ID NO: 1744741 - protein, 17 aa, Staphylococcus epidermidis
SKPKANEAVVTNESTKP

SEQ ID NO: 1744742 - protein, 17 aa, Staphylococcus epidermidis
SKQGTAYSQQVQTINQS

SEQ ID NO: 1744743 - protein, 18 aa, Staphylococcus epidermidis
SKRLDYFSYYALNSPFIY

SEQ ID NO: 1744744 - protein, 33 aa, Staphylococcus epidermidis
SKTHSIATIKSILPNVIKKPTAINDLTQEANNQ

SEQ ID NO: 1744745 - protein, 37 aa, Staphylococcus epidermidis
SKTLKLREGHIFIRKCLRTSIMFSIILLGFVAMNILF

SEQ ID NO: 1744746 - protein, 26 aa, Staphylococcus epidermidis
SKTVMPRKEDIPEPPTVSANVEQANV

SEQ ID NO: 1744747 - protein, 22 aa, Staphylococcus epidermidis
SKVALLAAFIPIISGMSGNSGT

SEQ ID NO: 1744748 - protein, 17 aa, Staphylococcus epidermidis
SKVFDYILVFFLFGIAV

SEQ ID NO: 1744749 - protein, 19 aa, Staphylococcus epidermidis
SKVIIVKRFKDIWKANQQI

SEQ ID NO: 1744750 - protein, 18 aa, Staphylococcus epidermidis
SKVRFEMVDCGKGVPEEE

SEQ ID NO: 1744751 - protein, 17 aa, Staphylococcus epidermidis
SLAEKFMIAIFIIALAL

SEQ ID NO: 1744752 - protein, 17 aa, Staphylococcus epidermidis
SLALLLIDIDGFKDVND

SEQ ID NO: 1744753 - protein, 18 aa, Staphylococcus epidermidis
SLAMYRRTLSYYCEPDID

SEQ ID NO: 1744754 - protein, 22 aa, Staphylococcus epidermidis
SLARLLLRDDARIWILDEPTTA

SEQ ID NO: 1744755 - protein, 19 aa, Staphylococcus epidermidis
SLATMLTILLFKRHTPATT

SEQ ID NO: 1744756 - protein, 17 aa, Staphylococcus epidermidis
SLAWLKIVGLVVALILL

SEQ ID NO: 1744757 - protein, 53 aa, Staphylococcus epidermidis
SLEQQKTRVKLYKSGKSWVKASINEIELLKTMGLPFLSKNEIQENVTEKTEGH

SEQ ID NO: 1744758 - protein, 22 aa, Staphylococcus epidermidis
SLEVFPRVAGENIIKTHTDATI

SEQ ID NO: 1744759 - protein, 18 aa, Staphylococcus epidermidis
SLFAFFLLTVFTITLKTY

SEQ ID NO: 1744760 - protein, 20 aa, Staphylococcus epidermidis
SLFAGRLSSRIGMKRLITIA

SEQ ID NO: 1744761 - protein, 21 aa, Staphylococcus epidermidis
SLGALPLGLGHDIFQSYSLTI

SEQ ID NO: 1744762 - protein, 25 aa, Staphylococcus epidermidis
SLGGFSWPIVLILLILFFFYSHYLF

SEQ ID NO: 1744763 - protein, 34 aa, Staphylococcus epidermidis
SLGIIIYVSLRFEWRMGLSAVLALLHDVFIIVAV

SEQ ID NO: 1744764 - protein, 19 aa, Staphylococcus epidermidis
SLGSGDSLLSGLFNDDGNI

SEQ ID NO: 1744765 - protein, 19 aa, Staphylococcus epidermidis
SLIFIRQRLTMVILNGIIG

SEQ ID NO: 1744766 - protein, 45 aa, Staphylococcus epidermidis
SLILAHLFKHLLIRFRYSYLYLSKRYYIIISFVLAIAFIYFYIIS

SEQ ID NO: 1744767 - protein, 45 aa, Staphylococcus epidermidis
SLILAHLFKHLLIRLRYSYLYLSKRYYIIISFVLAIAFIYFYIIS

SEQ ID NO: 1744768 - protein, 24 aa, Staphylococcus epidermidis
SLILIDFRLPRMLITILAGAALSL

SEQ ID NO: 1744769 - protein, 25 aa, Staphylococcus epidermidis
SLIPFVIATYFYKKTNGFFLLAPLF

SEQ ID NO: 1744770 - protein, 17 aa, Staphylococcus epidermidis
SLISAILIFLGSVIALI

SEQ ID NO: 1744771 - protein, 26 aa, Staphylococcus epidermidis
SLIVFFSIFVCYEILEPYFKNYSPDI

SEQ ID NO: 1744772 - protein, 17 aa, Staphylococcus epidermidis
SLKGFLHQYQIVLKDKI

SEQ ID NO: 1744773 - protein, 25 aa, Staphylococcus epidermidis
SLKLKMPMIRVFRVSYIINALNSII

SEQ ID NO: 1744774 - protein, 20 aa, Staphylococcus epidermidis
SLKLNNWQIFISIASTILLA

SEQ ID NO: 1744775 - protein, 29 aa, Staphylococcus epidermidis
SLKVKALKINNRWKFDSSVSNISINPNTG

SEQ ID NO: 1744776 - protein, 17 aa, Staphylococcus epidermidis
SLLLDGLLAFFIIGIIT

SEQ ID NO: 1744777 - protein, 26 aa, Staphylococcus epidermidis
SLLLKMLHVILPFMFGPILAALLCVK

SEQ ID NO: 1744778 - protein, 18 aa, Staphylococcus epidermidis
SLLTRTSMMVLLVVLFLA

SEQ ID NO: 1744779 - protein, 22 aa, Staphylococcus epidermidis
SLMCIPLAWFMNFDNFLVRPLM

SEQ ID NO: 1744780 - protein, 25 aa, Staphylococcus epidermidis
SLMPYSIALTIVWIAFTLIWFLLGI

SEQ ID NO: 1744781 - protein, 24 aa, Staphylococcus epidermidis
SLNAGALCYILWGIYLKDGIQDEK

SEQ ID NO: 1744782 - protein, 23 aa, Staphylococcus epidermidis
SLSAAIIEKGKVNKLLKRNPTVE

SEQ ID NO: 1744783 - protein, 22 aa, Staphylococcus epidermidis
SLTEGFSQVFLVPSVIGGLLII

SEQ ID NO: 1744784 - protein, 17 aa, Staphylococcus epidermidis
SLTGLNHGVKWLSNFNI

SEQ ID NO: 1744785 - protein, 20 aa, Staphylococcus epidermidis
SLTLLIRVNRSWKIPHEAAK

SEQ ID NO: 1744786 - protein, 25 aa, Staphylococcus epidermidis
SLVADLLGIFAMKKLFVNNKMSGIL

SEQ ID NO: 1744787 - protein, 24 aa, Staphylococcus epidermidis
SLVFKILVIILIVFILLAIVFGIY

SEQ ID NO: 1744788 - protein, 24 aa, Staphylococcus epidermidis
SLVLGTAIGPFFGMLLMNSFSIKI

SEQ ID NO: 1744789 - protein, 25 aa, Staphylococcus epidermidis
SLVLGTAIGPFFGMLLMNSFSINIL

SEQ ID NO: 1744790 - protein, 17 aa, Staphylococcus epidermidis
SLVPMIIIMLYRFLYNN

SEQ ID NO: 1744791 - protein, 21 aa, Staphylococcus epidermidis
SLVSIGTAIGLIFTQIGFPIV

SEQ ID NO: 1744792 - protein, 18 aa, Staphylococcus epidermidis
SLVTTLAVLIFKRHSPAN

SEQ ID NO: 1744793 - protein, 27 aa, Staphylococcus epidermidis
SMANGKKYIVTQAVRPTGTGNVYTEYW

SEQ ID NO: 1744794 - protein, 28 aa, Staphylococcus epidermidis
SMGGQTIRLMEHFLRNGNQEEIDYQREH

SEQ ID NO: 1744795 - protein, 18 aa, Staphylococcus epidermidis
SMIIDFLGLMYQYKTILT

SEQ ID NO: 1744796 - protein, 24 aa, Staphylococcus epidermidis
SMKLAKIPFGFLMKGLTPIFFFLI

SEQ ID NO: 1744797 - protein, 25 aa, Staphylococcus epidermidis
SMLQEFKVTVWYTAPTALRMLMSAG

SEQ ID NO: 1744798 - protein, 18 aa, Staphylococcus epidermidis
SMLWHIVSIWSVEYILHA

SEQ ID NO: 1744799 - protein, 21 aa, Staphylococcus epidermidis
SMMGLIFALTLGWVGRYLRYF

SEQ ID NO: 1744800 - protein, 18 aa, Staphylococcus epidermidis
SMMTAYVFYSYERAKGQI

SEQ ID NO: 1744801 - protein, 22 aa, Staphylococcus epidermidis
SMNLKMILLIIIAWLLVFILMK

SEQ ID NO: 1744802 - protein, 21 aa, Staphylococcus epidermidis
SMPWELSVIYSPLRLIILMVI

SEQ ID NO: 1744803 - protein, 21 aa, Staphylococcus epidermidis
SMSRLYYKIINAFVEDVQFED

SEQ ID NO: 1744804 - protein, 18 aa, Staphylococcus epidermidis
SMVILRPMVEALIYRHLV

SEQ ID NO: 1744805 - protein, 21 aa, Staphylococcus epidermidis
SMYPMAWAFSIIYLIVCVALA

SEQ ID NO: 1744806 - protein, 19 aa, Staphylococcus epidermidis
SNDGRRSTLERLASDTDQI

SEQ ID NO: 1744807 - protein, 22 aa, Staphylococcus epidermidis
SNDRTTIIVAHRLSTVLKADKI

SEQ ID NO: 1744808 - protein, 18 aa, Staphylococcus epidermidis
SNEAYNTTYHFNITATDN

SEQ ID NO: 1744809 - protein, 23 aa, Staphylococcus epidermidis
SNFAEALSMMLIPGSLVFLFGRM

SEQ ID NO: 1744810 - protein, 24 aa, Staphylococcus epidermidis
SNFDIPLSFAYVLFIVFWQVGFSN

SEQ ID NO: 1744811 - protein, 18 aa, Staphylococcus epidermidis
SNIFDWLVKMTAKFREWS

SEQ ID NO: 1744812 - protein, 23 aa, Staphylococcus epidermidis
SNILDKRFLFFFFASVILHCIWD

SEQ ID NO: 1744813 - protein, 17 aa, Staphylococcus epidermidis
SNILWFFVAVIVGSLAT

SEQ ID NO: 1744814 - protein, 17 aa, Staphylococcus epidermidis
SNIRSLLVFVVFGILGL

SEQ ID NO: 1744815 - protein, 23 aa, Staphylococcus epidermidis
SNKFEMWVGIAIAIIALILITMQ

SEQ ID NO: 1744816 - protein, 17 aa, Staphylococcus epidermidis
SNKNLVFIQNALAHQHI

SEQ ID NO: 1744817 - protein, 17 aa, Staphylococcus epidermidis
SNLPYHLYIIILIGIMC

SEQ ID NO: 1744818 - protein, 24 aa, Staphylococcus epidermidis
SNNLDLLHQNRLQDKVVKQPTKGE

SEQ ID NO: 1744819 - protein, 25 aa, Staphylococcus epidermidis
SNNPEFKKAMGILLISTVGYVGYVV

SEQ ID NO: 1744820 - protein, 20 aa, Staphylococcus epidermidis
SNPIDWAILGGIAAGTLITA

SEQ ID NO: 1744821 - protein, 28 aa, Staphylococcus epidermidis
SNQQFPPRNAQRRKRRRDVATNHNKHED

SEQ ID NO: 1744822 - protein, 30 aa, Staphylococcus epidermidis
SNQQFPPRNAQRRKRRRETATNQSKHQDDK

SEQ ID NO: 1744823 - protein, 22 aa, Staphylococcus epidermidis
SNSASTSLRESTSTSTSDSAST

SEQ ID NO: 1744824 - protein, 23 aa, Staphylococcus epidermidis
SNTGNRMFKRYAVITTSAKILGR

SEQ ID NO: 1744825 - protein, 23 aa, Staphylococcus epidermidis
SNVARATVSLTVENKGHTQSKET

SEQ ID NO: 1744826 - protein, 26 aa, Staphylococcus epidermidis
SNVFMFKTALKLAGDPYYSGMPLPND

SEQ ID NO: 1744827 - protein, 19 aa, Staphylococcus epidermidis
SNVGKYNFYSFEGLRTNNN

SEQ ID NO: 1744828 - protein, 22 aa, Staphylococcus epidermidis
SNVKETRALFVTTNELARRLQK

SEQ ID NO: 1744829 - protein, 33 aa, Staphylococcus epidermidis
SNYDRAVELYYYIKGGRVDYGAAHAAKYGHNRY

SEQ ID NO: 1744830 - protein, 19 aa, Staphylococcus epidermidis
SNYGSRIDIIISENEENDC

SEQ ID NO: 1744831 - protein, 33 aa, Staphylococcus epidermidis
SPDGVPGGDGIGFAFSPGPLGQIGKEGAAVGIG

SEQ ID NO: 1744832 - protein, 20 aa, Staphylococcus epidermidis
SPEAWYSMLQEFKVTVWYTA

SEQ ID NO: 1744833 - protein, 19 aa, Staphylococcus epidermidis
SPEVRSMIAEVSYAPAKNK

SEQ ID NO: 1744834 - protein, 18 aa, Staphylococcus epidermidis
SPEYGIWALIIGTLKITI

SEQ ID NO: 1744835 - protein, 21 aa, Staphylococcus epidermidis
SPIWFIFLFFYYKKYKTNAKA

SEQ ID NO: 1744836 - protein, 25 aa, Staphylococcus epidermidis
SPLMLLKLAIVWTLVQFFEGHFISP

SEQ ID NO: 1744837 - protein, 25 aa, Staphylococcus epidermidis
SPLYFRFSAYWPFFSDVFIWLPLFL

SEQ ID NO: 1744838 - protein, 22 aa, Staphylococcus epidermidis
SPQISMKRWALAGRHIGQDIMG

SEQ ID NO: 1744839 - protein, 21 aa, Staphylococcus epidermidis
SPQYTMSVWMGFNKVKQYGTN

SEQ ID NO: 1744840 - protein, 22 aa, Staphylococcus epidermidis
SPYLPFTYAIDALRETVGGIVP

SEQ ID NO: 1744841 - protein, 17 aa, Staphylococcus epidermidis
SQAKGIGFELDFKDEQK

SEQ ID NO: 1744842 - protein, 19 aa, Staphylococcus epidermidis
SQFTPKVSADGTRVDINFA

SEQ ID NO: 1744843 - protein, 24 aa, Staphylococcus epidermidis
SQHTFSFKLLFSLLIIGLILIALL

SEQ ID NO: 1744844 - protein, 18 aa, Staphylococcus epidermidis
SQIKNVFNMIDKREFMSV

SEQ ID NO: 1744845 - protein, 18 aa, Staphylococcus epidermidis
SQIKTVFNMIDKAEFMSV

SEQ ID NO: 1744846 - protein, 26 aa, Staphylococcus epidermidis
SQINVWKSLLAWRVTVFMGAQSLVFY

SEQ ID NO: 1744847 - protein, 24 aa, Staphylococcus epidermidis
SQLKNFFPSWAFIAIIVSTAIAAI

SEQ ID NO: 1744848 - protein, 19 aa, Staphylococcus epidermidis
SQPFTKRYYSLIIVMSIIT

SEQ ID NO: 1744849 - protein, 21 aa, Staphylococcus epidermidis
SQRKIDVESVFGIMKPILSFT

SEQ ID NO: 1744850 - protein, 23 aa, Staphylococcus epidermidis
SQSIFKMPFKQLLLMAMTSGAIG

SEQ ID NO: 1744851 - protein, 21 aa, Staphylococcus epidermidis
SQTISLWKYVFLSIVLIIGIY

SEQ ID NO: 1744852 - protein, 24 aa, Staphylococcus epidermidis
SQTREVGKTINPITITTTDNSKDV

SEQ ID NO: 1744853 - protein, 26 aa, Staphylococcus epidermidis
SQTVIYKFKDVQGPQISVDSQTREVG

SEQ ID NO: 1744854 - protein, 25 aa, Staphylococcus epidermidis
SQVNRLGIPLSIFFGGVKMMMPNMV

SEQ ID NO: 1744855 - protein, 27 aa, Staphylococcus epidermidis
SRDYPVIQGCVLFIGFFVVIINTIADI

SEQ ID NO: 1744856 - protein, 23 aa, Staphylococcus epidermidis
SRFKALRKHIILIIGTIVLIYLF

SEQ ID NO: 1744857 - protein, 23 aa, Staphylococcus epidermidis
SRFKGKRLINENVRKGIHRPKEL

SEQ ID NO: 1744858 - protein, 25 aa, Staphylococcus epidermidis
SRIDLYFKYNLKKYTSMKITKVEKN

SEQ ID NO: 1744859 - protein, 17 aa, Staphylococcus epidermidis
SRIFWRVSRKYVTGGNK

SEQ ID NO: 1744860 - protein, 17 aa, Staphylococcus epidermidis
SRIKVKVIIIIALLAMS

SEQ ID NO: 1744861 - protein, 17 aa, Staphylococcus epidermidis
SRIQSQIDSAKNEANSV

SEQ ID NO: 1744862 - protein, 27 aa, Staphylococcus epidermidis
SRITMPRKEAIPHSPIVEANEEHVNVT

SEQ ID NO: 1744863 - protein, 19 aa, Staphylococcus epidermidis
SRITMPRKEATPIPPTLEA

SEQ ID NO: 1744864 - protein, 19 aa, Staphylococcus epidermidis
SRITMPRKEATPLSPIVEA

SEQ ID NO: 1744865 - protein, 18 aa, Staphylococcus epidermidis
SRITMPVKEKTPAPPISI

SEQ ID NO: 1744866 - protein, 31 aa, Staphylococcus epidermidis
SRKRGKQGTGLGLFICKMIIEEHGGKIEVES

SEQ ID NO: 1744867 - protein, 18 aa, Staphylococcus epidermidis
SRLASLLIITAVQAVSIW

SEQ ID NO: 1744868 - protein, 19 aa, Staphylococcus epidermidis
SRLLGCILALIALIQIFRP

SEQ ID NO: 1744869 - protein, 22 aa, Staphylococcus epidermidis
SRLLKNPFNYIGLLFVLMIPVF

SEQ ID NO: 1744870 - protein, 22 aa, Staphylococcus epidermidis
SRLNKLKLKRIVYDKRKIAFIS

SEQ ID NO: 1744871 - protein, 35 aa, Staphylococcus epidermidis; identical to SEQ ID NO: 1577008

SEQ ID NO: 1744872 - protein, 20 aa, Staphylococcus epidermidis
SRLYYIILTIVIIAICVVVV

SEQ ID NO: 1744873 - protein, 19 aa, Staphylococcus epidermidis
SRNRLESKINETVQTEGMT

SEQ ID NO: 1744874 - protein, 22 aa, Staphylococcus epidermidis
SRRDGFNPMRIILAGAAISALL

SEQ ID NO: 1744875 - protein, 19 aa, Staphylococcus epidermidis
SRRGFWWFYLFNALTGVLV

SEQ ID NO: 1744876 - protein, 18 aa, Staphylococcus epidermidis
SRTGSIIGTFVFPIILAT

SEQ ID NO: 1744877 - protein, 19 aa, Staphylococcus epidermidis
SRTVLKRNFILIPTYILLQ

SEQ ID NO: 1744878 - protein, 21 aa, Staphylococcus epidermidis
SRVIERFPKSIIFIAPMIVFL

SEQ ID NO: 1744879 - protein, 23 aa, Staphylococcus epidermidis
SRYEKKNIVGLIFLSWYPTLYWV

SEQ ID NO: 1744880 - protein, 22 aa, Staphylococcus epidermidis
SRYEKKNIVGLIFVSWYPTVYW

SEQ ID NO: 1744881 - protein, 35 aa, Staphylococcus epidermidis
SRYSSRAPKRKDFVVSFIASAIVGSALGLYYKNKV

SEQ ID NO: 1744882 - protein, 18 aa, Staphylococcus epidermidis
SSELGFLVFVAVLLHKIP

SEQ ID NO: 1744883 - protein, 18 aa, Staphylococcus epidermidis
SSFTKFPITTGYYPNGGA

SEQ ID NO: 1744884 - protein, 18 aa, Staphylococcus epidermidis
SSGIGLFIVKHISNHLNH

SEQ ID NO: 1744885 - protein, 23 aa, Staphylococcus epidermidis
SSGYLKYILLIIIAWLFIFILMK

SEQ ID NO: 1744886 - protein, 22 aa, Staphylococcus epidermidis
SSHLAFGLLVLFALIALMTMIH

SEQ ID NO: 1744887 - protein, 28 aa, Staphylococcus epidermidis
SSIFIAVPLWGMLKKRQFKKTKNNKLIV

SEQ ID NO: 1744888 - protein, 22 aa, Staphylococcus epidermidis
SSIKKEHYHLMYLLEQKATYFI

SEQ ID NO: 1744889 - protein, 20 aa, Staphylococcus epidermidis
SSILIGLFVKYFKTIRPKTY

SEQ ID NO: 1744890 - protein, 34 aa, Staphylococcus epidermidis
SSISGLFSRRFWPSLKFLLPILIGMLIAIGLLSQ

SEQ ID NO: 1744891 - protein, 25 aa, Staphylococcus epidermidis
SSIVFKFTVSLAIILAVHIGITYLV

SEQ ID NO: 1744892 - protein, 18 aa, Staphylococcus epidermidis
SSIVSLFILYSIIYILYG

SEQ ID NO: 1744893 - protein, 23 aa, Staphylococcus epidermidis
SSKPKKRGKRSLDTNSGNDTTST

SEQ ID NO: 1744894 - protein, 18 aa, Staphylococcus epidermidis
SSLLFLINMIFVAIKDIV

SEQ ID NO: 1744895 - protein, 20 aa, Staphylococcus epidermidis
SSLLGLFQFILGGIISPLVG

SEQ ID NO: 1744896 - protein, 21 aa, Staphylococcus epidermidis
SSLPWLPAAIGFVLGGIFIRV

SEQ ID NO: 1744897 - protein, 17 aa, Staphylococcus epidermidis
SSLTIGVIFVIIALLKD

SEQ ID NO: 1744898 - protein, 23 aa, Staphylococcus epidermidis
SSNANGVTVYWFKDKQETLAQTL

SEQ ID NO: 1744899 - protein, 24 aa, Staphylococcus epidermidis
SSNFFKKQYWLFGVKKKDRHDMND

SEQ ID NO: 1744900 - protein, 24 aa, Staphylococcus epidermidis
SSNFFKKQYWLFGVKKKNRHDINE

SEQ ID NO: 1744901 - protein, 24 aa, Staphylococcus epidermidis
SSNFFKKQYWLFGVKKMDRHDINE

SEQ ID NO: 1744902 - protein, 20 aa, Staphylococcus epidermidis
SSPFVKLFSLIGIPFAAGIV

SEQ ID NO: 1744903 - protein, 27 aa, Staphylococcus epidermidis
SSPKLINLNAHLLYKTNATFRGNDGQR

SEQ ID NO: 1744904 - protein, 25 aa, Staphylococcus epidermidis
SSQILLNIRKSYGIVVLANTNSSQV

SEQ ID NO: 1744905 - protein, 23 aa, Staphylococcus epidermidis
SSQMSRRSFLKMLGIGGAGVMIG

SEQ ID NO: 1744906 - protein, 26 aa, Staphylococcus epidermidis
SSQNSIKSVHTFKPNENFLQTDYRAV

SEQ ID NO: 1744907 - protein, 18 aa, Staphylococcus epidermidis
SSRIGMKRLITIALTTCI

SEQ ID NO: 1744908 - protein, 18 aa, Staphylococcus epidermidis
SSSIVNLVFLPPKFETKI

SEQ ID NO: 1744909 - protein, 20 aa, Staphylococcus epidermidis
SSVGAFIIKLLQGYIPVNSA

SEQ ID NO: 1744910 - protein, 23 aa, Staphylococcus epidermidis
SSVGRLGQTFSEIGPKIKSIGDS

SEQ ID NO: 1744911 - protein, 17 aa, Staphylococcus epidermidis
SSVSLIFKSIKRAKNGR

SEQ ID NO: 1744912 - protein, 21 aa, Staphylococcus epidermidis
SSYIKYVPKFIVFISNYSYCI

SEQ ID NO: 1744913 - protein, 24 aa, Staphylococcus epidermidis
SSYISIRLKQEFETISLFHIHIDG

SEQ ID NO: 1744914 - protein, 23 aa, Staphylococcus epidermidis
STALFLLCFYHLPNLNRYNEKPA

SEQ ID NO: 1744915 - protein, 17 aa, Staphylococcus epidermidis
STAMPALFIILAVGIIV

SEQ ID NO: 1744916 - protein, 28 aa, Staphylococcus epidermidis
STFFDKMFPILIGFFVFFFVFLISGIAL

SEQ ID NO: 1744917 - protein, 18 aa, Staphylococcus epidermidis
STFMKAVALNIIMSQSLR

SEQ ID NO: 1744918 - protein, 24 aa, Staphylococcus epidermidis
STFMKAVALNLILAQSIQTATAHS

SEQ ID NO: 1744919 - protein, 24 aa, Staphylococcus epidermidis
STFMKAVALNLILAQSIQTATAYS

SEQ ID NO: 1744920 - protein, 18 aa, Staphylococcus epidermidis
STGIPNWVLVLILTVITI

SEQ ID NO: 1744921 - protein, 20 aa, Staphylococcus epidermidis
STIIASKINQQWTLNKDNFG

SEQ ID NO: 1744922 - protein, 26 aa, Staphylococcus epidermidis
STITASKINHQWSLNKVVPGITIEPN

SEQ ID NO: 1744923 - protein, 21 aa, Staphylococcus epidermidis
STKYTYCTKIIYQAYKYGVDQ

SEQ ID NO: 1744924 - protein, 17 aa, Staphylococcus epidermidis
STLFKLLTLLSNKFEPL

SEQ ID NO: 1744925 - protein, 17 aa, Staphylococcus epidermidis
STLIAFIIYSFQLMSPI

SEQ ID NO: 1744926 - protein, 18 aa, Staphylococcus epidermidis
STLVFIILGWVFSVLSLL

SEQ ID NO: 1744927 - protein, 19 aa, Staphylococcus epidermidis
STLVTIVVFLPLVFVSGSV

SEQ ID NO: 1744928 - protein, 17 aa, Staphylococcus epidermidis
STSEIQLTLSFAMIGLA

SEQ ID NO: 1744929 - protein, 17 aa, Staphylococcus epidermidis
STSLRESTSTSLSDSTS

SEQ ID NO: 1744930 - protein, 23 aa, Staphylococcus epidermidis
STSLSGSLSTNVSDSTSTSTSDS

SEQ ID NO: 1744931 - protein, 23 aa, Staphylococcus epidermidis
STSLSGSLSTSVSDSTSASTSDS

SEQ ID NO: 1744932 - protein, 18 aa, Staphylococcus epidermidis
STSMSVSYSNSASTSLSD

SEQ ID NO: 1744933 - protein, 45 aa, Staphylococcus epidermidis
STSTSMSTSETFTSQSPINSESQFIGDSLSEDTIVTQSKNTNMLN

SEQ ID NO: 1744934 - protein, 19 aa, Staphylococcus epidermidis
STVKLKKGQTYTIDEIMKQ

SEQ ID NO: 1744935 - protein, 24 aa, Staphylococcus epidermidis
STYFDMINPILIGFFVFFFTFLIS

SEQ ID NO: 1744936 - protein, 22 aa, Staphylococcus epidermidis
SVAKRIRIISMIPLIILLILAF

SEQ ID NO: 1744937 - protein, 24 aa, Staphylococcus epidermidis
SVEQLRAAIIYVVLNIIGSWLFLL

SEQ ID NO: 1744938 - protein, 25 aa, Staphylococcus epidermidis
SVEVPKIGYKGNYKIRIVNNDPKKE

SEQ ID NO: 1744939 - protein, 19 aa, Staphylococcus epidermidis
SVGAFFIKLMQGYIPVESA

SEQ ID NO: 1744940 - protein, 18 aa, Staphylococcus epidermidis
SVILAVGVSTLIGIVFGW

SEQ ID NO: 1744941 - protein, 23 aa, Staphylococcus epidermidis
SVILCLMLLLPLSHIKKRIKHPI

SEQ ID NO: 1744942 - protein, 24 aa, Staphylococcus epidermidis
SVIRPREVIKYLMITFLVLVANSV

SEQ ID NO: 1744943 - protein, 19 aa, Staphylococcus epidermidis
SVISICLALIWTFLYRNDE

SEQ ID NO: 1744944 - protein, 27 aa, Staphylococcus epidermidis
SVKAFGEFEFWFALIKVVTIILMIIAG

SEQ ID NO: 1744945 - protein, 18 aa, Staphylococcus epidermidis
SVLCTHLFMDVMATAEAF

SEQ ID NO: 1744946 - protein, 24 aa, Staphylococcus epidermidis
SVLREGVEVIIFYMGMIGSIKTQD

SEQ ID NO: 1744947 - protein, 19 aa, Staphylococcus epidermidis
SVMTWILAPHMNYTKDEIE

SEQ ID NO: 1744948 - protein, 21 aa, Staphylococcus epidermidis
SVPDFLTWNIKNIIFDLIIIS

SEQ ID NO: 1744949 - protein, 28 aa, Staphylococcus epidermidis
SVTMTMLMRRLGSILGIKMIMKQMVSST

SEQ ID NO: 1744950 - protein, 19 aa, Staphylococcus epidermidis
SVVIIGLIWLFKDKGQDQH

SEQ ID NO: 1744951 - protein, 24 aa, Staphylococcus epidermidis
SVVLPWKEFGGIFATFPAVFLVSM

SEQ ID NO: 1744952 - protein, 29 aa, Staphylococcus epidermidis
SVVVVTCLWFLFCVFIFQYIKLLFSRPRF

SEQ ID NO: 1744953 - protein, 17 aa, Staphylococcus epidermidis
SVYSTGLSAIWITIGLT

SEQ ID NO: 1744954 - protein, 20 aa, Staphylococcus epidermidis
SWFLTFGYVCVVALNATAFS

SEQ ID NO: 1744955 - protein, 20 aa, Staphylococcus epidermidis
SWLFLPYLCMIFIGGIIHNK

SEQ ID NO: 1744956 - protein, 23 aa, Staphylococcus epidermidis
SYEDLKNLTINWFNILVLVAAVF

SEQ ID NO: 1744957 - protein, 18 aa, Staphylococcus epidermidis
SYEDLKNLTINWFNVLSL

SEQ ID NO: 1744958 - protein, 17 aa, Staphylococcus epidermidis
SYHSVKAINIIKDKFEL

SEQ ID NO: 1744959 - protein, 24 aa, Staphylococcus epidermidis
SYHTFLPWISLVPVVSVIGLLILL

SEQ ID NO: 1744960 - protein, 18 aa, Staphylococcus epidermidis
SYINFIIISCISMIGGYL

SEQ ID NO: 1744961 - protein, 27 aa, Staphylococcus epidermidis
SYISVRLKQEFDPMILFSLHINGVKMY

SEQ ID NO: 1744962 - protein, 25 aa, Staphylococcus epidermidis
SYKLYPALMLIMSVFLSFAVVVQNI

SEQ ID NO: 1744963 - protein, 18 aa, Staphylococcus epidermidis
SYNVLRVGLGVLVLLGTL

SEQ ID NO: 1744964 - protein, 18 aa, Staphylococcus epidermidis
SYQSAKIFIVQNVIDHFK

SEQ ID NO: 1744965 - protein, 19 aa, Staphylococcus epidermidis
SYSLYLWHFPIISFIHSHY

SEQ ID NO: 1744966 - protein, 18 aa, Staphylococcus epidermidis
SYSLYLWHYPIIIFMNSY

SEQ ID NO: 1744967 - protein, 17 aa, Staphylococcus epidermidis
SYSQLYGIMGILGFATL

SEQ ID NO: 1744968 - protein, 29 aa, Staphylococcus epidermidis
SYTISYKLKDGYTLESIASKVSARETFDS

SEQ ID NO: 1744969 - protein, 28 aa, Staphylococcus epidermidis
SYTISYKLKDGYTLESVASKVSARETFD

SEQ ID NO: 1744970 - protein, 20 aa, Staphylococcus epidermidis
SYTVEFETPSGYTPTKANSG

SEQ ID NO: 1744971 - protein, 26 aa, Staphylococcus epidermidis
SYVRKRKYNTFKWLGIAMSIIGVLLI

SEQ ID NO: 1744972 - protein, 20 aa, Staphylococcus epidermidis
SYVWLNRLLIVILMFLNGLG

SEQ ID NO: 1744973 - protein, 18 aa, Staphylococcus epidermidis
SYYEAVVLGFYFIYRLIA

SEQ ID NO: 1744974 - protein, 24 aa, Staphylococcus epidermidis
SYYFLFCIVIIIALVVSFPIVLII

SEQ ID NO: 1744975 - protein, 23 aa, Staphylococcus epidermidis
SYYLNCYFVYKVKPTLKKFLSFP

SEQ ID NO: 1744976 - protein, 18 aa, Staphylococcus epidermidis
TAADGWIGVTLIFGAFAF

SEQ ID NO: 1744977 - protein, 18 aa, Staphylococcus epidermidis
TAADGWVGVTIIFGAFAF

SEQ ID NO: 1744978 - protein, 20 aa, Staphylococcus epidermidis
TADSPRGSLDIQVDQEEKEN

SEQ ID NO: 1744979 - protein, 26 aa, Staphylococcus epidermidis
TAGTMEWAKLGILISLLFFPNGHILI

SEQ ID NO: 1744980 - protein, 26 aa, Staphylococcus epidermidis
TAGTMEWAKLGILLSLLFFPNGHILI

SEQ ID NO: 1744981 - protein, 21 aa, Staphylococcus epidermidis
TAHVHITWMNWFIAAIVPGLI

SEQ ID NO: 1744982 - protein, 24 aa, Staphylococcus epidermidis
TAIFNYWRMFAISFIFFIIAGLLT

SEQ ID NO: 1744983 - protein, 18 aa, Staphylococcus epidermidis
TAIGLIFTQIGFPIVDII

SEQ ID NO: 1744984 - protein, 22 aa, Staphylococcus epidermidis
TAKELKKLLVKEGAKVKMTRTS

SEQ ID NO: 1744985 - protein, 22 aa, Staphylococcus epidermidis
TALFLLCFYHLPNLNRYNEKPT

SEQ ID NO: 1744986 - protein, 17 aa, Staphylococcus epidermidis
TALGYGIFAYCLHFLAQ

SEQ ID NO: 1744987 - protein, 18 aa, Staphylococcus epidermidis
TAQDYFPTVKKDVAQAAD

SEQ ID NO: 1744988 - protein, 23 aa, Staphylococcus epidermidis
TARNYKGGTNLVVRNAENNQEIA

SEQ ID NO: 1744989 - protein, 18 aa, Staphylococcus epidermidis
TASALTLALYLFSGNASA

SEQ ID NO: 1744990 - protein, 24 aa, Staphylococcus epidermidis
TATPIAGFLVMFGFNSLTKVIIYG

SEQ ID NO: 1744991 - protein, 21 aa, Staphylococcus epidermidis
TCVFIGFIVCGRWITHDLQTY

SEQ ID NO: 1744992 - protein, 20 aa, Staphylococcus epidermidis
TCVLIGFIVCGRWITHDLQT

SEQ ID NO: 1744993 - protein, 23 aa, Staphylococcus epidermidis
TDELKANIVSLPKTDKVADHLTA

SEQ ID NO: 1744994 - protein, 26 aa, Staphylococcus epidermidis
TDFLKTTRNAFFIGRTIDYNVSLEGA

SEQ ID NO: 1744995 - protein, 25 aa, Staphylococcus epidermidis
TDGLYWRIGACIVGAIFVVSYLYWY

SEQ ID NO: 1744996 - protein, 17 aa, Staphylococcus epidermidis
TDKEILAIIAVADEVRE

SEQ ID NO: 1744997 - protein, 24 aa, Staphylococcus epidermidis
TDLNRTGFWLKIPGKPGGVNKEYA

SEQ ID NO: 1744998 - protein, 26 aa, Staphylococcus epidermidis
TDLSYLTQMCVITFLMFTSAASGYAV

SEQ ID NO: 1744999 - protein, 24 aa, Staphylococcus epidermidis
TDNLPRFFVYLLLFMFSMIGIVIA

SEQ ID NO: 1745000 - protein, 18 aa, Staphylococcus epidermidis
TDPNFDFDGYVYVNDKKY

SEQ ID NO: 1745001 - protein, 20 aa, Staphylococcus epidermidis
TDYGISLIFVEDVIESLPEH

SEQ ID NO: 1745002 - protein, 25 aa, Staphylococcus epidermidis
TDYKRDGKELGEFYQSLINNMMRVE

SEQ ID NO: 1745003 - protein, 21 aa, Staphylococcus epidermidis
TEAKWQESREELIDRINNVDS

SEQ ID NO: 1745004 - protein, 17 aa, Staphylococcus epidermidis
TEAQALDGLMSALKESI

SEQ ID NO: 1745005 - protein, 21 aa, Staphylococcus epidermidis
TEAQKFFSQNLREMVTESGLA

SEQ ID NO: 1745006 - protein, 34 aa, Staphylococcus epidermidis
TEDNRFYHHGALDYKRLFGAVGKNLTGGFGAQGA

SEQ ID NO: 1745007 - protein, 21 aa, Staphylococcus epidermidis
TEEKPLLHVTVWVDENGNILK

SEQ ID NO: 1745008 - protein, 18 aa, Staphylococcus epidermidis
TEGFIRKYANVVNIEPNQ

SEQ ID NO: 1745009 - protein, 19 aa, Staphylococcus epidermidis
TEGIARPSFIAVTSDKYIP

SEQ ID NO: 1745010 - protein, 33 aa, Staphylococcus epidermidis
TEGMPLLAFHYPEEIWRGVFAFMSMMENIHHKS

SEQ ID NO: 1745011 - protein, 21 aa, Staphylococcus epidermidis
TEHKVEQIIHWAHLGDHIEEK

SEQ ID NO: 1745012 - protein, 21 aa, Staphylococcus epidermidis
TEINYLYTFSVLFFVDLIIIL

SEQ ID NO: 1745013 - protein, 20 aa, Staphylococcus epidermidis
TELEDLYFRGNERLLHQAFN

SEQ ID NO: 1745014 - protein, 21 aa, Staphylococcus epidermidis
TELEDLYFRGNERLLHQAFNN

SEQ ID NO: 1745015 - protein, 20 aa, Staphylococcus epidermidis
TELEDVYFLGNDRLIHQAFS

SEQ ID NO: 1745016 - protein, 25 aa, Staphylococcus epidermidis
TELMRRVESQAGYNFLTGNGSNPIN

SEQ ID NO: 1745017 - protein, 18 aa, Staphylococcus epidermidis
TELSESIADYENQKQQEN

SEQ ID NO: 1745018 - protein, 22 aa, Staphylococcus epidermidis
TELVQVRWLFRVTALVVFGLIV

SEQ ID NO: 1745019 - protein, 29 aa, Staphylococcus epidermidis
TENGNWFWKLTLIFFGLLVKLCLNINFNS

SEQ ID NO: 1745020 - protein, 17 aa, Staphylococcus epidermidis
TEQDIPKSSNKEVPNLV

SEQ ID NO: 1745021 - protein, 23 aa, Staphylococcus epidermidis
TESELKGVPGIGPTKAKEIINYR

SEQ ID NO: 1745022 - protein, 24 aa, Staphylococcus epidermidis
TETFKEVLKGTGVEPGKNNKETQQ

SEQ ID NO: 1745023 - protein, 23 aa, Staphylococcus epidermidis
TEVANICLLLTCFILAKVYSKNK

SEQ ID NO: 1745024 - protein, 26 aa, Staphylococcus epidermidis
TFDSIVFRNALQYTVIMAVAIFIALA

SEQ ID NO: 1745025 - protein, 26 aa, Staphylococcus epidermidis
TFFNEKGRIIGLLQMFMTKESIADRI

SEQ ID NO: 1745026 - protein, 19 aa, Staphylococcus epidermidis
TFHIPKVINGLVMIVGAVC

SEQ ID NO: 1745027 - protein, 23 aa, Staphylococcus epidermidis
TFHSYHELEFLLVIREDEKDTFS

SEQ ID NO: 1745028 - protein, 17 aa, Staphylococcus epidermidis
TFIFIFMSGIAFFITYK

SEQ ID NO: 1745029 - protein, 40 aa, Staphylococcus epidermidis
TFIFKNNFSIRKLKFGVASITLGSALIIGAHQEAKADENS

SEQ ID NO: 1745030 - protein, 22 aa, Staphylococcus epidermidis
TFIGAFLLYLPYTGRKPINFID

SEQ ID NO: 1745031 - protein, 21 aa, Staphylococcus epidermidis
TFILICGYLSHKNKINYMETQ

SEQ ID NO: 1745032 - protein, 27 aa, Staphylococcus epidermidis
TFISELSFGLPETWATALYGMAIVVGG

SEQ ID NO: 1745033 - protein, 25 aa, Staphylococcus epidermidis
TFLLYANVVYFRFFSDFLTFSTLNQ

SEQ ID NO: 1745034 - protein, 24 aa, Staphylococcus epidermidis
TFLYGVYIFLRIKKWITQRNLVYF

SEQ ID NO: 1745035 - protein, 17 aa, Staphylococcus epidermidis
TFTFLIISRVIQGFGAG

SEQ ID NO: 1745036 - protein, 21 aa, Staphylococcus epidermidis
TGANQKWLMSHNMNAMKDNTN

SEQ ID NO: 1745037 - protein, 24 aa, Staphylococcus epidermidis
TGATCYEILKIIGYPEIILNQIKF

SEQ ID NO: 1745038 - protein, 26 aa, Staphylococcus epidermidis
TGEIKFSHWQWFISIASIVVLFIANM

SEQ ID NO: 1745039 - protein, 24 aa, Staphylococcus epidermidis
TGFFSVRLLLSLVFINLTSPVGMH

SEQ ID NO: 1745040 - protein, 19 aa, Staphylococcus epidermidis
TGIELFKMPSIEDVLSGEL

SEQ ID NO: 1745041 - protein, 18 aa, Staphylococcus epidermidis
TGIFVGGGGVAWLIHPLF

SEQ ID NO: 1745042 - protein, 17 aa, Staphylococcus epidermidis
TGIKLLGFVVPVIVTIG

SEQ ID NO: 1745043 - protein, 17 aa, Staphylococcus epidermidis
TGIPQWILVTLLTVITI

SEQ ID NO: 1745044 - protein, 20 aa, Staphylococcus epidermidis
TGIYSAMLPLTFKFGPENSN

SEQ ID NO: 1745045 - protein, 20 aa, Staphylococcus epidermidis
TGKETIKITSIDKGDNVSPA

SEQ ID NO: 1745046 - protein, 19 aa, Staphylococcus epidermidis
TGNAEWYIYLGQFINAGVA

SEQ ID NO: 1745047 - protein, 18 aa, Staphylococcus epidermidis
TGNIWRYLVAIIACLLWF

SEQ ID NO: 1745048 - protein, 24 aa, Staphylococcus epidermidis
TGQDYPVMMAMTLFFSFLGLLGNL

SEQ ID NO: 1745049 - protein, 20 aa, Staphylococcus epidermidis
TGQFTLFFMHLSKILKQGKI

SEQ ID NO: 1745050 - protein, 24 aa, Staphylococcus epidermidis
TGTFLPSVVPIHFNLLTMLIYGIV

SEQ ID NO: 1745051 - protein, 21 aa, Staphylococcus epidermidis
THCVTRLRLVLNDDSKVDKDA

SEQ ID NO: 1745052 - protein, 23 aa, Staphylococcus epidermidis
THEKSRVLLIIFLILGLIFIGMG

SEQ ID NO: 1745053 - protein, 26 aa, Staphylococcus epidermidis
THFPQDWTIFYWSWWLVYAPFIGLFI

SEQ ID NO: 1745054 - protein, 31 aa, Staphylococcus epidermidis
THIIKCIVRFKLKHMFFVIGAYLMFLLFSLL

SEQ ID NO: 1745055 - protein, 22 aa, Staphylococcus epidermidis
THIVRMIIGLLVIVLAGMSVSI

SEQ ID NO: 1745056 - protein, 22 aa, Staphylococcus epidermidis
THLRLLQRLSKSLMHDDTRDRL

SEQ ID NO: 1745057 - protein, 24 aa, Staphylococcus epidermidis
THTGCGCSIGCFSIMFISFLLSML

SEQ ID NO: 1745058 - protein, 19 aa, Staphylococcus epidermidis
TIDGKVIFNNISFKNSDVG

SEQ ID NO: 1745059 - protein, 28 aa, Staphylococcus epidermidis
TIDSGFYKPTYNLGDYVWEDTNKDGIQD

SEQ ID NO: 1745060 - protein, 18 aa, Staphylococcus epidermidis
TIFILIGVFDKFGKDTIS

SEQ ID NO: 1745061 - protein, 22 aa, Staphylococcus epidermidis
TIFLSLKISMWSMTILLLMYTF

SEQ ID NO: 1745062 - protein, 19 aa, Staphylococcus epidermidis
TIGGLWKQRVRWAQGGHEV

SEQ ID NO: 1745063 - protein, 23 aa, Staphylococcus epidermidis
TIGHLQGGFNWVDQTWQYVDHET

SEQ ID NO: 1745064 - protein, 28 aa, Staphylococcus epidermidis
TIGMGWIIPALVGFIIGFVVYKIRGNKQ

SEQ ID NO: 1745065 - protein, 22 aa, Staphylococcus epidermidis
TIILRPYLDVLLLGRAQAINLG

SEQ ID NO: 1745066 - protein, 20 aa, Staphylococcus epidermidis
TIILVIAGIVGWYFWSAWSF

SEQ ID NO: 1745067 - protein, 29 aa, Staphylococcus epidermidis
TIIVLVVIGVLGFWFWNNATSYVTTDNAK

SEQ ID NO: 1745068 - protein, 33 aa, Staphylococcus epidermidis
TIKNFKLPLIILMFASSILSYFIIYSYTQKETK

SEQ ID NO: 1745069 - protein, 22 aa, Staphylococcus epidermidis
TIKSDAKTAIDQKAQQQSTIID

SEQ ID NO: 1745070 - protein, 19 aa, Staphylococcus epidermidis
TILAIRMGVNIGIAAAIIT

SEQ ID NO: 1745071 - protein, 19 aa, Staphylococcus epidermidis
TILHLSTWLFAFWGVMIIT

SEQ ID NO: 1745072 - protein, 23 aa, Staphylococcus epidermidis
TILLEIIFYFKLLKNYQYDQTNV

SEQ ID NO: 1745073 - protein, 18 aa, Staphylococcus epidermidis
TILTLSTWLFAFWGVMIV

SEQ ID NO: 1745074 - protein, 20 aa, Staphylococcus epidermidis
TIPAFLSILLVLTFIIFTLA

SEQ ID NO: 1745075 - protein, 22 aa, Staphylococcus epidermidis
TIPENRQGPALGTLSILLGIGP

SEQ ID NO: 1745076 - protein, 29 aa, Staphylococcus epidermidis
TIPYMLCSLLMIRVGERFMQKRGPQLPLM

SEQ ID NO: 1745077 - protein, 20 aa, Staphylococcus epidermidis
TIQQRYIKMIAIGSFIAMAS

SEQ ID NO: 1745078 - protein, 24 aa, Staphylococcus epidermidis
TISLICGRLIFNQRHRLLSSQSPI

SEQ ID NO: 1745079 - protein, 18 aa, Staphylococcus epidermidis
TIVFFPIFYIGHLVTKEH

SEQ ID NO: 1745080 - protein, 17 aa, Staphylococcus epidermidis
TIVFGFFALTFVTPLLR

SEQ ID NO: 1745081 - protein, 28 aa, Staphylococcus epidermidis
TIVKDGITKHIFKKEMTKKPTGKTKNPE

SEQ ID NO: 1745082 - protein, 20 aa, Staphylococcus epidermidis
TKAFTGYAILQLVQEGKINL

SEQ ID NO: 1745083 - protein, 18 aa, Staphylococcus epidermidis
TKASDYGTFFAMQPMMYI

SEQ ID NO: 1745084 - protein, 24 aa, Staphylococcus epidermidis
TKEGTSWILDTEVPGISINPNTGE

SEQ ID NO: 1745085 - protein, 37 aa, Staphylococcus epidermidis
TKGEDGVVSNGFIVAVAIVLAIFGLAKKSRKDDDDQD

SEQ ID NO: 1745086 - protein, 20 aa, Staphylococcus epidermidis
TKHIILKIALFSCLFSLPVY

SEQ ID NO: 1745087 - protein, 25 aa, Staphylococcus epidermidis
TKHKVLSIFIAFIFVVSPLYFRFSA

SEQ ID NO: 1745088 - protein, 21 aa, Staphylococcus epidermidis
TKICRHLKIDLGAYFLLIISQ

SEQ ID NO: 1745089 - protein, 18 aa, Staphylococcus epidermidis
TKINWKVFITPVILTLVL

SEQ ID NO: 1745090 - protein, 22 aa, Staphylococcus epidermidis
TKKKIKITLAMINVLLTAVELY

SEQ ID NO: 1745091 - protein, 19 aa, Staphylococcus epidermidis
TKKKIKVTFAMINVLLTAV

SEQ ID NO: 1745092 - protein, 23 aa, Staphylococcus epidermidis
TKLFEPLCNAIVKINESTLPTTS

SEQ ID NO: 1745093 - protein, 21 aa, Staphylococcus epidermidis
TKSEYYVDAFQLRLKELDSKY

SEQ ID NO: 1745094 - protein, 24 aa, Staphylococcus epidermidis
TKVYELISFISWFALPLLMSQVYV

SEQ ID NO: 1745095 - protein, 26 aa, Staphylococcus epidermidis
TLAYQFGRKRILSIALLTLTVTSLGA

SEQ ID NO: 1745096 - protein, 21 aa, Staphylococcus epidermidis
TLCLACVLYLIGQSIVNHVSI

SEQ ID NO: 1745097 - protein, 21 aa, Staphylococcus epidermidis
TLCLACVLYLIGQTIINHVSI

SEQ ID NO: 1745098 - protein, 19 aa, Staphylococcus epidermidis
TLDKEIIKQLTDGVNQANN

SEQ ID NO: 1745099 - protein, 21 aa, Staphylococcus epidermidis
TLEEKQIALGKLEEVKNEALN

SEQ ID NO: 1745100 - protein, 20 aa, Staphylococcus epidermidis
TLEKYGRWIIPIVFIGLGIY

SEQ ID NO: 1745101 - protein, 17 aa, Staphylococcus epidermidis
TLFDDMTHVISLNTGRS

SEQ ID NO: 1745102 - protein, 27 aa, Staphylococcus epidermidis
TLFFWFFKLKYSFGHIINSKIFTQEFI

SEQ ID NO: 1745103 - protein, 17 aa, Staphylococcus epidermidis
TLFKGVGIIFLITGIIF

SEQ ID NO: 1745104 - protein, 25 aa, Staphylococcus epidermidis
TLFMKSRFWLPLIISSMVFSSQHLS

SEQ ID NO: 1745105 - protein, 17 aa, Staphylococcus epidermidis
TLFVPVDLFNSWTSAKA

SEQ ID NO: 1745106 - protein, 19 aa, Staphylococcus epidermidis
TLFVPVELFNSWTSAQAQF

SEQ ID NO: 1745107 - protein, 17 aa, Staphylococcus epidermidis
TLIASKNESSWTLNKQI

SEQ ID NO: 1745108 - protein, 18 aa, Staphylococcus epidermidis
TLIIPILFFIIAIMMFAR

SEQ ID NO: 1745109 - protein, 30 aa, Staphylococcus epidermidis
TLITFTTILLFCLIIIFFLKDTLRNSELDE

SEQ ID NO: 1745110 - protein, 23 aa, Staphylococcus epidermidis
TLIVFFGLGFFKFADAHVTLNPN

SEQ ID NO: 1745111 - protein, 24 aa, Staphylococcus epidermidis
TLLETFFSSSLFKAMTKMLAFARN

SEQ ID NO: 1745112 - protein, 19 aa, Staphylococcus epidermidis
TLLGVVGALIIKGRKNLAG

SEQ ID NO: 1745113 - protein, 24 aa, Staphylococcus epidermidis
TLLLAKDIHPWLGVLMSAVMVGVI

SEQ ID NO: 1745114 - protein, 24 aa, Staphylococcus epidermidis
TLLTICTLLLCFLKADTSYTYLII

SEQ ID NO: 1745115 - protein, 26 aa, Staphylococcus epidermidis
TLLTLFVVPVMYEILFTLKNKLTKKF

SEQ ID NO: 1745116 - protein, 21 aa, Staphylococcus epidermidis
TLNEITIQLDAQRDLIKNNKE

SEQ ID NO: 1745117 - protein, 19 aa, Staphylococcus epidermidis
TLNLAKGIHPWLGLVLTVI

SEQ ID NO: 1745118 - protein, 19 aa, Staphylococcus epidermidis
TLNSFKINGAIVVIFTSIL

SEQ ID NO: 1745119 - protein, 18 aa, Staphylococcus epidermidis
TLPLGRPFFTACIGGGIG

SEQ ID NO: 1745120 - protein, 20 aa, Staphylococcus epidermidis
TLQIIFPYSLSMAIVGLVES

SEQ ID NO: 1745121 - protein, 34 aa, Staphylococcus epidermidis
TLQMLNMRYSHWLRFVWPVVAFVLVFGGGLLIAQ

SEQ ID NO: 1745122 - protein, 22 aa, Staphylococcus epidermidis
TLQRDALSPIQFVVESDIEHTG

SEQ ID NO: 1745123 - protein, 23 aa, Staphylococcus epidermidis
TLRYANYFSIRKLTVGVASITLG

SEQ ID NO: 1745124 - protein, 26 aa, Staphylococcus epidermidis
TLTIPKDRPVVFKLQAMDTMTSFWIP

SEQ ID NO: 1745125 - protein, 53 aa, Staphylococcus epidermidis
TLTPDAYSQKGAISLNTRLDSNRSFRFTGKVNLGNRYEGYSPDGVPGGDGIGF

SEQ ID NO: 1745126 - protein, 28 aa, Staphylococcus epidermidis
TLVPAIICLAGIFITMIWRSFQIDHGYH

SEQ ID NO: 1745127 - protein, 21 aa, Staphylococcus epidermidis
TLYLLDVHLGYTFSGGFIDYV

SEQ ID NO: 1745128 - protein, 19 aa, Staphylococcus epidermidis
TLYYWIRYLNYDVISRDKD

SEQ ID NO: 1745129 - protein, 21 aa, Staphylococcus epidermidis
TMICLIDIGHLFRVNRRLGGS

SEQ ID NO: 1745130 - protein, 22 aa, Staphylococcus epidermidis
TMLRLGLHGADIIPLLEGFGCN

SEQ ID NO: 1745131 - protein, 35 aa, Staphylococcus epidermidis
TMRILKSAFLSGLMLEFISLLGIGLVALEVALSLV

SEQ ID NO: 1745132 - protein, 35 aa, Staphylococcus epidermidis
TMRILKSAFLSGLMLEFISMLGIGLVALEVALSLV

SEQ ID NO: 1745133 - protein, 18 aa, Staphylococcus epidermidis
TMTFLTLPPKEVFLASVL

SEQ ID NO: 1745134 - protein, 23 aa, Staphylococcus epidermidis
TNALSHRNLFEVRLKDQDVQSHI

SEQ ID NO: 1745135 - protein, 19 aa, Staphylococcus epidermidis
TNDVVKNFTANGLLSLGAS

SEQ ID NO: 1745136 - protein, 20 aa, Staphylococcus epidermidis
TNELYFKSWEGLYHEIQNEP

SEQ ID NO: 1745137 - protein, 22 aa, Staphylococcus epidermidis
TNEMRHLKGLKPLKTNNDIAHI

SEQ ID NO: 1745138 - protein, 17 aa, Staphylococcus epidermidis
TNFITAMIKSRDLMYQN

SEQ ID NO: 1745139 - protein, 18 aa, Staphylococcus epidermidis
TNGIISLFLLTAGFIALY

SEQ ID NO: 1745140 - protein, 22 aa, Staphylococcus epidermidis
TNGKKPASIRQYETAKARIQNQ

SEQ ID NO: 1745141 - protein, 26 aa, Staphylococcus epidermidis
TNHVFSFKLLLSLLVIGFIVLAILLA

SEQ ID NO: 1745142 - protein, 19 aa, Staphylococcus epidermidis
TNIFFVVGIIITFMAILFQ

SEQ ID NO: 1745143 - protein, 27 aa, Staphylococcus epidermidis
TNKIILKILFVIIIVFVLFVGLMYFLS

SEQ ID NO: 1745144 - protein, 19 aa, Staphylococcus epidermidis
TNLMATPLNLRNDNPRINL

SEQ ID NO: 1745145 - protein, 33 aa, Staphylococcus epidermidis
TNSLISRFRQLATGAYKYNPFLINQVKNLNQLD

SEQ ID NO: 1745146 - protein, 26 aa, Staphylococcus epidermidis
TNSNFPKERIRFIAIQYLLDNVQISQ

SEQ ID NO: 1745147 - protein, 21 aa, Staphylococcus epidermidis
TNTPHAWWWDAILYGGIIIGN

SEQ ID NO: 1745148 - protein, 20 aa, Staphylococcus epidermidis
TPFCSCSTIPILAGLLNSKV

SEQ ID NO: 1745149 - protein, 21 aa, Staphylococcus epidermidis
TPFRKQGLKAFAIKKRFKPQF

SEQ ID NO: 1745150 - protein, 19 aa, Staphylococcus epidermidis
TPGEFTFNIEAGPHSPTIP

SEQ ID NO: 1745151 - protein, 20 aa, Staphylococcus epidermidis
TPIWFILLGLMYLRYKKANK

SEQ ID NO: 1745152 - protein, 18 aa, Staphylococcus epidermidis
TPPIGLGLATFIQKRKFN

SEQ ID NO: 1745153 - protein, 23 aa, Staphylococcus epidermidis
TPPKRAHYAFIMTMCGIHGTISL

SEQ ID NO: 1745154 - protein, 26 aa, Staphylococcus epidermidis
TPYLHIMGIYVLRSFGMAFIMMPIMT

SEQ ID NO: 1745155 - protein, 22 aa, Staphylococcus epidermidis
TQIFGIPVFLFLNILIILLCII

SEQ ID NO: 1745156 - protein, 22 aa, Staphylococcus epidermidis
TQIFGIPVFLFLNLLIVFLCII

SEQ ID NO: 1745157 - protein, 22 aa, Staphylococcus epidermidis
TQIFGIPVFLFLNLLIVLLCII

SEQ ID NO: 1745158 - protein, 17 aa, Staphylococcus epidermidis
TQIQRFVEYSKGEIAVG

SEQ ID NO: 1745159 - protein, 26 aa, Staphylococcus epidermidis
TQKPTARKAISGMASQLNNSINNTPY

SEQ ID NO: 1745160 - protein, 18 aa, Staphylococcus epidermidis
TQTSHSYIAWKLNPAGSI

SEQ ID NO: 1745161 - protein, 20 aa, Staphylococcus epidermidis
TRAAIFISPIWFIFLFFYYK

SEQ ID NO: 1745162 - protein, 27 aa, Staphylococcus epidermidis
TRHGLKNRLTLVVVIAFILFLILLFMF

SEQ ID NO: 1745163 - protein, 19 aa, Staphylococcus epidermidis
TRKEWNFNTIKSYQKLIRV

SEQ ID NO: 1745164 - protein, 21 aa, Staphylococcus epidermidis
TRKFVKNTINRIGRIGGSKAL

SEQ ID NO: 1745165 - protein, 20 aa, Staphylococcus epidermidis
TRKKWNFNTIKSYQKLIRVV

SEQ ID NO: 1745166 - protein, 27 aa, Staphylococcus epidermidis
TRLIKVNKLWKVPREAARISAWSFTLA

SEQ ID NO: 1745167 - protein, 18 aa, Staphylococcus epidermidis
TRLQHWCEKFDVTMVIKR

SEQ ID NO: 1745168 - protein, 19 aa, Staphylococcus epidermidis
TRPTSFIVPGFFVITVSII

SEQ ID NO: 1745169 - protein, 22 aa, Staphylococcus epidermidis
TRRAIYITPVWFFILGLMYLRY

SEQ ID NO: 1745170 - protein, 23 aa, Staphylococcus epidermidis
TRRQDFWWPMLFNFIIISLTDSV

SEQ ID NO: 1745171 - protein, 24 aa, Staphylococcus epidermidis
TRSRCDYCAEVIKPYDLLPIISFI

SEQ ID NO: 1745172 - protein, 28 aa, Staphylococcus epidermidis
TRSVALARFPWLSANIEYTVTREPYFST

SEQ ID NO: 1745173 - protein, 28 aa, Staphylococcus epidermidis
TRSWVNFLLKLLLSFVIVIFSGIIIPTI

SEQ ID NO: 1745174 - protein, 19 aa, Staphylococcus epidermidis
TRTAKGYFLIDEIKDDNSG

SEQ ID NO: 1745175 - protein, 19 aa, Staphylococcus epidermidis
TRTAKGYFLIDEIKDDSNG

SEQ ID NO: 1745176 - protein, 18 aa, Staphylococcus epidermidis
TRVEIWTLSIDHMSEAAK

SEQ ID NO: 1745177 - protein, 24 aa, Staphylococcus epidermidis
TRVLYRLTFVGSIFLAAIAILPII

SEQ ID NO: 1745178 - protein, 17 aa, Staphylococcus epidermidis
TRYALKSMMAGFLLSIV

SEQ ID NO: 1745179 - protein, 18 aa, Staphylococcus epidermidis
TSAWKGIFWGLVYGGLAF

SEQ ID NO: 1745180 - protein, 32 aa, Staphylococcus epidermidis
TSEINKISVITIKKPEAIAEIQELADKKLNKF

SEQ ID NO: 1745181 - protein, 23 aa, Staphylococcus epidermidis
TSGKTPASIRKYNEAKSRIQTQI

SEQ ID NO: 1745182 - protein, 23 aa, Staphylococcus epidermidis
TSKGPRIDIFSSDFDKNYMKSAS

SEQ ID NO: 1745183 - protein, 25 aa, Staphylococcus epidermidis
TSKQFTITIQDTISPVVNVTPSQAS

SEQ ID NO: 1745184 - protein, 18 aa, Staphylococcus epidermidis
TSKWLAVWSAIFFGNIVF

SEQ ID NO: 1745185 - protein, 19 aa, Staphylococcus epidermidis
TSLRESTSTSTSDSASTST

SEQ ID NO: 1745186 - protein, 24 aa, Staphylococcus epidermidis
TSMPEYWIAILLIYYLGVQWHLVP

SEQ ID NO: 1745187 - protein, 22 aa, Staphylococcus epidermidis
TSMSESLSTSVSDSTSTSTSDS

SEQ ID NO: 1745188 - protein, 22 aa, Staphylococcus epidermidis
TSMSTSETFTSQSPINSESQFI

SEQ ID NO: 1745189 - protein, 20 aa, Staphylococcus epidermidis
TSPFVMMTWITVLIPGQVKS

SEQ ID NO: 1745190 - protein, 20 aa, Staphylococcus epidermidis
TSPIFIKQKWFGEQHTPVYV

SEQ ID NO: 1745191 - protein, 20 aa, Staphylococcus epidermidis
TSPIFIKQKWFGEQRTPVYV

SEQ ID NO: 1745192 - protein, 18 aa, Staphylococcus epidermidis
TSSKRLTVVTNVDNWHSY

SEQ ID NO: 1745193 - protein, 30 aa, Staphylococcus epidermidis
TSTSMSTSETFTSQSPINSESQFIGDSLSE

SEQ ID NO: 1745194 - protein, 20 aa, Staphylococcus epidermidis
TSVLPEWAFGLFGAVIFGAI

SEQ ID NO: 1745195 - protein, 18 aa, Staphylococcus epidermidis
TSYGAGIIHFLGGIHEIY

SEQ ID NO: 1745196 - protein, 30 aa, Staphylococcus epidermidis
TTDIVQVRWLFRISSLIIFSIIIQSIYIAY

SEQ ID NO: 1745197 - protein, 44 aa, Staphylococcus epidermidis
TTDSNGKYEFTGLENGDYTIEFETPEGYTPTKQNSGSDEGKDSN

SEQ ID NO: 1745198 - protein, 23 aa, Staphylococcus epidermidis
TTGQDAAQFNGPQGTSVAQPGND

SEQ ID NO: 1745199 - protein, 24 aa, Staphylococcus epidermidis
TTIELPVAMVVSWILWGPQPNFLK

SEQ ID NO: 1745200 - protein, 18 aa, Staphylococcus epidermidis
TTIGGLLSAIGIAGMDRV

SEQ ID NO: 1745201 - protein, 20 aa, Staphylococcus epidermidis
TTLDTAMHGLRESIKDKNDT

SEQ ID NO: 1745202 - protein, 17 aa, Staphylococcus epidermidis
TTLLITWLLPVGVAIIP

SEQ ID NO: 1745203 - protein, 19 aa, Staphylococcus epidermidis
TTLWSRNLFDIQLIDEEHE

SEQ ID NO: 1745204 - protein, 32 aa, Staphylococcus epidermidis
TTMWQMANSFSMWRLFGISIIAIIGMLIWIMM

SEQ ID NO: 1745205 - protein, 24 aa, Staphylococcus epidermidis
TTNPKADIPGIIYSTIGFGALLYG

SEQ ID NO: 1745206 - protein, 17 aa, Staphylococcus epidermidis
TTPLLASWLVERTGNIL

SEQ ID NO: 1745207 - protein, 22 aa, Staphylococcus epidermidis
TTTLAGALLFTGVGATHNAHAA

SEQ ID NO: 1745208 - protein, 30 aa, Staphylococcus epidermidis
TTTPTIWASVLSFFAGVLLLKRQTRKSNKK

SEQ ID NO: 1745209 - protein, 23 aa, Staphylococcus epidermidis
TTVLTGLLLFPSVNDTTTHAAEV

SEQ ID NO: 1745210 - protein, 17 aa, Staphylococcus epidermidis
TTYYVIMVVSPIFITYA

SEQ ID NO: 1745211 - protein, 32 aa, Staphylococcus epidermidis
TVANWRILFVLLGILGLVWVMVWAKVFTDYPE

SEQ ID NO: 1745212 - protein, 23 aa, Staphylococcus epidermidis
TVARYRISLIDHMKELPLGYYQK

SEQ ID NO: 1745213 - protein, 28 aa, Staphylococcus epidermidis
TVATIRKETCSWKWTLFALIYPIITAYG

SEQ ID NO: 1745214 - protein, 19 aa, Staphylococcus epidermidis
TVDINLKIPDKIGDTSFSF

SEQ ID NO: 1745215 - protein, 21 aa, Staphylococcus epidermidis
TVDQWCVLDEVALKNKLIARI

SEQ ID NO: 1745216 - protein, 18 aa, Staphylococcus epidermidis
TVEQTIYINPLRYSAKET

SEQ ID NO: 1745217 - protein, 23 aa, Staphylococcus epidermidis
TVFCMLLNLTPIFAILTAIVTIE

SEQ ID NO: 1745218 - protein, 28 aa, Staphylococcus epidermidis
TVGGIVPEILITKVVVLTLFGLGFIIFG

SEQ ID NO: 1745219 - protein, 17 aa, Staphylococcus epidermidis
TVIALPLSYIMTKTSLA

SEQ ID NO: 1745220 - protein, 18 aa, Staphylococcus epidermidis
TVIKSPWLGRILIVGCIF

SEQ ID NO: 1745221 - protein, 25 aa, Staphylococcus epidermidis
TVILFFAIGCFKYADAHVTLNPNQS

SEQ ID NO: 1745222 - protein, 18 aa, Staphylococcus epidermidis
TVILLIAILFQFNLAHVA

SEQ ID NO: 1745223 - protein, 24 aa, Staphylococcus epidermidis
TVIVFFCIFLIFSPIGKLKLGKPN

SEQ ID NO: 1745224 - protein, 26 aa, Staphylococcus epidermidis
TVKGRDNYDFYGRVDIESNPTDLNAT

SEQ ID NO: 1745225 - protein, 19 aa, Staphylococcus epidermidis
TVKLILEIVRTIFVIELVG

SEQ ID NO: 1745226 - protein, 18 aa, Staphylococcus epidermidis
TVLHLLGIDSKNYLMFGT

SEQ ID NO: 1745227 - protein, 29 aa, Staphylococcus epidermidis
TVNGQENLYRIAIQYYGSGTQENVDKIKR

SEQ ID NO: 1745228 - protein, 17 aa, Staphylococcus epidermidis
TVNKKEALWSINENING

SEQ ID NO: 1745229 - protein, 24 aa, Staphylococcus epidermidis
TVNPNSEVIFEFNTMTARNYKGGT

SEQ ID NO: 1745230 - protein, 25 aa, Staphylococcus epidermidis
TVPSDLTDSFAIPKIKDNSGEIIAT

SEQ ID NO: 1745231 - protein, 23 aa, Staphylococcus epidermidis
TVTDLRPAGIITCENDRIDAVSD

SEQ ID NO: 1745232 - protein, 19 aa, Staphylococcus epidermidis
TVYFNDRYIVILGTNVKNT

SEQ ID NO: 1745233 - protein, 29 aa, Staphylococcus epidermidis
TVYGQENLYRIAIQYYGEGTQANVDKIKR

SEQ ID NO: 1745234 - protein, 19 aa, Staphylococcus epidermidis
TWILLIGSFFQWFDSAFNG

SEQ ID NO: 1745235 - protein, 20 aa, Staphylococcus epidermidis
TWILLIGSFFQWFDSAFNGF

SEQ ID NO: 1745236 - protein, 27 aa, Staphylococcus epidermidis
TWLFAFWGVMIITAFLVRDFSQGTSQL

SEQ ID NO: 1745237 - protein, 18 aa, Staphylococcus epidermidis
TWVNLLFKSLSLSMILVF

SEQ ID NO: 1745238 - protein, 24 aa, Staphylococcus epidermidis
TWVYIVLCYLSFLVITANILDYTY

SEQ ID NO: 1745239 - protein, 20 aa, Staphylococcus epidermidis
TYAGKTWTATLSELGLSPTD

SEQ ID NO: 1745240 - protein, 23 aa, Staphylococcus epidermidis
TYDHMKAKVKITITKEGHILISK

SEQ ID NO: 1745241 - protein, 23 aa, Staphylococcus epidermidis
TYDNMKAIVKISISKEGHILQSK

SEQ ID NO: 1745242 - protein, 17 aa, Staphylococcus epidermidis
TYEGRLAPEIMYNNIVK

SEQ ID NO: 1745243 - protein, 30 aa, Staphylococcus epidermidis
TYGFLWLKQTNIIFVLGIMIFLTFILFQNV

SEQ ID NO: 1745244 - protein, 20 aa, Staphylococcus epidermidis
TYILYSIFCILLIGLLILPE

SEQ ID NO: 1745245 - protein, 18 aa, Staphylococcus epidermidis
TYITPIIIALLYLYIDER

SEQ ID NO: 1745246 - protein, 22 aa, Staphylococcus epidermidis
TYKEVLSGAGVEPGKKKHKEDG

SEQ ID NO: 1745247 - protein, 25 aa, Staphylococcus epidermidis
TYKRLRFQVFLGIFIGYAGYYLLRK

SEQ ID NO: 1745248 - protein, 24 aa, Staphylococcus epidermidis
TYLHIMWIYIVRSFGMAFIMMPIM

SEQ ID NO: 1745249 - protein, 24 aa, Staphylococcus epidermidis
TYLHIMWIYIVRSFGMAFVMMPII

SEQ ID NO: 1745250 - protein, 26 aa, Staphylococcus epidermidis
TYLIPIVSLFALITISVMTFKLKKGN

SEQ ID NO: 1745251 - protein, 24 aa, Staphylococcus epidermidis
TYPFKNGYKNYIFKKSDQYYIVST

SEQ ID NO: 1745252 - protein, 23 aa, Staphylococcus epidermidis
TYQRLPIYIIIFIVLWLIINIIS

SEQ ID NO: 1745253 - protein, 23 aa, Staphylococcus epidermidis
TYSRNALFNHILSWVCLALGLIS

SEQ ID NO: 1745254 - protein, 27 aa, Staphylococcus epidermidis
TYTASNVRRFKGYKLYQTVSPDNMSGT

SEQ ID NO: 1745255 - protein, 25 aa, Staphylococcus epidermidis
TYTISMNWSLEIARALTGGIGIVLT

SEQ ID NO: 1745256 - protein, 19 aa, Staphylococcus epidermidis
VAAVLRIALGSATVAAVST

SEQ ID NO: 1745257 - protein, 18 aa, Staphylococcus epidermidis
VAAVLRISLGSATVAAVS

SEQ ID NO: 1745258 - protein, 29 aa, Staphylococcus epidermidis
VADHLTAIVKVMLADGSYITVNVPVKVVE

SEQ ID NO: 1745259 - protein, 28 aa, Staphylococcus epidermidis
VADHLTAKVKVILADGSYVTVNVPVKVV

SEQ ID NO: 1745260 - protein, 17 aa, Staphylococcus epidermidis
VADIGMKVPPIITNHYV

SEQ ID NO: 1745261 - protein, 26 aa, Staphylococcus epidermidis
VAEIYGGTFFYRFRKIIAPLFASGYS

SEQ ID NO: 1745262 - protein, 24 aa, Staphylococcus epidermidis
VAFIALAVAFIFLLLASRSEAVRT

SEQ ID NO: 1745263 - protein, 24 aa, Staphylococcus epidermidis
VAFLANCLKDWIGGVMSPLIVLII

SEQ ID NO: 1745264 - protein, 24 aa, Staphylococcus epidermidis
VAGFLAGYIAKWIKQIKVPKAMAS

SEQ ID NO: 1745265 - protein, 25 aa, Staphylococcus epidermidis
VAGLGYAARAYVKFDDQMNQMKVQL

SEQ ID NO: 1745266 - protein, 19 aa, Staphylococcus epidermidis
VAGYLFYFAVSVGVISFIV

SEQ ID NO: 1745267 - protein, 23 aa, Staphylococcus epidermidis
VAHSMGNMSFAYYMKNYGGDKQL

SEQ ID NO: 1745268 - protein, 20 aa, Staphylococcus epidermidis
VAHVHIDFQFIITLIAVVII

SEQ ID NO: 1745269 - protein, 17 aa, Staphylococcus epidermidis
VAIIYFIFFLKYKFLDK

SEQ ID NO: 1745270 - protein, 32 aa, Staphylococcus epidermidis
VAIIYLFMLGFYRLPGLVAIIALTTYIYLTLV

SEQ ID NO: 1745271 - protein, 18 aa, Staphylococcus epidermidis
VAIQREVNDNNLADQSPE

SEQ ID NO: 1745272 - protein, 17 aa, Staphylococcus epidermidis
VAIVVAILFFILFLVAI

SEQ ID NO: 1745273 - protein, 17 aa, Staphylococcus epidermidis
VAKHKKSKEKQLSEEDI

SEQ ID NO: 1745274 - protein, 20 aa, Staphylococcus epidermidis
VALACLTTACGLIVSVSQYF

SEQ ID NO: 1745275 - protein, 20 aa, Staphylococcus epidermidis
VALIIVGLVQKFLFTSYTVS

SEQ ID NO: 1745276 - protein, 19 aa, Staphylococcus epidermidis
VALLACIFANVGLTKIIMY

SEQ ID NO: 1745277 - protein, 20 aa, Staphylococcus epidermidis
VALLEMKQEFGVIKAQAPIA

SEQ ID NO: 1745278 - protein, 20 aa, Staphylococcus epidermidis
VALLLSNLVMNSVVRAESNT

SEQ ID NO: 1745279 - protein, 18 aa, Staphylococcus epidermidis
VALLQMIVMPLIFVSIVA

SEQ ID NO: 1745280 - protein, 18 aa, Staphylococcus epidermidis
VAMFIPLFFIFKYKQPMF

SEQ ID NO: 1745281 - protein, 19 aa, Staphylococcus epidermidis
VAMIIKGFVDFGGHSSNYG

SEQ ID NO: 1745282 - protein, 19 aa, Staphylococcus epidermidis
VANKLRDAEALDQSMQTLR

SEQ ID NO: 1745283 - protein, 17 aa, Staphylococcus epidermidis
VAQNESNTALALINNGD

SEQ ID NO: 1745284 - protein, 22 aa, Staphylococcus epidermidis
VASITLGTALFLSSSHDAQAAE

SEQ ID NO: 1745285 - protein, 17 aa, Staphylococcus epidermidis
VATALSRLLGCILALIA

SEQ ID NO: 1745286 - protein, 17 aa, Staphylococcus epidermidis
VAVLMFRGGDTSHNLNM

SEQ ID NO: 1745287 - protein, 23 aa, Staphylococcus epidermidis
VAVVLLAWVFLPKYLKYGVNTIS

SEQ ID NO: 1745288 - protein, 21 aa, Staphylococcus epidermidis
VAVVLLAWVFLPKYLQYGVST

SEQ ID NO: 1745289 - protein, 24 aa, Staphylococcus epidermidis
VCAHKRWLFISSTLIKQTVRSSLI

SEQ ID NO: 1745290 - protein, 21 aa, Staphylococcus epidermidis
VCIGLVFGLIAGIERKWLDQI

SEQ ID NO: 1745291 - protein, 18 aa, Staphylococcus epidermidis
VCINGIITSILLNAKPHE

SEQ ID NO: 1745292 - protein, 19 aa, Staphylococcus epidermidis
VDAGIRSGIFIALATFLRP

SEQ ID NO: 1745293 - protein, 23 aa, Staphylococcus epidermidis
VDGAREIIGMGLNKLGYSLNDKN

SEQ ID NO: 1745294 - protein, 23 aa, Staphylococcus epidermidis
VDGEAFKYWIIIASIILISMTGL

SEQ ID NO: 1745295 - protein, 22 aa, Staphylococcus epidermidis
VDGIKIMAYIGVVILTANGFAG

SEQ ID NO: 1745296 - protein, 23 aa, Staphylococcus epidermidis
VDIFMCGIATFLQANKITGTGLP

SEQ ID NO: 1745297 - protein, 19 aa, Staphylococcus epidermidis
VDISPNMLIQRLKAGKVYK

SEQ ID NO: 1745298 - protein, 17 aa, Staphylococcus epidermidis
VDKFSVSSMNWGMIAIF

SEQ ID NO: 1745299 - protein, 23 aa, Staphylococcus epidermidis
VDKWEWLKWNPISMMNIMIQIVD

SEQ ID NO: 1745300 - protein, 21 aa, Staphylococcus epidermidis
VDKWEWLKWNPISMMNIMVQI

SEQ ID NO: 1745301 - protein, 25 aa, Staphylococcus epidermidis
VDLFLHRLTIFLAIIFFVLMFCISY

SEQ ID NO: 1745302 - protein, 29 aa, Staphylococcus epidermidis
VDPRKSASILDIFGGCFQGLLPYSPQVIS

SEQ ID NO: 1745303 - protein, 56 aa, Staphylococcus epidermidis
VDSNGITTTGIINGADNLTIDSGFYKTPKYSVGDYVWKDTNKDSIQDDNEKGISGV

SEQ ID NO: 1745304 - protein, 24 aa, Staphylococcus epidermidis
VDSWKMVWFVLGIVSLVLGLIVLV

SEQ ID NO: 1745305 - protein, 19 aa, Staphylococcus epidermidis
VDTEFDRWIITEVDNHQII

SEQ ID NO: 1745306 - protein, 17 aa, Staphylococcus epidermidis
VDTGGQPARADQGQEGP

SEQ ID NO: 1745307 - protein, 24 aa, Staphylococcus epidermidis
VDTTPWKYRYIAGTIILLLVVLSY

SEQ ID NO: 1745308 - protein, 21 aa, Staphylococcus epidermidis
VEAGSVISTVEYRGNSDRSKV

SEQ ID NO: 1745309 - protein, 18 aa, Staphylococcus epidermidis
VEANKVPNAYPVTIQGEL

SEQ ID NO: 1745310 - protein, 19 aa, Staphylococcus epidermidis
VEASTKFATTIDNATTNES

SEQ ID NO: 1745311 - protein, 21 aa, Staphylococcus epidermidis
VEDFRNRSKDGLTSEELQAQK

SEQ ID NO: 1745312 - protein, 23 aa, Staphylococcus epidermidis
VEDNLRYRQIIFSHKDDLKTLTA

SEQ ID NO: 1745313 - protein, 20 aa, Staphylococcus epidermidis
VEGLPAGITFDEATNTISGT

SEQ ID NO: 1745314 - protein, 24 aa, Staphylococcus epidermidis
VEKLFKRYTDLVIDQLEDDDFEKG

SEQ ID NO: 1745315 - protein, 17 aa, Staphylococcus epidermidis
VEKSFSWYETGKMNMAY

SEQ ID NO: 1745316 - protein, 25 aa, Staphylococcus epidermidis
VELGSWKAPYSIVFVLDVFSALLII

SEQ ID NO: 1745317 - protein, 25 aa, Staphylococcus epidermidis
VERLPAMVLPSWAYNKIAPVAIDDV

SEQ ID NO: 1745318 - protein, 20 aa, Staphylococcus epidermidis
VESYFLTWVHQIKTPITASQ

SEQ ID NO: 1745319 - protein, 23 aa, Staphylococcus epidermidis
VETPLRKQGFKAFAIKKTYKPQF

SEQ ID NO: 1745320 - protein, 30 aa, Staphylococcus epidermidis
VEVDKLNSIVRKKAKALKEIELEADHVKQM

SEQ ID NO: 1745321 - protein, 17 aa, Staphylococcus epidermidis
VEYEFYADALSGQVLDI

SEQ ID NO: 1745322 - protein, 33 aa, Staphylococcus epidermidis
VFDVFLLLFIMKFGFRKIEAIVGTLIFTVLAIF

SEQ ID NO: 1745323 - protein, 17 aa, Staphylococcus epidermidis
VFDYQRSLLKSSVQLNS

SEQ ID NO: 1745324 - protein, 20 aa, Staphylococcus epidermidis
VFFHKVRGLLSFWIGALLIA

SEQ ID NO: 1745325 - protein, 23 aa, Staphylococcus epidermidis
VFFIGGTVTWFAFDKAIYEKQNY

SEQ ID NO: 1745326 - protein, 18 aa, Staphylococcus epidermidis
VFFIKRWFDTKTTIASAF

SEQ ID NO: 1745327 - protein, 17 aa, Staphylococcus epidermidis
VFFIPFIFAPIVNIWIF

SEQ ID NO: 1745328 - protein, 18 aa, Staphylococcus epidermidis
VFFIPFIFAPIVNIWIFK

SEQ ID NO: 1745329 - protein, 17 aa, Staphylococcus epidermidis
VFFLNLIGLILMAMNTF

SEQ ID NO: 1745330 - protein, 18 aa, Staphylococcus epidermidis
VFFTLTWIIITISLVLNL

SEQ ID NO: 1745331 - protein, 24 aa, Staphylococcus epidermidis
VFGGICIGVGIGVIVLAGGTTAGT

SEQ ID NO: 1745332 - protein, 22 aa, Staphylococcus epidermidis
VFGTISLASALLLFRRQRKSSK

SEQ ID NO: 1745333 - protein, 17 aa, Staphylococcus epidermidis
VFIIFFILRELRMKAPM

SEQ ID NO: 1745334 - protein, 26 aa, Staphylococcus epidermidis
VFIKTLVCILSFILIVGFSLIYNNSV

SEQ ID NO: 1745335 - protein, 29 aa, Staphylococcus epidermidis
VFIRTPNEFRLMILGGLVSGLVYFAFGIL

SEQ ID NO: 1745336 - protein, 35 aa, Staphylococcus epidermidis
VFLAQRSIFFFSWNEFAWWLVAHLFFIILMASCLP

SEQ ID NO: 1745337 - protein, 18 aa, Staphylococcus epidermidis
VFLIFFLYHKLRYKTNMI

SEQ ID NO: 1745338 - protein, 22 aa, Staphylococcus epidermidis
VFLMSSYCLLVIGTTKIQLQET

SEQ ID NO: 1745339 - protein, 18 aa, Staphylococcus epidermidis
VFSALLIITSIVITILII

SEQ ID NO: 1745340 - protein, 30 aa, Staphylococcus epidermidis
VFSIGLCYSILMALSRIRIGAHFTSDVTMS

SEQ ID NO: 1745341 - protein, 18 aa, Staphylococcus epidermidis
VFSIKDLAPFIAAIVCIL

SEQ ID NO: 1745342 - protein, 39 aa, Staphylococcus epidermidis
VFSKILKLRDGHIFIRKCLRTSIMFSIILLGFVAMNILF

SEQ ID NO: 1745343 - protein, 20 aa, Staphylococcus epidermidis
VFVAPTIKFHVWRVAIQTEQ

SEQ ID NO: 1745344 - protein, 26 aa, Staphylococcus epidermidis
VFVAPTMKFHVWRVAIQTDKHDYVGV

SEQ ID NO: 1745345 - protein, 19 aa, Staphylococcus epidermidis
VFYHLKLDVEFASILGLTK

SEQ ID NO: 1745346 - protein, 25 aa, Staphylococcus epidermidis
VFYHLKLDVEFASILGLTKDKSLLQ

SEQ ID NO: 1745347 - protein, 21 aa, Staphylococcus epidermidis
VGAAIALWVRCGKNKELRNTL

SEQ ID NO: 1745348 - protein, 21 aa, Staphylococcus epidermidis
VGAALALWVRCRKNQKLRNTL

SEQ ID NO: 1745349 - protein, 26 aa, Staphylococcus epidermidis
VGASTYRKNFCQRFLDEVNVTVIKGN

SEQ ID NO: 1745350 - protein, 27 aa, Staphylococcus epidermidis
VGASTYRKQFCKRFLEQIDVTVIKGNA

SEQ ID NO: 1745351 - protein, 18 aa, Staphylococcus epidermidis
VGDSIYIFTNAHVVGNQE

SEQ ID NO: 1745352 - protein, 17 aa, Staphylococcus epidermidis
VGEKILQEFGPRKPMLI

SEQ ID NO: 1745353 - protein, 31 aa, Staphylococcus epidermidis
VGEKKVRVGEQFKYRIKGVVGNRETIHEFAI

SEQ ID NO: 1745354 - protein, 23 aa, Staphylococcus epidermidis
VGESEFSFHLGVNLRDHGIPVMM

SEQ ID NO: 1745355 - protein, 17 aa, Staphylococcus epidermidis
VGETMVDEPLHFQGGLT

SEQ ID NO: 1745356 - protein, 23 aa, Staphylococcus epidermidis
VGEYPAHIPMMPDTIIYEDYRDS

SEQ ID NO: 1745357 - protein, 18 aa, Staphylococcus epidermidis
VGFILFMFMRAMGELLLS

SEQ ID NO: 1745358 - protein, 17 aa, Staphylococcus epidermidis
VGGFMSKKWNGIKSTTV

SEQ ID NO: 1745359 - protein, 22 aa, Staphylococcus epidermidis
VGGHPQFVRPLINPMVQGALRT

SEQ ID NO: 1745360 - protein, 28 aa, Staphylococcus epidermidis
VGGIFTLAGTFIALWFQFRKDDKDKRKD

SEQ ID NO: 1745361 - protein, 20 aa, Staphylococcus epidermidis
VGGIIGWIAGLIMGKDIPGG

SEQ ID NO: 1745362 - protein, 18 aa, Staphylococcus epidermidis
VGIFFKRLEFTGIGLLFC

SEQ ID NO: 1745363 - protein, 30 aa, Staphylococcus epidermidis
VGIIKFGIPMLIPLLIKYAIDGVINNHSLS

SEQ ID NO: 1745364 - protein, 30 aa, Staphylococcus epidermidis
VGILTCLNLRVSPVFAVIVGLVLHDQKLLP

SEQ ID NO: 1745365 - protein, 18 aa, Staphylococcus epidermidis
VGIPRFVIVTTYQFGQYA

SEQ ID NO: 1745366 - protein, 18 aa, Staphylococcus epidermidis
VGIYLAIILVICSCYLAF

SEQ ID NO: 1745367 - protein, 20 aa, Staphylococcus epidermidis
VGLTAIHFSNYVPFIPEHKV

SEQ ID NO: 1745368 - protein, 25 aa, Staphylococcus epidermidis
VGLVLKDFSLLPAFIAAYITAFVIK

SEQ ID NO: 1745369 - protein, 21 aa, Staphylococcus epidermidis
VGMIYPFLIRFSDFRTPRYFI

SEQ ID NO: 1745370 - protein, 24 aa, Staphylococcus epidermidis
VGNMGGGLLDFIATNWIPLGQNHW

SEQ ID NO: 1745371 - protein, 24 aa, Staphylococcus epidermidis
VGNSETIHAFAIVDNGEDVLSFEN

SEQ ID NO: 1745372 - protein, 24 aa, Staphylococcus epidermidis
VGPVANFLAGVSFLLSSYYVYRKR

SEQ ID NO: 1745373 - protein, 17 aa, Staphylococcus epidermidis
VGRIKHLIREPVFLFNI

SEQ ID NO: 1745374 - protein, 23 aa, Staphylococcus epidermidis
VGSALGLYYKNKVYKKTDELRDK

SEQ ID NO: 1745375 - protein, 20 aa, Staphylococcus epidermidis
VGSYGWKAILYFEIITTVAI

SEQ ID NO: 1745376 - protein, 17 aa, Staphylococcus epidermidis
VGTICLFILNLIINPHI

SEQ ID NO: 1745377 - protein, 17 aa, Staphylococcus epidermidis
VGTSLKFSSEEIAYLVT

SEQ ID NO: 1745378 - protein, 20 aa, Staphylococcus epidermidis
VGVFIPFTLAQFGMVLKWLR

SEQ ID NO: 1745379 - protein, 19 aa, Staphylococcus epidermidis
VGVIFLITFLIYLFYSPRL

SEQ ID NO: 1745380 - protein, 18 aa, Staphylococcus epidermidis
VGVISFIVWMLIQNDVDF

SEQ ID NO: 1745381 - protein, 24 aa, Staphylococcus epidermidis
VGVSTLIGIVFGWIPARAASKKEL

SEQ ID NO: 1745382 - protein, 26 aa, Staphylococcus epidermidis
VHHLDPRAKLIFVFVFIIFIFFCHSF

SEQ ID NO: 1745383 - protein, 21 aa, Staphylococcus epidermidis
VHIGWKGWVYVDQQIAKHMKG

SEQ ID NO: 1745384 - protein, 21 aa, Staphylococcus epidermidis
VHNVWEFLNAFFAEIIKVMSK

SEQ ID NO: 1745385 - protein, 19 aa, Staphylococcus epidermidis
VHNVWEFLNAFFSEIIKVM

SEQ ID NO: 1745386 - protein, 26 aa, Staphylococcus epidermidis
VHQLDPRAKLIFVFFFIILIFFCHSL

SEQ ID NO: 1745387 - protein, 26 aa, Staphylococcus epidermidis
VHVINWVIGVGGIFSGFIIGAFFLPL

SEQ ID NO: 1745388 - protein, 20 aa, Staphylococcus epidermidis
VIAAILYVRFGGYNLENDEL

SEQ ID NO: 1745389 - protein, 25 aa, Staphylococcus epidermidis
VIAYKDIKKIAAYQVILSIGFIILG

SEQ ID NO: 1745390 - protein, 24 aa, Staphylococcus epidermidis
VIDALQLRFILDWNSQSHRPQFKF

SEQ ID NO: 1745391 - protein, 17 aa, Staphylococcus epidermidis
VIFNFWLYLILYWLIPI

SEQ ID NO: 1745392 - protein, 24 aa, Staphylococcus epidermidis
VIFTPLVAFMLMRIMESSYKAMII

SEQ ID NO: 1745393 - protein, 26 aa, Staphylococcus epidermidis
VIGFGASYLFNWSIRRDMIPQSLMPP

SEQ ID NO: 1745394 - protein, 19 aa, Staphylococcus epidermidis
VIGLVFFFIRYPKLKRMDN

SEQ ID NO: 1745395 - protein, 18 aa, Staphylococcus epidermidis
VIGSLIIHDYILLGMSGL

SEQ ID NO: 1745396 - protein, 33 aa, Staphylococcus epidermidis
VIGVGLFVHWIWPDLPIGAAFAIAAILCPTDAV

SEQ ID NO: 1745397 - protein, 21 aa, Staphylococcus epidermidis
VIGVGYFIHWIWPDLPMPAAF

SEQ ID NO: 1745398 - protein, 19 aa, Staphylococcus epidermidis
VIGVLCLVVSHWFKSKENT

SEQ ID NO: 1745399 - protein, 33 aa, Staphylococcus epidermidis
VIIARIVSIVLRLCLYYILIFGIINYFVKRGDQ

SEQ ID NO: 1745400 - protein, 27 aa, Staphylococcus epidermidis
VIIFGLKVPLLIAFAVIFAGLSFGFVY

SEQ ID NO: 1745401 - protein, 20 aa, Staphylococcus epidermidis
VIKGAIAMYCTYLYGKHITK

SEQ ID NO: 1745402 - protein, 27 aa, Staphylococcus epidermidis
VILFLMEFARGMYILSYINFLPTVTSI

SEQ ID NO: 1745403 - protein, 18 aa, Staphylococcus epidermidis
VILGGSFSAFFITSVNSF

SEQ ID NO: 1745404 - protein, 17 aa, Staphylococcus epidermidis
VILMIMFGNFQVRKDRK

SEQ ID NO: 1745405 - protein, 17 aa, Staphylococcus epidermidis
VILRHITFPTVFFIVLL

SEQ ID NO: 1745406 - protein, 18 aa, Staphylococcus epidermidis
VINPMWFGILFAVIGALL

SEQ ID NO: 1745407 - protein, 18 aa, Staphylococcus epidermidis
VISGCIIALFTHWLRNRK

SEQ ID NO: 1745408 - protein, 18 aa, Staphylococcus epidermidis
VISGCIVALFTHWLRNRN

SEQ ID NO: 1745409 - protein, 32 aa, Staphylococcus epidermidis
VITFKGGLAPFTILFSLPFTVIGVVLALVITG

SEQ ID NO: 1745410 - protein, 17 aa, Staphylococcus epidermidis
VIVAVLMFRGGDTSHNL

SEQ ID NO: 1745411 - protein, 18 aa, Staphylococcus epidermidis
VIVGLKISIKPADKNHPY

SEQ ID NO: 1745412 - protein, 20 aa, Staphylococcus epidermidis
VIVLMSFLFYFVMKADFMEI

SEQ ID NO: 1745413 - protein, 18 aa, Staphylococcus epidermidis
VIVNRLLQSFSYYNYSHE

SEQ ID NO: 1745414 - protein, 20 aa, Staphylococcus epidermidis
VIVSCIIFSIFFLSVNQGAQ

SEQ ID NO: 1745415 - protein, 17 aa, Staphylococcus epidermidis
VIWLCMILYLNRFSDVK

SEQ ID NO: 1745416 - protein, 17 aa, Staphylococcus epidermidis
VKAHMSVKISQLGSEFD

SEQ ID NO: 1745417 - protein, 25 aa, Staphylococcus epidermidis
VKALLNRIQLQIAEAETNEDVDNSV

SEQ ID NO: 1745418 - protein, 21 aa, Staphylococcus epidermidis
VKASLFLLIGVMYKITKSTDL

SEQ ID NO: 1745419 - protein, 22 aa, Staphylococcus epidermidis
VKDNLRKARIEKLTQEEIHQQR

SEQ ID NO: 1745420 - protein, 23 aa, Staphylococcus epidermidis
VKDNLRKARIEKLTQEEIHQQRD

SEQ ID NO: 1745421 - protein, 23 aa, Staphylococcus epidermidis
VKDNLRKARIEKLTQEEIQQQHE

SEQ ID NO: 1745422 - protein, 19 aa, Staphylococcus epidermidis
VKEELHLSPKISDELIVDS

SEQ ID NO: 1745423 - protein, 28 aa, Staphylococcus epidermidis
VKGHLLLELAVIFGISALVTSFLKHKHE

SEQ ID NO: 1745424 - protein, 28 aa, Staphylococcus epidermidis
VKGNLLLELAVIFGISALVTSFLRHKHA

SEQ ID NO: 1745425 - protein, 25 aa, Staphylococcus epidermidis
VKGRDNYDFYGRVDIQSNPTDLNAT

SEQ ID NO: 1745426 - protein, 22 aa, Staphylococcus epidermidis
VKHPLFEYARSFDFIIITDVGL

SEQ ID NO: 1745427 - protein, 18 aa, Staphylococcus epidermidis
VKILESFIILPIVLPPTV

SEQ ID NO: 1745428 - protein, 22 aa, Staphylococcus epidermidis
VKKKEVIASLEIPKDFSKHLKA

SEQ ID NO: 1745429 - protein, 17 aa, Staphylococcus epidermidis
VKKLSDFINEDESAQNE

SEQ ID NO: 1745430 - protein, 17 aa, Staphylococcus epidermidis
VKLAKPLIALSILIVVV

SEQ ID NO: 1745431 - protein, 17 aa, Staphylococcus epidermidis
VKLRKAINKVYFMADVD

SEQ ID NO: 1745432 - protein, 20 aa, Staphylococcus epidermidis
VKLTIAAIFIFPFYILTVYF

SEQ ID NO: 1745433 - protein, 28 aa, Staphylococcus epidermidis
VKLTNRFSVRPVLLWTLFVFIIGNGMIA

SEQ ID NO: 1745434 - protein, 17 aa, Staphylococcus epidermidis
VKPLILGAIIMYLVGLI

SEQ ID NO: 1745435 - protein, 24 aa, Staphylococcus epidermidis
VKPQAKNQIQAIFDRKQSKFETNK

SEQ ID NO: 1745436 - protein, 21 aa, Staphylococcus epidermidis
VKRVKEAGGHIPVDLDALVKG

SEQ ID NO: 1745437 - protein, 17 aa, Staphylococcus epidermidis
VKSAFDYVNDLLGNNQN

SEQ ID NO: 1745438 - protein, 21 aa, Staphylococcus epidermidis
VKSEARQAVQNKANEQINHIQ

SEQ ID NO: 1745439 - protein, 18 aa, Staphylococcus epidermidis
VKSISFTRFYWGLVKHED

SEQ ID NO: 1745440 - protein, 33 aa, Staphylococcus epidermidis
VKTDARKAIQDKAFEQIELIKATPDATNEEKQA

SEQ ID NO: 1745441 - protein, 26 aa, Staphylococcus epidermidis
VKTKLRSVLPGALFTSIIWLVGSFLF

SEQ ID NO: 1745442 - protein, 20 aa, Staphylococcus epidermidis
VKTNALAALATDAKNKNAII

SEQ ID NO: 1745443 - protein, 26 aa, Staphylococcus epidermidis
VKVKPEALKQILAKLDNQRDLINNNA

SEQ ID NO: 1745444 - protein, 17 aa, Staphylococcus epidermidis
VKVLRSLPKLNSNLDAF

SEQ ID NO: 1745445 - protein, 26 aa, Staphylococcus epidermidis
VKWSTAQRMVVTWVITLPISAILAAI

SEQ ID NO: 1745446 - protein, 26 aa, Staphylococcus epidermidis
VKWSTAQRMVVTWVITLPISAILAGI

SEQ ID NO: 1745447 - protein, 19 aa, Staphylococcus epidermidis
VLAEKCSKVTALRGGLFGI

SEQ ID NO: 1745448 - protein, 19 aa, Staphylococcus epidermidis
VLASSLWLNITFKPLQILG

SEQ ID NO: 1745449 - protein, 18 aa, Staphylococcus epidermidis
VLCAVFVGPWYGLAQAFI

SEQ ID NO: 1745450 - protein, 24 aa, Staphylococcus epidermidis
VLDLLIVWYVLYLLITVFKGTKAI

SEQ ID NO: 1745451 - protein, 26 aa, Staphylococcus epidermidis
VLFIFRCLVVLLVFIGAVAKTETVWS

SEQ ID NO: 1745452 - protein, 18 aa, Staphylococcus epidermidis
VLFYVFIACQSYFKDPTR

SEQ ID NO: 1745453 - protein, 31 aa, Staphylococcus epidermidis
VLGGFIIHFANWRWIFFINIFIVIIAVPLMN

SEQ ID NO: 1745454 - protein, 19 aa, Staphylococcus epidermidis
VLHLPMSFFDTRKSGEILQ

SEQ ID NO: 1745455 - protein, 17 aa, Staphylococcus epidermidis
VLIFYSFLIYRRERNIQ

SEQ ID NO: 1745456 - protein, 17 aa, Staphylococcus epidermidis
VLIGIAIAVIGIFILAR

SEQ ID NO: 1745457 - protein, 19 aa, Staphylococcus epidermidis
VLIGIAIAVIGIFILARKT

SEQ ID NO: 1745458 - protein, 19 aa, Staphylococcus epidermidis
VLIHLSIGILIYITFLIIY

SEQ ID NO: 1745459 - protein, 22 aa, Staphylococcus epidermidis
VLIPIVIGFIFQRLAKKVAEKT

SEQ ID NO: 1745460 - protein, 17 aa, Staphylococcus epidermidis
VLISMVCVGLFYHHLPM

SEQ ID NO: 1745461 - protein, 27 aa, Staphylococcus epidermidis
VLIVLVGLIGFRWSKHQHIENQVLKNE

SEQ ID NO: 1745462 - protein, 28 aa, Staphylococcus epidermidis
VLKSHVIIFKTIDPIPWKQHNVKLVFFL

SEQ ID NO: 1745463 - protein, 25 aa, Staphylococcus epidermidis
VLKYYRFSQMRSFIIKLVGGMVVMS

SEQ ID NO: 1745464 - protein, 23 aa, Staphylococcus epidermidis
VLLALLKKFAWGPLKEVMDKRER

SEQ ID NO: 1745465 - protein, 17 aa, Staphylococcus epidermidis
VLLCYGISLTLLIIFIS

SEQ ID NO: 1745466 - protein, 17 aa, Staphylococcus epidermidis
VLLGVAVFYIASWIIGV

SEQ ID NO: 1745467 - protein, 18 aa, Staphylococcus epidermidis
VLLIAIFLMMYYKQISEG

SEQ ID NO: 1745468 - protein, 24 aa, Staphylococcus epidermidis
VLLICMVLAYAFLLGLFILGLVAS

SEQ ID NO: 1745469 - protein, 26 aa, Staphylococcus epidermidis
VLLLASLIGFIGMGLFGNKYQEMPDL

SEQ ID NO: 1745470 - protein, 18 aa, Staphylococcus epidermidis
VLLSIPVIYFYSKDNKFF

SEQ ID NO: 1745471 - protein, 25 aa, Staphylococcus epidermidis
VLNHLEHFDALQARERRFLSLYDYM

SEQ ID NO: 1745472 - protein, 23 aa, Staphylococcus epidermidis
VLPVIGFILYLFLGRTVSKKKME

SEQ ID NO: 1745473 - protein, 17 aa, Staphylococcus epidermidis
VLQPQFLLTNSKIIVFA

SEQ ID NO: 1745474 - protein, 22 aa, Staphylococcus epidermidis
VLRNFMPIIILAIIYFVHKVIK

SEQ ID NO: 1745475 - protein, 23 aa, Staphylococcus epidermidis
VLSMKITLTMLFSLMIILFVINN

SEQ ID NO: 1745476 - protein, 18 aa, Staphylococcus epidermidis
VLSWIGNILHLLYLGFIV

SEQ ID NO: 1745477 - protein, 26 aa, Staphylococcus epidermidis
VLTIFCLIIGLLLFFHKPIISHFIAP

SEQ ID NO: 1745478 - protein, 29 aa, Staphylococcus epidermidis
VLVALAVYLFRFVWVYVLYPYFYLSVSPF

SEQ ID NO: 1745479 - protein, 17 aa, Staphylococcus epidermidis
VLVLWIYFRRSLPRSVD

SEQ ID NO: 1745480 - protein, 20 aa, Staphylococcus epidermidis
VLVSHIFLLFKRRYNRYYGE

SEQ ID NO: 1745481 - protein, 20 aa, Staphylococcus epidermidis
VLVSIGISIIYWIGSIILVA

SEQ ID NO: 1745482 - protein, 27 aa, Staphylococcus epidermidis
VLVTCLWFLFCVFIFQYIKLLFSKPKF

SEQ ID NO: 1745483 - protein, 21 aa, Staphylococcus epidermidis
VLWMIAAIRLFAKKDKTYVNE

SEQ ID NO: 1745484 - protein, 27 aa, Staphylococcus epidermidis
VMEGFLRLSIPNWMRRLITRSLAVIPV

SEQ ID NO: 1745485 - protein, 27 aa, Staphylococcus epidermidis
VMFFLLLGVCMHFKTMLLNTIKAISAF

SEQ ID NO: 1745486 - protein, 29 aa, Staphylococcus epidermidis
VMGTGEHLWRFAVGFGAFIALVLYILRIK

SEQ ID NO: 1745487 - protein, 24 aa, Staphylococcus epidermidis
VMISICLILMPFLTNLAMLVFLSV

SEQ ID NO: 1745488 - protein, 17 aa, Staphylococcus epidermidis
VMLDYFWNDPISWTNNI

SEQ ID NO: 1745489 - protein, 17 aa, Staphylococcus epidermidis
VMLLTIAIILGFGALEI

SEQ ID NO: 1745490 - protein, 20 aa, Staphylococcus epidermidis
VMLLYFMFCGIMAFCQNIIG

SEQ ID NO: 1745491 - protein, 25 aa, Staphylococcus epidermidis
VMPGRFYLVRVYRIIMLVLTFLSEL

SEQ ID NO: 1745492 - protein, 18 aa, Staphylococcus epidermidis
VMRISASIWALVITVVLL

SEQ ID NO: 1745493 - protein, 25 aa, Staphylococcus epidermidis
VMSNRKGIQWESLDGSLPQLVFLIA

SEQ ID NO: 1745494 - protein, 24 aa, Staphylococcus epidermidis
VMYLIKFYGYRVIQENHQLKIQYG

SEQ ID NO: 1745495 - protein, 28 aa, Staphylococcus epidermidis
VNDLYKYTVRLHPGIADVGGEFYDFDLF

SEQ ID NO: 1745496 - protein, 24 aa, Staphylococcus epidermidis
VNEKRIRPEDMHIMANIFLPSNEF

SEQ ID NO: 1745497 - protein, 18 aa, Staphylococcus epidermidis
VNFDRQNRTLTFTSNGLT

SEQ ID NO: 1745498 - protein, 20 aa, Staphylococcus epidermidis
VNGGKVGLLNSVLERTSVFD

SEQ ID NO: 1745499 - protein, 17 aa, Staphylococcus epidermidis
VNKTELINARRRLDEEI

SEQ ID NO: 1745500 - protein, 19 aa, Staphylococcus epidermidis
VNLSETFEPISLHHFLGTD

SEQ ID NO: 1745501 - protein, 25 aa, Staphylococcus epidermidis
VNNAKDEGLRLINSDVPQPQQKAQA

SEQ ID NO: 1745502 - protein, 17 aa, Staphylococcus epidermidis
VNRRIEVSLIGKNQLTI

SEQ ID NO: 1745503 - protein, 31 aa, Staphylococcus epidermidis
VNVTPSQASEVFTPINPITITATDNSGKVVT

SEQ ID NO: 1745504 - protein, 24 aa, Staphylococcus epidermidis
VNWVDLRYKYKVRHDKCYVFKTNA

SEQ ID NO: 1745505 - protein, 17 aa, Staphylococcus epidermidis
VNYGFASIEGWRWMLGL

SEQ ID NO: 1745506 - protein, 24 aa, Staphylococcus epidermidis
VPALNERAKLILALNDYMPNIERL

SEQ ID NO: 1745507 - protein, 26 aa, Staphylococcus epidermidis
VPAVKKIELEPMFNVPVLVSLNKKRI

SEQ ID NO: 1745508 - protein, 21 aa, Staphylococcus epidermidis
VPFLVAWILDLILRRFIHLYE

SEQ ID NO: 1745509 - protein, 21 aa, Staphylococcus epidermidis
VPFLVAWILDLLLRKVIRLYS

SEQ ID NO: 1745510 - protein, 32 aa, Staphylococcus epidermidis
VPIGTVIGDWVGWRFTFLFIIVVSVFVGILML

SEQ ID NO: 1745511 - protein, 18 aa, Staphylococcus epidermidis
VPIIGGLCLDRIQQDWLL

SEQ ID NO: 1745512 - protein, 19 aa, Staphylococcus epidermidis
VPILLVFTILLFYGKFKGF

SEQ ID NO: 1745513 - protein, 27 aa, Staphylococcus epidermidis
VPIVLGLIILLGIAWGVYAFVTNTPKN

SEQ ID NO: 1745514 - protein, 23 aa, Staphylococcus epidermidis
VPMYIVSCIFGYLLFGLGLGLFA

SEQ ID NO: 1745515 - protein, 23 aa, Staphylococcus epidermidis
VPVSYKIAKILLDHMYKDEDRFL

SEQ ID NO: 1745516 - protein, 24 aa, Staphylococcus epidermidis
VPVVMAASVALFFLNLAFAETDRP

SEQ ID NO: 1745517 - protein, 26 aa, Staphylococcus epidermidis
VPYGDDWFAYFMRRLAERPQNLSLAF

SEQ ID NO: 1745518 - protein, 26 aa, Staphylococcus epidermidis
VPYILLSIGAFLTVGFVIFSIRRGRR

SEQ ID NO: 1745519 - protein, 19 aa, Staphylococcus epidermidis
VPYTPGMISAVFILLPISI

SEQ ID NO: 1745520 - protein, 44 aa, Staphylococcus epidermidis
VQFGTFEYTESAVAKVRYVDANTGKDIIPPKTIAGEVDGTVNID

SEQ ID NO: 1745521 - protein, 33 aa, Staphylococcus epidermidis; identical to SEQ ID NO: 1580577

SEQ ID NO: 1745522 - protein, 22 aa, Staphylococcus epidermidis
VQKARIELFFKHNLKGYKNIDI

SEQ ID NO: 1745523 - protein, 18 aa, Staphylococcus epidermidis
VQLKVNDAIHILQNKENN

SEQ ID NO: 1745524 - protein, 25 aa, Staphylococcus epidermidis
VQNLTALVNYPGISTPLEVPVKVWV

SEQ ID NO: 1745525 - protein, 26 aa, Staphylococcus epidermidis
VQNMLKWGTLVAIGFIIVATFMFMLD

SEQ ID NO: 1745526 - protein, 25 aa, Staphylococcus epidermidis
VQPYRYRIIATIIVGIIKFGIPMLI

SEQ ID NO: 1745527 - protein, 22 aa, Staphylococcus epidermidis
VQSNFSKSVPFSSDTTPPTINE

SEQ ID NO: 1745528 - protein, 25 aa, Staphylococcus epidermidis
VQYMAKRRIGALIVFEKETGLQDYI

SEQ ID NO: 1745529 - protein, 26 aa, Staphylococcus epidermidis
VQYMSSWPWDWAKPMGALMKDGSIST

SEQ ID NO: 1745530 - protein, 21 aa, Staphylococcus epidermidis
VQYNWDHLDFVGLDDTDYKRD

SEQ ID NO: 1745531 - protein, 24 aa, Staphylococcus epidermidis
VRDKPKPTQWAFLSLQHLFAMFGS

SEQ ID NO: 1745532 - protein, 19 aa, Staphylococcus epidermidis
VRISFLPISINNALTTRES

SEQ ID NO: 1745533 - protein, 17 aa, Staphylococcus epidermidis
VRKGHPAYQPKLDRDKD

SEQ ID NO: 1745534 - protein, 25 aa, Staphylococcus epidermidis
VRMASPIIVNARFSDPITGVEKLII

SEQ ID NO: 1745535 - protein, 17 aa, Staphylococcus epidermidis
VRNDHRFYPSKQEQQRL

SEQ ID NO: 1745536 - protein, 29 aa, Staphylococcus epidermidis
VRPVQHGWDHLDLVGMDAFDLTHTGRELG

SEQ ID NO: 1745537 - protein, 26 aa, Staphylococcus epidermidis
VRVDELYKYRIRGIVGNSETIHAFAI

SEQ ID NO: 1745538 - protein, 17 aa, Staphylococcus epidermidis
VRYGYTAAFILVILQVI

SEQ ID NO: 1745539 - protein, 17 aa, Staphylococcus epidermidis
VRYGYTASFILVILQVI

SEQ ID NO: 1745540 - protein, 25 aa, Staphylococcus epidermidis
VSAALKESISLIDSIEIQAHKKLEA

SEQ ID NO: 1745541 - protein, 21 aa, Staphylococcus epidermidis
VSAGLHIASGIARGIANGASR

SEQ ID NO: 1745542 - protein, 18 aa, Staphylococcus epidermidis
VSAIKRLINFMILIITKY

SEQ ID NO: 1745543 - protein, 17 aa, Staphylococcus epidermidis
VSCIVFLTFFLSVNQGA

SEQ ID NO: 1745544 - protein, 20 aa, Staphylococcus epidermidis
VSCSCALVLSVPVAVVTGIG

SEQ ID NO: 1745545 - protein, 18 aa, Staphylococcus epidermidis
VSDSNSASISLSESTSTS

SEQ ID NO: 1745546 - protein, 19 aa, Staphylococcus epidermidis
VSEFMFAAGQSFTILIISR

SEQ ID NO: 1745547 - protein, 18 aa, Staphylococcus epidermidis
VSIAVGIIFYFAVSIISG

SEQ ID NO: 1745548 - protein, 26 aa, Staphylococcus epidermidis
VSIIRVIWYVFSWILIKTVFTIRKLS

SEQ ID NO: 1745549 - protein, 18 aa, Staphylococcus epidermidis
VSILRPFLLQTYTFLKYI

SEQ ID NO: 1745550 - protein, 17 aa, Staphylococcus epidermidis
VSIPGMMTGLIIGGVPP

SEQ ID NO: 1745551 - protein, 17 aa, Staphylococcus epidermidis
VSKIYAYLFTIGLYLVI

SEQ ID NO: 1745552 - protein, 19 aa, Staphylococcus epidermidis
VSKLIPVFFIKRWFDTKTT

SEQ ID NO: 1745553 - protein, 27 aa, Staphylococcus epidermidis
VSKRLTKPLFFYTDWIKNLSNGKLFKP

SEQ ID NO: 1745554 - protein, 30 aa, Staphylococcus epidermidis
VSLSLDFSKKLIGRPLKAHEFDFVLKDEQG

SEQ ID NO: 1745555 - protein, 21 aa, Staphylococcus epidermidis
VSNNNLWFGASTMKPNQKLGE

SEQ ID NO: 1745556 - protein, 18 aa, Staphylococcus epidermidis
VSPAITISVIDKTPPAVK

SEQ ID NO: 1745557 - protein, 24 aa, Staphylococcus epidermidis
VSPPRISIILSIAIIVFGSMLSIW

SEQ ID NO: 1745558 - protein, 22 aa, Staphylococcus epidermidis
VSPVFAVIVGLVLKDFSLLPAF

SEQ ID NO: 1745559 - protein, 18 aa, Staphylococcus epidermidis
VSQKFYKSSFIVMSITGI

SEQ ID NO: 1745560 - protein, 18 aa, Staphylococcus epidermidis
VSRVYKWYELDEQFVDGI

SEQ ID NO: 1745561 - protein, 18 aa, Staphylococcus epidermidis
VSSFRWARGMTIVAALMT

SEQ ID NO: 1745562 - protein, 18 aa, Staphylococcus epidermidis
VSSMNWGMIAIFGAIFLV

SEQ ID NO: 1745563 - protein, 21 aa, Staphylococcus epidermidis
VSTFIPGFKMKYEDKKIDITI

SEQ ID NO: 1745564 - protein, 24 aa, Staphylococcus epidermidis
VSTKGKILYAYIGIILCYHNAYHT

SEQ ID NO: 1745565 - protein, 17 aa, Staphylococcus epidermidis
VSVGLVFLLQILLNVLE

SEQ ID NO: 1745566 - protein, 20 aa, Staphylococcus epidermidis
VSVQYLFSRFKYIFIPYILV

SEQ ID NO: 1745567 - protein, 25 aa, Staphylococcus epidermidis
VSVYLAITMLLVWLSLISITYRSDE

SEQ ID NO: 1745568 - protein, 25 aa, Staphylococcus epidermidis
VSVYLAITMLLVWLSLLSITYHSDE

SEQ ID NO: 1745569 - protein, 22 aa, Staphylococcus epidermidis
VSWIGFHLFCISYFKVIDLSIN

SEQ ID NO: 1745570 - protein, 17 aa, Staphylococcus epidermidis
VTERKRIKKHPDVQKVT

SEQ ID NO: 1745571 - protein, 19 aa, Staphylococcus epidermidis
VTFIPHVVALFSINKDALK

SEQ ID NO: 1745572 - protein, 17 aa, Staphylococcus epidermidis
VTFSYKDIVFIACILII

SEQ ID NO: 1745573 - protein, 21 aa, Staphylococcus epidermidis
VTGICFLLALFFSPLIEVVTS

SEQ ID NO: 1745574 - protein, 17 aa, Staphylococcus epidermidis
VTGVCFLLALFFSPLIE

SEQ ID NO: 1745575 - protein, 22 aa, Staphylococcus epidermidis
VTHKSFLIPPIIKGHQVESSNE

SEQ ID NO: 1745576 - protein, 28 aa, Staphylococcus epidermidis
VTHTVTGLPQGLKFDASTNSIVGTPTQI

SEQ ID NO: 1745577 - protein, 23 aa, Staphylococcus epidermidis
VTIFCGYAFAGIVEKAGCLDVML

SEQ ID NO: 1745578 - protein, 19 aa, Staphylococcus epidermidis
VTIIFGFAFIQAALQLLMF

SEQ ID NO: 1745579 - protein, 26 aa, Staphylococcus epidermidis
VTISSLALAAPLAFGNASAHAAQTND

SEQ ID NO: 1745580 - protein, 22 aa, Staphylococcus epidermidis
VTLKDEKGNIISTTTTDENGKY

SEQ ID NO: 1745581 - protein, 23 aa, Staphylococcus epidermidis
VTLMIAVPFFKLPVGIASGAVVE

SEQ ID NO: 1745582 - protein, 19 aa, Staphylococcus epidermidis
VTLQLYYDSARKFNDALWN

SEQ ID NO: 1745583 - protein, 17 aa, Staphylococcus epidermidis
VTMPRKESTPEAPTVNA

SEQ ID NO: 1745584 - protein, 17 aa, Staphylococcus epidermidis
VTNIWIMIALRLIQGLT

SEQ ID NO: 1745585 - protein, 24 aa, Staphylococcus epidermidis
VTNQLPIFIVMAVYTGIYAVFAVI

SEQ ID NO: 1745586 - protein, 24 aa, Staphylococcus epidermidis
VTPYLNRINGVFFGQIFTVYFNDR

SEQ ID NO: 1745587 - protein, 22 aa, Staphylococcus epidermidis
VTSQFAPKVSADGTRVDINFAR

SEQ ID NO: 1745588 - protein, 25 aa, Staphylococcus epidermidis
VTSQFHVLRALKFAKKAHLSFDGIG

SEQ ID NO: 1745589 - protein, 21 aa, Staphylococcus epidermidis
VTTPHQVFMNWFSHDPAFDYF

SEQ ID NO: 1745590 - protein, 20 aa, Staphylococcus epidermidis
VTVILLIAILFKFNLAHVAT

SEQ ID NO: 1745591 - protein, 19 aa, Staphylococcus epidermidis
VTWLISTLIWKFGKVEQHW

SEQ ID NO: 1745592 - protein, 22 aa, Staphylococcus epidermidis
VVAIAVAIALIALITKFVGKSY

SEQ ID NO: 1745593 - protein, 17 aa, Staphylococcus epidermidis
VVALFSINKDALKETKV

SEQ ID NO: 1745594 - protein, 25 aa, Staphylococcus epidermidis
VVDKDGRLIGIVSLKIDMENVEGMA

SEQ ID NO: 1745595 - protein, 17 aa, Staphylococcus epidermidis
VVFIAIYSLMYWITSRI

SEQ ID NO: 1745596 - protein, 19 aa, Staphylococcus epidermidis
VVIIIFSYQLVKTYLEDKA

SEQ ID NO: 1745597 - protein, 29 aa, Staphylococcus epidermidis
VVKTATKRLPWLIVLTFLGMITATILGSF

SEQ ID NO: 1745598 - protein, 23 aa, Staphylococcus epidermidis
VVLFTYKWAYKVTHVIEQNLVMN

SEQ ID NO: 1745599 - protein, 18 aa, Staphylococcus epidermidis
VVLGESAVILGLVLAFYM

SEQ ID NO: 1745600 - protein, 27 aa, Staphylococcus epidermidis
VVLIIRYLIYKFKPLKVVATDEEVTSP

SEQ ID NO: 1745601 - protein, 17 aa, Staphylococcus epidermidis
VVLVVSCSCALVLSVPV

SEQ ID NO: 1745602 - protein, 20 aa, Staphylococcus epidermidis
VVMLAARILLESGAEGTRVE

SEQ ID NO: 1745603 - protein, 18 aa, Staphylococcus epidermidis
VVMLLTIAIILGFGALEI

SEQ ID NO: 1745604 - protein, 40 aa, Staphylococcus epidermidis
VVNKDNFNEHMNLSGSATYDPKTGIATLTPDAYSQKGAIS

SEQ ID NO: 1745605 - protein, 26 aa, Staphylococcus epidermidis
VVPSLGATLFRKGVKTKRQHEGLGAI

SEQ ID NO: 1745606 - protein, 24 aa, Staphylococcus epidermidis
VVSSCIMLPLGYMVGYFIGTRPHT

SEQ ID NO: 1745607 - protein, 21 aa, Staphylococcus epidermidis
VVSVLACIFANVGLTKIIMYS

SEQ ID NO: 1745608 - protein, 23 aa, Staphylococcus epidermidis
VVTAILCGLTFTIDSIPIAVILV

SEQ ID NO: 1745609 - protein, 30 aa, Staphylococcus epidermidis
VVTYYLIKWLFYLTMKYLKWNISIVKGSVQ

SEQ ID NO: 1745610 - protein, 19 aa, Staphylococcus epidermidis
VVVAEILMGIIIGHSLLNI

SEQ ID NO: 1745611 - protein, 23 aa, Staphylococcus epidermidis
VVVDLWNAKSFRKLSLHSKLVLT

SEQ ID NO: 1745612 - protein, 18 aa, Staphylococcus epidermidis
VVVGVVFSAIFFATKISK

SEQ ID NO: 1745613 - protein, 20 aa, Staphylococcus epidermidis
VVVLTLFGLGFIIFGVCMKP

SEQ ID NO: 1745614 - protein, 24 aa, Staphylococcus epidermidis
VVYMIRIGIQIAYLLNDLKGRIAV

SEQ ID NO: 1745615 - protein, 26 aa, Staphylococcus epidermidis
VWEFLSEKWWLVIIVVVIICGSLSQM

SEQ ID NO: 1745616 - protein, 30 aa, Staphylococcus epidermidis
VWIPLIIIILCLIFRISTVPSMLISSISAL

SEQ ID NO: 1745617 - protein, 19 aa, Staphylococcus epidermidis
VWLSIILFIRGCSVGGINL

SEQ ID NO: 1745618 - protein, 21 aa, Staphylococcus epidermidis
VYAEKLIQYGNRYRKDHHSVD

SEQ ID NO: 1745619 - protein, 19 aa, Staphylococcus epidermidis
VYFGMGVIFSLVYVYTKRI

SEQ ID NO: 1745620 - protein, 18 aa, Staphylococcus epidermidis
VYLGIDWHSLTTWGAVGE

SEQ ID NO: 1745621 - protein, 18 aa, Staphylococcus epidermidis
VYLRAFICVIIIVTHLLT

SEQ ID NO: 1745622 - protein, 19 aa, Staphylococcus epidermidis
VYLVMGWIGIIFLPIIIIR

SEQ ID NO: 1745623 - protein, 35 aa, Staphylococcus epidermidis
VYPGYIYNIGFQFSFLICFFILMAQPFLKNLTPIK

SEQ ID NO: 1745624 - protein, 21 aa, Staphylococcus epidermidis
VYPVINICVIVLKPITVLLNK

SEQ ID NO: 1745625 - protein, 25 aa, Staphylococcus epidermidis
VYREFESYSGIGIRSLMSNKLNYYI

SEQ ID NO: 1745626 - protein, 25 aa, Staphylococcus epidermidis
VYVILGSVLIKLALNYPLIMMLHTP

SEQ ID NO: 1745627 - protein, 24 aa, Staphylococcus epidermidis
WAFMSEKWWVIIIIVIIICGTIGQ

SEQ ID NO: 1745628 - protein, 20 aa, Staphylococcus epidermidis
WALLGWKVAIVYFIVLTIFS

SEQ ID NO: 1745629 - protein, 20 aa, Staphylococcus epidermidis
WAPRTKRGRYLGFWNTSHNI

SEQ ID NO: 1745630 - protein, 25 aa, Staphylococcus epidermidis
WAQINGRNAISWDAKFKLDVWYVEN

SEQ ID NO: 1745631 - protein, 18 aa, Staphylococcus epidermidis
WATKMFIYSLNYLVVFFV

SEQ ID NO: 1745632 - protein, 23 aa, Staphylococcus epidermidis
WDVPYGYGERTIDVLPQMTFIYD

SEQ ID NO: 1745633 - protein, 21 aa, Staphylococcus epidermidis
WDYVICLTDLPSISDNKVVIS

SEQ ID NO: 1745634 - protein, 19 aa, Staphylococcus epidermidis
WDYVVCLTDLPSISDNKVV

SEQ ID NO: 1745635 - protein, 28 aa, Staphylococcus epidermidis
WEIIKKNWKLLVIIPLIFLILSAIFTFF

SEQ ID NO: 1745636 - protein, 22 aa, Staphylococcus epidermidis
WEPGKKVHLVGHSMGGQTIRLM

SEQ ID NO: 1745637 - protein, 21 aa, Staphylococcus epidermidis
WFGTKDGVDWAGHQIDKRIDK

SEQ ID NO: 1745638 - protein, 24 aa, Staphylococcus epidermidis
WFKFWSVIESGGWVIFTHMEIVFV

SEQ ID NO: 1745639 - protein, 23 aa, Staphylococcus epidermidis
WFQDNRRGLAMSIRQTAIPIGAA

SEQ ID NO: 1745640 - protein, 17 aa, Staphylococcus epidermidis
WGILSGKMGFFYIITLV

SEQ ID NO: 1745641 - protein, 19 aa, Staphylococcus epidermidis
WGSLLFHLGIIPVFFGHVV

SEQ ID NO: 1745642 - protein, 20 aa, Staphylococcus epidermidis
WHVLPLGFLFGLGFDTASEI

SEQ ID NO: 1745643 - protein, 18 aa, Staphylococcus epidermidis
WIAFTLIWFLLGIPVGPG

SEQ ID NO: 1745644 - protein, 25 aa, Staphylococcus epidermidis
WIFDVVRIVLPLIIIIILFTVLYSV

SEQ ID NO: 1745645 - protein, 18 aa, Staphylococcus epidermidis
WIGACFTAYFGGQMSDWL

SEQ ID NO: 1745646 - protein, 17 aa, Staphylococcus epidermidis
WILKSIIVIVLAIISAF

SEQ ID NO: 1745647 - protein, 19 aa, Staphylococcus epidermidis
WINGFSPQYTMSVWMGFNK

SEQ ID NO: 1745648 - protein, 29 aa, Staphylococcus epidermidis
WIPLIIIILCLIFRISTVPSMLISSISAL

SEQ ID NO: 1745649 - protein, 18 aa, Staphylococcus epidermidis
WKEYFKKSLIEQINHTPH

SEQ ID NO: 1745650 - protein, 22 aa, Staphylococcus epidermidis
WKLNPAGSISIMISLSLFLLLN

SEQ ID NO: 1745651 - protein, 19 aa, Staphylococcus epidermidis
WKLTLLTFITIPVFVFIMI

SEQ ID NO: 1745652 - protein, 20 aa, Staphylococcus epidermidis
WKNIFNFKKIISVAFATGTY

SEQ ID NO: 1745653 - protein, 24 aa, Staphylococcus epidermidis
WKQHNVKLVFFLAIAKKDAQMMKK

SEQ ID NO: 1745654 - protein, 20 aa, Staphylococcus epidermidis
WKVAIVYFIVLTIFSILTGF

SEQ ID NO: 1745655 - protein, 18 aa, Staphylococcus epidermidis
WKYLYREWFTSVDHKKIG

SEQ ID NO: 1745656 - protein, 20 aa, Staphylococcus epidermidis
WKYVFLSIVLIIGIYVIYLI

SEQ ID NO: 1745657 - protein, 24 aa, Staphylococcus epidermidis
WLGSLKLNGWQTFISIASIILLAI

SEQ ID NO: 1745658 - protein, 17 aa, Staphylococcus epidermidis
WLIILSIFMVSIPNKWT

SEQ ID NO: 1745659 - protein, 17 aa, Staphylococcus epidermidis
WLKGHGGGGKVGGSGSA

SEQ ID NO: 1745660 - protein, 18 aa, Staphylococcus epidermidis
WLNITFKPLQILGMLLIM

SEQ ID NO: 1745661 - protein, 18 aa, Staphylococcus epidermidis
WLNLIGWNGNLAVFILFG

SEQ ID NO: 1745662 - protein, 21 aa, Staphylococcus epidermidis
WLRKKTGSLRIARSYFSIAGM

SEQ ID NO: 1745663 - protein, 18 aa, Staphylococcus epidermidis
WLSAKRARTLKQQVALQQ

SEQ ID NO: 1745664 - protein, 26 aa, Staphylococcus epidermidis
WMGDDRLTPMLRMASFSFIFIGILGV

SEQ ID NO: 1745665 - protein, 17 aa, Staphylococcus epidermidis
WMLVFGIVAVIVTIITG

SEQ ID NO: 1745666 - protein, 19 aa, Staphylococcus epidermidis
WMYILCALLVTIAMILSKI

SEQ ID NO: 1745667 - protein, 19 aa, Staphylococcus epidermidis
WNFEIKVDLMIGSAEDVHE

SEQ ID NO: 1745668 - protein, 23 aa, Staphylococcus epidermidis
WNHILRLKTSFFDKNSNGELLSR

SEQ ID NO: 1745669 - protein, 23 aa, Staphylococcus epidermidis
WNNHKYAFLLLAFVNILLLGMFL

SEQ ID NO: 1745670 - protein, 23 aa, Staphylococcus epidermidis
WNNPEKYYSYFIGDWYVSGDSAY

SEQ ID NO: 1745671 - protein, 20 aa, Staphylococcus epidermidis
WPGFSRSGSTISTGVFMKLN

SEQ ID NO: 1745672 - protein, 18 aa, Staphylococcus epidermidis
WPTFIGVVVVLLFAVIPM

SEQ ID NO: 1745673 - protein, 24 aa, Staphylococcus epidermidis
WPTKEELFKYTVIVVSTVIFFLVF

SEQ ID NO: 1745674 - protein, 17 aa, Staphylococcus epidermidis
WQFTTILLAPLVIISVA

SEQ ID NO: 1745675 - protein, 18 aa, Staphylococcus epidermidis
WQLSFTVNRQQQFKKQPK

SEQ ID NO: 1745676 - protein, 17 aa, Staphylococcus epidermidis
WRMLIIYFISGLFGNFV

SEQ ID NO: 1745677 - protein, 19 aa, Staphylococcus epidermidis
WRQSHLETPLLNFGVFKNK

SEQ ID NO: 1745678 - protein, 18 aa, Staphylococcus epidermidis
WRVPFIVIVGIALVTFIF

SEQ ID NO: 1745679 - protein, 24 aa, Staphylococcus epidermidis
WSAISGAVTRIWNTVASWFSRVVS

SEQ ID NO: 1745680 - protein, 24 aa, Staphylococcus epidermidis
WSAISGAVTRIWNTVSSWFSRVVS

SEQ ID NO: 1745681 - protein, 29 aa, Staphylococcus epidermidis
WSAPINGSTVRSGLIGSVTNHDIVITLKN

SEQ ID NO: 1745682 - protein, 18 aa, Staphylococcus epidermidis
WSDIAWRDLNLIPIALVG

SEQ ID NO: 1745683 - protein, 17 aa, Staphylococcus epidermidis
WSDLAVVKAKVADENIK

SEQ ID NO: 1745684 - protein, 20 aa, Staphylococcus epidermidis
WSFYGNLLIMLPMSIWAMER

SEQ ID NO: 1745685 - protein, 19 aa, Staphylococcus epidermidis
WSLLSWKVAVIYFVVLAIF

SEQ ID NO: 1745686 - protein, 28 aa, Staphylococcus epidermidis
WSPMQGMPAWVWSCIFLVIIFALNSLSV

SEQ ID NO: 1745687 - protein, 27 aa, Staphylococcus epidermidis
WSSPSFKGLFLPKGKLSSLVFNFNLPG

SEQ ID NO: 1745688 - protein, 19 aa, Staphylococcus epidermidis
WSYETYGDLAVAYDENEVV

SEQ ID NO: 1745689 - protein, 18 aa, Staphylococcus epidermidis
WTAGFSFSAGLIDFVLSL

SEQ ID NO: 1745690 - protein, 18 aa, Staphylococcus epidermidis
WTAGFSFSAGLIDYVLSL

SEQ ID NO: 1745691 - protein, 26 aa, Staphylococcus epidermidis
WTEEEFKPSKDLSVWKTLSADEQETY

SEQ ID NO: 1745692 - protein, 20 aa, Staphylococcus epidermidis
WTIFMILKVIGTLIMMILGF

SEQ ID NO: 1745693 - protein, 17 aa, Staphylococcus epidermidis
WTKTVDVAPEFQNLMNH

SEQ ID NO: 1745694 - protein, 25 aa, Staphylococcus epidermidis
WTVIKSPWLGRTLIVGCIFAIFQQF

SEQ ID NO: 1745695 - protein, 18 aa, Staphylococcus epidermidis
WVCVHWFMSHYEPEFYFE

SEQ ID NO: 1745696 - protein, 18 aa, Staphylococcus epidermidis
WVGVTIIFGAFAFFWFVG

SEQ ID NO: 1745697 - protein, 20 aa, Staphylococcus epidermidis
WVKLLESFIILPIVLPPTVL

SEQ ID NO: 1745698 - protein, 18 aa, Staphylococcus epidermidis
WVNIISWTLIVILSGLNI

SEQ ID NO: 1745699 - protein, 17 aa, Staphylococcus epidermidis
WYDHIGIDKDRREGVYK

SEQ ID NO: 1745700 - protein, 18 aa, Staphylococcus epidermidis
WYFITFGAFVAFGLFLPN

SEQ ID NO: 1745701 - protein, 18 aa, Staphylococcus epidermidis
WYIYLGQFINAGVALIIV

SEQ ID NO: 1745702 - protein, 25 aa, Staphylococcus epidermidis
WYRLITSMFLHFNFEHILMNMLSLF

SEQ ID NO: 1745703 - protein, 24 aa, Staphylococcus epidermidis
WYSYLCPMLNWFIPIKCTELTYQE

SEQ ID NO: 1745704 - protein, 26 aa, Staphylococcus epidermidis
YAEYAKRIANSKVWDTEDQAITDLTS

SEQ ID NO: 1745705 - protein, 20 aa, Staphylococcus epidermidis
YAGIYFRNVRRSMIEQLNED

SEQ ID NO: 1745706 - protein, 19 aa, Staphylococcus epidermidis
YAGKTWTATLSELGLSPTD

SEQ ID NO: 1745707 - protein, 24 aa, Staphylococcus epidermidis
YAIHKRYVVDIARRQFYFAKKHVN

SEQ ID NO: 1745708 - protein, 19 aa, Staphylococcus epidermidis
YAKDMTRLPDGTWMADIAL

SEQ ID NO: 1745709 - protein, 19 aa, Staphylococcus epidermidis
YAKKHGWDTPQKAIYGGAD

SEQ ID NO: 1745710 - protein, 17 aa, Staphylococcus epidermidis
YAPLRFRSALVPLANIG

SEQ ID NO: 1745711 - protein, 27 aa, Staphylococcus epidermidis
YASFIAYRVGLRWEDLEEGISKRLNTA

SEQ ID NO: 1745712 - protein, 24 aa, Staphylococcus epidermidis
YASLQIAAAFSFLTVMGGKLKFQK

SEQ ID NO: 1745713 - protein, 17 aa, Staphylococcus epidermidis
YAWFLASSVSAFFVGVT

SEQ ID NO: 1745714 - protein, 27 aa, Staphylococcus epidermidis
YCYHKYLPWLILVPIVSMIGLLILLLK

SEQ ID NO: 1745715 - protein, 18 aa, Staphylococcus epidermidis
YDATLGRQINTNDVLTLL

SEQ ID NO: 1745716 - protein, 30 aa, Staphylococcus epidermidis
YDEKDCGPACLAMISQFYGKRVSIPRLREY

SEQ ID NO: 1745717 - protein, 29 aa, Staphylococcus epidermidis
YDKSKLHKELPLFVSGHFRNAMNNEETSL

SEQ ID NO: 1745718 - protein, 25 aa, Staphylococcus epidermidis
YDKYGPRPLIFAGFTLLTICTLLLC

SEQ ID NO: 1745719 - protein, 23 aa, Staphylococcus epidermidis
YDLIEILVLIPISLIITISSAIT

SEQ ID NO: 1745720 - protein, 25 aa, Staphylococcus epidermidis
YDVEDARNGIVLKILSVIYTLVLGI

SEQ ID NO: 1745721 - protein, 17 aa, Staphylococcus epidermidis
YEGYSPDGVAGGDGIGF

SEQ ID NO: 1745722 - protein, 23 aa, Staphylococcus epidermidis
YELFYARCQELLLGKFSSEKSNK

SEQ ID NO: 1745723 - protein, 19 aa, Staphylococcus epidermidis
YEQFLYRLMIIVGTIFTIA

SEQ ID NO: 1745724 - protein, 22 aa, Staphylococcus epidermidis
YERGKVLSIVMMDRGMIPLGSL

SEQ ID NO: 1745725 - protein, 17 aa, Staphylococcus epidermidis
YESATIDGANRFKQIIH

SEQ ID NO: 1745726 - protein, 23 aa, Staphylococcus epidermidis
YEVPILHVTVWLDEDGNILKDAV

SEQ ID NO: 1745727 - protein, 17 aa, Staphylococcus epidermidis
YFDVSCIPILTKSKKNL

SEQ ID NO: 1745728 - protein, 17 aa, Staphylococcus epidermidis
YFGMGVIFSLAYVYTKR

SEQ ID NO: 1745729 - protein, 18 aa, Staphylococcus epidermidis
YFHKVRGLLSFWIGTLLI

SEQ ID NO: 1745730 - protein, 25 aa, Staphylococcus epidermidis
YFHTIMFSSYIWKNVGWDSIIYFAA

SEQ ID NO: 1745731 - protein, 18 aa, Staphylococcus epidermidis
YFIAVAFVASGFSANLRG

SEQ ID NO: 1745732 - protein, 20 aa, Staphylococcus epidermidis
YFKYQEEVMACYDYISILDN

SEQ ID NO: 1745733 - protein, 24 aa, Staphylococcus epidermidis
YFLLPEALGSLILAITTAVIGLIG

SEQ ID NO: 1745734 - protein, 19 aa, Staphylococcus epidermidis
YFSKMIIPNIFSLVASILV

SEQ ID NO: 1745735 - protein, 19 aa, Staphylococcus epidermidis
YFYPRFKVTILGFIVSFIW

SEQ ID NO: 1745736 - protein, 18 aa, Staphylococcus epidermidis
YGDENFALLNSEKPDQIR

SEQ ID NO: 1745737 - protein, 28 aa, Staphylococcus epidermidis
YGFASIEGWRWMLGLAVVPSVILLIGIY

SEQ ID NO: 1745738 - protein, 20 aa, Staphylococcus epidermidis
YGNRHCKNIRDVSRQINRII

SEQ ID NO: 1745739 - protein, 18 aa, Staphylococcus epidermidis
YGSLSFHFANTMSQVKST

SEQ ID NO: 1745740 - protein, 17 aa, Staphylococcus epidermidis
YGVEYLLAATILMGVIQ

SEQ ID NO: 1745741 - protein, 17 aa, Staphylococcus epidermidis
YGWCFIILMFALPIYLS

SEQ ID NO: 1745742 - protein, 27 aa, Staphylococcus epidermidis
YGWQAVIYVSLAFMFYGLALLLSHIVA

SEQ ID NO: 1745743 - protein, 17 aa, Staphylococcus epidermidis
YGYTAAFILVILQVITG

SEQ ID NO: 1745744 - protein, 17 aa, Staphylococcus epidermidis
YGYTASFILVILQVITG

SEQ ID NO: 1745745 - protein, 17 aa, Staphylococcus epidermidis
YHAINWLSTLQFTIFTI

SEQ ID NO: 1745746 - protein, 17 aa, Staphylococcus epidermidis
YHLKILWNSIILGVSVV

SEQ ID NO: 1745747 - protein, 19 aa, Staphylococcus epidermidis
YHNLLFNIIVSIVFTIVIG

SEQ ID NO: 1745748 - protein, 24 aa, Staphylococcus epidermidis
YIAARGSKEFKWRLPDKKTIRNSA

SEQ ID NO: 1745749 - protein, 22 aa, Staphylococcus epidermidis
YICSFFVLLVCSLMIIFGLKLP

SEQ ID NO: 1745750 - protein, 17 aa, Staphylococcus epidermidis
YIFKSIGIFCYFSILYC

SEQ ID NO: 1745751 - protein, 19 aa, Staphylococcus epidermidis
YIIPISILIALIVVPILIF

SEQ ID NO: 1745752 - protein, 17 aa, Staphylococcus epidermidis
YIKEIKPLSIISVGFLL

SEQ ID NO: 1745753 - protein, 19 aa, Staphylococcus epidermidis
YIKHILRNSLIPIITFLGA

SEQ ID NO: 1745754 - protein, 18 aa, Staphylococcus epidermidis
YIKMIAIGSFIAMASSVL

SEQ ID NO: 1745755 - protein, 18 aa, Staphylococcus epidermidis
YILIGFLVLFSFQRILTT

SEQ ID NO: 1745756 - protein, 17 aa, Staphylococcus epidermidis
YILKIPILNSYYKIYRT

SEQ ID NO: 1745757 - protein, 17 aa, Staphylococcus epidermidis
YILPTTILFSWISLFMA

SEQ ID NO: 1745758 - protein, 26 aa, Staphylococcus epidermidis
YILSYFCLKFSMLFMSNATILTSFFT

SEQ ID NO: 1745759 - protein, 18 aa, Staphylococcus epidermidis
YILYSIFCVLLIGLLILP

SEQ ID NO: 1745760 - protein, 17 aa, Staphylococcus epidermidis
YINILFKIHDWIVHLFL

SEQ ID NO: 1745761 - protein, 27 aa, Staphylococcus epidermidis
YITTKRLKDGYQWDILFNSNHKGHEYM

SEQ ID NO: 1745762 - protein, 26 aa, Staphylococcus epidermidis
YIVQNGRGVYKWAVGNVPNIIHEVLN

SEQ ID NO: 1745763 - protein, 21 aa, Staphylococcus epidermidis
YKDDYKYSGDVDYERLNVHLN

SEQ ID NO: 1745764 - protein, 18 aa, Staphylococcus epidermidis
YKEIIAYSIPFVIVSLNF

SEQ ID NO: 1745765 - protein, 18 aa, Staphylococcus epidermidis
YKEKWLNQISHDLKSPLT

SEQ ID NO: 1745766 - protein, 19 aa, Staphylococcus epidermidis
YKEVRKRGLEPIEAFATAV

SEQ ID NO: 1745767 - protein, 19 aa, Staphylococcus epidermidis
YKHHGFDLKGTTRALFSTI

SEQ ID NO: 1745768 - protein, 21 aa, Staphylococcus epidermidis
YKIAVTVDCLGEFVGTREESL

SEQ ID NO: 1745769 - protein, 20 aa, Staphylococcus epidermidis
YKICIEPTLHIYGKKVKKGR

SEQ ID NO: 1745770 - protein, 17 aa, Staphylococcus epidermidis
YKIINAFVEDVQFEDGV

SEQ ID NO: 1745771 - protein, 18 aa, Staphylococcus epidermidis
YKIPVSNFFKTLLGQGDY

SEQ ID NO: 1745772 - protein, 21 aa, Staphylococcus epidermidis
YKKERLETAFSNFFTYENLTE

SEQ ID NO: 1745773 - protein, 20 aa, Staphylococcus epidermidis
YKKLVKRYTILSIIFMVYFG

SEQ ID NO: 1745774 - protein, 22 aa, Staphylococcus epidermidis
YKKVGDSIYIFTNAHVVGDQEK

SEQ ID NO: 1745775 - protein, 19 aa, Staphylococcus epidermidis
YKKYCRLRGDSLCDINEPK

SEQ ID NO: 1745776 - protein, 19 aa, Staphylococcus epidermidis
YKLDSLNIFAKDNKYLMAI

SEQ ID NO: 1745777 - protein, 26 aa, Staphylococcus epidermidis
YKLIGENIFSFFIKKRWFYLLNVLFL

SEQ ID NO: 1745778 - protein, 18 aa, Staphylococcus epidermidis
YKLVCVGIASYIGSQTFV

SEQ ID NO: 1745779 - protein, 31 aa, Staphylococcus epidermidis
YKNKENQAGEIIATKTGSTWSLNKQETGITI

SEQ ID NO: 1745780 - protein, 18 aa, Staphylococcus epidermidis
YKNYGTIIGSTFKNIGDV

SEQ ID NO: 1745781 - protein, 20 aa, Staphylococcus epidermidis
YKRHPMIKLMNAMQYDASGI

SEQ ID NO: 1745782 - protein, 29 aa, Staphylococcus epidermidis
YKRLPATVIGALFAVIFTYIFGDQSPLSY

SEQ ID NO: 1745783 - protein, 20 aa, Staphylococcus epidermidis
YKSQEFKGIYSLIEVSALLI

SEQ ID NO: 1745784 - protein, 19 aa, Staphylococcus epidermidis
YKTNAPFRGDGSQKTGNNS

SEQ ID NO: 1745785 - protein, 23 aa, Staphylococcus epidermidis
YKTRTVGFYSLGIVWVLQTISLS

SEQ ID NO: 1745786 - protein, 18 aa, Staphylococcus epidermidis
YKVFCINIYLLMTGIIIL

SEQ ID NO: 1745787 - protein, 19 aa, Staphylococcus epidermidis
YKWMMITTLITFTTILLFC

SEQ ID NO: 1745788 - protein, 23 aa, Staphylococcus epidermidis
YKYSFFCAILFISGVAFAFFIGF

SEQ ID NO: 1745789 - protein, 28 aa, Staphylococcus epidermidis
YLADGTVRDEAWLNKKLNYISKKTYQGI

SEQ ID NO: 1745790 - protein, 24 aa, Staphylococcus epidermidis
YLDIQKKRIDLFFEENLDNYKTLK

SEQ ID NO: 1745791 - protein, 25 aa, Staphylococcus epidermidis
YLDIQKKRIDLFFNENVNHYKHFTI

SEQ ID NO: 1745792 - protein, 25 aa, Staphylococcus epidermidis
YLFWELTSFSSFLLISFWREKKASI

SEQ ID NO: 1745793 - protein, 22 aa, Staphylococcus epidermidis
YLFYSPRLKFDVLENPNKNSKT

SEQ ID NO: 1745794 - protein, 17 aa, Staphylococcus epidermidis
YLGMAWEILNPALQIMV

SEQ ID NO: 1745795 - protein, 18 aa, Staphylococcus epidermidis
YLGMFSWVILRHITFPTV

SEQ ID NO: 1745796 - protein, 24 aa, Staphylococcus epidermidis
YLIAVAFCIPIHFKVVSNNVEDKE

SEQ ID NO: 1745797 - protein, 18 aa, Staphylococcus epidermidis
YLILEFLKHQSYVSQLII

SEQ ID NO: 1745798 - protein, 18 aa, Staphylococcus epidermidis
YLKDGTIRDEVWLNKKLN

SEQ ID NO: 1745799 - protein, 18 aa, Staphylococcus epidermidis
YLLTRLGENIIYSLTNKV

SEQ ID NO: 1745800 - protein, 24 aa, Staphylococcus epidermidis
YLNAEHPVGLALLVLSLLAIVGFV

SEQ ID NO: 1745801 - protein, 18 aa, Staphylococcus epidermidis
YLNEYKIAVTVDCLGEFV

SEQ ID NO: 1745802 - protein, 23 aa, Staphylococcus epidermidis
YLPAEVLKPLIIVILTLVIIYTV

SEQ ID NO: 1745803 - protein, 33 aa, Staphylococcus epidermidis
YLPQVFKSMLIPIVIIITMCFVHLPTAIIMVIT

SEQ ID NO: 1745804 - protein, 38 aa, Staphylococcus epidermidis
YLPQVFKSMMIPVAIIIAMCFVHLPTALIMMVTAPFIP

SEQ ID NO: 1745805 - protein, 21 aa, Staphylococcus epidermidis
YLRRLHSLLGIIPIGAFLIVH

SEQ ID NO: 1745806 - protein, 25 aa, Staphylococcus epidermidis
YLSCGFVGACGWMVYILFFDGLEVH

SEQ ID NO: 1745807 - protein, 17 aa, Staphylococcus epidermidis
YLSLKVSGQFGFINQIV

SEQ ID NO: 1745808 - protein, 20 aa, Staphylococcus epidermidis
YLTLDSFNLYFGIFMICVAI

SEQ ID NO: 1745809 - protein, 18 aa, Staphylococcus epidermidis
YLTLRFHNYLAIIFILIL

SEQ ID NO: 1745810 - protein, 18 aa, Staphylococcus epidermidis
YLVIKIAGIIAMMLLGFY

SEQ ID NO: 1745811 - protein, 19 aa, Staphylococcus epidermidis
YLVMIPLTFIFGADLLLIS

SEQ ID NO: 1745812 - protein, 21 aa, Staphylococcus epidermidis
YLVRIYRIVMLIITFLTELIK

SEQ ID NO: 1745813 - protein, 18 aa, Staphylococcus epidermidis
YLVTFVFCIVIAAVNLFV

SEQ ID NO: 1745814 - protein, 24 aa, Staphylococcus epidermidis
YLVVRLTILPEVKFNKVFSDYILI

SEQ ID NO: 1745815 - protein, 17 aa, Staphylococcus epidermidis
YLYCIIFALATLIPNLA

SEQ ID NO: 1745816 - protein, 17 aa, Staphylococcus epidermidis
YLYEHFTSLKGFYDASF

SEQ ID NO: 1745817 - protein, 27 aa, Staphylococcus epidermidis
YLYSEFSFPLLIMVIIIIFYKQIKNIL

SEQ ID NO: 1745818 - protein, 19 aa, Staphylococcus epidermidis
YLYWYCKKIKKEPKASYAY

SEQ ID NO: 1745819 - protein, 19 aa, Staphylococcus epidermidis
YLYYKRKVLTQNLVDKHMQ

SEQ ID NO: 1745820 - protein, 26 aa, Staphylococcus epidermidis
YMDIEEILSHGIDVWTTLNIQHIESL

SEQ ID NO: 1745821 - protein, 19 aa, Staphylococcus epidermidis
YMERLSYKKLLISLGTIVI

SEQ ID NO: 1745822 - protein, 17 aa, Staphylococcus epidermidis
YMMIIFPIIGLVCALLA

SEQ ID NO: 1745823 - protein, 23 aa, Staphylococcus epidermidis
YMPSDGWWLLNFISTIGALLMAI

SEQ ID NO: 1745824 - protein, 23 aa, Staphylococcus epidermidis
YMPSDGWWLLNFISTIGALLMGI

SEQ ID NO: 1745825 - protein, 18 aa, Staphylococcus epidermidis
YMVLPIILGFLITIFWGA

SEQ ID NO: 1745826 - protein, 24 aa, Staphylococcus epidermidis
YNDDKSFRLNVSYILSKIGKNVYP

SEQ ID NO: 1745827 - protein, 18 aa, Staphylococcus epidermidis
YNEAKSRIQSQIDSAKNE

SEQ ID NO: 1745828 - protein, 17 aa, Staphylococcus epidermidis
YNEGEVVLKTYDKLTEI

SEQ ID NO: 1745829 - protein, 17 aa, Staphylococcus epidermidis
YNFYGVGALDSDPIKTG

SEQ ID NO: 1745830 - protein, 17 aa, Staphylococcus epidermidis
YNGRDYRREQQLEEENE

SEQ ID NO: 1745831 - protein, 33 aa, Staphylococcus epidermidis
YNHAKPPVFLVRFWTLFASFLIGLALMGVLLFN

SEQ ID NO: 1745832 - protein, 17 aa, Staphylococcus epidermidis
YNHKQPLIYLFIVILVV

SEQ ID NO: 1745833 - protein, 18 aa, Staphylococcus epidermidis
YNLDFDLEHQQRVREQWR

SEQ ID NO: 1745834 - protein, 20 aa, Staphylococcus epidermidis
YNLFKVIPYLLVLILALIGV

SEQ ID NO: 1745835 - protein, 17 aa, Staphylococcus epidermidis
YNQERWQGANAMNAYQI

SEQ ID NO: 1745836 - protein, 25 aa, Staphylococcus epidermidis
YNRFSKGLFEWIGYNTKVFTYENVT

SEQ ID NO: 1745837 - protein, 17 aa, Staphylococcus epidermidis
YNRMGIVDWVFEVFGKD

SEQ ID NO: 1745838 - protein, 17 aa, Staphylococcus epidermidis
YNVKEKLTEQGYRVHEA

SEQ ID NO: 1745839 - protein, 26 aa, Staphylococcus epidermidis
YNVKSTHFFSLILIFTILLSTLGQSL

SEQ ID NO: 1745840 - protein, 19 aa, Staphylococcus epidermidis
YNYNVPLGYGTRIISKSSA

SEQ ID NO: 1745841 - protein, 19 aa, Staphylococcus epidermidis
YPAHIPMMPEKVIREDVER

SEQ ID NO: 1745842 - protein, 19 aa, Staphylococcus epidermidis
YPELRLRLVKGAYKEDASI

SEQ ID NO: 1745843 - protein, 52 aa, Staphylococcus epidermidis
YPGISTPLEVPVKVWVYNFDFTQPIYKIQVGDTFPKGTWAGYYKHLENGEGL

SEQ ID NO: 1745844 - protein, 18 aa, Staphylococcus epidermidis
YPMEVTIANEVVKKDFIV

SEQ ID NO: 1745845 - protein, 20 aa, Staphylococcus epidermidis
YPTGKLSAMVNIPNDINRVR

SEQ ID NO: 1745846 - protein, 19 aa, Staphylococcus epidermidis
YPVGLGWYLKTISYFLYTL

SEQ ID NO: 1745847 - protein, 19 aa, Staphylococcus epidermidis
YPYLCLTIFIIGHLARYKY

SEQ ID NO: 1745848 - protein, 32 aa, Staphylococcus epidermidis
YPYMLSGGMLQRMMIALALALKPKLIIADEPT

SEQ ID NO: 1745849 - protein, 30 aa, Staphylococcus epidermidis
YQANFFAIWFELGVLTFVYVLTAFKIARLG

SEQ ID NO: 1745850 - protein, 21 aa, Staphylococcus epidermidis
YQAVDNVVALGRIHGNDPNDH

SEQ ID NO: 1745851 - protein, 18 aa, Staphylococcus epidermidis
YQHYYYKLFAIATWILLI

SEQ ID NO: 1745852 - protein, 25 aa, Staphylococcus epidermidis
YQNFSFPVLFLIIIFLFKEQIKKIL

SEQ ID NO: 1745853 - protein, 25 aa, Staphylococcus epidermidis
YQNFSFPVLFLIIIFLFKKQIKKIL

SEQ ID NO: 1745854 - protein, 22 aa, Staphylococcus epidermidis
YQNITGSFDLIATPKRETAIKD

SEQ ID NO: 1745855 - protein, 17 aa, Staphylococcus epidermidis
YRAGTYVKNARKLNKHV

SEQ ID NO: 1745856 - protein, 17 aa, Staphylococcus epidermidis
YRIKGVVGNNETINDFA

SEQ ID NO: 1745857 - protein, 21 aa, Staphylococcus epidermidis
YRITMTDYCYRNYKEYLEDAI

SEQ ID NO: 1745858 - protein, 18 aa, Staphylococcus epidermidis
YRKNELFTIKLITFSFIF

SEQ ID NO: 1745859 - protein, 20 aa, Staphylococcus epidermidis
YRKVAIKAISIPPSEKEETF

SEQ ID NO: 1745860 - protein, 17 aa, Staphylococcus epidermidis
YRLIFHIEKGRLRFVKI

SEQ ID NO: 1745861 - protein, 18 aa, Staphylococcus epidermidis
YRLIVGMVAVFLASASSA

SEQ ID NO: 1745862 - protein, 20 aa, Staphylococcus epidermidis
YRLLLTIYFAITFWISILSL

SEQ ID NO: 1745863 - protein, 17 aa, Staphylococcus epidermidis
YRQTIAIWFRHLFMFSP

SEQ ID NO: 1745864 - protein, 35 aa, Staphylococcus epidermidis
YRSYEHTHFPNFGGGLIGFYLLKLFIPLISIVGVI

SEQ ID NO: 1745865 - protein, 27 aa, Staphylococcus epidermidis
YRTSVSDGITKFIYRKISTAQSPIVEN

SEQ ID NO: 1745866 - protein, 22 aa, Staphylococcus epidermidis
YRVEGFSCANCAGKFERNVKKI

SEQ ID NO: 1745867 - protein, 22 aa, Staphylococcus epidermidis
YSCLVIGLVLFMFGYTVMTSIL

SEQ ID NO: 1745868 - protein, 17 aa, Staphylococcus epidermidis
YSFNGGAHFGIDYGAPY

SEQ ID NO: 1745869 - protein, 18 aa, Staphylococcus epidermidis
YSGNALTKFLSLLMLVNG

SEQ ID NO: 1745870 - protein, 18 aa, Staphylococcus epidermidis
YSGSHLYVKSRQVNKNVK

SEQ ID NO: 1745871 - protein, 22 aa, Staphylococcus epidermidis
YSKVIGIPKWIQFLFIIIVAMV

SEQ ID NO: 1745872 - protein, 20 aa, Staphylococcus epidermidis
YSLFILFRYKEVRKRGLEPI

SEQ ID NO: 1745873 - protein, 19 aa, Staphylococcus epidermidis
YSLIWAFIGFIWITHALNA

SEQ ID NO: 1745874 - protein, 19 aa, Staphylococcus epidermidis
YSLKELDYLVNLLVEEIAY

SEQ ID NO: 1745875 - protein, 20 aa, Staphylococcus epidermidis
YSLVNWRKNLGYVMQNSGVL

SEQ ID NO: 1745876 - protein, 25 aa, Staphylococcus epidermidis
YSLYWKDLTRTGAISGMVAGAVVVI

SEQ ID NO: 1745877 - protein, 26 aa, Staphylococcus epidermidis
YSNNKPVYLTHTWTTNDGAIAEESIQ

SEQ ID NO: 1745878 - protein, 33 aa, Staphylococcus epidermidis
YSPDGVAGGDGIGFAFSPGPLGQIGKEGAAVGI

SEQ ID NO: 1745879 - protein, 19 aa, Staphylococcus epidermidis
YSPLKRLLLYVIILLTMCA

SEQ ID NO: 1745880 - protein, 19 aa, Staphylococcus epidermidis
YSPQQGMIQMRLFKEASNI

SEQ ID NO: 1745881 - protein, 28 aa, Staphylococcus epidermidis
YSQRKIDVEPVFGFMKAILGFTRMSVRG

SEQ ID NO: 1745882 - protein, 32 aa, Staphylococcus epidermidis
YSQRKIDVEPVFGFMKAILGFTRMSVRGIDKA

SEQ ID NO: 1745883 - protein, 24 aa, Staphylococcus epidermidis
YSRKANEIILAMKLEKILSKNEII

SEQ ID NO: 1745884 - protein, 23 aa, Staphylococcus epidermidis
YSSRIPRTVSILLSGSSLALSGL

SEQ ID NO: 1745885 - protein, 18 aa, Staphylococcus epidermidis
YTALAGVILGCFVFPPFG

SEQ ID NO: 1745886 - protein, 25 aa, Staphylococcus epidermidis
YTFTELMIIISIIYFKNLYIGRLDK

SEQ ID NO: 1745887 - protein, 17 aa, Staphylococcus epidermidis
YTLIWFFIGIVIYLLYG

SEQ ID NO: 1745888 - protein, 25 aa, Staphylococcus epidermidis
YTPLPATAKLEFTNVLDGKPLTDGE

SEQ ID NO: 1745889 - protein, 23 aa, Staphylococcus epidermidis
YTPTKANSGQDITVDSNGITTTG

SEQ ID NO: 1745890 - protein, 17 aa, Staphylococcus epidermidis
YTQIESITLRGVKMDTT

SEQ ID NO: 1745891 - protein, 19 aa, Staphylococcus epidermidis
YTRIIDVLIGIAIAVIGIF

SEQ ID NO: 1745892 - protein, 18 aa, Staphylococcus epidermidis
YTRIIDVLVGIIIAVLGI

SEQ ID NO: 1745893 - protein, 26 aa, Staphylococcus epidermidis
YTTTVFGSIALISSLLLLRRQRKESK

SEQ ID NO: 1745894 - protein, 19 aa, Staphylococcus epidermidis
YTWDRFKNKWTHFIISLPV

SEQ ID NO: 1745895 - protein, 19 aa, Staphylococcus epidermidis
YTWERFKNKWTHFFISIPV

SEQ ID NO: 1745896 - protein, 22 aa, Staphylococcus epidermidis
YVFIACQSYFKDPTRIYSDDVK

SEQ ID NO: 1745897 - protein, 18 aa, Staphylococcus epidermidis
YVFWELTSVSSFLLISYW

SEQ ID NO: 1745898 - protein, 29 aa, Staphylococcus epidermidis
YVIPFIISLINWRGLWIIIGVLSLTTLLM

SEQ ID NO: 1745899 - protein, 31 aa, Staphylococcus epidermidis
YVKMSCSVLLMSGTLIGYGLTKDTQADSTET

SEQ ID NO: 1745900 - protein, 17 aa, Staphylococcus epidermidis
YVRCNELLLGKFSSEKT

SEQ ID NO: 1745901 - protein, 23 aa, Staphylococcus epidermidis
YVSYPRKFIKGSHYPHVNVDKMK

SEQ ID NO: 1745902 - protein, 25 aa, Staphylococcus epidermidis
YVYTKRIAVPIGIHMLMNGSVVLAQ

SEQ ID NO: 1745903 - protein, 24 aa, Staphylococcus epidermidis
YVYTKRIAVPIGIHMLQNGTVVLM

SEQ ID NO: 1745904 - protein, 17 aa, Staphylococcus epidermidis
YWILPGRYKRHTKEYHE

SEQ ID NO: 1745905 - protein, 20 aa, Staphylococcus epidermidis
YWRIGACIIGAIFVISYLFW

SEQ ID NO: 1745906 - protein, 17 aa, Staphylococcus epidermidis
YYEYTLRIESINNEMRK

SEQ ID NO: 1745907 - protein, 32 aa, Staphylococcus epidermidis
YYFQITLENASWWKSFQFFDESETELPTTVVD

SEQ ID NO: 1745908 - protein, 18 aa, Staphylococcus epidermidis
YYFVFHIIIYQLELILNK

SEQ ID NO: 1745909 - protein, 19 aa, Staphylococcus epidermidis
YYIFFEKIGFLLVLLLGCV

SEQ ID NO: 1745910 - protein, 18 aa, Staphylococcus epidermidis
YYITSCIGLFILLIIFSL

SEQ ID NO: 1745911 - protein, 18 aa, Staphylococcus epidermidis
YYNRYLKQHDQVIDARLG

SEQ ID NO: 1745912 - protein, 17 aa, Staphylococcus epidermidis
YYNRYLKQNDQVLDARL

SEQ ID NO: 1745913 - protein, 18 aa, Staphylococcus epidermidis
YYVNPIALSFDFSKELLG

SEQ ID NO: 1745914 - protein, 17 aa, Staphylococcus epidermidis
YYYRLSKPYDDSDDITI

SEQ ID NO: 1745915 - protein, 19 aa, Staphylococcus epidermidis
ALFLLCFYHLPNLNRYNEK

SEQ ID NO: 1745916 - protein, 19 aa, Staphylococcus epidermidis
AYLSYRLEQEYSKDEIFQV

SEQ ID NO: 1745917 - protein, 19 aa, Staphylococcus epidermidis
ESVVLCLIGGIIGLILGII

SEQ ID NO: 1745918 - protein, 18 aa, Staphylococcus epidermidis
FFNKFVFHGRIQYNVDDL

SEQ ID NO: 1745919 - protein, 24 aa, Staphylococcus epidermidis
FGFIKRLLIPFGLHHIFHAPFWFE

SEQ ID NO: 1745920 - protein, 17 aa, Staphylococcus epidermidis
FVGFLGISYVTFKSVQL

SEQ ID NO: 1745921 - protein, 17 aa, Staphylococcus epidermidis
GKKAFWFIFIGGFLLTF

SEQ ID NO: 1745922 - protein, 18 aa, Staphylococcus epidermidis
GVWLYHFLERVLIPTGLH

SEQ ID NO: 1745923 - protein, 21 aa, Staphylococcus epidermidis
IGFASAWGYWFSAFLGNVAYA

SEQ ID NO: 1745924 - protein, 17 aa, Staphylococcus epidermidis
IGFYLLKLFIPLISIVG

SEQ ID NO: 1745925 - protein, 20 aa, Staphylococcus epidermidis
IGGILVWLGWYGFNVGSAFT

SEQ ID NO: 1745926 - protein, 17 aa, Staphylococcus epidermidis
IVACLKTAIGLITAFSE

SEQ ID NO: 1745927 - protein, 18 aa, Staphylococcus epidermidis
KLFRLPAIKRFEEDEELL

SEQ ID NO: 1745928 - protein, 17 aa, Staphylococcus epidermidis
LFWAFALCLLPFSLMLV

SEQ ID NO: 1745929 - protein, 21 aa, Staphylococcus epidermidis
LGWNYWFNWVITVAADVTIAA

SEQ ID NO: 1745930 - protein, 17 aa, Staphylococcus epidermidis
LPIAMPVIMAGIRTAMV

SEQ ID NO: 1745931 - protein, 21 aa, Staphylococcus epidermidis
PNFGGGLIGFYLLKLFIPLIS

SEQ ID NO: 1745932 - protein, 19 aa, Staphylococcus epidermidis
RTLTLFFPKAEWAQNIADT

SEQ ID NO: 1745933 - protein, 20 aa, Staphylococcus epidermidis
SSYHIFRIFFILFVIAPLIG

SEQ ID NO: 1745934 - protein, 18 aa, Staphylococcus epidermidis
VKDYGSGMTPFYTALSIW

SEQ ID NO: 1745935 - protein, 18 aa, Staphylococcus epidermidis
VTGWTYWLCWIITGMAEV

SEQ ID NO: 1745936 - protein, 19 aa, Staphylococcus epidermidis
WSTAQRMVVTWVITLPISA

SEQ ID NO: 1745937 - protein, 21 aa, Staphylococcus epidermidis
YMAKRRIGALIVFEKETGLQD

SEQ ID NO: 1745938 - protein, 18 aa, Staphylococcus epidermidis
YVALRISLIKVLKPYYPF

SEQ ID NO: 1745939 - protein, 20 aa, Staphylococcus epidermidis
AFEWPLFIVFGLIFLLLVPN

SEQ ID NO: 1745940 - protein, 20 aa, Staphylococcus epidermidis
AFFISRGFVKTGLGRRIALQ

SEQ ID NO: 1745941 - protein, 17 aa, Staphylococcus epidermidis
AIEALYYNRYLKQNDQV

SEQ ID NO: 1745942 - protein, 18 aa, Staphylococcus epidermidis
AIVVLRLGYLQIAQGSHY

SEQ ID NO: 1745943 - protein, 20 aa, Staphylococcus epidermidis
ANSIWAWLLVLVFLPLVGFI

SEQ ID NO: 1745944 - protein, 24 aa, Staphylococcus epidermidis
AQFIPEFIGSLVIGIISVIGHAFV

SEQ ID NO: 1745945 - protein, 22 aa, Staphylococcus epidermidis
ARLFGELEFWFSIIKVVTIITM

SEQ ID NO: 1745946 - protein, 21 aa, Staphylococcus epidermidis
ASYELPILYVTVWLDDQGNII

SEQ ID NO: 1745947 - protein, 25 aa, Staphylococcus epidermidis
ATFIGWRWIFVLSIIFSIIALILLR

SEQ ID NO: 1745948 - protein, 18 aa, Staphylococcus epidermidis
AYFYSIYEMMMWLTHQTH

SEQ ID NO: 1745949 - protein, 19 aa, Staphylococcus epidermidis
CELIPRWFVEYDGNWYAYK

SEQ ID NO: 1745950 - protein, 25 aa, Staphylococcus epidermidis
CTQRLKQTWKWFAISLIIGLVIILA

SEQ ID NO: 1745951 - protein, 19 aa, Staphylococcus epidermidis
DIEGWRWMLGLAVVPSVIL

SEQ ID NO: 1745952 - protein, 17 aa, Staphylococcus epidermidis
DIVIQWGVLALIVIFQP

SEQ ID NO: 1745953 - protein, 23 aa, Staphylococcus epidermidis
DLFSWRMPFYLVSAIAAVAFILG

SEQ ID NO: 1745954 - protein, 26 aa, Staphylococcus epidermidis
DLQKDLWKYLSIVGVIVLFTVYLASR

SEQ ID NO: 1745955 - protein, 19 aa, Staphylococcus epidermidis
DRKNIRWRYVGLLLVIQLI

SEQ ID NO: 1745956 - protein, 21 aa, Staphylococcus epidermidis
EEKILLALVLYRFAYYFVPVM

SEQ ID NO: 1745957 - protein, 21 aa, Staphylococcus epidermidis
EKILGWFSWVFLLILTIVSMF

SEQ ID NO: 1745958 - protein, 23 aa, Staphylococcus epidermidis
ENIKAHLKLTSYIDKSKVPNNNT

SEQ ID NO: 1745959 - protein, 18 aa, Staphylococcus epidermidis
ERFNKFEWLAIIFALVGV

SEQ ID NO: 1745960 - protein, 20 aa, Staphylococcus epidermidis
EVKARSAIHYASYKPTLANI

SEQ ID NO: 1745961 - protein, 19 aa, Staphylococcus epidermidis
FIAVPLWGMLKKRQFKKTK

SEQ ID NO: 1745962 - protein, 23 aa, Staphylococcus epidermidis
FIIEFIGALLLAFYFYRDNPDLK

SEQ ID NO: 1745963 - protein, 18 aa, Staphylococcus epidermidis
FILLIGIFCFLKGLIGFF

SEQ ID NO: 1745964 - protein, 20 aa, Staphylococcus epidermidis
FIMKFGFRKIEAIVGTLIFT

SEQ ID NO: 1745965 - protein, 19 aa, Staphylococcus epidermidis
FKFSYSWIHLAKIILISII

SEQ ID NO: 1745966 - protein, 22 aa, Staphylococcus epidermidis
FKSMLIPIVIIITMCFVHLPTA

SEQ ID NO: 1745967 - protein, 17 aa, Staphylococcus epidermidis
FLLLFIMKFGFRKIEAI

SEQ ID NO: 1745968 - protein, 21 aa, Staphylococcus epidermidis
FLMEFARGMYILSYINFLPTV

SEQ ID NO: 1745969 - protein, 19 aa, Staphylococcus epidermidis
FLNRLMIIIAITFTIVYVI

SEQ ID NO: 1745970 - protein, 20 aa, Staphylococcus epidermidis
FNEKGRIIGLLQMFMTKESI

SEQ ID NO: 1745971 - protein, 19 aa, Staphylococcus epidermidis
FRFRIPFTPGLIPKRREEI

SEQ ID NO: 1745972 - protein, 18 aa, Staphylococcus epidermidis
FRKIEAIVGTLIFTVLAI

SEQ ID NO: 1745973 - protein, 18 aa, Staphylococcus epidermidis
FSNEYLKKFIFNHKKKST

SEQ ID NO: 1745974 - protein, 17 aa, Staphylococcus epidermidis
FTIYWPFFSDTFIWLPL

SEQ ID NO: 1745975 - protein, 17 aa, Staphylococcus epidermidis
FTKGFLKSIAILIGLAI

SEQ ID NO: 1745976 - protein, 17 aa, Staphylococcus epidermidis
FVGAVAWTIYQMTVGMD

SEQ ID NO: 1745977 - protein, 22 aa, Staphylococcus epidermidis
FVIGWTYWVCWIVSSMSDLTAM

SEQ ID NO: 1745978 - protein, 23 aa, Staphylococcus epidermidis
FWNRWHMTLSFWFRDCIYMRSLF

SEQ ID NO: 1745979 - protein, 21 aa, Staphylococcus epidermidis
FYILTVYFFFGRLRKLTRVRS

SEQ ID NO: 1745980 - protein, 20 aa, Staphylococcus epidermidis
FYKFRFILIMFIIFLMAIMV

SEQ ID NO: 1745981 - protein, 18 aa, Staphylococcus epidermidis
FYLKKIWVAIKFLAVYLY

SEQ ID NO: 1745982 - protein, 19 aa, Staphylococcus epidermidis
GALVGSIWLILSIIPISII

SEQ ID NO: 1745983 - protein, 25 aa, Staphylococcus epidermidis
GFNLAELLARFGIILGVFLTSMEMG

SEQ ID NO: 1745984 - protein, 20 aa, Staphylococcus epidermidis
GGPGAVFWMWIIAFIGAASA

SEQ ID NO: 1745985 - protein, 19 aa, Staphylococcus epidermidis
GHFFWPAILAFALTGIGLP

SEQ ID NO: 1745986 - protein, 17 aa, Staphylococcus epidermidis
GHLKLALTVFAFIMMIS

SEQ ID NO: 1745987 - protein, 21 aa, Staphylococcus epidermidis
GIGRLPAIIALVVYALLPILR

SEQ ID NO: 1745988 - protein, 17 aa, Staphylococcus epidermidis
GIVPEILITKVIILGLF

SEQ ID NO: 1745989 - protein, 18 aa, Staphylococcus epidermidis
GKTALKYGFDLATEVGIK

SEQ ID NO: 1745990 - protein, 17 aa, Staphylococcus epidermidis
GPIKVLRIILLINAMAL

SEQ ID NO: 1745991 - protein, 18 aa, Staphylococcus epidermidis
GSVFPILSPILGWIGVFM

SEQ ID NO: 1745992 - protein, 19 aa, Staphylococcus epidermidis
GSVGEMFRPFALAITFSLL

SEQ ID NO: 1745993 - protein, 17 aa, Staphylococcus epidermidis
HNVWEFLNAFFAEIIKV

SEQ ID NO: 1745994 - protein, 17 aa, Staphylococcus epidermidis
IAISMRITKGFKQLIAL

SEQ ID NO: 1745995 - protein, 20 aa, Staphylococcus epidermidis
IFHAPFWFEFGSWKNAAGEI

SEQ ID NO: 1745996 - protein, 26 aa, Staphylococcus epidermidis
IFIRKCLRTSIMFSIILLGFVAMNIL

SEQ ID NO: 1745997 - protein, 19 aa, Staphylococcus epidermidis
IFLLFRFTPLLGLSNVYIY

SEQ ID NO: 1745998 - protein, 18 aa, Staphylococcus epidermidis
IFLMPSIIGGLLILIGIF

SEQ ID NO: 1745999 - protein, 23 aa, Staphylococcus epidermidis
IGIFCIIMIFALLGFLPYNLNPA

SEQ ID NO: 1746000 - protein, 19 aa, Staphylococcus epidermidis
IIIMRTSWWFIFFIFLGGL

SEQ ID NO: 1746001 - protein, 17 aa, Staphylococcus epidermidis
IIITMCFVHLPTAIIMI

SEQ ID NO: 1746002 - protein, 17 aa, Staphylococcus epidermidis
IILMVIAILGMAGWLFY

SEQ ID NO: 1746003 - protein, 17 aa, Staphylococcus epidermidis
IIVGWKFLSRTTAIYTA

SEQ ID NO: 1746004 - protein, 18 aa, Staphylococcus epidermidis
ILITKVIILGLFGIGFMV

SEQ ID NO: 1746005 - protein, 21 aa, Staphylococcus epidermidis
ILKSELLLAFSTSSSEAVLPI

SEQ ID NO: 1746006 - protein, 17 aa, Staphylococcus epidermidis
ILMGIVIGHSFLNLVER

SEQ ID NO: 1746007 - protein, 17 aa, Staphylococcus epidermidis
INHIGFQFSFLISLFII

SEQ ID NO: 1746008 - protein, 19 aa, Staphylococcus epidermidis
IPSNGRWYDHIGIKKDRRE

SEQ ID NO: 1746009 - protein, 20 aa, Staphylococcus epidermidis
IPVSTLRAGLIIGAKGSSYP

SEQ ID NO: 1746010 - protein, 18 aa, Staphylococcus epidermidis
IRTGRLIAISSLVFCILL

SEQ ID NO: 1746011 - protein, 17 aa, Staphylococcus epidermidis
IRYKKKYIPQIAVNHSV

SEQ ID NO: 1746012 - protein, 17 aa, Staphylococcus epidermidis
ISLCLIGTLLIAIAVNS

SEQ ID NO: 1746013 - protein, 20 aa, Staphylococcus epidermidis
ISLIKVLKPYYPFPVIVDDA

SEQ ID NO: 1746014 - protein, 22 aa, Staphylococcus epidermidis
ISLSRLAVRPGDSIEAIATEGS

SEQ ID NO: 1746015 - protein, 19 aa, Staphylococcus epidermidis
ITLWLSLVITMIFTVVEFV

SEQ ID NO: 1746016 - protein, 18 aa, Staphylococcus epidermidis
IYEMMMWLTHQTHHPHLY

SEQ ID NO: 1746017 - protein, 22 aa, Staphylococcus epidermidis
KAFGEFEFWFALIKVVTIVLMI

SEQ ID NO: 1746018 - protein, 28 aa, Staphylococcus epidermidis
KDFPTRKNHYAIRKFTVGTASIIVGSFL

SEQ ID NO: 1746019 - protein, 19 aa, Staphylococcus epidermidis
KDGLFPKWFAKENKNGAPM

SEQ ID NO: 1746020 - protein, 18 aa, Staphylococcus epidermidis
KDYTSYMLAEILKGTFKA

SEQ ID NO: 1746021 - protein, 18 aa, Staphylococcus epidermidis
KGLGVLFFVEFWERFSYY

SEQ ID NO: 1746022 - protein, 18 aa, Staphylococcus epidermidis
KIKLVMGGTDGDHDPEIN

SEQ ID NO: 1746023 - protein, 19 aa, Staphylococcus epidermidis
KIWVAIKFLAVYLYQLITS

SEQ ID NO: 1746024 - protein, 18 aa, Staphylococcus epidermidis
KKAVFPFIIASGFIADTT

SEQ ID NO: 1746025 - protein, 23 aa, Staphylococcus epidermidis
KKLKGKEVLFAWSPFIILTVIVM

SEQ ID NO: 1746026 - protein, 23 aa, Staphylococcus epidermidis
KKNYRSGTVFAILCWFVISVAIF

SEQ ID NO: 1746027 - protein, 20 aa, Staphylococcus epidermidis
KLFGELEFWFAIIKIVTIIA

SEQ ID NO: 1746028 - protein, 18 aa, Staphylococcus epidermidis
KNRGELRVGLSADYAPLE

SEQ ID NO: 1746029 - protein, 20 aa, Staphylococcus epidermidis
KPYYPFPVIVDDAFVHFDKY

SEQ ID NO: 1746030 - protein, 23 aa, Staphylococcus epidermidis
KQVFWRILLFYVLSIAVIAAIIP

SEQ ID NO: 1746031 - protein, 20 aa, Staphylococcus epidermidis
KRHTFPWIKTIIVAIIAGII

SEQ ID NO: 1746032 - protein, 20 aa, Staphylococcus epidermidis
KRLPQVINEAVSIFKNLTNG

SEQ ID NO: 1746033 - protein, 19 aa, Staphylococcus epidermidis
KRYYILIVMMAIITFACTF

SEQ ID NO: 1746034 - protein, 19 aa, Staphylococcus epidermidis
KSAFLSGLMLEFISMLGIG

SEQ ID NO: 1746035 - protein, 17 aa, Staphylococcus epidermidis
KSIENIGSLSFKFMVPI

SEQ ID NO: 1746036 - protein, 24 aa, Staphylococcus epidermidis
KSSKTKKWLIAIIVILLIIVAIFI

SEQ ID NO: 1746037 - protein, 22 aa, Staphylococcus epidermidis
KTGDGKWGFSFLDKDGDLAGSY

SEQ ID NO: 1746038 - protein, 19 aa, Staphylococcus epidermidis
KTKLRSVIPGAIFTSIIWL

SEQ ID NO: 1746039 - protein, 21 aa, Staphylococcus epidermidis
KVHLMKECLERGIELISSMGA

SEQ ID NO: 1746040 - protein, 24 aa, Staphylococcus epidermidis
KVLVIPGFILLISMTFLYSFLTTG

SEQ ID NO: 1746041 - protein, 23 aa, Staphylococcus epidermidis
KYGPRPLIFTGFILLISCTFLLC

SEQ ID NO: 1746042 - protein, 23 aa, Staphylococcus epidermidis
LAPFTILFSLPFTVIGVVLALII

SEQ ID NO: 1746043 - protein, 20 aa, Staphylococcus epidermidis
LDCITIIIALSIMFFLDVKL

SEQ ID NO: 1746044 - protein, 18 aa, Staphylococcus epidermidis
LDPALLRPGRFDRQIQVG

SEQ ID NO: 1746045 - protein, 24 aa, Staphylococcus epidermidis
LFIFRCFVVLLVFVGAVAKTETVW

SEQ ID NO: 1746046 - protein, 18 aa, Staphylococcus epidermidis
LFIICMFVSISMGTSVGT

SEQ ID NO: 1746047 - protein, 17 aa, Staphylococcus epidermidis
LFISLTLLIMFISMYDI

SEQ ID NO: 1746048 - protein, 21 aa, Staphylococcus epidermidis
LFLKRRGRELSLLQIIGLTKK

SEQ ID NO: 1746049 - protein, 17 aa, Staphylococcus epidermidis
LFLRNIRTTAISIVSIP

SEQ ID NO: 1746050 - protein, 20 aa, Staphylococcus epidermidis
LGAFIFRFIALFLISIIANF

SEQ ID NO: 1746051 - protein, 19 aa, Staphylococcus epidermidis
LGFLYKYIIAYLIQTYAVN

SEQ ID NO: 1746052 - protein, 17 aa, Staphylococcus epidermidis
LGVCGLVAIILRVPRLN

SEQ ID NO: 1746053 - protein, 17 aa, Staphylococcus epidermidis
LGVEWTRHLELKKQTLS

SEQ ID NO: 1746054 - protein, 20 aa, Staphylococcus epidermidis
LILIGFINFFLIKRKRKNKD

SEQ ID NO: 1746055 - protein, 20 aa, Staphylococcus epidermidis
LILQRFTKGFLKSIAILIGL

SEQ ID NO: 1746056 - protein, 18 aa, Staphylococcus epidermidis
LKHLWSLAIEEQFYLFFP

SEQ ID NO: 1746057 - protein, 20 aa, Staphylococcus epidermidis
LKLIMTLGFILGGIIGFFQG

SEQ ID NO: 1746058 - protein, 30 aa, Staphylococcus epidermidis
LKLSCSALLLSGSLVGYGFTKDAFADSEST

SEQ ID NO: 1746059 - protein, 19 aa, Staphylococcus epidermidis
LKSFKWRIIGFLAFLIIAI

SEQ ID NO: 1746060 - protein, 18 aa, Staphylococcus epidermidis
LLACGFVGAVAWTIYQMT

SEQ ID NO: 1746061 - protein, 23 aa, Staphylococcus epidermidis
LLFSRPRFKAIFDYIVGFVLIGL

SEQ ID NO: 1746062 - protein, 17 aa, Staphylococcus epidermidis
LLLPRLGAALTVVITVT

SEQ ID NO: 1746063 - protein, 23 aa, Staphylococcus epidermidis
LNHARPRALEYIKSLEKINNAQK

SEQ ID NO: 1746064 - protein, 23 aa, Staphylococcus epidermidis
LNKWCFWFFMIGFNVCFLPQFIL

SEQ ID NO: 1746065 - protein, 21 aa, Staphylococcus epidermidis
LNLFHGWPWYAIWLVLLGFGG

SEQ ID NO: 1746066 - protein, 17 aa, Staphylococcus epidermidis
LPIGAAFAIAAILCPTD

SEQ ID NO: 1746067 - protein, 19 aa, Staphylococcus epidermidis
LSIPNWLRRLITRSLAVIP

SEQ ID NO: 1746068 - protein, 18 aa, Staphylococcus epidermidis
LSLPFAMVGLFTSMFFII

SEQ ID NO: 1746069 - protein, 17 aa, Staphylococcus epidermidis
LVHKYYRGDHVEITLPV

SEQ ID NO: 1746070 - protein, 25 aa, Staphylococcus epidermidis
MATNLGWRSIFIVSIILTILSMFLI

SEQ ID NO: 1746071 - protein, 19 aa, Staphylococcus epidermidis
MAYNFSMWRLFGISIIAII

SEQ ID NO: 1746072 - protein, 20 aa, Staphylococcus epidermidis
MCIPLAWFLGLQDFFIKPLM

SEQ ID NO: 1746073 - protein, 19 aa, Staphylococcus epidermidis
MDFFWELATLILIMLLGHW

SEQ ID NO: 1746074 - protein, 20 aa, Staphylococcus epidermidis
MEGKNFKGAITIDMSESDSI

SEQ ID NO: 1746075 - protein, 21 aa, Staphylococcus epidermidis
MIVPWRCAMLYKYKKLQKNLI

SEQ ID NO: 1746076 - protein, 23 aa, Staphylococcus epidermidis
MLGFYRLPGLVAIIALTTYIYLT

SEQ ID NO: 1746077 - protein, 27 aa, Staphylococcus epidermidis
MLNMRYSHWLRFVWPVVAFVLIFGGGL

SEQ ID NO: 1746078 - protein, 17 aa, Staphylococcus epidermidis
MSTEMFGVFKALTTALI

SEQ ID NO: 1746079 - protein, 23 aa, Staphylococcus epidermidis
NGVLTFRSSDYLKDLPLSGELKA

SEQ ID NO: 1746080 - protein, 24 aa, Staphylococcus epidermidis
NIVGAKWVFFWSFIVLLLPIFLLG

SEQ ID NO: 1746081 - protein, 17 aa, Staphylococcus epidermidis
NLKLRYPFIGAVAGSGI

SEQ ID NO: 1746082 - protein, 22 aa, Staphylococcus epidermidis
NLPRFFIYLLLFMFSMIGIVIA

SEQ ID NO: 1746083 - protein, 25 aa, Staphylococcus epidermidis
NNMNFLRWVNIRDDYTISWTSSKIQ

SEQ ID NO: 1746084 - protein, 22 aa, Staphylococcus epidermidis
NNNRLGGTASWKDNRQPDKNIA

SEQ ID NO: 1746085 - protein, 26 aa, Staphylococcus epidermidis
NRFYQHGALDYKRLFGAIGKNLTGGF

SEQ ID NO: 1746086 - protein, 17 aa, Staphylococcus epidermidis
NRNFRFFQIFTAALQSF

SEQ ID NO: 1746087 - protein, 21 aa, Staphylococcus epidermidis
NTDGGLEWSPDHKSLIYKYDA

SEQ ID NO: 1746088 - protein, 21 aa, Staphylococcus epidermidis
PEFAIGMGPKIFSFRKDETLY

SEQ ID NO: 1746089 - protein, 24 aa, Staphylococcus epidermidis
PFLYRFVKRIHLGWFVLPVPIVLF

SEQ ID NO: 1746090 - protein, 24 aa, Staphylococcus epidermidis
PIAACGLLAPWIAGAAMALSSVSV

SEQ ID NO: 1746091 - protein, 17 aa, Staphylococcus epidermidis
PLMLLKLAVVWTLVQFF

SEQ ID NO: 1746092 - protein, 18 aa, Staphylococcus epidermidis
PLSFAYVIFIVFWQVGFS

SEQ ID NO: 1746093 - protein, 17 aa, Staphylococcus epidermidis
PMSWRKPLSLGLLILIL

SEQ ID NO: 1746094 - protein, 18 aa, Staphylococcus epidermidis
PPWKRFLSHFSFYAIALQ

SEQ ID NO: 1746095 - protein, 21 aa, Staphylococcus epidermidis
PRKSASILDIFGGCFQGLLPY

SEQ ID NO: 1746096 - protein, 18 aa, Staphylococcus epidermidis
PRYIKRIILATAISTLQG

SEQ ID NO: 1746097 - protein, 20 aa, Staphylococcus epidermidis
PSMMIPRFVAILGIISAAIT

SEQ ID NO: 1746098 - protein, 24 aa, Staphylococcus epidermidis
QEAINRVSAELARVQAQINAEHTT

SEQ ID NO: 1746099 - protein, 30 aa, Staphylococcus epidermidis
QKRIEFYRLYLLMIHLLKFGGMYADSVQRS

SEQ ID NO: 1746100 - protein, 17 aa, Staphylococcus epidermidis
QSLDMFLNIILKESNRI

SEQ ID NO: 1746101 - protein, 26 aa, Staphylococcus epidermidis
QSNSLKRKDFVVSFIASAIVGSAVGL

SEQ ID NO: 1746102 - protein, 22 aa, Staphylococcus epidermidis
QVLDARLGYYSVVKETNVQLLQ

SEQ ID NO: 1746103 - protein, 21 aa, Staphylococcus epidermidis
RAGIMCPEFAIGMGPKIFSFR

SEQ ID NO: 1746104 - protein, 17 aa, Staphylococcus epidermidis
RIGACIIGAIFVISYLF

SEQ ID NO: 1746105 - protein, 23 aa, Staphylococcus epidermidis
RKFYWRYQIGLQMLLNIIIGAVV

SEQ ID NO: 1746106 - protein, 22 aa, Staphylococcus epidermidis
RLKLGETFFGYLIWYSVGRFFV

SEQ ID NO: 1746107 - protein, 19 aa, Staphylococcus epidermidis
RLLPVGGYVRMAGDGLEEP

SEQ ID NO: 1746108 - protein, 19 aa, Staphylococcus epidermidis
RQSFNIPALKTWQQVKSQA

SEQ ID NO: 1746109 - protein, 18 aa, Staphylococcus epidermidis
RWYFAIGFFFIGVIAYMD

SEQ ID NO: 1746110 - protein, 18 aa, Staphylococcus epidermidis
RYINILFIISWIQLIGGL

SEQ ID NO: 1746111 - protein, 19 aa, Staphylococcus epidermidis
RYLGIPIFLGIMWLIFQTT

SEQ ID NO: 1746112 - protein, 24 aa, Staphylococcus epidermidis
SAPQKRWHFILAFNSSILIGLFVK

SEQ ID NO: 1746113 - protein, 17 aa, Staphylococcus epidermidis
SDLAKWVQLQIHPTSKS

SEQ ID NO: 1746114 - protein, 19 aa, Staphylococcus epidermidis
SFMLTGFAFMVTTSLFSHQ

SEQ ID NO: 1746115 - protein, 23 aa, Staphylococcus epidermidis
SKGLKLKVIFNFGLPLIIALLHA

SEQ ID NO: 1746116 - protein, 24 aa, Staphylococcus epidermidis
SKGLLLKIAFNFGLPLLIALLHAL

SEQ ID NO: 1746117 - protein, 23 aa, Staphylococcus epidermidis
STMMAAICGFLFLAADPVKDGGF

SEQ ID NO: 1746118 - protein, 17 aa, Staphylococcus epidermidis
SYWTWWLTYGVIALLLI

SEQ ID NO: 1746119 - protein, 25 aa, Staphylococcus epidermidis
TASKRLPWLIVLTFLGMITATILGS

SEQ ID NO: 1746120 - protein, 18 aa, Staphylococcus epidermidis
TEMFGVFKALTTALITPF

SEQ ID NO: 1746121 - protein, 17 aa, Staphylococcus epidermidis
TGAGCLLGGVLASFLFR

SEQ ID NO: 1746122 - protein, 25 aa, Staphylococcus epidermidis
TIKNIRQNLFWAFGYNVAGIPIAAC

SEQ ID NO: 1746123 - protein, 18 aa, Staphylococcus epidermidis
TLFLKFDRLIAVLGGVTP

SEQ ID NO: 1746124 - protein, 24 aa, Staphylococcus epidermidis
TVTIRKGDLIKEFSSNLNNMNFLR

SEQ ID NO: 1746125 - protein, 24 aa, Staphylococcus epidermidis
TYGYKRFEILAALFNGVTLFIISI

SEQ ID NO: 1746126 - protein, 19 aa, Staphylococcus epidermidis
VFLFFKGKKAFWFIFIGGF

SEQ ID NO: 1746127 - protein, 22 aa, Staphylococcus epidermidis
VFPEIVMALIFIKAVGPGSFSG

SEQ ID NO: 1746128 - protein, 18 aa, Staphylococcus epidermidis
VIVDDAFVHFDKYRKERM

SEQ ID NO: 1746129 - protein, 18 aa, Staphylococcus epidermidis
VIVGPNFYMGIGTPGGNK

SEQ ID NO: 1746130 - protein, 17 aa, Staphylococcus epidermidis
VLGDLFGSVGAIVASLL

SEQ ID NO: 1746131 - protein, 18 aa, Staphylococcus epidermidis
VMGTGFAFWSFVLAILLI

SEQ ID NO: 1746132 - protein, 17 aa, Staphylococcus epidermidis
VNKLWKVPREAARISAW

SEQ ID NO: 1746133 - protein, 25 aa, Staphylococcus epidermidis
VNQYWPEHMDFRWAQGSGTPSSRNA

SEQ ID NO: 1746134 - protein, 20 aa, Staphylococcus epidermidis
VRLKQEFDPMILFSLHINGV

SEQ ID NO: 1746135 - protein, 18 aa, Staphylococcus epidermidis
VSAGYKWFFAYPDQHIET

SEQ ID NO: 1746136 - protein, 19 aa, Staphylococcus epidermidis
VSASFKWYDFVYFIDTIIY

SEQ ID NO: 1746137 - protein, 19 aa, Staphylococcus epidermidis
VSWGEWFLYAAPWSIIMSI

SEQ ID NO: 1746138 - protein, 19 aa, Staphylococcus epidermidis
VVSYLNWQWVYFILTILYL

SEQ ID NO: 1746139 - protein, 25 aa, Staphylococcus epidermidis
VYGQENLYRIAIQYYGEGTQANVDK

SEQ ID NO: 1746140 - protein, 18 aa, Staphylococcus epidermidis
VYLFRFVWVYVLYPYFYL

SEQ ID NO: 1746141 - protein, 23 aa, Staphylococcus epidermidis
WAIPCYLCAFIAIIYGFTGIGIK

SEQ ID NO: 1746142 - protein, 18 aa, Staphylococcus epidermidis
WFNLWAMWDPYGHTGHIK

SEQ ID NO: 1746143 - protein, 17 aa, Staphylococcus epidermidis
WLRERPERWGIKLTINL

SEQ ID NO: 1746144 - protein, 20 aa, Staphylococcus epidermidis
YELVEILVLIPISFIITIAS

SEQ ID NO: 1746145 - protein, 18 aa, Staphylococcus epidermidis
YGFLRLEIIVAFLNGLAL

SEQ ID NO: 1746146 - protein, 22 aa, Staphylococcus epidermidis
YKRLRFQVFLGIFIGYAGYYLL

SEQ ID NO: 1746147 - protein, 19 aa, Staphylococcus epidermidis
YMSSWPWDWAKPMGSLMKD

SEQ ID NO: 1746148 - protein, 21 aa, Staphylococcus epidermidis
YPTERLRFIAIQYLIDNVQIY

SEQ ID NO: 1746149 - protein, 17 aa, Staphylococcus epidermidis
YQKSWFIILTLLFIFPL

SEQ ID NO: 1746150 - protein, 17 aa, Staphylococcus epidermidis
YQNLTFDSIVFRNALQY

SEQ ID NO: 1746151 - protein, 23 aa, Staphylococcus epidermidis
YTEMKWLTPDGHYIHGKGIRPDV

SEQ ID NO: 1746152 - protein, 18 aa, Staphylococcus epidermidis
AHSTLTWNEEPNSWKNNI

SEQ ID NO: 1746153 - protein, 19 aa, Staphylococcus epidermidis
AIFNYWWMFAISFIFFIIA

SEQ ID NO: 1746154 - protein, 17 aa, Staphylococcus epidermidis
AIIEKGKVNKLLKRNPT

SEQ ID NO: 1746155 - protein, 19 aa, Staphylococcus epidermidis
AILYFEIITTIAIGLGLII

SEQ ID NO: 1746156 - protein, 17 aa, Staphylococcus epidermidis
AKLIFVFFFILLIFFCH

SEQ ID NO: 1746157 - protein, 21 aa, Staphylococcus epidermidis
AKNKWLSVIGWLVILGVIITP

SEQ ID NO: 1746158 - protein, 25 aa, Staphylococcus epidermidis
AKPPRFLVRFWTLFVSFLIGLVLMS

SEQ ID NO: 1746159 - protein, 18 aa, Staphylococcus epidermidis
ALSIFSFFTANLIFGIIF

SEQ ID NO: 1746160 - protein, 19 aa, Staphylococcus epidermidis
APLCFSMAMAERTGGSGNA

SEQ ID NO: 1746161 - protein, 17 aa, Staphylococcus epidermidis
AQDVARFLPNKILNIRY

SEQ ID NO: 1746162 - protein, 17 aa, Staphylococcus epidermidis
AQLYFHFSHNITSQREP

SEQ ID NO: 1746163 - protein, 17 aa, Staphylococcus epidermidis
ARIPFWFLIKGLTPIFF

SEQ ID NO: 1746164 - protein, 37 aa, Staphylococcus epidermidis
DDSGFPPGTFFHASNRRWPYNLPRSRNILRASDVQGN

SEQ ID NO: 1746165 - protein, 23 aa, Staphylococcus epidermidis
DIVQVRWLFRISSFIIFSIIIQS

SEQ ID NO: 1746166 - protein, 18 aa, Staphylococcus epidermidis
DKSLPLAGVTLISGLAIM

SEQ ID NO: 1746167 - protein, 24 aa, Staphylococcus epidermidis
DLKRVAKTPGVWVILAGLAILPSF

SEQ ID NO: 1746168 - protein, 24 aa, Staphylococcus epidermidis
EDHLKFSLFLAMLLACLLIQAATN

SEQ ID NO: 1746169 - protein, 18 aa, Staphylococcus epidermidis
EIRSKPTPPRIITTANEL

SEQ ID NO: 1746170 - protein, 20 aa, Staphylococcus epidermidis
EKSKDLKLIKGLKDLNKAQL

SEQ ID NO: 1746171 - protein, 24 aa, Staphylococcus epidermidis
ETFSEFRIFLAVLITLLLIISISL

SEQ ID NO: 1746172 - protein, 18 aa, Staphylococcus epidermidis
FAGAFIVHKICKKVLSTY

SEQ ID NO: 1746173 - protein, 21 aa, Staphylococcus epidermidis
FASTIFPVFMVMIIGLISFYA

SEQ ID NO: 1746174 - protein, 21 aa, Staphylococcus epidermidis
FFWFFKLKYSFGHIINSKIFT

SEQ ID NO: 1746175 - protein, 17 aa, Staphylococcus epidermidis
FGRRMPYLLIAGPIGAI

SEQ ID NO: 1746176 - protein, 17 aa, Staphylococcus epidermidis
FHVWRVAIQTDKHDYVG

SEQ ID NO: 1746177 - protein, 18 aa, Staphylococcus epidermidis
FLQFNWFQPLLIGLAGLL

SEQ ID NO: 1746178 - protein, 30 aa, Staphylococcus epidermidis
FSIRKFNIGIFSALIATVAFLAHPGQATAS

SEQ ID NO: 1746179 - protein, 27 aa, Staphylococcus epidermidis
FTQPIYKIQVGDTFPKGTWAGYYKHLE

SEQ ID NO: 1746180 - protein, 22 aa, Staphylococcus epidermidis
GAPLPQFWRSAGAINSSVANDF

SEQ ID NO: 1746181 - protein, 24 aa, Staphylococcus epidermidis
GASTYRKNFCQRFLGEVNVTVIKG

SEQ ID NO: 1746182 - protein, 18 aa, Staphylococcus epidermidis
GIFCFLKGLIGFFIGGDS

SEQ ID NO: 1746183 - protein, 19 aa, Staphylococcus epidermidis
GIICLIYWIGSILILVLTC

SEQ ID NO: 1746184 - protein, 19 aa, Staphylococcus epidermidis
GIICVINYALVRHIAFDKY

SEQ ID NO: 1746185 - protein, 17 aa, Staphylococcus epidermidis
GSGDVSYRISFKTQGAP

SEQ ID NO: 1746186 - protein, 21 aa, Staphylococcus epidermidis
HGNFKVKFFVSLIFAIPIILL

SEQ ID NO: 1746187 - protein, 23 aa, Staphylococcus epidermidis
HPELKISAIIGIVFMTMLLFIFL

SEQ ID NO: 1746188 - protein, 18 aa, Staphylococcus epidermidis
IGLISFYAIYIWVEHRTI

SEQ ID NO: 1746189 - protein, 19 aa, Staphylococcus epidermidis
IIGGIGWVLAKVTRQPKFE

SEQ ID NO: 1746190 - protein, 19 aa, Staphylococcus epidermidis
IKLAEPILVIGNPLGTDFK

SEQ ID NO: 1746191 - protein, 18 aa, Staphylococcus epidermidis
IKLWLTIILIVATVLILL

SEQ ID NO: 1746192 - protein, 17 aa, Staphylococcus epidermidis
ILISMIILLSFISTHVL

SEQ ID NO: 1746193 - protein, 25 aa, Staphylococcus epidermidis
IMFGLKLPLLIAFAVVFAGLSFGYI

SEQ ID NO: 1746194 - protein, 17 aa, Staphylococcus epidermidis
IMFSVFIAFVFQDDSAI

SEQ ID NO: 1746195 - protein, 22 aa, Staphylococcus epidermidis
INHVKEQLSLVFNAIEKDRKDI

SEQ ID NO: 1746196 - protein, 18 aa, Staphylococcus epidermidis
IPGLLSFLADNSFNTKVK

SEQ ID NO: 1746197 - protein, 25 aa, Staphylococcus epidermidis
IQQLHDGYRYYSFIDTIGVNSGSHL

SEQ ID NO: 1746198 - protein, 19 aa, Staphylococcus epidermidis
IRYKLRPVNISTPREVTFN

SEQ ID NO: 1746199 - protein, 20 aa, Staphylococcus epidermidis
ISIFSIVVSIVFIRLKNIRK

SEQ ID NO: 1746200 - protein, 17 aa, Staphylococcus epidermidis
ITKFIYRKISTAQSPIV

SEQ ID NO: 1746201 - protein, 26 aa, Staphylococcus epidermidis
ITTKRLKDGYQWDILFNSNHKGHEYM

SEQ ID NO: 1746202 - protein, 17 aa, Staphylococcus epidermidis
IVLGCTFTAVAPMILIG

SEQ ID NO: 1746203 - protein, 18 aa, Staphylococcus epidermidis
IVVSIVFIRLKNIRKRKM

SEQ ID NO: 1746204 - protein, 23 aa, Staphylococcus epidermidis
KASRRFSGLLARVESQDMASSII

SEQ ID NO: 1746205 - protein, 24 aa, Staphylococcus epidermidis
KASWYLPKWLGAVLPNVDVEGKAL

SEQ ID NO: 1746206 - protein, 24 aa, Staphylococcus epidermidis
KAVQPELDKAIAMLKNKENNNALV

SEQ ID NO: 1746207 - protein, 21 aa, Staphylococcus epidermidis
KEAFQLLMWMGFIILISLIVW

SEQ ID NO: 1746208 - protein, 20 aa, Staphylococcus epidermidis
KIKLWHFILVILGIILLTSI

SEQ ID NO: 1746209 - protein, 19 aa, Staphylococcus epidermidis
KMNALRLAKSYVKNINISN

SEQ ID NO: 1746210 - protein, 24 aa, Staphylococcus epidermidis
KMRVVRRRIALFGGILLAIILILL

SEQ ID NO: 1746211 - protein, 20 aa, Staphylococcus epidermidis
KNRLTLVVIVIFIIFLILLF

SEQ ID NO: 1746212 - protein, 19 aa, Staphylococcus epidermidis
KNTKLGMRYTYKNTIDDKT

SEQ ID NO: 1746213 - protein, 20 aa, Staphylococcus epidermidis
KRNYLCFVFIFLIGSILGLL

SEQ ID NO: 1746214 - protein, 19 aa, Staphylococcus epidermidis
KTILPRVDTKAVARSVLNA

SEQ ID NO: 1746215 - protein, 21 aa, Staphylococcus epidermidis
LAGLAILPSFYAWFNLWAMWD

SEQ ID NO: 1746216 - protein, 19 aa, Staphylococcus epidermidis
LATLILIMLLGHWIEMNAV

SEQ ID NO: 1746217 - protein, 18 aa, Staphylococcus epidermidis
LAVMGFASAISVLFAVLA

SEQ ID NO: 1746218 - protein, 17 aa, Staphylococcus epidermidis
LDRILGMISGILYFGIY

SEQ ID NO: 1746219 - protein, 26 aa, Staphylococcus epidermidis
LENGEGLPIDGWKFYWNQQSTGTTSD

SEQ ID NO: 1746220 - protein, 17 aa, Staphylococcus epidermidis
LEVSPVFAVIVGLVLHD

SEQ ID NO: 1746221 - protein, 19 aa, Staphylococcus epidermidis
LFGELEFWLSIIKVLTILA

SEQ ID NO: 1746222 - protein, 23 aa, Staphylococcus epidermidis
LFKRLSWPYGLIIAAVIITSLGS

SEQ ID NO: 1746223 - protein, 24 aa, Staphylococcus epidermidis
LIGFGAAFLFNWLIGQDKIPQSLM

SEQ ID NO: 1746224 - protein, 17 aa, Staphylococcus epidermidis
LIIIFFLKDTLRSSEID

SEQ ID NO: 1746225 - protein, 19 aa, Staphylococcus epidermidis
LISLYLKLMVIFGLAVTIF

SEQ ID NO: 1746226 - protein, 18 aa, Staphylococcus epidermidis
LMRYGGGVSYQLIEDESP

SEQ ID NO: 1746227 - protein, 17 aa, Staphylococcus epidermidis
LPLALPLILSGIRLSSV

SEQ ID NO: 1746228 - protein, 17 aa, Staphylococcus epidermidis
LQSFKVIFAIIITLVTV

SEQ ID NO: 1746229 - protein, 23 aa, Staphylococcus epidermidis
LSGELKAIVYYNQYVQSNFSNSV

SEQ ID NO: 1746230 - protein, 17 aa, Staphylococcus epidermidis
LSSYYLFNWFFFVYHLG

SEQ ID NO: 1746231 - protein, 18 aa, Staphylococcus epidermidis
LTLMIPLLIVVTFMTFMM

SEQ ID NO: 1746232 - protein, 17 aa, Staphylococcus epidermidis
LYSRPLFYFGNFMKPLI

SEQ ID NO: 1746233 - protein, 17 aa, Staphylococcus epidermidis
MHIVMLLAALSMAGVPF

SEQ ID NO: 1746234 - protein, 18 aa, Staphylococcus epidermidis
MITVALVWWSAFTILTGM

SEQ ID NO: 1746235 - protein, 21 aa, Staphylococcus epidermidis
MRRYLMRFVHHIGGLADFSAL

SEQ ID NO: 1746236 - protein, 22 aa, Staphylococcus epidermidis
MTPWKYRYVAGIIVLALVVVSY

SEQ ID NO: 1746237 - protein, 20 aa, Staphylococcus epidermidis
MVLTAIALVVVWFIFNQLVA

SEQ ID NO: 1746238 - protein, 26 aa, Staphylococcus epidermidis
NAARSGRPIQFLVGFDVEDSHHNPET

SEQ ID NO: 1746239 - protein, 17 aa, Staphylococcus epidermidis
NGFSWPIVLVLLILFYF

SEQ ID NO: 1746240 - protein, 18 aa, Staphylococcus epidermidis
NKLTEFFTGYATAMNSAF

SEQ ID NO: 1746241 - protein, 18 aa, Staphylococcus epidermidis
NKNRVAIKQGNALPTNLA

SEQ ID NO: 1746242 - protein, 18 aa, Staphylococcus epidermidis
NLGRSAQDVARFLPNKIL

SEQ ID NO: 1746243 - protein, 24 aa, Staphylococcus epidermidis
NNKPLRMMIYLGMFTFSISILYII

SEQ ID NO: 1746244 - protein, 23 aa, Staphylococcus epidermidis
NVRMPRMLAGLIIGGALAIAGLL

SEQ ID NO: 1746245 - protein, 20 aa, Staphylococcus epidermidis
PETLLPVNLYVKPELKHTIE

SEQ ID NO: 1746246 - protein, 18 aa, Staphylococcus epidermidis
PFNEAWEVAQQMAKKIVT

SEQ ID NO: 1746247 - protein, 18 aa, Staphylococcus epidermidis
PFTKRYYILIVMMAIITF

SEQ ID NO: 1746248 - protein, 19 aa, Staphylococcus epidermidis
PIDFKKLMIIGSLISVATA

SEQ ID NO: 1746249 - protein, 23 aa, Staphylococcus epidermidis
PLQWIASIYIEFLRGTPMLVQVF

SEQ ID NO: 1746250 - protein, 20 aa, Staphylococcus epidermidis
PSKYKLEVGIGRDISGDPIS

SEQ ID NO: 1746251 - protein, 22 aa, Staphylococcus epidermidis
QGIPAWVWSCIFLIIIFALNSL

SEQ ID NO: 1746252 - protein, 23 aa, Staphylococcus epidermidis
QNMLKWGALVAIGFIIVATFMFM

SEQ ID NO: 1746253 - protein, 18 aa, Staphylococcus epidermidis
QPVKIPGYQHYRTSVSDG

SEQ ID NO: 1746254 - protein, 23 aa, Staphylococcus epidermidis
QRKLWLRNFMQAFFVVFFVYMAM

SEQ ID NO: 1746255 - protein, 19 aa, Staphylococcus epidermidis
QRMVVTWVITLPISAVLAA

SEQ ID NO: 1746256 - protein, 24 aa, Staphylococcus epidermidis
QSIKDMISHAALRTEVKQLLQQAK

SEQ ID NO: 1746257 - protein, 17 aa, Staphylococcus epidermidis
RAITRFKIPEGYSIKDV

SEQ ID NO: 1746258 - protein, 18 aa, Staphylococcus epidermidis
RISDALVRMQREHVHISL

SEQ ID NO: 1746259 - protein, 20 aa, Staphylococcus epidermidis
RITPIFAISEGWVWTITLVG

SEQ ID NO: 1746260 - protein, 20 aa, Staphylococcus epidermidis
RLIILIELFIQFIISAILSI

SEQ ID NO: 1746261 - protein, 25 aa, Staphylococcus epidermidis
RPEVKVVDSLNGFTMVNGGKVGLLN

SEQ ID NO: 1746262 - protein, 20 aa, Staphylococcus epidermidis
RTWTRFGRRMPYLLIAGPIG

SEQ ID NO: 1746263 - protein, 19 aa, Staphylococcus epidermidis
RYPNRFNIHYRIDDQCQDA

SEQ ID NO: 1746264 - protein, 42 aa, Staphylococcus epidermidis
SEGKKKGGFMKILLPLIAAILILGAIAIFGGMALNNHNDSKS

SEQ ID NO: 1746265 - protein, 25 aa, Staphylococcus epidermidis
SGLFSRRFWPSLKFLLPILVGMLIA

SEQ ID NO: 1746266 - protein, 20 aa, Staphylococcus epidermidis
SGLMLEFISMLGIGLVALEA

SEQ ID NO: 1746267 - protein, 22 aa, Staphylococcus epidermidis
SGQLGATVKPGSAPNQDTEATP

SEQ ID NO: 1746268 - protein, 22 aa, Staphylococcus epidermidis
SGQLGATVKPGSAPNQDTEVKP

SEQ ID NO: 1746269 - protein, 18 aa, Staphylococcus epidermidis
SIHVLSFIFVLMILLNPQ

SEQ ID NO: 1746270 - protein, 23 aa, Staphylococcus epidermidis
SKIVYRFTTLFTMVAAFVDGVKA

SEQ ID NO: 1746271 - protein, 25 aa, Staphylococcus epidermidis
SNHKGHEYMYYWFGLPSDQTPTGPV

SEQ ID NO: 1746272 - protein, 18 aa, Staphylococcus epidermidis
SRNAGSFTKTVTVVYQNG

SEQ ID NO: 1746273 - protein, 19 aa, Staphylococcus epidermidis
SRPLFYFGNFMKPLIWLMN

SEQ ID NO: 1746274 - protein, 26 aa, Staphylococcus epidermidis
STDIQGGGVYRLFKLPDNVHRLKVQF

SEQ ID NO: 1746275 - protein, 19 aa, Staphylococcus epidermidis
SYLCPMLNWFIPIKFTELT

SEQ ID NO: 1746276 - protein, 21 aa, Staphylococcus epidermidis
TFSIMFPLTFKFGSENSNVIV

SEQ ID NO: 1746277 - protein, 21 aa, Staphylococcus epidermidis
TIGPNLRKYFSLSNGSDLPNR

SEQ ID NO: 1746278 - protein, 21 aa, Staphylococcus epidermidis
TILLFCLIIIFFLKDTLRSSE

SEQ ID NO: 1746279 - protein, 22 aa, Staphylococcus epidermidis
TKLKRIPTLITESKKHSNNPHS

SEQ ID NO: 1746280 - protein, 24 aa, Staphylococcus epidermidis
TNIRLRKIVPIGISVFILILIIVL

SEQ ID NO: 1746281 - protein, 17 aa, Staphylococcus epidermidis
TRNAFFIGRTIDYNVSL

SEQ ID NO: 1746282 - protein, 26 aa, Staphylococcus epidermidis
TVGRAYRSALNWSLNHKWIVLIVSIF

SEQ ID NO: 1746283 - protein, 19 aa, Staphylococcus epidermidis
VDAFKNLKIPLSISGQAAQ

SEQ ID NO: 1746284 - protein, 17 aa, Staphylococcus epidermidis
VELPIAMPVIMAGIRTA

SEQ ID NO: 1746285 - protein, 18 aa, Staphylococcus epidermidis
VFIAFVFQDDSAIKSMGI

SEQ ID NO: 1746286 - protein, 18 aa, Staphylococcus epidermidis
VFLALGITFLALWILTNI

SEQ ID NO: 1746287 - protein, 19 aa, Staphylococcus epidermidis
VFMVMIIGLISFYAIYIWV

SEQ ID NO: 1746288 - protein, 18 aa, Staphylococcus epidermidis
VIDKRLKYIILHEYAHAK

SEQ ID NO: 1746289 - protein, 21 aa, Staphylococcus epidermidis
VIVFFCVFLIFSPIGKLKLGK

SEQ ID NO: 1746290 - protein, 18 aa, Staphylococcus epidermidis
VKRKVVVQLTRFEKILYI

SEQ ID NO: 1746291 - protein, 18 aa, Staphylococcus epidermidis
VNLPQGWTKTFTINPNNN

SEQ ID NO: 1746292 - protein, 24 aa, Staphylococcus epidermidis
VSFPKRVFTALAIGIVFGIVLHLI

SEQ ID NO: 1746293 - protein, 18 aa, Staphylococcus epidermidis
VVDGQFKSVDAFKNLKIP

SEQ ID NO: 1746294 - protein, 18 aa, Staphylococcus epidermidis
VVMDLLFEKLDCHLAMPQ

SEQ ID NO: 1746295 - protein, 20 aa, Staphylococcus epidermidis
WVGWRFTFLFIIIVSVFVGV

SEQ ID NO: 1746296 - protein, 21 aa, Staphylococcus epidermidis
YGPWRIVFVILTMFGIVMLIG

SEQ ID NO: 1746297 - protein, 17 aa, Staphylococcus epidermidis
YKNGLKNYVFKQKDEYY

SEQ ID NO: 1746298 - protein, 22 aa, Staphylococcus epidermidis
YTKRIAVPIGIHMLMNGSVVLT

SEQ ID NO: 1746299 - protein, 20 aa, Staphylococcus epidermidis
ALKAARLNLENKINQTVQTD

SEQ ID NO: 1746300 - protein, 22 aa, Staphylococcus epidermidis
ANDGYRIQPHIGLSIYESTNKD

SEQ ID NO: 1746301 - protein, 17 aa, Staphylococcus epidermidis
ATSHLLGYVGPINSEEL

SEQ ID NO: 1746302 - protein, 17 aa, Staphylococcus epidermidis
AYPGNFVQAVNQYWPEH

SEQ ID NO: 1746303 - protein, 19 aa, Staphylococcus epidermidis
CSLLMIRVGERFMQKRGPQ

SEQ ID NO: 1746304 - protein, 21 aa, Staphylococcus epidermidis
DPPIWVCLELMTFGQFSAFVE

SEQ ID NO: 1746305 - protein, 24 aa, Staphylococcus epidermidis
DTSQCPNCGQLLTKKKKRKIKDQS

SEQ ID NO: 1746306 - protein, 18 aa, Staphylococcus epidermidis
FHTIMFSSYIWKNVGWDS

SEQ ID NO: 1746307 - protein, 22 aa, Staphylococcus epidermidis
FRDIWTSSISFIFFVGVIIGIS

SEQ ID NO: 1746308 - protein, 17 aa, Staphylococcus epidermidis
FYFILSFVLMVTVPNTI

SEQ ID NO: 1746309 - protein, 20 aa, Staphylococcus epidermidis
GGFANWRVVFGFMIVLAIIT

SEQ ID NO: 1746310 - protein, 19 aa, Staphylococcus epidermidis
GIACGFIFYPITMIITKKY

SEQ ID NO: 1746311 - protein, 17 aa, Staphylococcus epidermidis
GKILAAMLFGMFIAILN

SEQ ID NO: 1746312 - protein, 21 aa, Staphylococcus epidermidis
GLAIFCFVLYIAFGKYGNVTL

SEQ ID NO: 1746313 - protein, 23 aa, Staphylococcus epidermidis
GTSYFRFQYFNPLNSSKYYENLD

SEQ ID NO: 1746314 - protein, 17 aa, Staphylococcus epidermidis
HSGCGCILGCLTISLIS

SEQ ID NO: 1746315 - protein, 17 aa, Staphylococcus epidermidis
IFRPIMRPLFTLPGRST

SEQ ID NO: 1746316 - protein, 19 aa, Staphylococcus epidermidis
IGTFSTVIATLVFMGINTN

SEQ ID NO: 1746317 - protein, 17 aa, Staphylococcus epidermidis
IPMLIPLLIKYAIDGVI

SEQ ID NO: 1746318 - protein, 17 aa, Staphylococcus epidermidis
IPVLFLFPFVQKHFVKG

SEQ ID NO: 1746319 - protein, 17 aa, Staphylococcus epidermidis
IRATWMLYLIGIYPLLI

SEQ ID NO: 1746320 - protein, 17 aa, Staphylococcus epidermidis
IRTLLNIAGREGAFNEI

SEQ ID NO: 1746321 - protein, 24 aa, Staphylococcus epidermidis
IVSFCFIFLLLLFFRYILKRYFNY

SEQ ID NO: 1746322 - protein, 25 aa, Staphylococcus epidermidis
IYVSLRFEWRMGLSSVLALLHDVFI

SEQ ID NO: 1746323 - protein, 30 aa, Staphylococcus epidermidis
KFTVGTASIIVGSFLFFGQTQAHAEQAEEF

SEQ ID NO: 1746324 - protein, 17 aa, Staphylococcus epidermidis
KHTGWLIVLSIIFVLLI

SEQ ID NO: 1746325 - protein, 19 aa, Staphylococcus epidermidis
KKTWFKFFIGVLLISLLAS

SEQ ID NO: 1746326 - protein, 27 aa, Staphylococcus epidermidis
KLPDNVHRLKVQFLPMNEIHSDFKRIQ

SEQ ID NO: 1746327 - protein, 20 aa, Staphylococcus epidermidis
KLREGHIFIRKCLRTSIMFS

SEQ ID NO: 1746328 - protein, 28 aa, Staphylococcus epidermidis
KNQYPVVFVHGFLGFAGDNQFSLAPKYW

SEQ ID NO: 1746329 - protein, 20 aa, Staphylococcus epidermidis
KQGTGLGLFICKMIIEEHGG

SEQ ID NO: 1746330 - protein, 18 aa, Staphylococcus epidermidis
KQLVVAFFKEHWPKMLII

SEQ ID NO: 1746331 - protein, 20 aa, Staphylococcus epidermidis
KRLPEMLGVFQGLTFVVTIS

SEQ ID NO: 1746332 - protein, 23 aa, Staphylococcus epidermidis
KRSKMKIAILSIIFVILLIGLFS

SEQ ID NO: 1746333 - protein, 20 aa, Staphylococcus epidermidis
KTRIIKALSEMSPKVRNLIA

SEQ ID NO: 1746334 - protein, 20 aa, Staphylococcus epidermidis
KVFGCLGIALAMYATTPKEN

SEQ ID NO: 1746335 - protein, 25 aa, Staphylococcus epidermidis
KVLKLKIRWPFWLSQIGLILLGVQI

SEQ ID NO: 1746336 - protein, 18 aa, Staphylococcus epidermidis
LCLIFRISTVPSMLISSI

SEQ ID NO: 1746337 - protein, 23 aa, Staphylococcus epidermidis
LEILPRFNKIIVMNDGEIIENDS

SEQ ID NO: 1746338 - protein, 17 aa, Staphylococcus epidermidis
LFTGRLVDKFSVSSINW

SEQ ID NO: 1746339 - protein, 26 aa, Staphylococcus epidermidis
LGLFLMWKFSKWPSIARTIITVAISV

SEQ ID NO: 1746340 - protein, 29 aa, Staphylococcus epidermidis
LGLFLMWRYAHWKNWLKLTVSSVYIISLV

SEQ ID NO: 1746341 - protein, 20 aa, Staphylococcus epidermidis
LHTNRFYFILSFVLMVTVPN

SEQ ID NO: 1746342 - protein, 25 aa, Staphylococcus epidermidis
LTGLLSSFWLVLAKRRKKEEEEKQS

SEQ ID NO: 1746343 - protein, 17 aa, Staphylococcus epidermidis
LTIPVLFLFPFVQKHFV

SEQ ID NO: 1746344 - protein, 18 aa, Staphylococcus epidermidis
LTVKETFLTWSLLETIIS

SEQ ID NO: 1746345 - protein, 21 aa, Staphylococcus epidermidis
LVFPFIIACGFIVYSTSLPLV

SEQ ID NO: 1746346 - protein, 17 aa, Staphylococcus epidermidis
LVSCLLILFLGSAIFSL

SEQ ID NO: 1746347 - protein, 19 aa, Staphylococcus epidermidis
LWFLFCVFIFQYIKLLFSR

SEQ ID NO: 1746348 - protein, 25 aa, Staphylococcus epidermidis
NDFFSLRTGGPVDARIVWVNNQGPD

SEQ ID NO: 1746349 - protein, 22 aa, Staphylococcus epidermidis
NFWLYWKTMFAFEPWHSAMEMR

SEQ ID NO: 1746350 - protein, 18 aa, Staphylococcus epidermidis
NLFLPWYYLIKFIMPIVI

SEQ ID NO: 1746351 - protein, 17 aa, Staphylococcus epidermidis
NMNLPFINKFILKMERD

SEQ ID NO: 1746352 - protein, 17 aa, Staphylococcus epidermidis
NQTRISSFYGVIIYIII

SEQ ID NO: 1746353 - protein, 20 aa, Staphylococcus epidermidis
PALICLAGIFITMIWRSFQI

SEQ ID NO: 1746354 - protein, 18 aa, Staphylococcus epidermidis
PGKKIHFIGHSMGGQTIR

SEQ ID NO: 1746355 - protein, 17 aa, Staphylococcus epidermidis
PIIHICVIVLKPITILL

SEQ ID NO: 1746356 - protein, 18 aa, Staphylococcus epidermidis
PLYFRFTIYWPFFSDTFI

SEQ ID NO: 1746357 - protein, 21 aa, Staphylococcus epidermidis
PVQFIIGWQFYVGAYKNLRNG

SEQ ID NO: 1746358 - protein, 19 aa, Staphylococcus epidermidis
PYYIFRFRIPFTPGLIPKR

SEQ ID NO: 1746359 - protein, 17 aa, Staphylococcus epidermidis
QKSEVFIIKELDILNNA

SEQ ID NO: 1746360 - protein, 19 aa, Staphylococcus epidermidis
RDLICAIMVGVLSGIVTLA

SEQ ID NO: 1746361 - protein, 25 aa, Staphylococcus epidermidis
RKKGWLFGCGGCLVLLILIIVGVTA

SEQ ID NO: 1746362 - protein, 26 aa, Staphylococcus epidermidis
RPFFSFSWNEFAWWLVAHLFFIILMA

SEQ ID NO: 1746363 - protein, 17 aa, Staphylococcus epidermidis
RSGIMPTVFSKLHSKHK

SEQ ID NO: 1746364 - protein, 23 aa, Staphylococcus epidermidis
SDLKGRIAIAIAFQNIMLIVTTF

SEQ ID NO: 1746365 - protein, 20 aa, Staphylococcus epidermidis
SFILAFPMAIIWPTIQNGLN

SEQ ID NO: 1746366 - protein, 24 aa, Staphylococcus epidermidis
SFWFRDCIYMRSLFYMSRKKLLKS

SEQ ID NO: 1746367 - protein, 19 aa, Staphylococcus epidermidis
SKEEIRTLLNIAGREGAFN

SEQ ID NO: 1746368 - protein, 17 aa, Staphylococcus epidermidis
SKLKALINRTHKQIDEA

SEQ ID NO: 1746369 - protein, 17 aa, Staphylococcus epidermidis
SSLKPFLAYGPAIENMK

SEQ ID NO: 1746370 - protein, 22 aa, Staphylococcus epidermidis
TGRELGQFYLGIMDNIMRIEEA

SEQ ID NO: 1746371 - protein, 17 aa, Staphylococcus epidermidis
TRIRPILMTAIATIGAL

SEQ ID NO: 1746372 - protein, 20 aa, Staphylococcus epidermidis
TRISSFYGVIIYIIILFLFI

SEQ ID NO: 1746373 - protein, 17 aa, Staphylococcus epidermidis
TVIATLVFMGINTNHAS

SEQ ID NO: 1746374 - protein, 18 aa, Staphylococcus epidermidis
VDIDLGFSQWGLKQQPNE

SEQ ID NO: 1746375 - protein, 18 aa, Staphylococcus epidermidis
VHPIMYFLMALFILYFIF

SEQ ID NO: 1746376 - protein, 17 aa, Staphylococcus epidermidis
VQFFNWFALMYLWTYST

SEQ ID NO: 1746377 - protein, 23 aa, Staphylococcus epidermidis
VSIVLRLCLYYILIFGIINYFVR

SEQ ID NO: 1746378 - protein, 29 aa, Staphylococcus epidermidis
VVAFFKEHWPKMLIIIGIIVLLLILNAIF

SEQ ID NO: 1746379 - protein, 25 aa, Staphylococcus epidermidis
VYFIVCLLISFLALISMNIRILSGL

SEQ ID NO: 1746380 - protein, 17 aa, Staphylococcus epidermidis
WGFPRWASITTIFIGLI

SEQ ID NO: 1746381 - protein, 18 aa, Staphylococcus epidermidis
WIWPELPIGAAFAIAAIL

SEQ ID NO: 1746382 - protein, 18 aa, Staphylococcus epidermidis
WRVVFGFMIVLAIITMLG

SEQ ID NO: 1746383 - protein, 23 aa, Staphylococcus epidermidis
YKQEWFIVLSLLFIFPLGLFLMW

SEQ ID NO: 1746384 - protein, 24 aa, Staphylococcus epidermidis
YQFDGLKNGLTYKITFETPEGYTP

SEQ ID NO: 1746385 - protein, 17 aa, Staphylococcus epidermidis
YVSWIIVVGISLILVAI

SEQ ID NO: 1746386 - protein, 20 aa, Staphylococcus epidermidis
AEFMSVSGLERMGFNDEYLA

SEQ ID NO: 1746387 - protein, 18 aa, Staphylococcus epidermidis
DEDLKLQYDYAINLANNV

SEQ ID NO: 1746388 - protein, 25 aa, Staphylococcus epidermidis
EFMPELKWHYAYFVCLTLMLIITII

SEQ ID NO: 1746389 - protein, 19 aa, Staphylococcus epidermidis
EFMSVSGLERMGFNDEYLA

SEQ ID NO: 1746390 - protein, 19 aa, Staphylococcus epidermidis
EGDKIGVPGFVRGLHDMHA

SEQ ID NO: 1746391 - protein, 18 aa, Staphylococcus epidermidis
EGHKLIGIRGMPRVGKTE

SEQ ID NO: 1746392 - protein, 22 aa, Staphylococcus epidermidis
EISKILPVIEIKSAARNEIHQK

SEQ ID NO: 1746393 - protein, 24 aa, Staphylococcus epidermidis
ERYRIPRLLGITIIYVAIIGIITL

SEQ ID NO: 1746394 - protein, 24 aa, Staphylococcus epidermidis
ERYRIPRLLGITIIYVAIVGIITL

SEQ ID NO: 1746395 - protein, 17 aa, Staphylococcus epidermidis
ETFKEVLKGTGVEPGKI

SEQ ID NO: 1746396 - protein, 26 aa, Staphylococcus epidermidis
FEFMPELKWHYAYFVCLTLMLIITII

SEQ ID NO: 1746397 - protein, 20 aa, Staphylococcus epidermidis
FIFLLLVFFRYILKRYFNYS

SEQ ID NO: 1746398 - protein, 19 aa, Staphylococcus epidermidis
FIIYKFGDDYIRVYNTEFE

SEQ ID NO: 1746399 - protein, 20 aa, Staphylococcus epidermidis
FIIYKFGDDYIRVYNTEFEM

SEQ ID NO: 1746400 - protein, 20 aa, Staphylococcus epidermidis
FKEVLKGTGVEPGKINKETQ

SEQ ID NO: 1746401 - protein, 19 aa, Staphylococcus epidermidis
FKFWSVIESGGWVIFTHME

SEQ ID NO: 1746402 - protein, 17 aa, Staphylococcus epidermidis
FRFTIYWPFFSDTFIWL

SEQ ID NO: 1746403 - protein, 17 aa, Staphylococcus epidermidis
FSCAMAFSAASQIYLGK

SEQ ID NO: 1746404 - protein, 19 aa, Staphylococcus epidermidis
FSFMPLKHLWSLAIEEQFY

SEQ ID NO: 1746405 - protein, 17 aa, Staphylococcus epidermidis
GCLVLLILIIVGVTACT

SEQ ID NO: 1746406 - protein, 20 aa, Staphylococcus epidermidis
GLAIFCFVLYIAFGKYGNVT

SEQ ID NO: 1746407 - protein, 21 aa, Staphylococcus epidermidis
GRRRLVMLIAIVFIIGALILA

SEQ ID NO: 1746408 - protein, 17 aa, Staphylococcus epidermidis
GSWKAPYSIVFVVDIFS

SEQ ID NO: 1746409 - protein, 23 aa, Staphylococcus epidermidis
GVKVCTNCGTPVRNDGPNYKHSE

SEQ ID NO: 1746410 - protein, 17 aa, Staphylococcus epidermidis
HIAEHKLGYVVVNKTQQ

SEQ ID NO: 1746411 - protein, 20 aa, Staphylococcus epidermidis
IDSPYIIKVISKYDPNKDDY

SEQ ID NO: 1746412 - protein, 20 aa, Staphylococcus epidermidis
IISGLCRLYIGGADAYTYLI

SEQ ID NO: 1746413 - protein, 24 aa, Staphylococcus epidermidis
IIYRTELLPSLYLYLYLKNNNDFK

SEQ ID NO: 1746414 - protein, 17 aa, Staphylococcus epidermidis
ILFSALMSFLFTNIYYH

SEQ ID NO: 1746415 - protein, 22 aa, Staphylococcus epidermidis
ILLLMCVRWWIKYLSFKKNEHL

SEQ ID NO: 1746416 - protein, 24 aa, Staphylococcus epidermidis
ISTPLEVPVKVWVYNFDFTQPIYK

SEQ ID NO: 1746417 - protein, 19 aa, Staphylococcus epidermidis
KHLMFSKTFLFYCLLIIIF

SEQ ID NO: 1746418 - protein, 18 aa, Staphylococcus epidermidis
KLYLVVSIFLPVVFYLLF

SEQ ID NO: 1746419 - protein, 24 aa, Staphylococcus epidermidis
KQSKLILIFICIFTFFIMIIQSQF

SEQ ID NO: 1746420 - protein, 23 aa, Staphylococcus epidermidis
KSKENKKRFTAMMLVCAMFAICW

SEQ ID NO: 1746421 - protein, 23 aa, Staphylococcus epidermidis
LFMKYRFWLPFIISSIIFSSQHL

SEQ ID NO: 1746422 - protein, 18 aa, Staphylococcus epidermidis
LGAGVEWGTTFVTLVTFV

SEQ ID NO: 1746423 - protein, 17 aa, Staphylococcus epidermidis
LHAEIFFDGETTPIRKD

SEQ ID NO: 1746424 - protein, 17 aa, Staphylococcus epidermidis
LIIYVFTQFFYKKYITT

SEQ ID NO: 1746425 - protein, 17 aa, Staphylococcus epidermidis
LILAIAFFFGLKAYQGH

SEQ ID NO: 1746426 - protein, 18 aa, Staphylococcus epidermidis
LILAIAFFFGLKAYQGHK

SEQ ID NO: 1746427 - protein, 22 aa, Staphylococcus epidermidis
LKGVRKKLWLSIALIGSLQYGG

SEQ ID NO: 1746428 - protein, 17 aa, Staphylococcus epidermidis
LKLALTVFAFIMMISVV

SEQ ID NO: 1746429 - protein, 18 aa, Staphylococcus epidermidis
LKLALTVFAFIMMISVVL

SEQ ID NO: 1746430 - protein, 22 aa, Staphylococcus epidermidis
LKLKMPLIRVFRVSYIINALNS

SEQ ID NO: 1746431 - protein, 20 aa, Staphylococcus epidermidis
LKLQYDYAINLANNVLDKEN

SEQ ID NO: 1746432 - protein, 19 aa, Staphylococcus epidermidis
LKVAVAKASLVRQNSNYIN

SEQ ID NO: 1746433 - protein, 22 aa, Staphylococcus epidermidis
LPFRRIISFFLVFTMLFSVGVV

SEQ ID NO: 1746434 - protein, 18 aa, Staphylococcus epidermidis
LPKIPYKVFVIFFILVSF

SEQ ID NO: 1746435 - protein, 17 aa, Staphylococcus epidermidis
LPMALSFFSGKRLVPIM

SEQ ID NO: 1746436 - protein, 24 aa, Staphylococcus epidermidis
LYVIRYKFKLSFSIITHWIYNIFI

SEQ ID NO: 1746437 - protein, 18 aa, Staphylococcus epidermidis
MSLSLCWDVGKLDDVFNQ

SEQ ID NO: 1746438 - protein, 23 aa, Staphylococcus epidermidis
NENRTANLQSMFTNIDTKNHTVE

SEQ ID NO: 1746439 - protein, 18 aa, Staphylococcus epidermidis
NNRYSIPYFFGTVGILYD

SEQ ID NO: 1746440 - protein, 17 aa, Staphylococcus epidermidis
NRLKRLGIRKGVKVVFS

SEQ ID NO: 1746441 - protein, 17 aa, Staphylococcus epidermidis
NRLSFKGQIFFVSIDSM

SEQ ID NO: 1746442 - protein, 21 aa, Staphylococcus epidermidis
NSGNYIVHFDKPSGMTQTTTD

SEQ ID NO: 1746443 - protein, 17 aa, Staphylococcus epidermidis
PRAKLIFVFFFILLIFF

SEQ ID NO: 1746444 - protein, 18 aa, Staphylococcus epidermidis
QPHYIFSFTSACISIMTP

SEQ ID NO: 1746445 - protein, 21 aa, Staphylococcus epidermidis
QRKFWYSFGLVFGGIGLISIF

SEQ ID NO: 1746446 - protein, 24 aa, Staphylococcus epidermidis
QSKLIPIFICIFTFLLMVIQSQFL

SEQ ID NO: 1746447 - protein, 18 aa, Staphylococcus epidermidis
RGIENINMFTFIQLLTPF

SEQ ID NO: 1746448 - protein, 19 aa, Staphylococcus epidermidis
RGIENINMFTFIQLLTPFV

SEQ ID NO: 1746449 - protein, 20 aa, Staphylococcus epidermidis
RRRLVMLIAIVFIIGALILA

SEQ ID NO: 1746450 - protein, 20 aa, Staphylococcus epidermidis
SDLTDSFAIPKIKDNSGEII

SEQ ID NO: 1746451 - protein, 18 aa, Staphylococcus epidermidis
SFYAWFNLWAMWDPYGHT

SEQ ID NO: 1746452 - protein, 19 aa, Staphylococcus epidermidis
SFYAWFNLWAMWDPYGHTG

SEQ ID NO: 1746453 - protein, 19 aa, Staphylococcus epidermidis
SICIIGIGIIGWYMWSLWS

SEQ ID NO: 1746454 - protein, 18 aa, Staphylococcus epidermidis
SIDEISKILPVIEIKSAA

SEQ ID NO: 1746455 - protein, 17 aa, Staphylococcus epidermidis
SKDIKIINQIVDNAIEL

SEQ ID NO: 1746456 - protein, 22 aa, Staphylococcus epidermidis
SKENKKRFTAMMLVCAMFAICW

SEQ ID NO: 1746457 - protein, 20 aa, Staphylococcus epidermidis
SKNQKGMIVQQDWKGSHNQF

SEQ ID NO: 1746458 - protein, 17 aa, Staphylococcus epidermidis
SLMCIPLAWFLGLQDFF

SEQ ID NO: 1746459 - protein, 25 aa, Staphylococcus epidermidis
SYFIKQWALDRIKQIQLETMNSIRG

SEQ ID NO: 1746460 - protein, 17 aa, Staphylococcus epidermidis
TGIFFIMLFILIKLFME

SEQ ID NO: 1746461 - protein, 17 aa, Staphylococcus epidermidis
TLAFPAYLLKISRSFEV

SEQ ID NO: 1746462 - protein, 17 aa, Staphylococcus epidermidis
TQFFYKKYITTSINYLN

SEQ ID NO: 1746463 - protein, 17 aa, Staphylococcus epidermidis
TSLNGFERLNHARPRAL

SEQ ID NO: 1746464 - protein, 24 aa, Staphylococcus epidermidis
VEAFKELWLPIITICFILAISKIT

SEQ ID NO: 1746465 - protein, 25 aa, Staphylococcus epidermidis
VEAFKELWLPIITICFILAISKITT

SEQ ID NO: 1746466 - protein, 17 aa, Staphylococcus epidermidis
VLFLFPFVQKHFVKGIT

SEQ ID NO: 1746467 - protein, 19 aa, Staphylococcus epidermidis
VVSFCFIFLLLVFFRYILK

SEQ ID NO: 1746468 - protein, 25 aa, Staphylococcus epidermidis
VYFIVCLLISFLALISMNIRILSGF

SEQ ID NO: 1746469 - protein, 18 aa, Staphylococcus epidermidis
VYNFDFTQPIYKIQVGDT

SEQ ID NO: 1746470 - protein, 17 aa, Staphylococcus epidermidis
WITCLFVAFPVFTSYTA

SEQ ID NO: 1746471 - protein, 23 aa, Staphylococcus epidermidis
YQTPKYSLGNYVWYDTNKDGIQG

SEQ ID NO: 1746472 - protein, 17 aa, Staphylococcus epidermidis
YSFGRDGLLPSWLSQLN

SEQ ID NO: 1746473 - protein, 17 aa, Staphylococcus epidermidis
YSIYEMMMWLTHQTHHP

SEQ ID NO: 1746474 - protein, 23 aa, Staphylococcus epidermidis
YVKPELKHTIELYHDNEKQNRKE

SEQ ID NO: 1746475 - protein, 24 aa, Staphylococcus epidermidis
AAFFYSIYESIKWLINTNYEPHLY

SEQ ID NO: 1746476 - protein, 25 aa, Staphylococcus epidermidis
ADEALRFIIMYLRWRNDRWQARMKQ

SEQ ID NO: 1746477 - protein, 21 aa, Staphylococcus epidermidis
AKDGLFPKWFAKENKNKAPVN

SEQ ID NO: 1746478 - protein, 17 aa, Staphylococcus epidermidis
AKVAAIIGQAKILDHAM

SEQ ID NO: 1746479 - protein, 23 aa, Staphylococcus epidermidis
ANDGYRIQPHIGLSIYESTNKDE

SEQ ID NO: 1746480 - protein, 23 aa, Staphylococcus epidermidis
ANHPIEMNMIWKAMLIPSMGYVV

SEQ ID NO: 1746481 - protein, 18 aa, Staphylococcus epidermidis
ASKDIKIINQIVDNAIEL

SEQ ID NO: 1746482 - protein, 19 aa, Staphylococcus epidermidis
ASSTWAWLFVLFVLPVIGF

SEQ ID NO: 1746483 - protein, 27 aa, Staphylococcus epidermidis
ASSYIDMIDRIPPVAPKANSITTEDTS

SEQ ID NO: 1746484 - protein, 23 aa, Staphylococcus epidermidis
ATPVQFVIGWQFYVGAYKNLRNG

SEQ ID NO: 1746485 - protein, 18 aa, Staphylococcus epidermidis
AYPGNFVQAVNQYWPEHM

SEQ ID NO: 1746486 - protein, 24 aa, Staphylococcus epidermidis
DFFSLRTGGPVDARIVWVNNQGPD

SEQ ID NO: 1746487 - protein, 17 aa, Staphylococcus epidermidis
DNSFQDFVIDYNGDTKV

SEQ ID NO: 1746488 - protein, 18 aa, Staphylococcus epidermidis
DNSGEIIATGTYDNTNKQ

SEQ ID NO: 1746489 - protein, 17 aa, Staphylococcus epidermidis
DYKGGGMANLFKDLKHL

SEQ ID NO: 1746490 - protein, 22 aa, Staphylococcus epidermidis
EILPRFNKIIVMNDGEIIENGS

SEQ ID NO: 1746491 - protein, 20 aa, Staphylococcus epidermidis
EKTYKIGDYVWEDVDKDGIQ

SEQ ID NO: 1746492 - protein, 22 aa, Staphylococcus epidermidis
ETFKEVLKGTGVEPGKINKETQ

SEQ ID NO: 1746493 - protein, 19 aa, Staphylococcus epidermidis
EVHPIMYFLMALFILYFIF

SEQ ID NO: 1746494 - protein, 19 aa, Staphylococcus epidermidis
FFVSRAYHWYELDEQFVDG

SEQ ID NO: 1746495 - protein, 18 aa, Staphylococcus epidermidis
FIAFYFKKIRTQKIVFSI

SEQ ID NO: 1746496 - protein, 17 aa, Staphylococcus epidermidis
FIIACGFIADSTSLPLV

SEQ ID NO: 1746497 - protein, 17 aa, Staphylococcus epidermidis
FSSYIWKNVGWDSIIYF

SEQ ID NO: 1746498 - protein, 19 aa, Staphylococcus epidermidis
GAFLMFIAFYFKKIRTQKI

SEQ ID NO: 1746499 - protein, 19 aa, Staphylococcus epidermidis
GAFLMFIAFYFKKLRTQKI

SEQ ID NO: 1746500 - protein, 23 aa, Staphylococcus epidermidis
GGFANWRVVFGFMIVLAIITMLG

SEQ ID NO: 1746501 - protein, 21 aa, Staphylococcus epidermidis
GIISGLCRLYIGGADAYTYLI

SEQ ID NO: 1746502 - protein, 19 aa, Staphylococcus epidermidis
GIPMLIPLLIKYAIDGVIN

SEQ ID NO: 1746503 - protein, 18 aa, Staphylococcus epidermidis
GKDYDLQEQRGYTDSEQH

SEQ ID NO: 1746504 - protein, 20 aa, Staphylococcus epidermidis
GLKTRRMVLFMNRNTRTSKG

SEQ ID NO: 1746505 - protein, 18 aa, Staphylococcus epidermidis
GLLAPWVAGAAMALSSVS

SEQ ID NO: 1746506 - protein, 23 aa, Staphylococcus epidermidis
GSYLLGIHWRLGYTGIILVSIAD

SEQ ID NO: 1746507 - protein, 18 aa, Staphylococcus epidermidis
GTRIRPILMTAIATIGAL

SEQ ID NO: 1746508 - protein, 21 aa, Staphylococcus epidermidis
GTSYFRFQYFNPLNSSKYYEN

SEQ ID NO: 1746509 - protein, 17 aa, Staphylococcus epidermidis
GVIKAHDAENLIYDVTF

SEQ ID NO: 1746510 - protein, 18 aa, Staphylococcus epidermidis
IALGIGGAITAVALSRKE

SEQ ID NO: 1746511 - protein, 17 aa, Staphylococcus epidermidis
IFHLIRLASKIDSQFNK

SEQ ID NO: 1746512 - protein, 17 aa, Staphylococcus epidermidis
IFRKKLYLVVSIFLPVV

SEQ ID NO: 1746513 - protein, 18 aa, Staphylococcus epidermidis
IGATLLFGLGHNEAKAEE

SEQ ID NO: 1746514 - protein, 20 aa, Staphylococcus epidermidis
IGFSSAWGYWFAAFLGNVAY

SEQ ID NO: 1746515 - protein, 19 aa, Staphylococcus epidermidis
IIFFRWGWADPLASVIVAI

SEQ ID NO: 1746516 - protein, 24 aa, Staphylococcus epidermidis
IIFRKKLYLVMSIFLPVVFYLLFT

SEQ ID NO: 1746517 - protein, 18 aa, Staphylococcus epidermidis
IIISFIFYFYTTEKKVDK

SEQ ID NO: 1746518 - protein, 19 aa, Staphylococcus epidermidis
IKIFTKDNMQVIGDITTIA

SEQ ID NO: 1746519 - protein, 20 aa, Staphylococcus epidermidis
IKIFTKDNMQVIGDITTIAD

SEQ ID NO: 1746520 - protein, 19 aa, Staphylococcus epidermidis
IKIFTKDNMQVIGDITTIS

SEQ ID NO: 1746521 - protein, 19 aa, Staphylococcus epidermidis
ILGAGVEWGTTIVTLVTFV

SEQ ID NO: 1746522 - protein, 23 aa, Staphylococcus epidermidis
ILLLMCVRWWIKYLSFKKNEHLK

SEQ ID NO: 1746523 - protein, 17 aa, Staphylococcus epidermidis
INIIVAWIMLRGSDVEE

SEQ ID NO: 1746524 - protein, 19 aa, Staphylococcus epidermidis
IPALIGWVGQVGWLSVNVS

SEQ ID NO: 1746525 - protein, 19 aa, Staphylococcus epidermidis
IPFDKKRVFNPDLKPGEER

SEQ ID NO: 1746526 - protein, 19 aa, Staphylococcus epidermidis
IPGLLSFLADNSFNTKVKG

SEQ ID NO: 1746527 - protein, 20 aa, Staphylococcus epidermidis
IPKIPYKVFVVFFILVSFIL

SEQ ID NO: 1746528 - protein, 17 aa, Staphylococcus epidermidis
ISPRFSLIFLIIIYLTI

SEQ ID NO: 1746529 - protein, 25 aa, Staphylococcus epidermidis
ISTPLEVPVKVWVYNFDFTQPIYKI

SEQ ID NO: 1746530 - protein, 17 aa, Staphylococcus epidermidis
ITIIISFIFYFYTTEKK

SEQ ID NO: 1746531 - protein, 23 aa, Staphylococcus epidermidis
IVSFCFIFLLLLFFRYILKRYFN

SEQ ID NO: 1746532 - protein, 21 aa, Staphylococcus epidermidis
IWSNSKFKLALKVQDRQDSNE

SEQ ID NO: 1746533 - protein, 23 aa, Staphylococcus epidermidis
IYVSLRFEWRMGLSSVLALLHDV

SEQ ID NO: 1746534 - protein, 20 aa, Staphylococcus epidermidis
KAEPGSTVVITFPDGQTAEG

SEQ ID NO: 1746535 - protein, 22 aa, Staphylococcus epidermidis
KARPKIEAIVPQVSKKRDALNA

SEQ ID NO: 1746536 - protein, 19 aa, Staphylococcus epidermidis
KDNSGEIIATGTYDNKNKQ

SEQ ID NO: 1746537 - protein, 21 aa, Staphylococcus epidermidis
KGVRKKLWLSIALIGSLQYGG

SEQ ID NO: 1746538 - protein, 22 aa, Staphylococcus epidermidis
KKTLRYGTASALTLALYLFNSN

SEQ ID NO: 1746539 - protein, 18 aa, Staphylococcus epidermidis
KLVFPFIIACGFIADSTS

SEQ ID NO: 1746540 - protein, 20 aa, Staphylococcus epidermidis
KPYYIFRFRIPFTPGLIPKR

SEQ ID NO: 1746541 - protein, 19 aa, Staphylococcus epidermidis
KQLSEEDIHSIPVVKRKQN

SEQ ID NO: 1746542 - protein, 24 aa, Staphylococcus epidermidis
KRSKMKIAILSIIFVILLIGLFSF

SEQ ID NO: 1746543 - protein, 17 aa, Staphylococcus epidermidis
KSLLKRRLINIKEGNLK

SEQ ID NO: 1746544 - protein, 17 aa, Staphylococcus epidermidis
KTYKIGDYVWEDVDKDG

SEQ ID NO: 1746545 - protein, 21 aa, Staphylococcus epidermidis
KVFGCLGIALAMYATTPKENR

SEQ ID NO: 1746546 - protein, 18 aa, Staphylococcus epidermidis
KWGFPRWASITTIFIGLI

SEQ ID NO: 1746547 - protein, 17 aa, Staphylococcus epidermidis
LAGLKFSISLKVIERLL

SEQ ID NO: 1746548 - protein, 17 aa, Staphylococcus epidermidis
LAIVGSLFIFGRRKKGN

SEQ ID NO: 1746549 - protein, 20 aa, Staphylococcus epidermidis
LCSLLMIRVGERFMQKRGPQ

SEQ ID NO: 1746550 - protein, 22 aa, Staphylococcus epidermidis
LFMKYRFWLPFIISSIIFSSQH

SEQ ID NO: 1746551 - protein, 17 aa, Staphylococcus epidermidis
LIGVLLLTNATYTTLLL

SEQ ID NO: 1746552 - protein, 24 aa, Staphylococcus epidermidis
LIIIILCLIFRISTVPSMLISSIS

SEQ ID NO: 1746553 - protein, 19 aa, Staphylococcus epidermidis
LKVAVAKAPLVRQNSNYIN

SEQ ID NO: 1746554 - protein, 18 aa, Staphylococcus epidermidis
LLLCISFLLITIFIGGCG

SEQ ID NO: 1746555 - protein, 18 aa, Staphylococcus epidermidis
LPFQFTFPGSEWVVLILS

SEQ ID NO: 1746556 - protein, 18 aa, Staphylococcus epidermidis
LPQRRWVYFLALSTSVLI

SEQ ID NO: 1746557 - protein, 19 aa, Staphylococcus epidermidis
LPQRRWVYFLALSTSVLIA

SEQ ID NO: 1746558 - protein, 17 aa, Staphylococcus epidermidis
LSFKGQIFFVSIDSMME

SEQ ID NO: 1746559 - protein, 19 aa, Staphylococcus epidermidis
LTAKVKVILADGSFVTVNV

SEQ ID NO: 1746560 - protein, 25 aa, Staphylococcus epidermidis
LTDWIKNSGGTTFSLSMTASTGGAK

SEQ ID NO: 1746561 - protein, 25 aa, Staphylococcus epidermidis
LTGLLSSFWLVLAKRRKKEEEKQSI

SEQ ID NO: 1746562 - protein, 19 aa, Staphylococcus epidermidis
LTLHAEIFFDGETTPIRKD

SEQ ID NO: 1746563 - protein, 17 aa, Staphylococcus epidermidis
LVITIIISFIFYFYTTE

SEQ ID NO: 1746564 - protein, 17 aa, Staphylococcus epidermidis
LWFYFRKSIPKTFDISS

SEQ ID NO: 1746565 - protein, 22 aa, Staphylococcus epidermidis
LYIPHFLSWVVVIGIFKKLLAP

SEQ ID NO: 1746566 - protein, 22 aa, Staphylococcus epidermidis
LYIPHFLSWVVVISIFKKLLAP

SEQ ID NO: 1746567 - protein, 25 aa, Staphylococcus epidermidis
LYLSKRYYIIISFVLAIAFIYFYII

SEQ ID NO: 1746568 - protein, 17 aa, Staphylococcus epidermidis
MGRSGIMPTVFSKLHSK

SEQ ID NO: 1746569 - protein, 21 aa, Staphylococcus epidermidis
MNIRILSGFLFLIAAIVTIPL

SEQ ID NO: 1746570 - protein, 17 aa, Staphylococcus epidermidis
NALFSMKSGSWLKGFLP

SEQ ID NO: 1746571 - protein, 18 aa, Staphylococcus epidermidis
NGSGIGLYFANIVLQQYN

SEQ ID NO: 1746572 - protein, 23 aa, Staphylococcus epidermidis
NKDNFNEHMNLSGSATYDPKTGI

SEQ ID NO: 1746573 - protein, 22 aa, Staphylococcus epidermidis
NKKHAFNTLAHIIIWDTDQQPL

SEQ ID NO: 1746574 - protein, 23 aa, Staphylococcus epidermidis
NKPLRMMIYLGMFTFSISILYII

SEQ ID NO: 1746575 - protein, 23 aa, Staphylococcus epidermidis
NLNSGNYIVHFDKPSGMTQTTTD

SEQ ID NO: 1746576 - protein, 19 aa, Staphylococcus epidermidis
NLPFQFTFPGSEWVVLILS

SEQ ID NO: 1746577 - protein, 18 aa, Staphylococcus epidermidis
NRLKRLGIRKGVKVVFSD

SEQ ID NO: 1746578 - protein, 30 aa, Staphylococcus epidermidis
NTGSVIKLNLTKWLSLQSDFVNGGKVNLSF

SEQ ID NO: 1746579 - protein, 18 aa, Staphylococcus epidermidis
NVTLRSRMYTFSKNKAIR

SEQ ID NO: 1746580 - protein, 22 aa, Staphylococcus epidermidis
PDAYSQKGAISLNTRLDSNRSF

SEQ ID NO: 1746581 - protein, 18 aa, Staphylococcus epidermidis
PLFTGRLVDKFSVSSINW

SEQ ID NO: 1746582 - protein, 20 aa, Staphylococcus epidermidis
PLYFRFTIYWPFFSDTFIWL

SEQ ID NO: 1746583 - protein, 30 aa, Staphylococcus epidermidis
PNENFLQTDYRAVLYIKEQVNKELIPYIDP

SEQ ID NO: 1746584 - protein, 24 aa, Staphylococcus epidermidis
PNENRTANLQSMFTNIDTKNHTVE

SEQ ID NO: 1746585 - protein, 21 aa, Staphylococcus epidermidis
PNLLNKYGIRKLSAGTASLLI

SEQ ID NO: 1746586 - protein, 19 aa, Staphylococcus epidermidis
PNNRYSIPYFFGTVGILYD

SEQ ID NO: 1746587 - protein, 22 aa, Staphylococcus epidermidis
PRNVGGGGAFGAFVSTDRNGMA

SEQ ID NO: 1746588 - protein, 26 aa, Staphylococcus epidermidis
PSDERFKVGQQLIVKVVDEEGNVSEP

SEQ ID NO: 1746589 - protein, 18 aa, Staphylococcus epidermidis
QLAGLKFSISLKVIERLL

SEQ ID NO: 1746590 - protein, 17 aa, Staphylococcus epidermidis
QRRRRRIDNQSKEKDAT

SEQ ID NO: 1746591 - protein, 23 aa, Staphylococcus epidermidis
QSKLILIFICIFTFLLMVIQSQF

SEQ ID NO: 1746592 - protein, 22 aa, Staphylococcus epidermidis
QTPKYSLGNYVWYDTNKDGIQG

SEQ ID NO: 1746593 - protein, 18 aa, Staphylococcus epidermidis
RDLICAIMVGVLGGIVTL

SEQ ID NO: 1746594 - protein, 19 aa, Staphylococcus epidermidis
RKFWYSFGLLFGGIGLISI

SEQ ID NO: 1746595 - protein, 18 aa, Staphylococcus epidermidis
RLVSCLLILFLGSAIFSL

SEQ ID NO: 1746596 - protein, 18 aa, Staphylococcus epidermidis
RSGIMPTVFSKLHSKHKT

SEQ ID NO: 1746597 - protein, 24 aa, Staphylococcus epidermidis
SDLKGRIAIAIAFQNIMLIVTTFI

SEQ ID NO: 1746598 - protein, 25 aa, Staphylococcus epidermidis
SETTLKGGQPLQVIAIDKAGNKSEA

SEQ ID NO: 1746599 - protein, 17 aa, Staphylococcus epidermidis
SFMPLKHLWSLAIEEQF

SEQ ID NO: 1746600 - protein, 25 aa, Staphylococcus epidermidis
SFWFRDCIYMRSLFYMSRKKLLKSQ

SEQ ID NO: 1746601 - protein, 22 aa, Staphylococcus epidermidis
SKGTLLGTLFAGLGALLLGKRR

SEQ ID NO: 1746602 - protein, 21 aa, Staphylococcus epidermidis
SLCIIGMGIIGWYMWSLWSLI

SEQ ID NO: 1746603 - protein, 17 aa, Staphylococcus epidermidis
SPYIIKVISKYDPNKDD

SEQ ID NO: 1746604 - protein, 23 aa, Staphylococcus epidermidis
SQASEVFTPINPITITATDNSGK

SEQ ID NO: 1746605 - protein, 17 aa, Staphylococcus epidermidis
SQLLKGHVYNGISGAQF

SEQ ID NO: 1746606 - protein, 17 aa, Staphylococcus epidermidis
SRGMFRLVSGMTFANNP

SEQ ID NO: 1746607 - protein, 24 aa, Staphylococcus epidermidis
SYFIKQWALDRIKEIQLETMNSIR

SEQ ID NO: 1746608 - protein, 23 aa, Staphylococcus epidermidis
TFEYTESAVAKVRYVDANTGKDI

SEQ ID NO: 1746609 - protein, 20 aa, Staphylococcus epidermidis
TGIACGFIFYPITMIITKKY

SEQ ID NO: 1746610 - protein, 25 aa, Staphylococcus epidermidis
THTVTGLPQGLKFDASTNSIVGTPT

SEQ ID NO: 1746611 - protein, 25 aa, Staphylococcus epidermidis
TIRNIRQNLFWAFGYNVAGIPIAAI

SEQ ID NO: 1746612 - protein, 17 aa, Staphylococcus epidermidis
TISMNWSLEVARALTGG

SEQ ID NO: 1746613 - protein, 28 aa, Staphylococcus epidermidis
TQLNSWGWRIPFLLGMFLGLFGLYLRRK

SEQ ID NO: 1746614 - protein, 30 aa, Staphylococcus epidermidis
TSFANLRTFSRFTVLNTMAAPTTTSTTTTS

SEQ ID NO: 1746615 - protein, 21 aa, Staphylococcus epidermidis
TSFILAFPMAIIWPTIQNGLN

SEQ ID NO: 1746616 - protein, 17 aa, Staphylococcus epidermidis
TSTGFILASAGSAIGLG

SEQ ID NO: 1746617 - protein, 17 aa, Staphylococcus epidermidis
TVKETFLTWSLLETIIS

SEQ ID NO: 1746618 - protein, 21 aa, Staphylococcus epidermidis
VAILVLRSGFYVTKSSLHVLM

SEQ ID NO: 1746619 - protein, 22 aa, Staphylococcus epidermidis
VASLGALLLFFKRRKKDENDEK

SEQ ID NO: 1746620 - protein, 18 aa, Staphylococcus epidermidis
VIQGCVLFIGFFVVIINT

SEQ ID NO: 1746621 - protein, 19 aa, Staphylococcus epidermidis
VKGEFKFEKELSLLDISTV

SEQ ID NO: 1746622 - protein, 19 aa, Staphylococcus epidermidis
VKGEFKFEKELSLLNISTV

SEQ ID NO: 1746623 - protein, 25 aa, Staphylococcus epidermidis
VKGSLLLELAVVFGISALVTSFLKH

SEQ ID NO: 1746624 - protein, 21 aa, Staphylococcus epidermidis
VPALICLAGIFITMIWRSFQI

SEQ ID NO: 1746625 - protein, 20 aa, Staphylococcus epidermidis
VQFIIGWQFYVGAYKNLRNG

SEQ ID NO: 1746626 - protein, 26 aa, Staphylococcus epidermidis
VSADGTRVDINFARSMANGKKYIVTQ

SEQ ID NO: 1746627 - protein, 26 aa, Staphylococcus epidermidis
VSNGFIVAVAIVLAIFGLAKKSRKDD

SEQ ID NO: 1746628 - protein, 18 aa, Staphylococcus epidermidis
VSRAYRWYELDEQFVDGV

SEQ ID NO: 1746629 - protein, 19 aa, Staphylococcus epidermidis
VYIIPRFFKAIPAPLIAII

SEQ ID NO: 1746630 - protein, 17 aa, Staphylococcus epidermidis
WIWPELPIGAAFAIAAI

SEQ ID NO: 1746631 - protein, 17 aa, Staphylococcus epidermidis
WRMGLSSVLALLHDVFI

SEQ ID NO: 1746632 - protein, 19 aa, Staphylococcus epidermidis
WVYNFDFTQPIYKIQVGDT

SEQ ID NO: 1746633 - protein, 19 aa, Staphylococcus epidermidis
YFLQFNWFQPLLIGLAGLL

SEQ ID NO: 1746634 - protein, 25 aa, Staphylococcus epidermidis
YQFDGLKNGLTYKITFETPEGYTPT

SEQ ID NO: 1746635 - protein, 17 aa, Staphylococcus epidermidis
YRIPRTLLGLLIGSSLA

SEQ ID NO: 1746636 - protein, 17 aa, Staphylococcus epidermidis
YSHKSCIILGAITLTLG

SEQ ID NO: 1746637 - protein, 24 aa, Staphylococcus epidermidis
YSNNKPVYLTHTWTTNDGAIAEES

SEQ ID NO: 1746638 - protein, 23 aa, Staphylococcus epidermidis
YVKPELKHTIELYHDNEKQDRKE

SEQ ID NO: 1746639 - protein, 17 aa, Staphylococcus epidermidis
AAIFHWTAGFSFSAGLI

SEQ ID NO: 1746640 - protein, 26 aa, Staphylococcus epidermidis
ADEALRFIIMYLRWRKDRWQARMKQI

SEQ ID NO: 1746641 - protein, 26 aa, Staphylococcus epidermidis
ADEALRFIIMYLRWRNNRWQARMKQI

SEQ ID NO: 1746642 - protein, 24 aa, Staphylococcus epidermidis
AEYAKRIANSKVWDTEDQAITDLT

SEQ ID NO: 1746643 - protein, 19 aa, Staphylococcus epidermidis
AFFISRGFVKTGLGRRIAL

SEQ ID NO: 1746644 - protein, 19 aa, Staphylococcus epidermidis
AGKVIPHWDVFGLHINEVG

SEQ ID NO: 1746645 - protein, 20 aa, Staphylococcus epidermidis
AGLGALLLLFKRRRKDEDNN

SEQ ID NO: 1746646 - protein, 19 aa, Staphylococcus epidermidis
AHSTLTWNEEPNSWKNNIG

SEQ ID NO: 1746647 - protein, 18 aa, Staphylococcus epidermidis
AIIEKGKVNKLLKRNPTV

SEQ ID NO: 1746648 - protein, 26 aa, Staphylococcus epidermidis
AILPSFYAWFNLWAMWDPYGNTGHIK

SEQ ID NO: 1746649 - protein, 21 aa, Staphylococcus epidermidis
AILVAIGWRLIWKRQIDKHKK

SEQ ID NO: 1746650 - protein, 17 aa, Staphylococcus epidermidis
AKLIFVFFFIILIFFCH

SEQ ID NO: 1746651 - protein, 17 aa, Staphylococcus epidermidis
AKPPVFLVRFWTLFASF

SEQ ID NO: 1746652 - protein, 27 aa, Staphylococcus epidermidis
AKTTALVGGAFTFNMLNNHQAFAASET

SEQ ID NO: 1746653 - protein, 22 aa, Staphylococcus epidermidis
ALARFPWLSANIEYTVTREPYF

SEQ ID NO: 1746654 - protein, 20 aa, Staphylococcus epidermidis
ALKAARLELENKINQTVQTD

SEQ ID NO: 1746655 - protein, 19 aa, Staphylococcus epidermidis
ALKAARLNLENKINQTVQT

SEQ ID NO: 1746656 - protein, 18 aa, Staphylococcus epidermidis
ALLFAICCNFYILKKYAN

SEQ ID NO: 1746657 - protein, 17 aa, Staphylococcus epidermidis
ALLFIAQLYFHFSHNIT

SEQ ID NO: 1746658 - protein, 17 aa, Staphylococcus epidermidis
ALVYGYQRFDTMVIIIT

SEQ ID NO: 1746659 - protein, 18 aa, Staphylococcus epidermidis
ANGKKYIVTQAVRPTGTG

SEQ ID NO: 1746660 - protein, 24 aa, Staphylococcus epidermidis
ANISNWRFAMLVIIVISFIALISI

SEQ ID NO: 1746661 - protein, 17 aa, Staphylococcus epidermidis
ANITFAIAIKFIALLLV

SEQ ID NO: 1746662 - protein, 23 aa, Staphylococcus epidermidis
ANNGYRIQPHIGLAIHESTNKDE

SEQ ID NO: 1746663 - protein, 19 aa, Staphylococcus epidermidis
ANNVIWPTSNEQFNLKANY

SEQ ID NO: 1746664 - protein, 20 aa, Staphylococcus epidermidis
ANSIWAWLLVLVFLPLIGFI

SEQ ID NO: 1746665 - protein, 23 aa, Staphylococcus epidermidis
APQKRWHFILAFSSSILVGLFIK

SEQ ID NO: 1746666 - protein, 25 aa, Staphylococcus epidermidis
APSKPKGLKSYRMVFSTMNVERMNS

SEQ ID NO: 1746667 - protein, 24 aa, Staphylococcus epidermidis
AQFIPEFLGSLVIGIIAVLGHSLV

SEQ ID NO: 1746668 - protein, 22 aa, Staphylococcus epidermidis
AQGFGWKGSFGLNQILGVFMYP

SEQ ID NO: 1746669 - protein, 31 aa, Staphylococcus epidermidis
AQKRLEFYRLYLLMVHLLKFGGMYAASVNRS

SEQ ID NO: 1746670 - protein, 17 aa, Staphylococcus epidermidis
AQLTLSIGVGEGTENLI

SEQ ID NO: 1746671 - protein, 17 aa, Staphylococcus epidermidis
AQMTYHFVLAMFPMLIF

SEQ ID NO: 1746672 - protein, 17 aa, Staphylococcus epidermidis
ARIPFWFLIKGLTLIFF

SEQ ID NO: 1746673 - protein, 22 aa, Staphylococcus epidermidis
ARLFGELEFWFSIIKVVTIVAM

SEQ ID NO: 1746674 - protein, 19 aa, Staphylococcus epidermidis
ARNGIVLKILSVIYTLVLG

SEQ ID NO: 1746675 - protein, 18 aa, Staphylococcus epidermidis
ARRICWFGSITVTLILAV

SEQ ID NO: 1746676 - protein, 19 aa, Staphylococcus epidermidis
ARTTNGWDRSVLDPRVAGI

SEQ ID NO: 1746677 - protein, 25 aa, Staphylococcus epidermidis
ASFIAYRVGLRWEDLEEGISKRLNT

SEQ ID NO: 1746678 - protein, 20 aa, Staphylococcus epidermidis
ASIEGWRWMLGLAVVPSVIL

SEQ ID NO: 1746679 - protein, 17 aa, Staphylococcus epidermidis
ASKDIKMINQIVDNAIE

SEQ ID NO: 1746680 - protein, 17 aa, Staphylococcus epidermidis
ASLLIGATLVFGINGQV

SEQ ID NO: 1746681 - protein, 19 aa, Staphylococcus epidermidis
ASNRRWPYNLPRSRNILRA

SEQ ID NO: 1746682 - protein, 22 aa, Staphylococcus epidermidis
ASNVRRFKGYKLYQTVSPDNMS

SEQ ID NO: 1746683 - protein, 25 aa, Staphylococcus epidermidis
ASPIKRSEIIFGYVFGYGSFSVIQT

SEQ ID NO: 1746684 - protein, 26 aa, Staphylococcus epidermidis
ASYLIKKWALDRIKQIQLETMNSIRD

SEQ ID NO: 1746685 - protein, 27 aa, Staphylococcus epidermidis
ATADIQGGGVWRLFKIPENVNRIKVQF

SEQ ID NO: 1746686 - protein, 19 aa, Staphylococcus epidermidis
ATCYEILKIIGYPEIILNQ

SEQ ID NO: 1746687 - protein, 19 aa, Staphylococcus epidermidis
ATFLERFSYFLIIPFLSIY

SEQ ID NO: 1746688 - protein, 24 aa, Staphylococcus epidermidis
ATFLGWKWIFIFSIVVSVISLILI

SEQ ID NO: 1746689 - protein, 25 aa, Staphylococcus epidermidis
ATNLKLRRIVPLGIIFFILILIVIL

SEQ ID NO: 1746690 - protein, 19 aa, Staphylococcus epidermidis
AVYLFRFVWVYVLYPYFYL

SEQ ID NO: 1746691 - protein, 24 aa, Staphylococcus epidermidis
AYAFRQCTWWVYNRRLELGLPCDP

SEQ ID NO: 1746692 - protein, 23 aa, Staphylococcus epidermidis
AYKLMWFNGHMTFTLTITTMITS

SEQ ID NO: 1746693 - protein, 19 aa, Staphylococcus epidermidis
CGFVGAVAWTIYQLTVGMD

SEQ ID NO: 1746694 - protein, 21 aa, Staphylococcus epidermidis
CGPACLAMISQFYGKRVSIPR

SEQ ID NO: 1746695 - protein, 18 aa, Staphylococcus epidermidis
CILILIACIFIKEPFVYF

SEQ ID NO: 1746696 - protein, 20 aa, Staphylococcus epidermidis
CLWFLFCVFIFQYIKLLFSR

SEQ ID NO: 1746697 - protein, 18 aa, Staphylococcus epidermidis
CMLLNLTPIFAILTAIVT

SEQ ID NO: 1746698 - protein, 17 aa, Staphylococcus epidermidis
CRFIMGFAIGMDSPVAF

SEQ ID NO: 1746699 - protein, 19 aa, Staphylococcus epidermidis
DCVTIIIALSIMFFLDVKL

SEQ ID NO: 1746700 - protein, 17 aa, Staphylococcus epidermidis
DDAKRLYEFYGEVEQAP

SEQ ID NO: 1746701 - protein, 18 aa, Staphylococcus epidermidis
DDEKDADGEDVRVTITDH

SEQ ID NO: 1746702 - protein, 41 aa, Staphylococcus epidermidis
DDKKKGGFMKILLPLIAAILILGAIAIFGGMALNNHNDSKS

SEQ ID NO: 1746703 - protein, 19 aa, Staphylococcus epidermidis
DEATRIVIMYTSLEGQEAT

SEQ ID NO: 1746704 - protein, 20 aa, Staphylococcus epidermidis
DEVWLALYIQACITYQTLDK

SEQ ID NO: 1746705 - protein, 35 aa, Staphylococcus epidermidis
DFWNRWHMTLSFWFRDCIYMRSLFYMSRKKLLKSQ

SEQ ID NO: 1746706 - protein, 19 aa, Staphylococcus epidermidis
DGAPYKRRQNIINSSSGHR

SEQ ID NO: 1746707 - protein, 21 aa, Staphylococcus epidermidis
DGKEIKVRMIGMDTPETVKPN

SEQ ID NO: 1746708 - protein, 41 aa, Staphylococcus epidermidis
DGKKKGGLMKILLPLIAAVLILGAIAIFGGMALNNHNDSKN

SEQ ID NO: 1746709 - protein, 18 aa, Staphylococcus epidermidis
DGLFPKWFAKENENGAPV

SEQ ID NO: 1746710 - protein, 17 aa, Staphylococcus epidermidis
DHDDFSIDNGYFDDDSD

SEQ ID NO: 1746711 - protein, 17 aa, Staphylococcus epidermidis
DIFVWFKLVLNDTSEFH

SEQ ID NO: 1746712 - protein, 20 aa, Staphylococcus epidermidis
DIKWGAAITAIFSILIFISK

SEQ ID NO: 1746713 - protein, 21 aa, Staphylococcus epidermidis
DIPKKRSRRAVEGNNASDVNT

SEQ ID NO: 1746714 - protein, 23 aa, Staphylococcus epidermidis
DIVQVRWLFRISSLIIFSIIIQS

SEQ ID NO: 1746715 - protein, 20 aa, Staphylococcus epidermidis
DKDGRLIGIVSLKIDMENVE

SEQ ID NO: 1746716 - protein, 17 aa, Staphylococcus epidermidis
DKKREFDPNLAPGTEKV

SEQ ID NO: 1746717 - protein, 23 aa, Staphylococcus epidermidis
DKMFPILIGFFVFFFVFLISGIA

SEQ ID NO: 1746718 - protein, 17 aa, Staphylococcus epidermidis
DKMKLLRDKLKTLVNPV

SEQ ID NO: 1746719 - protein, 17 aa, Staphylococcus epidermidis
DKMKLLRDQLKTLVNPV

SEQ ID NO: 1746720 - protein, 18 aa, Staphylococcus epidermidis
DKNGNAIGTTTTDVSGHY

SEQ ID NO: 1746721 - protein, 26 aa, Staphylococcus epidermidis
DKSKLHKELPLFVSGHFRNAMNNEET

SEQ ID NO: 1746722 - protein, 17 aa, Staphylococcus epidermidis
DLILRYMEKLSYKKLLI

SEQ ID NO: 1746723 - protein, 20 aa, Staphylococcus epidermidis
DLKGRIAVAIAFQNIMLILS

SEQ ID NO: 1746724 - protein, 18 aa, Staphylococcus epidermidis
DLNIPFTKSLTGRNLKDG

SEQ ID NO: 1746725 - protein, 24 aa, Staphylococcus epidermidis
DNLDSGNYIIHFEKPEGMTQTTAN

SEQ ID NO: 1746726 - protein, 17 aa, Staphylococcus epidermidis
DNPRINLLAATEDTKPK

SEQ ID NO: 1746727 - protein, 23 aa, Staphylococcus epidermidis
DNPTYSLGDYVWLDKNKNGVQDD

SEQ ID NO: 1746728 - protein, 26 aa, Staphylococcus epidermidis
DNRFYHHGALDYKRLFGAVGKNLTGG

SEQ ID NO: 1746729 - protein, 17 aa, Staphylococcus epidermidis
DNSGEIIATGTYDNTNK

SEQ ID NO: 1746730 - protein, 18 aa, Staphylococcus epidermidis
DQVSKWIIATSMKIGDSY

SEQ ID NO: 1746731 - protein, 18 aa, Staphylococcus epidermidis
DSGFYKTPKYSVGDYVWK

SEQ ID NO: 1746732 - protein, 21 aa, Staphylococcus epidermidis
DSGNYIIHFEKPEGMTQTTAN

SEQ ID NO: 1746733 - protein, 19 aa, Staphylococcus epidermidis
DSIVFRNALQYSVIMAVAI

SEQ ID NO: 1746734 - protein, 18 aa, Staphylococcus epidermidis
DSIVFRNALQYTVIMAVA

SEQ ID NO: 1746735 - protein, 22 aa, Staphylococcus epidermidis
DSKSGWRKTLFEIAGKDRITLE

SEQ ID NO: 1746736 - protein, 23 aa, Staphylococcus epidermidis
DTSQCPNCGQLLTKKKKRKIKDQ

SEQ ID NO: 1746737 - protein, 17 aa, Staphylococcus epidermidis
DVLMKAFQIDAPVNPGN

SEQ ID NO: 1746738 - protein, 19 aa, Staphylococcus epidermidis
DWVGWRFTFLFIMLVSVVV

SEQ ID NO: 1746739 - protein, 23 aa, Staphylococcus epidermidis
DYKRDGKELGEFYQSLINNMMRV

SEQ ID NO: 1746740 - protein, 26 aa, Staphylococcus epidermidis
DYMPELKWHYAYFVCLGVMLVITIIL

SEQ ID NO: 1746741 - protein, 23 aa, Staphylococcus epidermidis
EAIPVFAGVIVLLAFVLLVFVFR

SEQ ID NO: 1746742 - protein, 24 aa, Staphylococcus epidermidis
EDHLKFSLFLAMLIACLLIQAATN

SEQ ID NO: 1746743 - protein, 23 aa, Staphylococcus epidermidis
EDHLKFSLFLAMLVACLLIQAAT

SEQ ID NO: 1746744 - protein, 20 aa, Staphylococcus epidermidis
EFAIGMGPKIFSFRKDETLY

SEQ ID NO: 1746745 - protein, 18 aa, Staphylococcus epidermidis
EFARGMYILSYINFLPTV

SEQ ID NO: 1746746 - protein, 23 aa, Staphylococcus epidermidis
EFLSEKWWLVIIVVVIICGSLSQ

SEQ ID NO: 1746747 - protein, 34 aa, Staphylococcus epidermidis
EGAAVGIGGLNNAFGFKLDTYHNTSTPKSDAKAK

SEQ ID NO: 1746748 - protein, 32 aa, Staphylococcus epidermidis
EGDTFTIKYGQYIRPGGLELPAIKTQLRSKDG

SEQ ID NO: 1746749 - protein, 17 aa, Staphylococcus epidermidis
EGQSFCNKCGTHIKQSN

SEQ ID NO: 1746750 - protein, 17 aa, Staphylococcus epidermidis
EHNHAFKGLSWHQSLFY

SEQ ID NO: 1746751 - protein, 22 aa, Staphylococcus epidermidis
EIIPSFFPSIIVLFGSIFFLFM

SEQ ID NO: 1746752 - protein, 21 aa, Staphylococcus epidermidis
EIKFSHWQWFISIASIVVLFI

SEQ ID NO: 1746753 - protein, 19 aa, Staphylococcus epidermidis
EIRSKPTPPRIITTANELR

SEQ ID NO: 1746754 - protein, 21 aa, Staphylococcus epidermidis
EISKILPVIEIKSAARNEIHQ

SEQ ID NO: 1746755 - protein, 26 aa, Staphylococcus epidermidis
EISKLSNWRFAMLVIIVISFIALISI

SEQ ID NO: 1746756 - protein, 21 aa, Staphylococcus epidermidis
EIYGGTFFYRFRKIIAPLFAS

SEQ ID NO: 1746757 - protein, 25 aa, Staphylococcus epidermidis
EKGSKGILFGSLFAGLGALLLLFKR

SEQ ID NO: 1746758 - protein, 19 aa, Staphylococcus epidermidis
EKILLALLLYRFAYYFVPV

SEQ ID NO: 1746759 - protein, 18 aa, Staphylococcus epidermidis
EKLFKRYTDLVIDQLEDD

SEQ ID NO: 1746760 - protein, 17 aa, Staphylococcus epidermidis
EKLRYLLNIGKLEELRA

SEQ ID NO: 1746761 - protein, 20 aa, Staphylococcus epidermidis
EKQLSEEDIHSIPVVKRKQN

SEQ ID NO: 1746762 - protein, 19 aa, Staphylococcus epidermidis
EKTYKIGDYVWEDVDKDGI

SEQ ID NO: 1746763 - protein, 21 aa, Staphylococcus epidermidis
EKVLGWFSWVFLLILTIITMF

SEQ ID NO: 1746764 - protein, 20 aa, Staphylococcus epidermidis
ELATLILIMLLGHWIEMNAV

SEQ ID NO: 1746765 - protein, 17 aa, Staphylococcus epidermidis
ENHLSIDTGWSFPSGHS

SEQ ID NO: 1746766 - protein, 21 aa, Staphylococcus epidermidis
ENTEIYKLFGWMSLFVLIIFI

SEQ ID NO: 1746767 - protein, 19 aa, Staphylococcus epidermidis
EPGDWLTFFGTLVGALIGA

SEQ ID NO: 1746768 - protein, 22 aa, Staphylococcus epidermidis
ERDTFNWARWLPHMTLSALNIR

SEQ ID NO: 1746769 - protein, 23 aa, Staphylococcus epidermidis
ERFMWKWKLFRIFNKQADISGDY

SEQ ID NO: 1746770 - protein, 23 aa, Staphylococcus epidermidis
ERYRIPRLLGITIIYVAIVGIIT

SEQ ID NO: 1746771 - protein, 21 aa, Staphylococcus epidermidis
ESNNGVIFSLIALFSSLFFIK

SEQ ID NO: 1746772 - protein, 20 aa, Staphylococcus epidermidis
ESYRAAILYQNWFFITHWKL

SEQ ID NO: 1746773 - protein, 22 aa, Staphylococcus epidermidis
ETFKEVLKGTGVEPGKNNKETQ

SEQ ID NO: 1746774 - protein, 22 aa, Staphylococcus epidermidis
ETSHLFSFFISYHFNQFDLSFQ

SEQ ID NO: 1746775 - protein, 22 aa, Staphylococcus epidermidis
EVKVLMPIKEFTPLAPLLETNY

SEQ ID NO: 1746776 - protein, 25 aa, Staphylococcus epidermidis
EVSKILPVIEIKLAARNEIHQKAEV

SEQ ID NO: 1746777 - protein, 19 aa, Staphylococcus epidermidis
EYRIIPLIVCVANIGKDLT

SEQ ID NO: 1746778 - protein, 17 aa, Staphylococcus epidermidis
FEKVIAFIIIFGMCKLI

SEQ ID NO: 1746779 - protein, 18 aa, Staphylococcus epidermidis
FENIVAFILLVILVKLIL

SEQ ID NO: 1746780 - protein, 17 aa, Staphylococcus epidermidis
FFKYLAIFLSINLILTL

SEQ ID NO: 1746781 - protein, 17 aa, Staphylococcus epidermidis
FFVSRAYHWYELDEQFV

SEQ ID NO: 1746782 - protein, 17 aa, Staphylococcus epidermidis
FFVYLLLFMFSMIGIVI

SEQ ID NO: 1746783 - protein, 19 aa, Staphylococcus epidermidis
FFWFFKLHYSFGHIINSKI

SEQ ID NO: 1746784 - protein, 18 aa, Staphylococcus epidermidis
FGLIIGILVLISYLLFLL

SEQ ID NO: 1746785 - protein, 17 aa, Staphylococcus epidermidis
FGLKVPLLIAFAVIFAG

SEQ ID NO: 1746786 - protein, 17 aa, Staphylococcus epidermidis
FGMSRFLTYILVILATG

SEQ ID NO: 1746787 - protein, 27 aa, Staphylococcus epidermidis
FGTFEYTESAVAKVRYVDANTGKDIIP

SEQ ID NO: 1746788 - protein, 23 aa, Staphylococcus epidermidis
FHFANLLARFGIILGVFLNSVGM

SEQ ID NO: 1746789 - protein, 17 aa, Staphylococcus epidermidis
FIAAIFIKNGWFPNKDL

SEQ ID NO: 1746790 - protein, 18 aa, Staphylococcus epidermidis
FIAFYFKKLRTQKIVFSI

SEQ ID NO: 1746791 - protein, 19 aa, Staphylococcus epidermidis
FIAFYFKKLRTQKIVFSIG

SEQ ID NO: 1746792 - protein, 23 aa, Staphylococcus epidermidis
FIFRCLVVLLVFIGAVAKTETVW

SEQ ID NO: 1746793 - protein, 17 aa, Staphylococcus epidermidis
FIFYKILILWTLPTLIF

SEQ ID NO: 1746794 - protein, 22 aa, Staphylococcus epidermidis
FIISLINWRGLWIIIGVLSLTT

SEQ ID NO: 1746795 - protein, 17 aa, Staphylococcus epidermidis
FIKFNCMLGNTFTPQAD

SEQ ID NO: 1746796 - protein, 17 aa, Staphylococcus epidermidis
FILIPAFIIFQSIIPII

SEQ ID NO: 1746797 - protein, 19 aa, Staphylococcus epidermidis
FIVKLIPVHYIFRVLSILI

SEQ ID NO: 1746798 - protein, 17 aa, Staphylococcus epidermidis
FIVLVIFKRSIIMPLYM

SEQ ID NO: 1746799 - protein, 19 aa, Staphylococcus epidermidis
FIVRVLIPFALIISLFLIS

SEQ ID NO: 1746800 - protein, 20 aa, Staphylococcus epidermidis
FKAFKWRIIGFLAFLIIAIL

SEQ ID NO: 1746801 - protein, 19 aa, Staphylococcus epidermidis
FKFSYSWIHFGKIFLYSFI

SEQ ID NO: 1746802 - protein, 18 aa, Staphylococcus epidermidis
FKFWSVIESGGWVIFTHM

SEQ ID NO: 1746803 - protein, 19 aa, Staphylococcus epidermidis
FKHLLIRLRYSYLYLSKRY

SEQ ID NO: 1746804 - protein, 18 aa, Staphylococcus epidermidis
FKKAMGILLISTVGYVGY

SEQ ID NO: 1746805 - protein, 17 aa, Staphylococcus epidermidis
FKKEFVVSFVIAILVVA

SEQ ID NO: 1746806 - protein, 17 aa, Staphylococcus epidermidis
FKLDTYHNTSPPKSDAK

SEQ ID NO: 1746807 - protein, 19 aa, Staphylococcus epidermidis
FKLPGLIKYGFNINERYIK

SEQ ID NO: 1746808 - protein, 17 aa, Staphylococcus epidermidis
FKLPLIILMFASSILSY

SEQ ID NO: 1746809 - protein, 20 aa, Staphylococcus epidermidis
FKNLGYSYVGTDALKAPNYT

SEQ ID NO: 1746810 - protein, 25 aa, Staphylococcus epidermidis
FKPLSWLASIYIEFLRGTPMLVQVF

SEQ ID NO: 1746811 - protein, 19 aa, Staphylococcus epidermidis
FKPYYIFKMRIPFTPGLIP

SEQ ID NO: 1746812 - protein, 34 aa, Staphylococcus epidermidis
FKQLVVAFFKEHWPKMLIIIGIIVLLLILNAIFT

SEQ ID NO: 1746813 - protein, 19 aa, Staphylococcus epidermidis
FKRLFPYSFVNKAKESYRF

SEQ ID NO: 1746814 - protein, 19 aa, Staphylococcus epidermidis
FKTALKLAGDPYYSGMPLP

SEQ ID NO: 1746815 - protein, 25 aa, Staphylococcus epidermidis
FLFKRLSWPYGLIIAAVIITSLGSL

SEQ ID NO: 1746816 - protein, 24 aa, Staphylococcus epidermidis
FLLLFIMRFGFRKIEAIVGTLIFT

SEQ ID NO: 1746817 - protein, 18 aa, Staphylococcus epidermidis
FLMILPALIGYLLGFPMF

SEQ ID NO: 1746818 - protein, 19 aa, Staphylococcus epidermidis
FLPNKILNIRYKLRPVNIE

SEQ ID NO: 1746819 - protein, 24 aa, Staphylococcus epidermidis
FLSGLICAIVLFLIIVVIYRQPLL

SEQ ID NO: 1746820 - protein, 20 aa, Staphylococcus epidermidis
FLVRFWTLFASFLIGLALMG

SEQ ID NO: 1746821 - protein, 20 aa, Staphylococcus epidermidis
FLVRFWTLFVSFLMGLVLMT

SEQ ID NO: 1746822 - protein, 17 aa, Staphylococcus epidermidis
FMSEKWWVIIIIVIIIC

SEQ ID NO: 1746823 - protein, 17 aa, Staphylococcus epidermidis
FNEGWDVAQQMAKKIVT

SEQ ID NO: 1746824 - protein, 21 aa, Staphylococcus epidermidis
FNYWWMFALSFVFFLIAGALT

SEQ ID NO: 1746825 - protein, 18 aa, Staphylococcus epidermidis
FPKGTWVGYYKHLENGEG

SEQ ID NO: 1746826 - protein, 28 aa, Staphylococcus epidermidis
FPQPIYKIQVGDTFPKGTWVGYYKHLEN

SEQ ID NO: 1746827 - protein, 21 aa, Staphylococcus epidermidis
FPSKYKLEVGIGRDISGDPIS

SEQ ID NO: 1746828 - protein, 18 aa, Staphylococcus epidermidis
FPVLFLIIIFLFKEQIKK

SEQ ID NO: 1746829 - protein, 19 aa, Staphylococcus epidermidis
FPVLFLIIIFLFKKQIKKI

SEQ ID NO: 1746830 - protein, 17 aa, Staphylococcus epidermidis
FPVPFRFSGFRFDVSSI

SEQ ID NO: 1746831 - protein, 19 aa, Staphylococcus epidermidis
FQGHVPWGYSIILIISSVI

SEQ ID NO: 1746832 - protein, 17 aa, Staphylococcus epidermidis
FQMIQFIPLFAVPQVFF

SEQ ID NO: 1746833 - protein, 18 aa, Staphylococcus epidermidis
FRIFLAVLLSLLLVISIS

SEQ ID NO: 1746834 - protein, 17 aa, Staphylococcus epidermidis
FRPFALAITFSLLASLL

SEQ ID NO: 1746835 - protein, 18 aa, Staphylococcus epidermidis
FRVKGGHAESFFPSKLPL

SEQ ID NO: 1746836 - protein, 20 aa, Staphylococcus epidermidis
FRYAIFKGLGLGGAMTTGFL

SEQ ID NO: 1746837 - protein, 17 aa, Staphylococcus epidermidis
FRYIWTSLISFIFFVGV

SEQ ID NO: 1746838 - protein, 18 aa, Staphylococcus epidermidis
FSCAMAFSAASQIYLGKF

SEQ ID NO: 1746839 - protein, 20 aa, Staphylococcus epidermidis
FSFMPLKHLWSLAIEEQFYL

SEQ ID NO: 1746840 - protein, 17 aa, Staphylococcus epidermidis
FSGQAPYLFAHRGGMAV

SEQ ID NO: 1746841 - protein, 26 aa, Staphylococcus epidermidis
FSIRKFNIGIFFALIATVTFLAHPGQ

SEQ ID NO: 1746842 - protein, 17 aa, Staphylococcus epidermidis
FSISLKVIERLLLALIL

SEQ ID NO: 1746843 - protein, 20 aa, Staphylococcus epidermidis
FSLIALFSSLFFIKRKSNKN

SEQ ID NO: 1746844 - protein, 18 aa, Staphylococcus epidermidis
FTAGRVINKIKYDSSQKS

SEQ ID NO: 1746845 - protein, 21 aa, Staphylococcus epidermidis
FTELMIIISIIYFKNLYIGRL

SEQ ID NO: 1746846 - protein, 17 aa, Staphylococcus epidermidis
FTKGFLKSIAILIGLVL

SEQ ID NO: 1746847 - protein, 22 aa, Staphylococcus epidermidis
FTLAGTFIALWFQFRKDDKDKR

SEQ ID NO: 1746848 - protein, 27 aa, Staphylococcus epidermidis
FVDIGWFLTNWLYKFVNFVEDVLDKIV

SEQ ID NO: 1746849 - protein, 18 aa, Staphylococcus epidermidis
FVGACGWMVYILFFDGLE

SEQ ID NO: 1746850 - protein, 23 aa, Staphylococcus epidermidis
FVIGWTYWICWVVSSMSDLTAMG

SEQ ID NO: 1746851 - protein, 19 aa, Staphylococcus epidermidis
FVSRAYRWYELDEQFVDGV

SEQ ID NO: 1746852 - protein, 23 aa, Staphylococcus epidermidis
FWFPEIPNWISALFCVLILMSFN

SEQ ID NO: 1746853 - protein, 17 aa, Staphylococcus epidermidis
FYAQPSFWFGVFRYLTE

SEQ ID NO: 1746854 - protein, 20 aa, Staphylococcus epidermidis
FYILTVYFFFGRLRQLTRVR

SEQ ID NO: 1746855 - protein, 22 aa, Staphylococcus epidermidis
FYKFRFILIMLIVFLMAIMVLF

SEQ ID NO: 1746856 - protein, 25 aa, Staphylococcus epidermidis
FYKTPKYSVGDYVWKDTNKDGIQDD

SEQ ID NO: 1746857 - protein, 22 aa, Staphylococcus epidermidis
FYLTPKYNVGDYVWEDTNKDGI

SEQ ID NO: 1746858 - protein, 28 aa, Staphylococcus epidermidis
GAAVGIGGLNNAFGFKLDTYHNTSPPKS

SEQ ID NO: 1746859 - protein, 28 aa, Staphylococcus epidermidis
GAAVGIGGLNNAFGFKLDTYHNTSTPRS

SEQ ID NO: 1746860 - protein, 17 aa, Staphylococcus epidermidis
GADGWGFMFSKKDGDDF

SEQ ID NO: 1746861 - protein, 19 aa, Staphylococcus epidermidis
GAFIFRFIALFLISIIANF

SEQ ID NO: 1746862 - protein, 18 aa, Staphylococcus epidermidis
GAFLMFIAFYFKKLRTQK

SEQ ID NO: 1746863 - protein, 24 aa, Staphylococcus epidermidis
GAFLMFIAFYFKKLRTQKIVFSIG

SEQ ID NO: 1746864 - protein, 17 aa, Staphylococcus epidermidis
GAFTFNMLNNHQAFAAS

SEQ ID NO: 1746865 - protein, 23 aa, Staphylococcus epidermidis
GASTYRKNFCQRFLDEVNVTVIK

SEQ ID NO: 1746866 - protein, 24 aa, Staphylococcus epidermidis
GASTYRKQFCKRFLEQIDVTVIKG

SEQ ID NO: 1746867 - protein, 18 aa, Staphylococcus epidermidis
GDAAGMLFAPKQVINGVQ

SEQ ID NO: 1746868 - protein, 17 aa, Staphylococcus epidermidis
GDGFARQTFKVHSVSQS

SEQ ID NO: 1746869 - protein, 19 aa, Staphylococcus epidermidis
GDQNAAVTLPADQENNAPQ

SEQ ID NO: 1746870 - protein, 25 aa, Staphylococcus epidermidis
GDYTIEFETPEGYTPTKQNSGSDEG

SEQ ID NO: 1746871 - protein, 24 aa, Staphylococcus epidermidis
GEKKVRVGEQFKYRIKGVVGNRET

SEQ ID NO: 1746872 - protein, 22 aa, Staphylococcus epidermidis
GETFRNSFDWLGLNKKYLTRTL

SEQ ID NO: 1746873 - protein, 21 aa, Staphylococcus epidermidis
GETFSEFRIFLAVLLSLLLVI

SEQ ID NO: 1746874 - protein, 17 aa, Staphylococcus epidermidis
GFTEQYLIWSIFRLISG

SEQ ID NO: 1746875 - protein, 17 aa, Staphylococcus epidermidis
GGICIGVGIGVIVLAGG

SEQ ID NO: 1746876 - protein, 25 aa, Staphylococcus epidermidis
GGLAPFTILFSLPFTVIGVVLALVI

SEQ ID NO: 1746877 - protein, 20 aa, Staphylococcus epidermidis
GGPGAVFWMWVIAFIGAASA

SEQ ID NO: 1746878 - protein, 23 aa, Staphylococcus epidermidis
GGQTIRLMEHFLRNGNQEEIDYQ

SEQ ID NO: 1746879 - protein, 18 aa, Staphylococcus epidermidis
GHSAWRYFMLIFYLVPYA

SEQ ID NO: 1746880 - protein, 17 aa, Staphylococcus epidermidis
GIGGLIGSFGIGFVIDK

SEQ ID NO: 1746881 - protein, 22 aa, Staphylococcus epidermidis
GIHEIYFPYVLMRPLLFLAVIL

SEQ ID NO: 1746882 - protein, 27 aa, Staphylococcus epidermidis
GIKNFFKFVCIVFIVVCIFLFIVKKKG

SEQ ID NO: 1746883 - protein, 24 aa, Staphylococcus epidermidis
GILTFRLYRHFYYRLFAIITVILI

SEQ ID NO: 1746884 - protein, 19 aa, Staphylococcus epidermidis
GIMCVINYALVRHIAFDKY

SEQ ID NO: 1746885 - protein, 18 aa, Staphylococcus epidermidis
GIPMLIPLLIKYAIDGVI

SEQ ID NO: 1746886 - protein, 21 aa, Staphylococcus epidermidis
GIRRILAVGFDNSFDSISNQT

SEQ ID NO: 1746887 - protein, 18 aa, Staphylococcus epidermidis
GITKFIYRKISTAQSPIV

SEQ ID NO: 1746888 - protein, 17 aa, Staphylococcus epidermidis
GIVPEILITKVVVLTLF

SEQ ID NO: 1746889 - protein, 21 aa, Staphylococcus epidermidis
GKETRFGIGLSALFTTITTAF

SEQ ID NO: 1746890 - protein, 18 aa, Staphylococcus epidermidis
GKILAAMLFGMFIAILNQ

SEQ ID NO: 1746891 - protein, 24 aa, Staphylococcus epidermidis
GKQGTGLGLFICKMIIEAHGGRID

SEQ ID NO: 1746892 - protein, 21 aa, Staphylococcus epidermidis
GKQGTGLGLFICKMIIEEHGG

SEQ ID NO: 1746893 - protein, 22 aa, Staphylococcus epidermidis
GKQGTGLGLFICKMIIEEHGGK

SEQ ID NO: 1746894 - protein, 25 aa, Staphylococcus epidermidis
GKTFSEFRIFLAVLITLLLIISISL

SEQ ID NO: 1746895 - protein, 24 aa, Staphylococcus epidermidis
GKTYLKHFLWFNGLTGVFAFILLL

SEQ ID NO: 1746896 - protein, 17 aa, Staphylococcus epidermidis
GLCRLYIGGADAYTYLI

SEQ ID NO: 1746897 - protein, 17 aa, Staphylococcus epidermidis
GLLISIGNWRWIFWINI

SEQ ID NO: 1746898 - protein, 17 aa, Staphylococcus epidermidis
GLSEFYALVLFAGLFHL

SEQ ID NO: 1746899 - protein, 17 aa, Staphylococcus epidermidis
GPDEIKKLLGVDAGIRD

SEQ ID NO: 1746900 - protein, 17 aa, Staphylococcus epidermidis
GSKALNLNLGFAQWGFK

SEQ ID NO: 1746901 - protein, 22 aa, Staphylococcus epidermidis
GSLICAISFNFPIMMGGRVLQA

SEQ ID NO: 1746902 - protein, 17 aa, Staphylococcus epidermidis
GSLWIYYIRFIKGNLRW

SEQ ID NO: 1746903 - protein, 18 aa, Staphylococcus epidermidis
GSSLKPFLAYGPAIENMQ

SEQ ID NO: 1746904 - protein, 20 aa, Staphylococcus epidermidis
GSVGEMFRPFALAITFSLLA

SEQ ID NO: 1746905 - protein, 24 aa, Staphylococcus epidermidis
GSWYIPKWLGSVLPKIDIEGKALD

SEQ ID NO: 1746906 - protein, 22 aa, Staphylococcus epidermidis
GSYTVEFETPSGYTPTKANSGQ

SEQ ID NO: 1746907 - protein, 17 aa, Staphylococcus epidermidis
GTFFHASNRRWPYNLPR

SEQ ID NO: 1746908 - protein, 23 aa, Staphylococcus epidermidis
GTGEHLWRFAVGFGAFIALVLYI

SEQ ID NO: 1746909 - protein, 17 aa, Staphylococcus epidermidis
GTLIGYGLTKDTQADST

SEQ ID NO: 1746910 - protein, 20 aa, Staphylococcus epidermidis
GTRIRPILMTAIATIGALIP

SEQ ID NO: 1746911 - protein, 22 aa, Staphylococcus epidermidis
GVKGAVIGSIWLIVSIIPITII

SEQ ID NO: 1746912 - protein, 20 aa, Staphylococcus epidermidis
GVKVCTNCGTPVNQHHQSHS

SEQ ID NO: 1746913 - protein, 25 aa, Staphylococcus epidermidis
GVSSEAAYTTTVFGTISLASALLLF

SEQ ID NO: 1746914 - protein, 24 aa, Staphylococcus epidermidis
GVTFKELWLPVLTICFILAISKIT

SEQ ID NO: 1746915 - protein, 18 aa, Staphylococcus epidermidis
GYIVCVYGIFAFLIPATI

SEQ ID NO: 1746916 - protein, 17 aa, Staphylococcus epidermidis
HAGDQNAAVTLPADQEN

SEQ ID NO: 1746917 - protein, 18 aa, Staphylococcus epidermidis
HATEFAGIIFSFTGQSST

SEQ ID NO: 1746918 - protein, 22 aa, Staphylococcus epidermidis
HDTRLSSFYGIIIFSVVVFLFI

SEQ ID NO: 1746919 - protein, 17 aa, Staphylococcus epidermidis
HFDALQARERRFLSLYD

SEQ ID NO: 1746920 - protein, 17 aa, Staphylococcus epidermidis
HFLLFNGLMGGLSFVLL

SEQ ID NO: 1746921 - protein, 18 aa, Staphylococcus epidermidis
HFLWPAILAFALTGIGLP

SEQ ID NO: 1746922 - protein, 18 aa, Staphylococcus epidermidis
HGGFLNEDFRLFSTDNKN

SEQ ID NO: 1746923 - protein, 19 aa, Staphylococcus epidermidis
HIAEHKLGYVVINKTQQIL

SEQ ID NO: 1746924 - protein, 18 aa, Staphylococcus epidermidis
HIAEHKLGYVVVNKTQQI

SEQ ID NO: 1746925 - protein, 19 aa, Staphylococcus epidermidis
HIAEHKLGYVVVNKTQQIL

SEQ ID NO: 1746926 - protein, 20 aa, Staphylococcus epidermidis
HKLILRYSLWYIKTVKGSVR

SEQ ID NO: 1746927 - protein, 20 aa, Staphylococcus epidermidis
HLLLELAVIFGISALVTSFL

SEQ ID NO: 1746928 - protein, 21 aa, Staphylococcus epidermidis
HLVFFLPFYKSFRVHKLVNKK

SEQ ID NO: 1746929 - protein, 22 aa, Staphylococcus epidermidis
HPELKISAMIGIVFMTMLLFIF

SEQ ID NO: 1746930 - protein, 17 aa, Staphylococcus epidermidis
HPNRVALFIALAIMGFV

SEQ ID NO: 1746931 - protein, 17 aa, Staphylococcus epidermidis
HRKDIRLSDTDKIDPMV

SEQ ID NO: 1746932 - protein, 17 aa, Staphylococcus epidermidis
HSFRYAIFKGLGLGGAM

SEQ ID NO: 1746933 - protein, 20 aa, Staphylococcus epidermidis
HSIPFYKGGYFVFIYKNKSH

SEQ ID NO: 1746934 - protein, 27 aa, Staphylococcus epidermidis
HSNGSWDFLIHFFVDIGWFLTNWLYKF

SEQ ID NO: 1746935 - protein, 25 aa, Staphylococcus epidermidis
HSNNLDLLHQNRLQDKVVKQPTKGE

SEQ ID NO: 1746936 - protein, 26 aa, Staphylococcus epidermidis
HSNNLDLLHQNRLQDKVVKQPTKGED

SEQ ID NO: 1746937 - protein, 24 aa, Staphylococcus epidermidis
HTVTGLPQGLKFDASTNSIVGTPT

SEQ ID NO: 1746938 - protein, 18 aa, Staphylococcus epidermidis
HVGRIICILMILIAVVGL

SEQ ID NO: 1746939 - protein, 18 aa, Staphylococcus epidermidis
HVLGDLFGSIGAIVAALL

SEQ ID NO: 1746940 - protein, 19 aa, Staphylococcus epidermidis
IAAFAGAIGPLSLGLGSIV

SEQ ID NO: 1746941 - protein, 28 aa, Staphylococcus epidermidis
IAFFKEHWPKMLIIIGIIVLLLILNAIF

SEQ ID NO: 1746942 - protein, 17 aa, Staphylococcus epidermidis
IAFYFKKLRTQKIVFSI

SEQ ID NO: 1746943 - protein, 21 aa, Staphylococcus epidermidis
IAKTLIHWCDKAFVTKLVLGQ

SEQ ID NO: 1746944 - protein, 17 aa, Staphylococcus epidermidis
IALGIGGAITVVALSRK

SEQ ID NO: 1746945 - protein, 19 aa, Staphylococcus epidermidis
IATIKSILPNVIKKPTAIN

SEQ ID NO: 1746946 - protein, 17 aa, Staphylococcus epidermidis
IAVAFCIPIHFKVVSNN

SEQ ID NO: 1746947 - protein, 27 aa, Staphylococcus epidermidis
IDFILRWKRYFILGVVGIIIAILTLTN

SEQ ID NO: 1746948 - protein, 17 aa, Staphylococcus epidermidis
IDFKKLMILGSLVSLAT

SEQ ID NO: 1746949 - protein, 17 aa, Staphylococcus epidermidis
IDKRLKYIILHEYAHAK

SEQ ID NO: 1746950 - protein, 24 aa, Staphylococcus epidermidis
IEAIHKIKPITIIKPQALNEITNQ

SEQ ID NO: 1746951 - protein, 20 aa, Staphylococcus epidermidis
IELIIGIALIFAGVMMSQIN

SEQ ID NO: 1746952 - protein, 18 aa, Staphylococcus epidermidis
IFCEIAFWFVILLGLVTR

SEQ ID NO: 1746953 - protein, 17 aa, Staphylococcus epidermidis
IFCFLKGFIGFFIGGDS

SEQ ID NO: 1746954 - protein, 18 aa, Staphylococcus epidermidis
IFDKRKRDVLALRNGTNV

SEQ ID NO: 1746955 - protein, 20 aa, Staphylococcus epidermidis
IFHAPFWFEFGSWKNAAGDI

SEQ ID NO: 1746956 - protein, 17 aa, Staphylococcus epidermidis
IFHLIRLASKIDNQFNK

SEQ ID NO: 1746957 - protein, 19 aa, Staphylococcus epidermidis
IFKERKLLITIAYKLLMDD

SEQ ID NO: 1746958 - protein, 19 aa, Staphylococcus epidermidis
IFLLFRFTPLLGLSDAYIY

SEQ ID NO: 1746959 - protein, 17 aa, Staphylococcus epidermidis
IGALLFWLTCLFITTLL

SEQ ID NO: 1746960 - protein, 22 aa, Staphylococcus epidermidis
IGFGASYLFNWSIRRDMIPQSL

SEQ ID NO: 1746961 - protein, 19 aa, Staphylococcus epidermidis
IGFGLCWPYVLLPYGFGQI

SEQ ID NO: 1746962 - protein, 19 aa, Staphylococcus epidermidis
IGIFCFLKGLIGFFIGGDS

SEQ ID NO: 1746963 - protein, 23 aa, Staphylococcus epidermidis
IGIFCIIMVFALLGFLPYNLNPA

SEQ ID NO: 1746964 - protein, 17 aa, Staphylococcus epidermidis
IGIQIAYLLNDLKGRIA

SEQ ID NO: 1746965 - protein, 18 aa, Staphylococcus epidermidis
IGLTCYVIYILKVILLAR

SEQ ID NO: 1746966 - protein, 24 aa, Staphylococcus epidermidis
IGLVAIVIGMFWFKLYQRTTNPKA

SEQ ID NO: 1746967 - protein, 18 aa, Staphylococcus epidermidis
IGNLPGYRNYLIEYKEKD

SEQ ID NO: 1746968 - protein, 19 aa, Staphylococcus epidermidis
IGTFSTVIATLVFMGINPN

SEQ ID NO: 1746969 - protein, 18 aa, Staphylococcus epidermidis
IGTMIGDWVGWRFTFLFI

SEQ ID NO: 1746970 - protein, 18 aa, Staphylococcus epidermidis
IGVGMILREFYIFRFVIG

SEQ ID NO: 1746971 - protein, 24 aa, Staphylococcus epidermidis
IHFANWRWIFFINIFIVIIAVPLM

SEQ ID NO: 1746972 - protein, 18 aa, Staphylococcus epidermidis
IIDLRLFKNMSFSSPIFA

SEQ ID NO: 1746973 - protein, 18 aa, Staphylococcus epidermidis
IIEAIQFYDVEAHMSVKI

SEQ ID NO: 1746974 - protein, 25 aa, Staphylococcus epidermidis
IIFGLKLPLLIAFAVIFAGLSFGYI

SEQ ID NO: 1746975 - protein, 19 aa, Staphylococcus epidermidis
IIFRKKLYLVISILLPVVF

SEQ ID NO: 1746976 - protein, 22 aa, Staphylococcus epidermidis
IIIPFIIAVSIMFAIEYILISI

SEQ ID NO: 1746977 - protein, 17 aa, Staphylococcus epidermidis
IIITMCFVHLPTAIIMV

SEQ ID NO: 1746978 - protein, 24 aa, Staphylococcus epidermidis
IIKKNWKLLVIIPLIFLILSAIFT

SEQ ID NO: 1746979 - protein, 22 aa, Staphylococcus epidermidis
IILKILFVIIIVFVLFVGLMYF

SEQ ID NO: 1746980 - protein, 24 aa, Staphylococcus epidermidis
IIQSLCVLLGIWIYKMDKNESSAI

SEQ ID NO: 1746981 - protein, 30 aa, Staphylococcus epidermidis
IISFFKKHWPKLLIIIGIILLLLILNAIFT

SEQ ID NO: 1746982 - protein, 18 aa, Staphylococcus epidermidis
IISGLCRLYIGGADAYTY

SEQ ID NO: 1746983 - protein, 18 aa, Staphylococcus epidermidis
IIVDDAFVHFDKHRKERM

SEQ ID NO: 1746984 - protein, 17 aa, Staphylococcus epidermidis
IKEFTPLAPLLETNYKK

SEQ ID NO: 1746985 - protein, 20 aa, Staphylococcus epidermidis
IKFSHWQWFISIASIVILFI

SEQ ID NO: 1746986 - protein, 24 aa, Staphylococcus epidermidis
IKGYELYIVLAIFIILDIILALIT

SEQ ID NO: 1746987 - protein, 22 aa, Staphylococcus epidermidis
IKLLNCILCYFNIILVCVMLFT

SEQ ID NO: 1746988 - protein, 17 aa, Staphylococcus epidermidis
IKLWLTIILIVATVLIL

SEQ ID NO: 1746989 - protein, 18 aa, Staphylococcus epidermidis
IKNFKLPLIILMFASSIL

SEQ ID NO: 1746990 - protein, 22 aa, Staphylococcus epidermidis
IKSDLWSAFYIFTAFNVVYAIF

SEQ ID NO: 1746991 - protein, 21 aa, Staphylococcus epidermidis
IKTLVCILSFILIVGFSLIYN

SEQ ID NO: 1746992 - protein, 18 aa, Staphylococcus epidermidis
IKTSRFLLGLTIPSVLSL

SEQ ID NO: 1746993 - protein, 17 aa, Staphylococcus epidermidis
ILAHLFKHLLIRLRYSY

SEQ ID NO: 1746994 - protein, 18 aa, Staphylococcus epidermidis
ILDGLAFGVLTVFLINWI

SEQ ID NO: 1746995 - protein, 19 aa, Staphylococcus epidermidis
ILFTPAAKDYANFMSDNTD

SEQ ID NO: 1746996 - protein, 19 aa, Staphylococcus epidermidis
ILGAGVEWGTTIVTLATFV

SEQ ID NO: 1746997 - protein, 18 aa, Staphylococcus epidermidis
ILITKVVVLTLFGLGFII

SEQ ID NO: 1746998 - protein, 22 aa, Staphylococcus epidermidis
ILLLMCVRWWIKYLNFKKNEHL

SEQ ID NO: 1746999 - protein, 22 aa, Staphylococcus epidermidis
ILNLFLAWFFIYFDWGRNGVKG

SEQ ID NO: 1747000 - protein, 22 aa, Staphylococcus epidermidis
ILNLFLAWFFIYFPWGRTGVKG

SEQ ID NO: 1747001 - protein, 22 aa, Staphylococcus epidermidis
ILNRKWWQSFHFYQKNKELKIT

SEQ ID NO: 1747002 - protein, 19 aa, Staphylococcus epidermidis
ILQRFTKGFLKSIAILIGL

SEQ ID NO: 1747003 - protein, 17 aa, Staphylococcus epidermidis
ILSHDGFAYIMNNAIKN

SEQ ID NO: 1747004 - protein, 17 aa, Staphylococcus epidermidis
ILVCTKLNLQVGTNVAV

SEQ ID NO: 1747005 - protein, 19 aa, Staphylococcus epidermidis
ILVGLFIKYFRTVSIKSYI

SEQ ID NO: 1747006 - protein, 17 aa, Staphylococcus epidermidis
ILVLRLGYLQIAQGSQY

SEQ ID NO: 1747007 - protein, 17 aa, Staphylococcus epidermidis
IMFSVFIAFVFQEDSAI

SEQ ID NO: 1747008 - protein, 17 aa, Staphylococcus epidermidis
INEKWLLMICVLVIIIN

SEQ ID NO: 1747009 - protein, 22 aa, Staphylococcus epidermidis
INHVKEQLSLVFNAIEKDQKDI

SEQ ID NO: 1747010 - protein, 25 aa, Staphylococcus epidermidis
IPDIKRPWLPPLPEIVYQSELIETD

SEQ ID NO: 1747011 - protein, 19 aa, Staphylococcus epidermidis
IPGLLSFLADDSFKTKVKG

SEQ ID NO: 1747012 - protein, 19 aa, Staphylococcus epidermidis
IPLTSKRFIDWLNLNNIVP

SEQ ID NO: 1747013 - protein, 23 aa, Staphylococcus epidermidis
IQEPKLSFIISFLYLMVGFITAF

SEQ ID NO: 1747014 - protein, 20 aa, Staphylococcus epidermidis
IQFDDCSGVKNCLNKQISKT

SEQ ID NO: 1747015 - protein, 19 aa, Staphylococcus epidermidis
IQILQCYDAIHFKITLKEN

SEQ ID NO: 1747016 - protein, 17 aa, Staphylococcus epidermidis
IQIPHIFMNPWFQFVLA

SEQ ID NO: 1747017 - protein, 20 aa, Staphylococcus epidermidis
IQNPALIMLLAGLGLLGLFR

SEQ ID NO: 1747018 - protein, 20 aa, Staphylococcus epidermidis
IQNPALIMLLTGLGLLGLFR

SEQ ID NO: 1747019 - protein, 20 aa, Staphylococcus epidermidis
IQQKANEIIQIIEANNNASA

SEQ ID NO: 1747020 - protein, 18 aa, Staphylococcus epidermidis
IRFRYSYLYLSKRYYIII

SEQ ID NO: 1747021 - protein, 17 aa, Staphylococcus epidermidis
IRIGIQIAYLLNDLKGR

SEQ ID NO: 1747022 - protein, 17 aa, Staphylococcus epidermidis
IRILSGLLFLIAAIVTI

SEQ ID NO: 1747023 - protein, 22 aa, Staphylococcus epidermidis
IRKETCSWKWTLFALIYPIITA

SEQ ID NO: 1747024 - protein, 20 aa, Staphylococcus epidermidis
IRLLPVGGYVRMAGDGLEEP

SEQ ID NO: 1747025 - protein, 17 aa, Staphylococcus epidermidis
IRLRYSYLYLSKRYYII

SEQ ID NO: 1747026 - protein, 17 aa, Staphylococcus epidermidis
ISELSFGLPETWATALY

SEQ ID NO: 1747027 - protein, 23 aa, Staphylococcus epidermidis
ISFPKRVFSALGIGIVLGIALHL

SEQ ID NO: 1747028 - protein, 21 aa, Staphylococcus epidermidis
ISHTVPNEWKEFFYKSYKFVD

SEQ ID NO: 1747029 - protein, 17 aa, Staphylococcus epidermidis
ISIILSIAIIVFGSMLS

SEQ ID NO: 1747030 - protein, 20 aa, Staphylococcus epidermidis
ISILLLMGFILYFHHLTSEA

SEQ ID NO: 1747031 - protein, 18 aa, Staphylococcus epidermidis
ISKILPVIESKSAARNEI

SEQ ID NO: 1747032 - protein, 21 aa, Staphylococcus epidermidis
ISKKTKIGMRYTFKESIGNKT

SEQ ID NO: 1747033 - protein, 20 aa, Staphylococcus epidermidis
ISLIKVLKPYYPFPIIVDDA

SEQ ID NO: 1747034 - protein, 32 aa, Staphylococcus epidermidis
ISLNTRLDSNRSFRFIGKVNLGNRYEGYSPDG

SEQ ID NO: 1747035 - protein, 35 aa, Staphylococcus epidermidis
ISLNTRLDSNRSFRFTGKVNLGNRYEGYSPDGVVG

SEQ ID NO: 1747036 - protein, 23 aa, Staphylococcus epidermidis
ISMLKLKLKWRVAVSSLLYGILN

SEQ ID NO: 1747037 - protein, 23 aa, Staphylococcus epidermidis
ISPNEFKFGLSFLTRSVALARFP

SEQ ID NO: 1747038 - protein, 25 aa, Staphylococcus epidermidis
ISRGYRQILKWSLNHKWIVIIVSIV

SEQ ID NO: 1747039 - protein, 18 aa, Staphylococcus epidermidis
ISSLALAAPLAFGNASAH

SEQ ID NO: 1747040 - protein, 17 aa, Staphylococcus epidermidis
ISSLYGILILLFVLSII

SEQ ID NO: 1747041 - protein, 25 aa, Staphylococcus epidermidis
ISTPLEVPVKVWVYNFDFPQPIYKI

SEQ ID NO: 1747042 - protein, 17 aa, Staphylococcus epidermidis
ITCKALIGLNAQRLSVS

SEQ ID NO: 1747043 - protein, 19 aa, Staphylococcus epidermidis
ITFAIAIKFIALLLVIPGW

SEQ ID NO: 1747044 - protein, 27 aa, Staphylococcus epidermidis
ITLENASWWKSFQFFDESETELPTTVV

SEQ ID NO: 1747045 - protein, 25 aa, Staphylococcus epidermidis
ITLPLLRPGIFSGWILIFCISMREL

SEQ ID NO: 1747046 - protein, 19 aa, Staphylococcus epidermidis
ITPIFAISEGWVWTITIVG

SEQ ID NO: 1747047 - protein, 25 aa, Staphylococcus epidermidis
ITTKRLKDGYQWDILFNSNHKGHEY

SEQ ID NO: 1747048 - protein, 17 aa, Staphylococcus epidermidis
ITYLIPLLIAFSGGRLI

SEQ ID NO: 1747049 - protein, 18 aa, Staphylococcus epidermidis
IVDGQFKSVDAFKNLKIP

SEQ ID NO: 1747050 - protein, 18 aa, Staphylococcus epidermidis
IVFFCIFLIFSPIGKLKL

SEQ ID NO: 1747051 - protein, 18 aa, Staphylococcus epidermidis
IVLIIESYINFIIISCIS

SEQ ID NO: 1747052 - protein, 17 aa, Staphylococcus epidermidis
IVLLAFVLLVFVFRSIL

SEQ ID NO: 1747053 - protein, 23 aa, Staphylococcus epidermidis
IVLVGLIGFRWSKHQHIENQVLK

SEQ ID NO: 1747054 - protein, 17 aa, Staphylococcus epidermidis
IVPRWFWFYIILVSIVF

SEQ ID NO: 1747055 - protein, 23 aa, Staphylococcus epidermidis
IVQNGRGVYKWAVGNVPNIIHEV

SEQ ID NO: 1747056 - protein, 18 aa, Staphylococcus epidermidis
IVTSCFFTIVAFILFLVL

SEQ ID NO: 1747057 - protein, 18 aa, Staphylococcus epidermidis
IVVDGEFNSVDALKNLKI

SEQ ID NO: 1747058 - protein, 17 aa, Staphylococcus epidermidis
IVVGIAIFTFIIWISLV

SEQ ID NO: 1747059 - protein, 17 aa, Staphylococcus epidermidis
IVVGPNFYMGIGTPGGN

SEQ ID NO: 1747060 - protein, 17 aa, Staphylococcus epidermidis
IVVGWKFLSRTTAIYTA

SEQ ID NO: 1747061 - protein, 18 aa, Staphylococcus epidermidis
IWVAIKFLAVYIYQLLTS

SEQ ID NO: 1747062 - protein, 18 aa, Staphylococcus epidermidis
IWYVFSWILIKTVFTIRK

SEQ ID NO: 1747063 - protein, 17 aa, Staphylococcus epidermidis
IYAISLVLFLPFLVLSI

SEQ ID NO: 1747064 - protein, 20 aa, Staphylococcus epidermidis
IYHSFLLKKWYLFLYLILIL

SEQ ID NO: 1747065 - protein, 17 aa, Staphylococcus epidermidis
IYICWLGIFFAFTFMNI

SEQ ID NO: 1747066 - protein, 17 aa, Staphylococcus epidermidis
IYKAQLYLAPYSPKGYI

SEQ ID NO: 1747067 - protein, 18 aa, Staphylococcus epidermidis
IYQNLTFDSIVFRNALQY

SEQ ID NO: 1747068 - protein, 22 aa, Staphylococcus epidermidis
IYVFRFIWVFLWYKDFYFPKNI

SEQ ID NO: 1747069 - protein, 23 aa, Staphylococcus epidermidis
IYVSLRFEWRMGLSAVLALLHDV

SEQ ID NO: 1747070 - protein, 28 aa, Staphylococcus epidermidis
KADPRNVGGGGAFGAFVSTDRNGMATTE

SEQ ID NO: 1747071 - protein, 22 aa, Staphylococcus epidermidis
KAFGEFEFWFALIKVVTIILMI

SEQ ID NO: 1747072 - protein, 17 aa, Staphylococcus epidermidis
KAIFPFIIASGFIADTT

SEQ ID NO: 1747073 - protein, 22 aa, Staphylococcus epidermidis
KALNLNLGFAQWGFKQKPNESY

SEQ ID NO: 1747074 - protein, 17 aa, Staphylococcus epidermidis
KAPRSFISPSIVVGPNF

SEQ ID NO: 1747075 - protein, 23 aa, Staphylococcus epidermidis
KASRRFSGLLARLESQDMVSSII

SEQ ID NO: 1747076 - protein, 18 aa, Staphylococcus epidermidis
KDADGEDVRVTITDHDDF

SEQ ID NO: 1747077 - protein, 19 aa, Staphylococcus epidermidis
KDEGLRLINSDVPQPQQKA

SEQ ID NO: 1747078 - protein, 18 aa, Staphylococcus epidermidis
KDGDDFLKNGGILREKGT

SEQ ID NO: 1747079 - protein, 17 aa, Staphylococcus epidermidis
KDIIPPKTIAGEVDGTV

SEQ ID NO: 1747080 - protein, 22 aa, Staphylococcus epidermidis
KDKFELGEAFPVTIAIKDDHKL

SEQ ID NO: 1747081 - protein, 18 aa, Staphylococcus epidermidis
KDRPVVFKLQAMDTMTSF

SEQ ID NO: 1747082 - protein, 21 aa, Staphylococcus epidermidis
KDTFSWSRWLPHMTLGAQNIR

SEQ ID NO: 1747083 - protein, 19 aa, Staphylococcus epidermidis
KDYTAYMLAEILKGTFKAY

SEQ ID NO: 1747084 - protein, 17 aa, Staphylococcus epidermidis
KEFVVSFVIAILVVAIS

SEQ ID NO: 1747085 - protein, 34 aa, Staphylococcus epidermidis
KEGDTFTIKYGQYIRPGGLELPAIKTQLRSKDGS

SEQ ID NO: 1747086 - protein, 17 aa, Staphylococcus epidermidis
KELKLIMTLGFILGGII

SEQ ID NO: 1747087 - protein, 19 aa, Staphylococcus epidermidis
KEPFVYFVIWGIFVESLTL

SEQ ID NO: 1747088 - protein, 21 aa, Staphylococcus epidermidis
KEVFQLLMWMGFIILISLIVW

SEQ ID NO: 1747089 - protein, 18 aa, Staphylococcus epidermidis
KFHVWRVAIQTDKHDYVG

SEQ ID NO: 1747090 - protein, 29 aa, Staphylococcus epidermidis
KFTVGTASIIVGSFLFFGQTQAHAEEFER

SEQ ID NO: 1747091 - protein, 30 aa, Staphylococcus epidermidis
KFTVGTASIIVGSFLFFGQTQAHAEEFERV

SEQ ID NO: 1747092 - protein, 17 aa, Staphylococcus epidermidis
KGLLASIASILGLSGLA

SEQ ID NO: 1747093 - protein, 23 aa, Staphylococcus epidermidis
KGLLLKILFNFGLPLIVALLHAL

SEQ ID NO: 1747094 - protein, 17 aa, Staphylococcus epidermidis
KGNHIPALIGWVGQVGW

SEQ ID NO: 1747095 - protein, 17 aa, Staphylococcus epidermidis
KHLLIRFRYSYLYLSKR

SEQ ID NO: 1747096 - protein, 21 aa, Staphylococcus epidermidis
KHLYKCLLFLNICIFIVHILK

SEQ ID NO: 1747097 - protein, 18 aa, Staphylococcus epidermidis
KHTGWLIVLSIIFVLLIA

SEQ ID NO: 1747098 - protein, 19 aa, Staphylococcus epidermidis
KIEAIKSLFSFKQPPLAHV

SEQ ID NO: 1747099 - protein, 17 aa, Staphylococcus epidermidis
KIFELMLIFSIIIFIFF

SEQ ID NO: 1747100 - protein, 18 aa, Staphylococcus epidermidis
KISPRFSLIFLIIIYLTI

SEQ ID NO: 1747101 - protein, 21 aa, Staphylococcus epidermidis
KKAFEWPLFIIFGLVFLLLVP

SEQ ID NO: 1747102 - protein, 18 aa, Staphylococcus epidermidis
KKLAHSHLSNAQIVNQLK

SEQ ID NO: 1747103 - protein, 17 aa, Staphylococcus epidermidis
KKSAAKTTALVGGAFTF

SEQ ID NO: 1747104 - protein, 18 aa, Staphylococcus epidermidis
KKSAAKTTALVGGAFTFN

SEQ ID NO: 1747105 - protein, 20 aa, Staphylococcus epidermidis
KKTLRYGTASALTLALYLFN

SEQ ID NO: 1747106 - protein, 22 aa, Staphylococcus epidermidis
KKTRIIKALSEMSPKVRNLIAE

SEQ ID NO: 1747107 - protein, 21 aa, Staphylococcus epidermidis
KKTWFKFFIGVLLIGLLASII

SEQ ID NO: 1747108 - protein, 17 aa, Staphylococcus epidermidis
KKYIVTQAVRPTGTGNV

SEQ ID NO: 1747109 - protein, 21 aa, Staphylococcus epidermidis
KLDLKAHKKLAAKQRIQQKAN

SEQ ID NO: 1747110 - protein, 20 aa, Staphylococcus epidermidis
KLFGELEFWFAIIKIATIIA

SEQ ID NO: 1747111 - protein, 20 aa, Staphylococcus epidermidis
KLGETFFGYLIWYSIGRFFV

SEQ ID NO: 1747112 - protein, 26 aa, Staphylococcus epidermidis
KLPDNVHRLKVQFLPMNEIHSDFKRI

SEQ ID NO: 1747113 - protein, 19 aa, Staphylococcus epidermidis
KLYLVISILLPVVFYLLFT

SEQ ID NO: 1747114 - protein, 19 aa, Staphylococcus epidermidis
KNFFPSWAFIAIIVSTAIA

SEQ ID NO: 1747115 - protein, 18 aa, Staphylococcus epidermidis
KNQKGMIVQQDWNGKNNK

SEQ ID NO: 1747116 - protein, 24 aa, Staphylococcus epidermidis
KNQYPVIFVHGFVGLVGEDSFDLY

SEQ ID NO: 1747117 - protein, 20 aa, Staphylococcus epidermidis
KNRLTLVVVIAFILFLILLF

SEQ ID NO: 1747118 - protein, 19 aa, Staphylococcus epidermidis
KNTKLGMRYTYKNTIDNKT

SEQ ID NO: 1747119 - protein, 20 aa, Staphylococcus epidermidis
KNVYFQYGFRNSVLKNINLN

SEQ ID NO: 1747120 - protein, 17 aa, Staphylococcus epidermidis
KNYRIGKPTSFESASEE

SEQ ID NO: 1747121 - protein, 18 aa, Staphylococcus epidermidis
KPQARQALIAKVNEKQSA

SEQ ID NO: 1747122 - protein, 24 aa, Staphylococcus epidermidis
KPTVWIVLLSIIFVLLIAAVLYGG

SEQ ID NO: 1747123 - protein, 21 aa, Staphylococcus epidermidis
KPYYPFPIIVDDAFVHFDKHR

SEQ ID NO: 1747124 - protein, 24 aa, Staphylococcus epidermidis
KQSKLILIFICIFTFLLMVIQSQF

SEQ ID NO: 1747125 - protein, 21 aa, Staphylococcus epidermidis
KRFKLRMPGAFMILFLLTVVA

SEQ ID NO: 1747126 - protein, 20 aa, Staphylococcus epidermidis
KRIAVPIGIHMLMNGSVVLA

SEQ ID NO: 1747127 - protein, 21 aa, Staphylococcus epidermidis
KRLPQVINEAISIFKYLTNNA

SEQ ID NO: 1747128 - protein, 20 aa, Staphylococcus epidermidis
KRLRKLPFIILIFLIILIAL

SEQ ID NO: 1747129 - protein, 23 aa, Staphylococcus epidermidis
KRLTKPLFFYTDWIKNLSNGKLF

SEQ ID NO: 1747130 - protein, 21 aa, Staphylococcus epidermidis
KRTRISMFIWLIFLLPLPFLL

SEQ ID NO: 1747131 - protein, 19 aa, Staphylococcus epidermidis
KRVAMILMIGYFIASMISV

SEQ ID NO: 1747132 - protein, 29 aa, Staphylococcus epidermidis
KSAFLSGLMLEFISLLGIGLVALEVALSL

SEQ ID NO: 1747133 - protein, 26 aa, Staphylococcus epidermidis
KSAFLSGLMLEFISMLGIGLVALEAA

SEQ ID NO: 1747134 - protein, 20 aa, Staphylococcus epidermidis
KSKDLKLIKVLKDLNKAQLE

SEQ ID NO: 1747135 - protein, 20 aa, Staphylococcus epidermidis
KSMVIPSIFLVISLLGIYNN

SEQ ID NO: 1747136 - protein, 20 aa, Staphylococcus epidermidis
KSRINWILWILFLNIILLGV

SEQ ID NO: 1747137 - protein, 23 aa, Staphylococcus epidermidis
KSVQPELDKAISLLQNKENNDAL

SEQ ID NO: 1747138 - protein, 22 aa, Staphylococcus epidermidis
KTETPLRHVIPFNEENRYLVMP

SEQ ID NO: 1747139 - protein, 22 aa, Staphylococcus epidermidis
KTGHSPWRYLIVMFYFVPYILF

SEQ ID NO: 1747140 - protein, 17 aa, Staphylococcus epidermidis
KTGIATLTPDAYSQKGA

SEQ ID NO: 1747141 - protein, 23 aa, Staphylococcus epidermidis
KTIAGEVDGTVNIDKQLNNFKNL

SEQ ID NO: 1747142 - protein, 20 aa, Staphylococcus epidermidis
KTILPRVDTKAVARSVLNAL

SEQ ID NO: 1747143 - protein, 24 aa, Staphylococcus epidermidis
KTKLRSVLPGALFTSIIWLVGSFL

SEQ ID NO: 1747144 - protein, 21 aa, Staphylococcus epidermidis
KTRIIKALSEMSPKVRNLIAE

SEQ ID NO: 1747145 - protein, 43 aa, Staphylococcus epidermidis
KTRVKLYKSGKSWVKASINEIELLKTMGLPFLSKNEIQENVTE

SEQ ID NO: 1747146 - protein, 20 aa, Staphylococcus epidermidis
KTYIKHFLLFNGLMGGLSFV

SEQ ID NO: 1747147 - protein, 18 aa, Staphylococcus epidermidis
KVELPIAMPVIMAGIRTA

SEQ ID NO: 1747148 - protein, 22 aa, Staphylococcus epidermidis
KVFKLEIKWPFWLSQTGLIFLG

SEQ ID NO: 1747149 - protein, 21 aa, Staphylococcus epidermidis
KVHLMKECLERGINMISSMGA

SEQ ID NO: 1747150 - protein, 17 aa, Staphylococcus epidermidis
KVILRFWPFNDMKYNFN

SEQ ID NO: 1747151 - protein, 23 aa, Staphylococcus epidermidis
KVKALKINNRWKFDSSVSNISIN

SEQ ID NO: 1747152 - protein, 17 aa, Staphylococcus epidermidis
KVNLSFAQSDFYTQIES

SEQ ID NO: 1747153 - protein, 23 aa, Staphylococcus epidermidis
KVTLKDEKGNIISTTTTDENGKY

SEQ ID NO: 1747154 - protein, 18 aa, Staphylococcus epidermidis
KVTLKDKNGNAIGTTTTD

SEQ ID NO: 1747155 - protein, 18 aa, Staphylococcus epidermidis
KVTLKNKNGDTIGTTTTD

SEQ ID NO: 1747156 - protein, 19 aa, Staphylococcus epidermidis
KVVLMILMFIGRVGLISFI

SEQ ID NO: 1747157 - protein, 18 aa, Staphylococcus epidermidis
KVYQAFVSVEVPKIGYKG

SEQ ID NO: 1747158 - protein, 19 aa, Staphylococcus epidermidis
KWGFPRWASILTIFIGLIA

SEQ ID NO: 1747159 - protein, 19 aa, Staphylococcus epidermidis
KWIACLFVAFSVFTSYTAY

SEQ ID NO: 1747160 - protein, 19 aa, Staphylococcus epidermidis
KWPISILVIIVIALSLIFS

SEQ ID NO: 1747161 - protein, 20 aa, Staphylococcus epidermidis
KYGPRPLIFAGFTLLTICTL

SEQ ID NO: 1747162 - protein, 17 aa, Staphylococcus epidermidis
KYLIYRIGKDDASGLAA

SEQ ID NO: 1747163 - protein, 18 aa, Staphylococcus epidermidis
KYRIRGIVGNSETIHAFA

SEQ ID NO: 1747164 - protein, 19 aa, Staphylococcus epidermidis
KYVRKKLWLSIALIGSLQY

SEQ ID NO: 1747165 - protein, 18 aa, Staphylococcus epidermidis
KYWLEIFGGIAIGTVSAL

SEQ ID NO: 1747166 - protein, 21 aa, Staphylococcus epidermidis
KYYIRQVIRQVVLVLFLMTLL

SEQ ID NO: 1747167 - protein, 22 aa, Staphylococcus epidermidis
LAGLAILPSFYAWFNLWAMWDP

SEQ ID NO: 1747168 - protein, 19 aa, Staphylococcus epidermidis
LANCLKDWIGGVMSPLIVL

SEQ ID NO: 1747169 - protein, 19 aa, Staphylococcus epidermidis
LAPMLYKAAKWITSLANKF

SEQ ID NO: 1747170 - protein, 18 aa, Staphylococcus epidermidis
LCPMLNWFIPIKCTELTY

SEQ ID NO: 1747171 - protein, 18 aa, Staphylococcus epidermidis
LCTIIGGLIAVWCRNFIE

SEQ ID NO: 1747172 - protein, 24 aa, Staphylococcus epidermidis
LDKARPKIEAIVPQVSKKRDALNA

SEQ ID NO: 1747173 - protein, 17 aa, Staphylococcus epidermidis
LDPALLRPGRFDRQIQV

SEQ ID NO: 1747174 - protein, 17 aa, Staphylococcus epidermidis
LDPRAKLIFVFFFILLI

SEQ ID NO: 1747175 - protein, 19 aa, Staphylococcus epidermidis
LDPRAKLIFVFFFILLIFF

SEQ ID NO: 1747176 - protein, 21 aa, Staphylococcus epidermidis
LDPRAKLIFVFVFIIFIFFCH

SEQ ID NO: 1747177 - protein, 22 aa, Staphylococcus epidermidis
LEDVFKIRACLRFDSKKDHKNI

SEQ ID NO: 1747178 - protein, 20 aa, Staphylococcus epidermidis
LEEAKQLAIAHLNTLNDLND

SEQ ID NO: 1747179 - protein, 23 aa, Staphylococcus epidermidis
LEILPRFNKIIVMNDGEIIENGS

SEQ ID NO: 1747180 - protein, 26 aa, Staphylococcus epidermidis
LENGEGLPIDGWRFYWNQQSTGTTSD

SEQ ID NO: 1747181 - protein, 20 aa, Staphylococcus epidermidis
LFFWFFKLHYSFGHIINSKI

SEQ ID NO: 1747182 - protein, 18 aa, Staphylococcus epidermidis
LFGELEFWLSIIKVITIF

SEQ ID NO: 1747183 - protein, 19 aa, Staphylococcus epidermidis
LFHPFKPYYIFKMRIPFTP

SEQ ID NO: 1747184 - protein, 17 aa, Staphylococcus epidermidis
LFHPFKPYYIFRFRIPF

SEQ ID NO: 1747185 - protein, 21 aa, Staphylococcus epidermidis
LFILLTCRFIMGFAIGMDSPV

SEQ ID NO: 1747186 - protein, 18 aa, Staphylococcus epidermidis
LFIMDWKLTLLTFITIPV

SEQ ID NO: 1747187 - protein, 18 aa, Staphylococcus epidermidis
LFIMSVIVIIGFVLNMFI

SEQ ID NO: 1747188 - protein, 23 aa, Staphylococcus epidermidis
LFKKLSWPYGLIIAAVIITSLGS

SEQ ID NO: 1747189 - protein, 21 aa, Staphylococcus epidermidis
LFKNILRFIGLVILLDILMFL

SEQ ID NO: 1747190 - protein, 17 aa, Staphylococcus epidermidis
LFLRNIRTTAISVVSIP

SEQ ID NO: 1747191 - protein, 19 aa, Staphylococcus epidermidis
LFMKSRFWLPLIISSMVFS

SEQ ID NO: 1747192 - protein, 24 aa, Staphylococcus epidermidis
LFSKRFWPSLKFLLPIIIGMGLAI

SEQ ID NO: 1747193 - protein, 18 aa, Staphylococcus epidermidis
LFVICMFVSISMGTSVGT

SEQ ID NO: 1747194 - protein, 23 aa, Staphylococcus epidermidis
LGELIRWLLVFGFIFQLPILFMG

SEQ ID NO: 1747195 - protein, 18 aa, Staphylococcus epidermidis
LGFLYKYIIAYFIQVYAV

SEQ ID NO: 1747196 - protein, 18 aa, Staphylococcus epidermidis
LGGFSWPIVLILLILFFF

SEQ ID NO: 1747197 - protein, 18 aa, Staphylococcus epidermidis
LGGSQSYLFFGSLPVSKK

SEQ ID NO: 1747198 - protein, 19 aa, Staphylococcus epidermidis
LGILCYIFWGIYLKEGMYQ

SEQ ID NO: 1747199 - protein, 31 aa, Staphylococcus epidermidis
LGLFLMWRYAHWKIWLKLVVSSVYTIGLVLT

SEQ ID NO: 1747200 - protein, 30 aa, Staphylococcus epidermidis
LGLFLMWRYAHWKNWLKLIVSSVYIISLVL

SEQ ID NO: 1747201 - protein, 18 aa, Staphylococcus epidermidis
LGLMIPLLILISMVVFSL

SEQ ID NO: 1747202 - protein, 18 aa, Staphylococcus epidermidis
LGSWKAPYSIVFVLDVFS

SEQ ID NO: 1747203 - protein, 18 aa, Staphylococcus epidermidis
LGSWKAPYSIVFVVDIFS

SEQ ID NO: 1747204 - protein, 17 aa, Staphylococcus epidermidis
LHMALRLFMLLTLISGF

SEQ ID NO: 1747205 - protein, 23 aa, Staphylococcus epidermidis
LHTNRIYFILSFVFMVTVPNTIY

SEQ ID NO: 1747206 - protein, 22 aa, Staphylococcus epidermidis
LHTNRIYFILSFVLMVTVPNTI

SEQ ID NO: 1747207 - protein, 20 aa, Staphylococcus epidermidis
LIACLAYLYFFVMKNEEQVE

SEQ ID NO: 1747208 - protein, 17 aa, Staphylococcus epidermidis
LIAIIIAVLLLFLVNTF

SEQ ID NO: 1747209 - protein, 17 aa, Staphylococcus epidermidis
LIAIIVAILLLFLVNNF

SEQ ID NO: 1747210 - protein, 32 aa, Staphylococcus epidermidis
LIAMNRYQVMPGYKVKFIFMILVTMIVFVLIN

SEQ ID NO: 1747211 - protein, 17 aa, Staphylococcus epidermidis
LIGENIFSFFIKKRWFY

SEQ ID NO: 1747212 - protein, 24 aa, Staphylococcus epidermidis
LIGFGAAFLFNWLISQDKIPQSLM

SEQ ID NO: 1747213 - protein, 17 aa, Staphylococcus epidermidis
LIGVLLLTHATYTALLL

SEQ ID NO: 1747214 - protein, 17 aa, Staphylococcus epidermidis
LIGVLLLTHATYTTLLL

SEQ ID NO: 1747215 - protein, 22 aa, Staphylococcus epidermidis
LIIFAFAFRFIVKLIPVHYIFR

SEQ ID NO: 1747216 - protein, 27 aa, Staphylococcus epidermidis
LIILSLYLKWWILFGVSIALLIIVAIA

SEQ ID NO: 1747217 - protein, 19 aa, Staphylococcus epidermidis
LIRYIKKWTRSYIMFNFAF

SEQ ID NO: 1747218 - protein, 27 aa, Staphylococcus epidermidis
LISIGNWRWIFWINIPFIFIGLIGCLL

SEQ ID NO: 1747219 - protein, 22 aa, Staphylococcus epidermidis
LISIGNWRWIFWINIPIILIGL

SEQ ID NO: 1747220 - protein, 24 aa, Staphylococcus epidermidis
LISIILAYIFKWLGLVDDVLLMVI

SEQ ID NO: 1747221 - protein, 20 aa, Staphylococcus epidermidis
LISLYLKLMVIFGIALAIFI

SEQ ID NO: 1747222 - protein, 18 aa, Staphylococcus epidermidis
LITTQGWIKISFIDHLPL

SEQ ID NO: 1747223 - protein, 24 aa, Staphylococcus epidermidis
LKAKIRAVIPWSILYEILVGIFIS

SEQ ID NO: 1747224 - protein, 17 aa, Staphylococcus epidermidis
LKANYELDDSIKEGDTF

SEQ ID NO: 1747225 - protein, 19 aa, Staphylococcus epidermidis
LKHLWSLAIEEQFYLFFPA

SEQ ID NO: 1747226 - protein, 19 aa, Staphylococcus epidermidis
LKLKMPLIRVFRVSYIINA

SEQ ID NO: 1747227 - protein, 17 aa, Staphylococcus epidermidis
LKLNGWQTFISIASIIL

SEQ ID NO: 1747228 - protein, 21 aa, Staphylococcus epidermidis
LKLRDGHIFIRKCLRTSIMFS

SEQ ID NO: 1747229 - protein, 17 aa, Staphylococcus epidermidis
LKSELLLAFSTSSSEAV

SEQ ID NO: 1747230 - protein, 19 aa, Staphylococcus epidermidis
LKVPLLIAFAVIFAGLSFG

SEQ ID NO: 1747231 - protein, 19 aa, Staphylococcus epidermidis
LKYDHEYTTHIELESVIPT

SEQ ID NO: 1747232 - protein, 17 aa, Staphylococcus epidermidis
LLAIVGFVLNMFIKHFK

SEQ ID NO: 1747233 - protein, 19 aa, Staphylococcus epidermidis
LLAIVGSLFIFGRRKKGNE

SEQ ID NO: 1747234 - protein, 17 aa, Staphylococcus epidermidis
LLAPWIAGAAMALSSVS

SEQ ID NO: 1747235 - protein, 17 aa, Staphylococcus epidermidis
LLCKRWILNMPFVSHFI

SEQ ID NO: 1747236 - protein, 20 aa, Staphylococcus epidermidis
LLFFAFRTSNNFAIQHRIIA

SEQ ID NO: 1747237 - protein, 19 aa, Staphylococcus epidermidis
LLHYIFKINEKWLLMICVL

SEQ ID NO: 1747238 - protein, 17 aa, Staphylococcus epidermidis
LLIKFKIISTLIIKIKN

SEQ ID NO: 1747239 - protein, 17 aa, Staphylococcus epidermidis
LLILLSITHVCLLLLRK

SEQ ID NO: 1747240 - protein, 17 aa, Staphylococcus epidermidis
LLLPRLGAALTVVMTVT

SEQ ID NO: 1747241 - protein, 18 aa, Staphylococcus epidermidis
LLVSLTFWSHHSFFNISV

SEQ ID NO: 1747242 - protein, 22 aa, Staphylococcus epidermidis
LLYSRPLFYFGNFMKPLIWLMN

SEQ ID NO: 1747243 - protein, 22 aa, Staphylococcus epidermidis
LMCLCSLTFFFFFSIMNIIAFD

SEQ ID NO: 1747244 - protein, 17 aa, Staphylococcus epidermidis
LMRYGGGVSYQLIEDES

SEQ ID NO: 1747245 - protein, 18 aa, Staphylococcus epidermidis
LNFKRLEKPIAIIFSLLY

SEQ ID NO: 1747246 - protein, 22 aa, Staphylococcus epidermidis
LNLFHGWPWYAVWLVLLGFGGG

SEQ ID NO: 1747247 - protein, 17 aa, Staphylococcus epidermidis
LNLKYYIRQVIRQVVLV

SEQ ID NO: 1747248 - protein, 17 aa, Staphylococcus epidermidis
LNMPFGFKKKALIKDGK

SEQ ID NO: 1747249 - protein, 25 aa, Staphylococcus epidermidis
LNNARTSLDRNVFFGPLGQSRSYTI

SEQ ID NO: 1747250 - protein, 18 aa, Staphylococcus epidermidis
LNNFKNLGYSYVGTDALK

SEQ ID NO: 1747251 - protein, 20 aa, Staphylococcus epidermidis
LNPEVIKWAKDVYGKRVLDT

SEQ ID NO: 1747252 - protein, 17 aa, Staphylococcus epidermidis
LNQRIGDHMAYKVKTDL

SEQ ID NO: 1747253 - protein, 22 aa, Staphylococcus epidermidis
LPFRRIISFFLVFTMLFSAGVV

SEQ ID NO: 1747254 - protein, 20 aa, Staphylococcus epidermidis
LPIHAKWLIASFYIFMLMIM

SEQ ID NO: 1747255 - protein, 18 aa, Staphylococcus epidermidis
LPLALPLILSGIRLSSVY

SEQ ID NO: 1747256 - protein, 17 aa, Staphylococcus epidermidis
LPLIILMFASSILSYFI

SEQ ID NO: 1747257 - protein, 25 aa, Staphylococcus epidermidis
LQLQDGYRYYSFIDTIGVYSGSHLY

SEQ ID NO: 1747258 - protein, 18 aa, Staphylococcus epidermidis
LQSFKVIFAIIITLITVI

SEQ ID NO: 1747259 - protein, 18 aa, Staphylococcus epidermidis
LREDFLYLRAIEREQYRK

SEQ ID NO: 1747260 - protein, 19 aa, Staphylococcus epidermidis
LREGHIFIRKCLRTSIMFS

SEQ ID NO: 1747261 - protein, 17 aa, Staphylococcus epidermidis
LSFSCAMAFSAASQIYL

SEQ ID NO: 1747262 - protein, 17 aa, Staphylococcus epidermidis
LSIFSFFTANLIFGIIF

SEQ ID NO: 1747263 - protein, 17 aa, Staphylococcus epidermidis
LSIPEFVIMIALASFFH

SEQ ID NO: 1747264 - protein, 18 aa, Staphylococcus epidermidis
LSIPEFVIMIALASFFHP

SEQ ID NO: 1747265 - protein, 23 aa, Staphylococcus epidermidis
LSISNWRRIFAFLTFIAVIVLVG

SEQ ID NO: 1747266 - protein, 17 aa, Staphylococcus epidermidis
LSKWRTKIGYVMQSNSM

SEQ ID NO: 1747267 - protein, 18 aa, Staphylococcus epidermidis
LSLPFAMFGLFASMFFII

SEQ ID NO: 1747268 - protein, 25 aa, Staphylococcus epidermidis
LSNARTSLDRNVFFGTLGQSRSYTI

SEQ ID NO: 1747269 - protein, 18 aa, Staphylococcus epidermidis
LSSYYLFNWFFFVYHLGV

SEQ ID NO: 1747270 - protein, 19 aa, Staphylococcus epidermidis
LSSYYLFNWFFVVYHLGVI

SEQ ID NO: 1747271 - protein, 22 aa, Staphylococcus epidermidis
LSYLTQMCVITFLMFTSAASGY

SEQ ID NO: 1747272 - protein, 18 aa, Staphylococcus epidermidis
LTDSFAIPKIKDNSGEII

SEQ ID NO: 1747273 - protein, 20 aa, Staphylococcus epidermidis
LTDWCDLAFVTKLVLGQSEQ

SEQ ID NO: 1747274 - protein, 18 aa, Staphylococcus epidermidis
LTGICYYSSIKLTNPSIA

SEQ ID NO: 1747275 - protein, 23 aa, Staphylococcus epidermidis
LTGLLYGFWLVFAKRRKNEEEEE

SEQ ID NO: 1747276 - protein, 18 aa, Staphylococcus epidermidis
LTIKETFLTWSLLETIIS

SEQ ID NO: 1747277 - protein, 17 aa, Staphylococcus epidermidis
LTLMIPLLIVVTFMTFM

SEQ ID NO: 1747278 - protein, 21 aa, Staphylococcus epidermidis
LTNRFSVRPVLLWTLFVFIIG

SEQ ID NO: 1747279 - protein, 17 aa, Staphylococcus epidermidis
LTPKYNVGDYVWEDTNK

SEQ ID NO: 1747280 - protein, 23 aa, Staphylococcus epidermidis
LTPKYNVGDYVWEDTNKDGIQDD

SEQ ID NO: 1747281 - protein, 17 aa, Staphylococcus epidermidis
LTYTVTLPENFEYVENS

SEQ ID NO: 1747282 - protein, 18 aa, Staphylococcus epidermidis
LVACGFVGAVAWTIYQLT

SEQ ID NO: 1747283 - protein, 22 aa, Staphylococcus epidermidis
LVADLLGIFAMKKLFVNNKMSG

SEQ ID NO: 1747284 - protein, 19 aa, Staphylococcus epidermidis
LVGGLLLAFYFYRDNPDLK

SEQ ID NO: 1747285 - protein, 17 aa, Staphylococcus epidermidis
LVGIDFLAVMGFASAIS

SEQ ID NO: 1747286 - protein, 19 aa, Staphylococcus epidermidis
LVIQTICVLLGIWVYNLDK

SEQ ID NO: 1747287 - protein, 19 aa, Staphylococcus epidermidis
LVLMLPLLIVVSFMTFMMT

SEQ ID NO: 1747288 - protein, 17 aa, Staphylococcus epidermidis
LVLYLNWNIDVYKKEKL

SEQ ID NO: 1747289 - protein, 25 aa, Staphylococcus epidermidis
LVMLLAPFLFDWTWSQSVYRGLVLL

SEQ ID NO: 1747290 - protein, 17 aa, Staphylococcus epidermidis
LVNWRKNLGYVMQNSGV

SEQ ID NO: 1747291 - protein, 18 aa, Staphylococcus epidermidis
LVQVRWLFRVTALVVFGL

SEQ ID NO: 1747292 - protein, 17 aa, Staphylococcus epidermidis
LYAGRISLAIGFTSTIG

SEQ ID NO: 1747293 - protein, 17 aa, Staphylococcus epidermidis
LYLAPYSPKGYIEKLGQ

SEQ ID NO: 1747294 - protein, 18 aa, Staphylococcus epidermidis
LYRYKNFRYFIGEDEVHV

SEQ ID NO: 1747295 - protein, 18 aa, Staphylococcus epidermidis
LYVVFKMIFWFNPALYIS

SEQ ID NO: 1747296 - protein, 20 aa, Staphylococcus epidermidis
MANSFSMWRLFGISIIAIIG

SEQ ID NO: 1747297 - protein, 17 aa, Staphylococcus epidermidis
MATEMFGVFNPLTMAMM

SEQ ID NO: 1747298 - protein, 24 aa, Staphylococcus epidermidis
MATNLGWRSIFIVSIVLTILAMFL

SEQ ID NO: 1747299 - protein, 17 aa, Staphylococcus epidermidis
MCPEFAIGMGPKIFSFR

SEQ ID NO: 1747300 - protein, 20 aa, Staphylococcus epidermidis
MGGAWFVRFHYFKNNQLNLY

SEQ ID NO: 1747301 - protein, 18 aa, Staphylococcus epidermidis
MGIYVLRSFGMAFIMMPI

SEQ ID NO: 1747302 - protein, 17 aa, Staphylococcus epidermidis
MHIVMLLAALSMAGVPL

SEQ ID NO: 1747303 - protein, 23 aa, Staphylococcus epidermidis
MIKGEGFNNIWFDLSILLVFIIG

SEQ ID NO: 1747304 - protein, 18 aa, Staphylococcus epidermidis
MINPILIGFFVFFFTFLI

SEQ ID NO: 1747305 - protein, 18 aa, Staphylococcus epidermidis
MIPNIFSFFASVLVLWIY

SEQ ID NO: 1747306 - protein, 19 aa, Staphylococcus epidermidis
MITVALVWWSAFTILTGMI

SEQ ID NO: 1747307 - protein, 25 aa, Staphylococcus epidermidis
MKMRVVRRRIALFGGILLAIILILL

SEQ ID NO: 1747308 - protein, 24 aa, Staphylococcus epidermidis
MLGFYRLPGLVAIIALTAYIYLTL

SEQ ID NO: 1747309 - protein, 17 aa, Staphylococcus epidermidis
MLNKTGKDYDLQEQRGY

SEQ ID NO: 1747310 - protein, 26 aa, Staphylococcus epidermidis
MLNMRYSHWLRFVWPVVAFVLVFGGG

SEQ ID NO: 1747311 - protein, 23 aa, Staphylococcus epidermidis
MLNVRYSHWLRFVWPVVAFVLIF

SEQ ID NO: 1747312 - protein, 22 aa, Staphylococcus epidermidis
MNIRILSGFLFLLAAVVTIPLV

SEQ ID NO: 1747313 - protein, 17 aa, Staphylococcus epidermidis
MPLIRVFRVSYIINALN

SEQ ID NO: 1747314 - protein, 20 aa, Staphylococcus epidermidis
MPLTLLAMIAFYIAIFSIMK

SEQ ID NO: 1747315 - protein, 20 aa, Staphylococcus epidermidis
MPLYMMFSILLTYYVSMSIA

SEQ ID NO: 1747316 - protein, 17 aa, Staphylococcus epidermidis
MQASVSIVPAVESDKLK

SEQ ID NO: 1747317 - protein, 25 aa, Staphylococcus epidermidis
MQAWGWRIPFILGLFLGLFGLYLRR

SEQ ID NO: 1747318 - protein, 23 aa, Staphylococcus epidermidis
MQGMPAWVWSCIFLVIIFALNSL

SEQ ID NO: 1747319 - protein, 23 aa, Staphylococcus epidermidis
MRVVRKRIAVFGGILLAAILILI

SEQ ID NO: 1747320 - protein, 19 aa, Staphylococcus epidermidis
MSICNKWTLFLAILLSLIL

SEQ ID NO: 1747321 - protein, 17 aa, Staphylococcus epidermidis
MSSYNFKQGDKIGTPGF

SEQ ID NO: 1747322 - protein, 17 aa, Staphylococcus epidermidis
MSTWTLYYWGWWLSWSP

SEQ ID NO: 1747323 - protein, 17 aa, Staphylococcus epidermidis
MVFLRPMVEQIIYRYLI

SEQ ID NO: 1747324 - protein, 21 aa, Staphylococcus epidermidis
MVFTAIALVAVWFIFNQLVAG

SEQ ID NO: 1747325 - protein, 20 aa, Staphylococcus epidermidis
MVLTAIALVIVWFIFNQIVA

SEQ ID NO: 1747326 - protein, 20 aa, Staphylococcus epidermidis
NAGLSWKATREYQHILDDMN

SEQ ID NO: 1747327 - protein, 17 aa, Staphylococcus epidermidis
NAIINKPIRSVEEVNNA

SEQ ID NO: 1747328 - protein, 18 aa, Staphylococcus epidermidis
NALIPWGVSGTFIMGALK

SEQ ID NO: 1747329 - protein, 20 aa, Staphylococcus epidermidis
NAYDYKISCVHIPKNGEEGL

SEQ ID NO: 1747330 - protein, 26 aa, Staphylococcus epidermidis
NDAKPKIEAIVPKVRKKRSALDELQA

SEQ ID NO: 1747331 - protein, 23 aa, Staphylococcus epidermidis
NDFYSRLTGILGFLVQISPITIV

SEQ ID NO: 1747332 - protein, 18 aa, Staphylococcus epidermidis
NDNPRINLLAATEDTKPK

SEQ ID NO: 1747333 - protein, 22 aa, Staphylococcus epidermidis
NDRYGRTLAYVWISDKRMFNEE

SEQ ID NO: 1747334 - protein, 17 aa, Staphylococcus epidermidis
NEDFRLFSTDNKNGKLT

SEQ ID NO: 1747335 - protein, 25 aa, Staphylococcus epidermidis
NEIEIPKWLLFFSVLLSIIGSIFQL

SEQ ID NO: 1747336 - protein, 18 aa, Staphylococcus epidermidis
NEKLRYLLNIAKLEDIKN

SEQ ID NO: 1747337 - protein, 22 aa, Staphylococcus epidermidis
NENRTANLQSMFTNIDTKNHTV

SEQ ID NO: 1747338 - protein, 21 aa, Staphylococcus epidermidis
NFWLYWKTMFAFEPWHSAMEM

SEQ ID NO: 1747339 - protein, 38 aa, Staphylococcus epidermidis
NGADNLTIDSGFYKTPKYSVGDYVWKDTNKDSIQDDNE

SEQ ID NO: 1747340 - protein, 22 aa, Staphylococcus epidermidis
NGNWFWKLTLIFFGLLVKLCLN

SEQ ID NO: 1747341 - protein, 17 aa, Staphylococcus epidermidis
NGSGIGLYFANIVLQQY

SEQ ID NO: 1747342 - protein, 22 aa, Staphylococcus epidermidis
NGSTVRSGLIGSVTNHDIVITL

SEQ ID NO: 1747343 - protein, 18 aa, Staphylococcus epidermidis
NGVKGAANGIAWVIESAH

SEQ ID NO: 1747344 - protein, 23 aa, Staphylococcus epidermidis
NHKGHEYMYYWFGLPSDQTPTGP

SEQ ID NO: 1747345 - protein, 20 aa, Staphylococcus epidermidis
NHLWLIPGLCICGIALFTSL

SEQ ID NO: 1747346 - protein, 18 aa, Staphylococcus epidermidis
NIHIWKPAIDFFSILSKA

SEQ ID NO: 1747347 - protein, 23 aa, Staphylococcus epidermidis
NIIFCLLGTLIIALGVNMFVIPG

SEQ ID NO: 1747348 - protein, 26 aa, Staphylococcus epidermidis
NIRYKLRPVNIETPREVTFNESLKYK

SEQ ID NO: 1747349 - protein, 17 aa, Staphylococcus epidermidis
NISESLAIFSLILLLVV

SEQ ID NO: 1747350 - protein, 21 aa, Staphylococcus epidermidis
NKEEIRTLLNIAGREGAFNEV

SEQ ID NO: 1747351 - protein, 23 aa, Staphylococcus epidermidis
NKELKLIMSLGFILGGIIGLFQG

SEQ ID NO: 1747352 - protein, 17 aa, Staphylococcus epidermidis
NKIKFSLVIGILVLISY

SEQ ID NO: 1747353 - protein, 17 aa, Staphylococcus epidermidis
NKKEAIETILATRLNQE

SEQ ID NO: 1747354 - protein, 24 aa, Staphylococcus epidermidis
NKKSGARPGPKVNEGHNNDLTDDH

SEQ ID NO: 1747355 - protein, 22 aa, Staphylococcus epidermidis
NKLTIVRGVDHWHSLSKDPNPE

SEQ ID NO: 1747356 - protein, 20 aa, Staphylococcus epidermidis
NKPYFYKGILLILLVCLIIA

SEQ ID NO: 1747357 - protein, 27 aa, Staphylococcus epidermidis
NKTGKDYDLQEQRGYTDSEQHNETQSN

SEQ ID NO: 1747358 - protein, 31 aa, Staphylococcus epidermidis
NKTIDSGFYKPTYNLGDYVWEDTNKDGIQDD

SEQ ID NO: 1747359 - protein, 21 aa, Staphylococcus epidermidis
NKWCFWLFMIGFNVCFLPQFI

SEQ ID NO: 1747360 - protein, 20 aa, Staphylococcus epidermidis
NKWVSIVAWLIVLGVIITPL

SEQ ID NO: 1747361 - protein, 17 aa, Staphylococcus epidermidis
NLFLPWYYLIKFIMPIV

SEQ ID NO: 1747362 - protein, 18 aa, Staphylococcus epidermidis
NLFLPWYYLIKFVMPIVI

SEQ ID NO: 1747363 - protein, 24 aa, Staphylococcus epidermidis
NLKDGEFHFALKNDKEEVLATGVN

SEQ ID NO: 1747364 - protein, 20 aa, Staphylococcus epidermidis
NLLLELAVIFGISALVTSFL

SEQ ID NO: 1747365 - protein, 26 aa, Staphylococcus epidermidis
NLQREMWKYLSIIGVIVLFTVYLASR

SEQ ID NO: 1747366 - protein, 27 aa, Staphylococcus epidermidis
NLTDWIKNSGGTTFSLSMTASTGGAKN

SEQ ID NO: 1747367 - protein, 22 aa, Staphylococcus epidermidis
NMLKWGTLVAIGFIIVATFMFM

SEQ ID NO: 1747368 - protein, 17 aa, Staphylococcus epidermidis
NMYLPFINKCILKMERD

SEQ ID NO: 1747369 - protein, 19 aa, Staphylococcus epidermidis
NNPEFKKAMGILLISTVGY

SEQ ID NO: 1747370 - protein, 17 aa, Staphylococcus epidermidis
NNQCPKCGQSLPKNNKA

SEQ ID NO: 1747371 - protein, 19 aa, Staphylococcus epidermidis
NPALIMLLAGLGLLGLFRN

SEQ ID NO: 1747372 - protein, 19 aa, Staphylococcus epidermidis
NPTYSLGDYVWLDKNKNGV

SEQ ID NO: 1747373 - protein, 23 aa, Staphylococcus epidermidis
NQIMPVTMPFHLSIGNLLSVVVI

SEQ ID NO: 1747374 - protein, 23 aa, Staphylococcus epidermidis
NQPFDEWFYRALVVLVVSCSCAL

SEQ ID NO: 1747375 - protein, 26 aa, Staphylococcus epidermidis
NQTIKRFFIWLALTVLFAFLSFINYH

SEQ ID NO: 1747376 - protein, 22 aa, Staphylococcus epidermidis
NQTRISSFYGVIIYIIILFLFI

SEQ ID NO: 1747377 - protein, 18 aa, Staphylococcus epidermidis
NRNFRFFQIFTAALQSFS

SEQ ID NO: 1747378 - protein, 17 aa, Staphylococcus epidermidis
NRYSIPYFFGTVGILYD

SEQ ID NO: 1747379 - protein, 18 aa, Staphylococcus epidermidis
NSSGDAYPGNFVQAVNQY

SEQ ID NO: 1747380 - protein, 18 aa, Staphylococcus epidermidis
NSYWVWWLTYGVIALLLV

SEQ ID NO: 1747381 - protein, 18 aa, Staphylococcus epidermidis
NTCFNRWQFTTILLAPLV

SEQ ID NO: 1747382 - protein, 18 aa, Staphylococcus epidermidis
NTILRWLSIFVIPLFGII

SEQ ID NO: 1747383 - protein, 25 aa, Staphylococcus epidermidis
NTMNKRINFIFGFIVFIFAIVVLRL

SEQ ID NO: 1747384 - protein, 25 aa, Staphylococcus epidermidis
NTMNKRINFVFGFIVLIFAILVLRL

SEQ ID NO: 1747385 - protein, 21 aa, Staphylococcus epidermidis
NTREARFLPNKILNIRYKLRP

SEQ ID NO: 1747386 - protein, 21 aa, Staphylococcus epidermidis
NVNRIKVQFLPNNDIQTNYQR

SEQ ID NO: 1747387 - protein, 22 aa, Staphylococcus epidermidis
NVRMPRMLASLIIGGALAIAGL

SEQ ID NO: 1747388 - protein, 22 aa, Staphylococcus epidermidis
NYGPWRIVFVILTMFGIVMLIG

SEQ ID NO: 1747389 - protein, 18 aa, Staphylococcus epidermidis
PALIMLLAGLGLLGLFRN

SEQ ID NO: 1747390 - protein, 45 aa, Staphylococcus epidermidis
PDAYSQKGAISLNTRLDSNRSFRFTGKVNLGNRYEGYSPDGVPGG

SEQ ID NO: 1747391 - protein, 28 aa, Staphylococcus epidermidis
PDGVPGGDGIGFAFSPGPLGQIGKEGAA

SEQ ID NO: 1747392 - protein, 20 aa, Staphylococcus epidermidis
PEIVTALIFIKAVGPGSFSG

SEQ ID NO: 1747393 - protein, 31 aa, Staphylococcus epidermidis
PGYIYNIGFQFSFLICFFILMAQPFLKNLTP

SEQ ID NO: 1747394 - protein, 17 aa, Staphylococcus epidermidis
PILMTAIATIGALIPLL

SEQ ID NO: 1747395 - protein, 24 aa, Staphylococcus epidermidis
PILYRFVKRIHLGWFVLPVPIVLF

SEQ ID NO: 1747396 - protein, 22 aa, Staphylococcus epidermidis
PIMGSWRSAFKRAGDYAYATGG

SEQ ID NO: 1747397 - protein, 20 aa, Staphylococcus epidermidis
PIVLGLIILLGIAWGVYAFV

SEQ ID NO: 1747398 - protein, 18 aa, Staphylococcus epidermidis
PIVVGIAIFTFIIWISLV

SEQ ID NO: 1747399 - protein, 18 aa, Staphylococcus epidermidis
PKCGQSLPKNNKAKQTSS

SEQ ID NO: 1747400 - protein, 20 aa, Staphylococcus epidermidis
PKIIGGIGWVLAKITRQPKF

SEQ ID NO: 1747401 - protein, 20 aa, Staphylococcus epidermidis
PKIIGGIGWVLAKVTRQPKF

SEQ ID NO: 1747402 - protein, 17 aa, Staphylococcus epidermidis
PKIPYKVFVIFFILVSF

SEQ ID NO: 1747403 - protein, 19 aa, Staphylococcus epidermidis
PKVRKKRSALDELQASADN

SEQ ID NO: 1747404 - protein, 18 aa, Staphylococcus epidermidis
PLCFSMAMAERTGGSGNA

SEQ ID NO: 1747405 - protein, 18 aa, Staphylococcus epidermidis
PLFTGRLVDKFSVSSMNW

SEQ ID NO: 1747406 - protein, 17 aa, Staphylococcus epidermidis
PLIFAGFTLLTICTLLL

SEQ ID NO: 1747407 - protein, 17 aa, Staphylococcus epidermidis
PLSFAYVLFIVFWQVGF

SEQ ID NO: 1747408 - protein, 24 aa, Staphylococcus epidermidis
PLSGELKAIVYYNQYVQSNFSKSV

SEQ ID NO: 1747409 - protein, 20 aa, Staphylococcus epidermidis
PLSLRLNDWYTIAISMLTLG

SEQ ID NO: 1747410 - protein, 22 aa, Staphylococcus epidermidis
PNKRLLGSYASSYIDMIDRIPP

SEQ ID NO: 1747411 - protein, 24 aa, Staphylococcus epidermidis
PNLKDRFQLFLNRHVLRVISVTLC

SEQ ID NO: 1747412 - protein, 27 aa, Staphylococcus epidermidis
PPRHRRPRFPWFKTILVALIAGIIGAL

SEQ ID NO: 1747413 - protein, 25 aa, Staphylococcus epidermidis
PQVFKSMLIPIVIIITMCFVHLPTA

SEQ ID NO: 1747414 - protein, 24 aa, Staphylococcus epidermidis
PQVFKSMMIPVAIIIAMCFVHLPT

SEQ ID NO: 1747415 - protein, 17 aa, Staphylococcus epidermidis
PRAKLIFVFFFIILIFF

SEQ ID NO: 1747416 - protein, 20 aa, Staphylococcus epidermidis
PRGLGVLFFVEFWERFSYYG

SEQ ID NO: 1747417 - protein, 20 aa, Staphylococcus epidermidis
PRKSASILDIFGGCFQGLLP

SEQ ID NO: 1747418 - protein, 20 aa, Staphylococcus epidermidis
PRWFWFYIILVSIVFPFEIG

SEQ ID NO: 1747419 - protein, 19 aa, Staphylococcus epidermidis
PSEVGKYLITITTIDKDGN

SEQ ID NO: 1747420 - protein, 18 aa, Staphylococcus epidermidis
PSFWFGVFRYLTEGATII

SEQ ID NO: 1747421 - protein, 17 aa, Staphylococcus epidermidis
PSNGRWYDHIGIDKDRR

SEQ ID NO: 1747422 - protein, 24 aa, Staphylococcus epidermidis
PSQASEVFTPINPITITATDNSGK

SEQ ID NO: 1747423 - protein, 39 aa, Staphylococcus epidermidis
PTKKNHYSIRKFTVGTASIIVGSFLFFGQAHAEENPQGT

SEQ ID NO: 1747424 - protein, 31 aa, Staphylococcus epidermidis
PTSFANLRTFSRFTVLNTMAAPTTTSTTTTS

SEQ ID NO: 1747425 - protein, 17 aa, Staphylococcus epidermidis
PTSMCIATILYGMSTVM

SEQ ID NO: 1747426 - protein, 24 aa, Staphylococcus epidermidis
PVQHGWDHLDLVGMDAFDLTHTGR

SEQ ID NO: 1747427 - protein, 17 aa, Staphylococcus epidermidis
PWKRFLSHFSFYAIALQ

SEQ ID NO: 1747428 - protein, 19 aa, Staphylococcus epidermidis
PYFMIFLPFFKRNKYWGFL

SEQ ID NO: 1747429 - protein, 17 aa, Staphylococcus epidermidis
PYNLPRSRNILRASDVQ

SEQ ID NO: 1747430 - protein, 17 aa, Staphylococcus epidermidis
QCPKCGQSLPKNNKAKQ

SEQ ID NO: 1747431 - protein, 17 aa, Staphylococcus epidermidis
QDFWWPMLFNFIIISLT

SEQ ID NO: 1747432 - protein, 28 aa, Staphylococcus epidermidis
QFDNLDSGNYIIHFEKPEGMTQTTANSG

SEQ ID NO: 1747433 - protein, 23 aa, Staphylococcus epidermidis
QGIPAWVWSCIFLIIIFALNSLS

SEQ ID NO: 1747434 - protein, 18 aa, Staphylococcus epidermidis
QHTFSFKLLFSLLIIGLI

SEQ ID NO: 1747435 - protein, 24 aa, Staphylococcus epidermidis
QINVWKSLLAWRVTVFMGAQSLVF

SEQ ID NO: 1747436 - protein, 19 aa, Staphylococcus epidermidis
QKHTGWLIVLSIIFVLLIA

SEQ ID NO: 1747437 - protein, 19 aa, Staphylococcus epidermidis
QKKRIDLFFNENVNHYKHF

SEQ ID NO: 1747438 - protein, 17 aa, Staphylococcus epidermidis
QLAGLKFSISLKVIERL

SEQ ID NO: 1747439 - protein, 25 aa, Staphylococcus epidermidis
QLNNFKNLGYSYVGTDALKAPNYTE

SEQ ID NO: 1747440 - protein, 25 aa, Staphylococcus epidermidis
QNESPLRYLIAISIVILVVLGAFQL

SEQ ID NO: 1747441 - protein, 19 aa, Staphylococcus epidermidis
QPSLPIKFVIGALMAGASY

SEQ ID NO: 1747442 - protein, 23 aa, Staphylococcus epidermidis
QPTDNSFQYFVIDYNGDTKVMTV

SEQ ID NO: 1747443 - protein, 40 aa, Staphylococcus epidermidis
QPTKGEDGVVSNGFIVAVAIVLAIFGLAKKSRKDDDDQDG

SEQ ID NO: 1747444 - protein, 20 aa, Staphylococcus epidermidis
QQILEIIEAIQFYDVEAHMS

SEQ ID NO: 1747445 - protein, 21 aa, Staphylococcus epidermidis
QQKSEVFIIKELDILNNAQKA

SEQ ID NO: 1747446 - protein, 46 aa, Staphylococcus epidermidis
QQKTRVKLYKSGKSWVKASINEIELLKTMGLPFLSKNEIQENVTEK

SEQ ID NO: 1747447 - protein, 17 aa, Staphylococcus epidermidis
QRFENIVAFILLVILVK

SEQ ID NO: 1747448 - protein, 17 aa, Staphylococcus epidermidis
QRIGDHMAYKVKTDLRR

SEQ ID NO: 1747449 - protein, 19 aa, Staphylococcus epidermidis
QRKIDVEPVFGFMKAILGF

SEQ ID NO: 1747450 - protein, 20 aa, Staphylococcus epidermidis
QRKIDVEPVFGFMKAILGFT

SEQ ID NO: 1747451 - protein, 17 aa, Staphylococcus epidermidis
QRLPIYIIIFIVLWLII

SEQ ID NO: 1747452 - protein, 19 aa, Staphylococcus epidermidis
QRMVVTWVITLPISAILAA

SEQ ID NO: 1747453 - protein, 19 aa, Staphylococcus epidermidis
QRMVVTWVITLPISAILAG

SEQ ID NO: 1747454 - protein, 23 aa, Staphylococcus epidermidis
QSAQLGATVKPGSAPTQDTEVKP

SEQ ID NO: 1747455 - protein, 19 aa, Staphylococcus epidermidis
QSIDEISKILPVIEIKSAA

SEQ ID NO: 1747456 - protein, 24 aa, Staphylococcus epidermidis
QSLKDMISHAALRTEVKQLLQQAK

SEQ ID NO: 1747457 - protein, 26 aa, Staphylococcus epidermidis
QTGFNPAALMLLAGLGLLGLYRNRTK

SEQ ID NO: 1747458 - protein, 33 aa, Staphylococcus epidermidis
QTLFDKRLDAMQNFPTGWLKAMVNIPDNMNQVR

SEQ ID NO: 1747459 - protein, 21 aa, Staphylococcus epidermidis
QTPKYSLGNYVWYDTNKDGIQ

SEQ ID NO: 1747460 - protein, 18 aa, Staphylococcus epidermidis
QVFWRILLFYILAIFIIG

SEQ ID NO: 1747461 - protein, 18 aa, Staphylococcus epidermidis
QVFWRILLFYVLSIAVIA

SEQ ID NO: 1747462 - protein, 23 aa, Staphylococcus epidermidis
QVNRLGIPLSIFFGGVKMMMPNM

SEQ ID NO: 1747463 - protein, 18 aa, Staphylococcus epidermidis
QYLIWSIFRLISGITSGT

SEQ ID NO: 1747464 - protein, 20 aa, Staphylococcus epidermidis
RDIWTSSISFIFFVGVIIGI

SEQ ID NO: 1747465 - protein, 18 aa, Staphylococcus epidermidis
RDLICAIMVGVLGGIIAL

SEQ ID NO: 1747466 - protein, 17 aa, Staphylococcus epidermidis
RDNYDFYGRVDIESNPT

SEQ ID NO: 1747467 - protein, 22 aa, Staphylococcus epidermidis
REKGTPSAAGFRIDTGYYNNDP

SEQ ID NO: 1747468 - protein, 23 aa, Staphylococcus epidermidis
REKGTPSAAGFRIDTGYYNNDPL

SEQ ID NO: 1747469 - protein, 17 aa, Staphylococcus epidermidis
RERPERWGIKLTINLIG

SEQ ID NO: 1747470 - protein, 18 aa, Staphylococcus epidermidis
RFASRSVLLWALIIFIFG

SEQ ID NO: 1747471 - protein, 17 aa, Staphylococcus epidermidis
RFNKFEWLAIIFALIGV

SEQ ID NO: 1747472 - protein, 18 aa, Staphylococcus epidermidis
RGYHGIYKGMTRKEVEDK

SEQ ID NO: 1747473 - protein, 17 aa, Staphylococcus epidermidis
RIGACIVGAIFVVSYLY

SEQ ID NO: 1747474 - protein, 23 aa, Staphylococcus epidermidis
RIIDDFGKAVGFITLTGLLYGFW

SEQ ID NO: 1747475 - protein, 17 aa, Staphylococcus epidermidis
RILFVLLGILGLVWVMV

SEQ ID NO: 1747476 - protein, 18 aa, Staphylococcus epidermidis
RISDALIRMQREHVHMSL

SEQ ID NO: 1747477 - protein, 20 aa, Staphylococcus epidermidis
RKANEIILAMKLEKILSKNE

SEQ ID NO: 1747478 - protein, 17 aa, Staphylococcus epidermidis
RKPIILMAMALVFTTVI

SEQ ID NO: 1747479 - protein, 19 aa, Staphylococcus epidermidis
RKYNTFKWLGIAMSIIGVL

SEQ ID NO: 1747480 - protein, 18 aa, Staphylococcus epidermidis
RLELGLPCDPFFGNGGDW

SEQ ID NO: 1747481 - protein, 18 aa, Staphylococcus epidermidis
RLIILIELLIQFIISAIL

SEQ ID NO: 1747482 - protein, 18 aa, Staphylococcus epidermidis
RLNQVLALIVLFLLIILP

SEQ ID NO: 1747483 - protein, 23 aa, Staphylococcus epidermidis
RLPLSELYEGVGILETPFGYLIS

SEQ ID NO: 1747484 - protein, 17 aa, Staphylococcus epidermidis
RNIFPYILLSIGVLLTL

SEQ ID NO: 1747485 - protein, 18 aa, Staphylococcus epidermidis
RNKLKFGLIIGILVLISY

SEQ ID NO: 1747486 - protein, 19 aa, Staphylococcus epidermidis
RPFTKRYYILIVMMAIITF

SEQ ID NO: 1747487 - protein, 19 aa, Staphylococcus epidermidis
RPIIKRYVALIGTLLTLVV

SEQ ID NO: 1747488 - protein, 24 aa, Staphylococcus epidermidis
RPLQWIAGIYIEFLRGTPMLVQVF

SEQ ID NO: 1747489 - protein, 19 aa, Staphylococcus epidermidis
RQPVKIPGYQHYRTSVSDG

SEQ ID NO: 1747490 - protein, 19 aa, Staphylococcus epidermidis
RQSFNIPALKTWQQVKKSA

SEQ ID NO: 1747491 - protein, 20 aa, Staphylococcus epidermidis
RRGIENINMFTFIQLLTPFV

SEQ ID NO: 1747492 - protein, 17 aa, Staphylococcus epidermidis
RRICWFGSIVVAIVLAI

SEQ ID NO: 1747493 - protein, 17 aa, Staphylococcus epidermidis
RRLGGSQSYLFFGSLPV

SEQ ID NO: 1747494 - protein, 21 aa, Staphylococcus epidermidis
RSEISIAVGIVFFLITSLLSS

SEQ ID NO: 1747495 - protein, 26 aa, Staphylococcus epidermidis
RSIFFFSWNEFAWWLVAHLFFIILMA

SEQ ID NO: 1747496 - protein, 23 aa, Staphylococcus epidermidis
RSKVKIIVLSLIFVLLLASLIGF

SEQ ID NO: 1747497 - protein, 22 aa, Staphylococcus epidermidis
RVLFDSRLNGMGPYPTGKLSAM

SEQ ID NO: 1747498 - protein, 19 aa, Staphylococcus epidermidis
RVNFKIVLPGAILTIIILF

SEQ ID NO: 1747499 - protein, 17 aa, Staphylococcus epidermidis
RWTVWKIAIVGGILTFP

SEQ ID NO: 1747500 - protein, 17 aa, Staphylococcus epidermidis
RWYFAIGFFFIGVIAYM

SEQ ID NO: 1747501 - protein, 18 aa, Staphylococcus epidermidis
RYPNRFNIHYRIDDQCQD

SEQ ID NO: 1747502 - protein, 18 aa, Staphylococcus epidermidis
SASAKWGILAPIFVPMLI

SEQ ID NO: 1747503 - protein, 20 aa, Staphylococcus epidermidis
SASSTWAWLFVLFILPIIGF

SEQ ID NO: 1747504 - protein, 19 aa, Staphylococcus epidermidis
SAYNWAFFNPIRKIYYNIT

SEQ ID NO: 1747505 - protein, 21 aa, Staphylococcus epidermidis
SDKNAKDKLPDTGANEDHDSK

SEQ ID NO: 1747506 - protein, 26 aa, Staphylococcus epidermidis
SEAIHFCFTYRHALRLVSPDTLFAQF

SEQ ID NO: 1747507 - protein, 19 aa, Staphylococcus epidermidis
SEIVFGYLAGYGMFAVLQT

SEQ ID NO: 1747508 - protein, 17 aa, Staphylococcus epidermidis
SELLLAFSTSSSEAVLP

SEQ ID NO: 1747509 - protein, 35 aa, Staphylococcus epidermidis
SERGPVKIPGYRYTRMTMSDGITKYIYKKVSNNQT

SEQ ID NO: 1747510 - protein, 19 aa, Staphylococcus epidermidis
SEYFWWMVAHIIFMVLMAI

SEQ ID NO: 1747511 - protein, 19 aa, Staphylococcus epidermidis
SFGLPETWATALYGMAIVV

SEQ ID NO: 1747512 - protein, 20 aa, Staphylococcus epidermidis
SFILAFPMAIIWPYIQTGLN

SEQ ID NO: 1747513 - protein, 19 aa, Staphylococcus epidermidis
SFISPSIVVGPNFYMGIGT

SEQ ID NO: 1747514 - protein, 18 aa, Staphylococcus epidermidis
SFMPLKHLWSLAIEEQFY

SEQ ID NO: 1747515 - protein, 21 aa, Staphylococcus epidermidis
SGFYKPTYNLGDYVWEDTNKD

SEQ ID NO: 1747516 - protein, 24 aa, Staphylococcus epidermidis
SGGNFRLQNFLARIKPADYYYTTL

SEQ ID NO: 1747517 - protein, 18 aa, Staphylococcus epidermidis
SGIMCPEFAIGMGPKIFS

SEQ ID NO: 1747518 - protein, 26 aa, Staphylococcus epidermidis
SGLFSRRFWPSLKFLLPILIGMLIAI

SEQ ID NO: 1747519 - protein, 20 aa, Staphylococcus epidermidis
SGLMLEFISMLGIGLVALEV

SEQ ID NO: 1747520 - protein, 17 aa, Staphylococcus epidermidis
SGLSFSCAMAFSAASQI

SEQ ID NO: 1747521 - protein, 19 aa, Staphylococcus epidermidis
SGNYIVHFDKPSGMTQTTT

SEQ ID NO: 1747522 - protein, 18 aa, Staphylococcus epidermidis
SGQLGATVKPGSATNQDT

SEQ ID NO: 1747523 - protein, 18 aa, Staphylococcus epidermidis
SGRPIQFLVGFDVEDSHH

SEQ ID NO: 1747524 - protein, 17 aa, Staphylococcus epidermidis
SGSDYWNVTSFTYTLTL

SEQ ID NO: 1747525 - protein, 17 aa, Staphylococcus epidermidis
SGTIFAIVCWLVISVAI

SEQ ID NO: 1747526 - protein, 19 aa, Staphylococcus epidermidis
SGVKNCLNKQISKTQLPDT

SEQ ID NO: 1747527 - protein, 17 aa, Staphylococcus epidermidis
SIDEISKILPVIESKSA

SEQ ID NO: 1747528 - protein, 18 aa, Staphylococcus epidermidis
SIELGGWVILLGGIAIGL

SEQ ID NO: 1747529 - protein, 21 aa, Staphylococcus epidermidis
SIGPNLRKYFSLSNGSDLPNR

SEQ ID NO: 1747530 - protein, 17 aa, Staphylococcus epidermidis
SIHVLSFIFVLMIVLNP

SEQ ID NO: 1747531 - protein, 18 aa, Staphylococcus epidermidis
SIILGLLVLMSIVLTYMV

SEQ ID NO: 1747532 - protein, 21 aa, Staphylococcus epidermidis
SIINLRLFKSISFSSSIFAIF

SEQ ID NO: 1747533 - protein, 17 aa, Staphylococcus epidermidis
SIISFIAAILLIIGSIF

SEQ ID NO: 1747534 - protein, 23 aa, Staphylococcus epidermidis
SIQKEYWLVYGIVTLAAVIIPFF

SEQ ID NO: 1747535 - protein, 18 aa, Staphylococcus epidermidis
SIRKKLWLATGIVGIIQY

SEQ ID NO: 1747536 - protein, 17 aa, Staphylococcus epidermidis
SIVFKFTVSLAIILAVH

SEQ ID NO: 1747537 - protein, 23 aa, Staphylococcus epidermidis
SIVVCIFLLFALIFFLFTLPFSA

SEQ ID NO: 1747538 - protein, 21 aa, Staphylococcus epidermidis
SKEEIRTLLNIAGREGAFNEI

SEQ ID NO: 1747539 - protein, 22 aa, Staphylococcus epidermidis
SKESKKRFTAIMLICAMFAICW

SEQ ID NO: 1747540 - protein, 24 aa, Staphylococcus epidermidis
SKGLKLKVIFNFGLPLIVALLHGY

SEQ ID NO: 1747541 - protein, 24 aa, Staphylococcus epidermidis
SKIVYRFTTLFTMVAAFVDGVKAS

SEQ ID NO: 1747542 - protein, 18 aa, Staphylococcus epidermidis
SKKAAPLIVAKRKKDKNE

SEQ ID NO: 1747543 - protein, 19 aa, Staphylococcus epidermidis
SKLKALINRAHKQIDEAET

SEQ ID NO: 1747544 - protein, 23 aa, Staphylococcus epidermidis
SKSEWRKTLFIIGGNSTVTLDDV

SEQ ID NO: 1747545 - protein, 23 aa, Staphylococcus epidermidis
SKVVYRFTTFFTMIAAFIDGVKA

SEQ ID NO: 1747546 - protein, 21 aa, Staphylococcus epidermidis
SLCLIGMGIIGWYMWSLWSLI

SEQ ID NO: 1747547 - protein, 19 aa, Staphylococcus epidermidis
SLIGFIGMGLFGNKYQEMP

SEQ ID NO: 1747548 - protein, 19 aa, Staphylococcus epidermidis
SLITFIVLVIFKRSIIMPL

SEQ ID NO: 1747549 - protein, 17 aa, Staphylococcus epidermidis
SLLAITCIAQFGSIIIS

SEQ ID NO: 1747550 - protein, 17 aa, Staphylococcus epidermidis
SLLSWVVTLFFIALSFY

SEQ ID NO: 1747551 - protein, 19 aa, Staphylococcus epidermidis
SLVFKILVIILIVFILLAI

SEQ ID NO: 1747552 - protein, 17 aa, Staphylococcus epidermidis
SNARLFGIVGMLIALLA

SEQ ID NO: 1747553 - protein, 23 aa, Staphylococcus epidermidis
SNFPKERIRFIAIQYLLDNVQIS

SEQ ID NO: 1747554 - protein, 21 aa, Staphylococcus epidermidis
SNGKYEFTGLENGDYTIEFET

SEQ ID NO: 1747555 - protein, 25 aa, Staphylococcus epidermidis
SNGNFSIAIPSDYVLTGKETIKITS

SEQ ID NO: 1747556 - protein, 28 aa, Staphylococcus epidermidis
SNGNFSIAIPSYYVLTGKETIKITSIDK

SEQ ID NO: 1747557 - protein, 18 aa, Staphylococcus epidermidis
SNPIDWAILGGIAAGTLI

SEQ ID NO: 1747558 - protein, 24 aa, Staphylococcus epidermidis
SPYEIISALILAWSLMVSWNQMVA

SEQ ID NO: 1747559 - protein, 18 aa, Staphylococcus epidermidis
SQNSIKSVHTFKPNENFL

SEQ ID NO: 1747560 - protein, 17 aa, Staphylococcus epidermidis
SRFCSNCGHNIEKLNSN

SEQ ID NO: 1747561 - protein, 17 aa, Staphylococcus epidermidis
SRFWLPLIISSMVFSSQ

SEQ ID NO: 1747562 - protein, 18 aa, Staphylococcus epidermidis
SRNAGSFTKTVTVAYQNG

SEQ ID NO: 1747563 - protein, 20 aa, Staphylococcus epidermidis
SRSVLLWALIIFIFGNGLIA

SEQ ID NO: 1747564 - protein, 20 aa, Staphylococcus epidermidis
SSAPFGLAFSHMFNPTIGNI

SEQ ID NO: 1747565 - protein, 24 aa, Staphylococcus epidermidis
SSQKSIKSVHTFKPNENFLQTDYR

SEQ ID NO: 1747566 - protein, 24 aa, Staphylococcus epidermidis
SSRTKKWLIALVVILLIVVAIFVT

SEQ ID NO: 1747567 - protein, 18 aa, Staphylococcus epidermidis
STFFAFICYVSWSSAFGS

SEQ ID NO: 1747568 - protein, 25 aa, Staphylococcus epidermidis
STSIRRTEIVSGYLIGYGIFAIIQT

SEQ ID NO: 1747569 - protein, 24 aa, Staphylococcus epidermidis
STSMSTSETFTSQSPINSESQFIG

SEQ ID NO: 1747570 - protein, 20 aa, Staphylococcus epidermidis
SVIVIIGFVLNMFIKHFKKE

SEQ ID NO: 1747571 - protein, 17 aa, Staphylococcus epidermidis
SVKRSEIVFGYLAGYGM

SEQ ID NO: 1747572 - protein, 20 aa, Staphylococcus epidermidis
SVKVEPKFNFLSVLFQITLA

SEQ ID NO: 1747573 - protein, 21 aa, Staphylococcus epidermidis
SVLDPRVAGIYQDIDVTPGSE

SEQ ID NO: 1747574 - protein, 17 aa, Staphylococcus epidermidis
SWDTGLYYFGFIGEKPV

SEQ ID NO: 1747575 - protein, 18 aa, Staphylococcus epidermidis
SYASWVIVVGISLILVAI

SEQ ID NO: 1747576 - protein, 18 aa, Staphylococcus epidermidis
SYFCLKFSMLFMSNATIL

SEQ ID NO: 1747577 - protein, 18 aa, Staphylococcus epidermidis
SYIWPGVMTLIFLVSFIH

SEQ ID NO: 1747578 - protein, 22 aa, Staphylococcus epidermidis
SYLLGIHWRLGYTGIILVSIAD

SEQ ID NO: 1747579 - protein, 19 aa, Staphylococcus epidermidis
SYRAAILYQNWFFITHWKL

SEQ ID NO: 1747580 - protein, 18 aa, Staphylococcus epidermidis
SYVSWIIVVGISLILVAI

SEQ ID NO: 1747581 - protein, 20 aa, Staphylococcus epidermidis
TAIFNYWWMFAISFIFFIIA

SEQ ID NO: 1747582 - protein, 21 aa, Staphylococcus epidermidis
TASKINHQWSLNKQVQGITIE

SEQ ID NO: 1747583 - protein, 21 aa, Staphylococcus epidermidis
TASKINHQWSLNKVVPGITIE

SEQ ID NO: 1747584 - protein, 25 aa, Staphylococcus epidermidis
TATKRLPWLIVLTFLGMITATILGS

SEQ ID NO: 1747585 - protein, 24 aa, Staphylococcus epidermidis
TCLNLRVSPVFAVIVGLVLHDQKL

SEQ ID NO: 1747586 - protein, 29 aa, Staphylococcus epidermidis
TDARKAIQDKAFEQIELIKATPDATNEEK

SEQ ID NO: 1747587 - protein, 26 aa, Staphylococcus epidermidis
TDLKRVAKTPGVWIILIGLAILPSFY

SEQ ID NO: 1747588 - protein, 25 aa, Staphylococcus epidermidis
TDLKRVAKTPGVWVILAGLAILPSF

SEQ ID NO: 1747589 - protein, 24 aa, Staphylococcus epidermidis
TDRYGRTLAYVWLKNGDMFNESLV

SEQ ID NO: 1747590 - protein, 24 aa, Staphylococcus epidermidis
TDRYGRTLAYVWLKNGDMLNESLV

SEQ ID NO: 1747591 - protein, 20 aa, Staphylococcus epidermidis
TELPETGLSNEHDYTTTVFG

SEQ ID NO: 1747592 - protein, 17 aa, Staphylococcus epidermidis
TELPETGLSNEYDYTTT

SEQ ID NO: 1747593 - protein, 17 aa, Staphylococcus epidermidis
TEMFGVFNPLTMAMMSP

SEQ ID NO: 1747594 - protein, 39 aa, Staphylococcus epidermidis
TFIFKNNFSIRKLKFGVASITLGSALIIGAHQEAKADEN

SEQ ID NO: 1747595 - protein, 17 aa, Staphylococcus epidermidis
TFLPSVVPIHFNLLTML

SEQ ID NO: 1747596 - protein, 18 aa, Staphylococcus epidermidis
TGADGWGFMFSKKDGDDF

SEQ ID NO: 1747597 - protein, 21 aa, Staphylococcus epidermidis
TGHSAWRYFMLIFYLVPYVLF

SEQ ID NO: 1747598 - protein, 20 aa, Staphylococcus epidermidis
TGIACGFIFYPLTMLISKRH

SEQ ID NO: 1747599 - protein, 18 aa, Staphylococcus epidermidis
TGIFFIMLFILIKLFMEV

SEQ ID NO: 1747600 - protein, 23 aa, Staphylococcus epidermidis
TGKDYDLQEQRGYTDSEQHNETQ

SEQ ID NO: 1747601 - protein, 27 aa, Staphylococcus epidermidis
TGKIVKRSALPIAIVALIVGIMFIWKS

SEQ ID NO: 1747602 - protein, 20 aa, Staphylococcus epidermidis
TGNVYTEYWLTRDGTTNTND

SEQ ID NO: 1747603 - protein, 24 aa, Staphylococcus epidermidis
TGTGNVYTEYWLTRDGTTNTNDFY

SEQ ID NO: 1747604 - protein, 18 aa, Staphylococcus epidermidis
THSGCGCMLGCLTISLIS

SEQ ID NO: 1747605 - protein, 18 aa, Staphylococcus epidermidis
TIAGEVDATVNIDKQLNN

SEQ ID NO: 1747606 - protein, 20 aa, Staphylococcus epidermidis
TIAGEVDGTVNIDKQLNNFK

SEQ ID NO: 1747607 - protein, 24 aa, Staphylococcus epidermidis
TIDSGFYKPIYNLGDYVWEDTNKD

SEQ ID NO: 1747608 - protein, 28 aa, Staphylococcus epidermidis
TIDSGFYKTPKYSVGDYVWEDTNKDGIQ

SEQ ID NO: 1747609 - protein, 23 aa, Staphylococcus epidermidis
TIFCLIIGLLLFFHKPIISHFIA

SEQ ID NO: 1747610 - protein, 17 aa, Staphylococcus epidermidis
TIHAFAIVDNGEDVLSF

SEQ ID NO: 1747611 - protein, 23 aa, Staphylococcus epidermidis
TILLFCLIIIFFLKDTLRSSEID

SEQ ID NO: 1747612 - protein, 25 aa, Staphylococcus epidermidis
TIRNIRQNLFWAFGYNVAGIPIAAL

SEQ ID NO: 1747613 - protein, 19 aa, Staphylococcus epidermidis
TISMNWSLEVARAMTGGIG

SEQ ID NO: 1747614 - protein, 21 aa, Staphylococcus epidermidis
TITRFSIRKYQGFGAASVAVA

SEQ ID NO: 1747615 - protein, 37 aa, Staphylococcus epidermidis; identical to SEQ ID NO: 1745085

SEQ ID NO: 1747616 - protein, 17 aa, Staphylococcus epidermidis
TKGHKLKKSAAKTTALV

SEQ ID NO: 1747617 - protein, 19 aa, Staphylococcus epidermidis
TKLGEVWAMLCLSLTLVAY

SEQ ID NO: 1747618 - protein, 22 aa, Staphylococcus epidermidis
TKLKRIPTLITESKQNSNNSHI

SEQ ID NO: 1747619 - protein, 24 aa, Staphylococcus epidermidis
TKVFPMWLRWSLFIILVGADTYIA

SEQ ID NO: 1747620 - protein, 23 aa, Staphylococcus epidermidis
TLEMYRFEYPITFATSIFASIFT

SEQ ID NO: 1747621 - protein, 23 aa, Staphylococcus epidermidis
TLEMYRFEYPITFVTSIFASIFT

SEQ ID NO: 1747622 - protein, 18 aa, Staphylococcus epidermidis
TLHAEIFFDGETTPIRKD

SEQ ID NO: 1747623 - protein, 22 aa, Staphylococcus epidermidis
TLRYANYFSIRKLTVGVASITL

SEQ ID NO: 1747624 - protein, 17 aa, Staphylococcus epidermidis
TLVATKSNATWSLDKQV

SEQ ID NO: 1747625 - protein, 22 aa, Staphylococcus epidermidis
TMMAAMCGFLFLAADPVKDGGF

SEQ ID NO: 1747626 - protein, 31 aa, Staphylococcus epidermidis
TNMLNKTGKDYDLQEQRGYTDSEQHNETQSN

SEQ ID NO: 1747627 - protein, 23 aa, Staphylococcus epidermidis
TPNEFRLMILGGLVSGLVYFAFG

SEQ ID NO: 1747628 - protein, 23 aa, Staphylococcus epidermidis
TPNKRLLGSYASSYIDMIDRIPP

SEQ ID NO: 1747629 - protein, 20 aa, Staphylococcus epidermidis
TPSEVGKYLITITTIDKDGN

SEQ ID NO: 1747630 - protein, 27 aa, Staphylococcus epidermidis
TPTIWASVLSFFAGVLLLKRQTRKSNK

SEQ ID NO: 1747631 - protein, 22 aa, Staphylococcus epidermidis
TPVQFIIGWQFYVGAYKNLRNG

SEQ ID NO: 1747632 - protein, 17 aa, Staphylococcus epidermidis
TPWKYRYVAGIIVLALV

SEQ ID NO: 1747633 - protein, 21 aa, Staphylococcus epidermidis
TRFIVRVLIPFAFIISLFLIS

SEQ ID NO: 1747634 - protein, 17 aa, Staphylococcus epidermidis
TRFIVRVLIPFALIISL

SEQ ID NO: 1747635 - protein, 17 aa, Staphylococcus epidermidis
TRISSLYGILILLFVLS

SEQ ID NO: 1747636 - protein, 18 aa, Staphylococcus epidermidis
TRNAFFIGRTIDYNVSLE

SEQ ID NO: 1747637 - protein, 42 aa, Staphylococcus epidermidis
TRVKIYKSGKSWVKASINEIELLKTMGLPFLSKNEIQENVTE

SEQ ID NO: 1747638 - protein, 19 aa, Staphylococcus epidermidis
TSFEKWNFVKLAKPLIALS

SEQ ID NO: 1747639 - protein, 18 aa, Staphylococcus epidermidis
TSLLRYYFWITILIVILI

SEQ ID NO: 1747640 - protein, 24 aa, Staphylococcus epidermidis
TSMPEYWLAILFIYYLGVRWQLLP

SEQ ID NO: 1747641 - protein, 22 aa, Staphylococcus epidermidis
TSMSTSETFTSQSPINSESQFI

SEQ ID NO: 1747642 - protein, 21 aa, Staphylococcus epidermidis
TTALVGGAFTFNMLNNHQAFA

SEQ ID NO: 1747643 - protein, 21 aa, Staphylococcus epidermidis
TTALVGGAFTFNMLNNHQALA

SEQ ID NO: 1747644 - protein, 24 aa, Staphylococcus epidermidis
TTILLFCLIIIFFLKDTLRNSELD

SEQ ID NO: 1747645 - protein, 30 aa, Staphylococcus epidermidis
TTTDVSGHYQFKGLENGSYTVEFETPSGYT

SEQ ID NO: 1747646 - protein, 24 aa, Staphylococcus epidermidis
TTTVTGLPSGLSFDQTTNTIIGTP

SEQ ID NO: 1747647 - protein, 23 aa, Staphylococcus epidermidis
TTVTGLPSGLSFDQTTNTIIGTP

SEQ ID NO: 1747648 - protein, 23 aa, Staphylococcus epidermidis
TTVTGLPSGLSFDQTTNTITGTP

SEQ ID NO: 1747649 - protein, 18 aa, Staphylococcus epidermidis
TVIATLVFMGINPNHASA

SEQ ID NO: 1747650 - protein, 23 aa, Staphylococcus epidermidis
TVKNGKFIPGEVKVYEVTDTNAM

SEQ ID NO: 1747651 - protein, 18 aa, Staphylococcus epidermidis
TWISFCVGRGIFIFSKGV

SEQ ID NO: 1747652 - protein, 22 aa, Staphylococcus epidermidis
TYGYKRFEVLAALFNGVTLFII

SEQ ID NO: 1747653 - protein, 21 aa, Staphylococcus epidermidis
VAEGFLKFNGMLGHTFKPQAD

SEQ ID NO: 1747654 - protein, 24 aa, Staphylococcus epidermidis
VAGGDGIGFAFSPGPLGQIGKEGA

SEQ ID NO: 1747655 - protein, 19 aa, Staphylococcus epidermidis
VALVFRLNQSLTFWSAGGV

SEQ ID NO: 1747656 - protein, 20 aa, Staphylococcus epidermidis
VATKSNATWSLDKQVQGITI

SEQ ID NO: 1747657 - protein, 23 aa, Staphylococcus epidermidis
VAVWCLIGYRLARFRYVSETLEK

SEQ ID NO: 1747658 - protein, 18 aa, Staphylococcus epidermidis
VAYIVCSISLLIQAPLLS

SEQ ID NO: 1747659 - protein, 18 aa, Staphylococcus epidermidis
VCLHFEFAGNPVLHHLGI

SEQ ID NO: 1747660 - protein, 19 aa, Staphylococcus epidermidis
VDAFKNLKIPLSISGQAGQ

SEQ ID NO: 1747661 - protein, 20 aa, Staphylococcus epidermidis
VDELYKYRIRGIVGNSETIH

SEQ ID NO: 1747662 - protein, 18 aa, Staphylococcus epidermidis
VDTGFYLTPKYNVGDYVW

SEQ ID NO: 1747663 - protein, 17 aa, Staphylococcus epidermidis
VEDARNGIVLKILSVIY

SEQ ID NO: 1747664 - protein, 17 aa, Staphylococcus epidermidis
VEKKIPWGTIIVFGVGI

SEQ ID NO: 1747665 - protein, 20 aa, Staphylococcus epidermidis
VELPLALPLIISGIRLSSVY

SEQ ID NO: 1747666 - protein, 19 aa, Staphylococcus epidermidis
VELYYYIKGGRVDYGAAHA

SEQ ID NO: 1747667 - protein, 19 aa, Staphylococcus epidermidis
VFFLFKYVKSWIRNEMILR

SEQ ID NO: 1747668 - protein, 17 aa, Staphylococcus epidermidis
VFHLIRLASKINSQYNK

SEQ ID NO: 1747669 - protein, 18 aa, Staphylococcus epidermidis
VFIAFVFQEDSAIKSMGI

SEQ ID NO: 1747670 - protein, 19 aa, Staphylococcus epidermidis
VFIALAITFGVLWVLTNVL

SEQ ID NO: 1747671 - protein, 18 aa, Staphylococcus epidermidis
VFLALGITFLALWVLTNV

SEQ ID NO: 1747672 - protein, 18 aa, Staphylococcus epidermidis
VFMFKTALKLAGDPYYSG

SEQ ID NO: 1747673 - protein, 23 aa, Staphylococcus epidermidis
VFTAEFYASFAFAILISILIDIG

SEQ ID NO: 1747674 - protein, 20 aa, Staphylococcus epidermidis
VGAIILQLALLFIAQLYYHF

SEQ ID NO: 1747675 - protein, 19 aa, Staphylococcus epidermidis
VGASFKWYDFVYFIDTIIY

SEQ ID NO: 1747676 - protein, 18 aa, Staphylococcus epidermidis
VGATLMFGAADNEAKAAE

SEQ ID NO: 1747677 - protein, 26 aa, Staphylococcus epidermidis
VGSCGWKAILYFEIITTIAIGLGLII

SEQ ID NO: 1747678 - protein, 18 aa, Staphylococcus epidermidis
VHYIFRVLSILIFIMTFK

SEQ ID NO: 1747679 - protein, 19 aa, Staphylococcus epidermidis
VICSCYLAFILIGSLQGKD

SEQ ID NO: 1747680 - protein, 20 aa, Staphylococcus epidermidis
VIDARLGYYSVVKETNVQLL

SEQ ID NO: 1747681 - protein, 19 aa, Staphylococcus epidermidis
VIFCGVAYYFLRKLDIKNK

SEQ ID NO: 1747682 - protein, 18 aa, Staphylococcus epidermidis
VIGILCLMISHWFKSKDN

SEQ ID NO: 1747683 - protein, 19 aa, Staphylococcus epidermidis
VIGVLGFWFWNNATSYVTT

SEQ ID NO: 1747684 - protein, 18 aa, Staphylococcus epidermidis
VILIPVFILFALVDFGFG

SEQ ID NO: 1747685 - protein, 18 aa, Staphylococcus epidermidis
VIPALKYDHEYTTHIELE

SEQ ID NO: 1747686 - protein, 17 aa, Staphylococcus epidermidis
VIQGCVLFIGFFVVIIN

SEQ ID NO: 1747687 - protein, 18 aa, Staphylococcus epidermidis
VISIHWWIKYLGFKKDER

SEQ ID NO: 1747688 - protein, 23 aa, Staphylococcus epidermidis
VISRWAQEFNIYFKRYNSDQFVA

SEQ ID NO: 1747689 - protein, 20 aa, Staphylococcus epidermidis
VKFFKSCFLIGLILILVIDL

SEQ ID NO: 1747690 - protein, 19 aa, Staphylococcus epidermidis
VKGEFKFDKEFLLLNISTV

SEQ ID NO: 1747691 - protein, 21 aa, Staphylococcus epidermidis
VKPEALKQILAKLDNQRDLIN

SEQ ID NO: 1747692 - protein, 17 aa, Staphylococcus epidermidis
VKRKVVVQLTRFEKILY

SEQ ID NO: 1747693 - protein, 18 aa, Staphylococcus epidermidis
VKRKVVVQLTRFEKVLYI

SEQ ID NO: 1747694 - protein, 19 aa, Staphylococcus epidermidis
VKSTHFFSLILIFTILLST

SEQ ID NO: 1747695 - protein, 22 aa, Staphylococcus epidermidis
VKVLNSLSGFTMVNGGQVGLLN

SEQ ID NO: 1747696 - protein, 17 aa, Staphylococcus epidermidis
VLFLFPFVQKHFVKGIN

SEQ ID NO: 1747697 - protein, 20 aa, Staphylococcus epidermidis
VLFWLCILSFFSVLNEMVLN

SEQ ID NO: 1747698 - protein, 21 aa, Staphylococcus epidermidis
VLFWLCILSFFSVLNEMVLNV

SEQ ID NO: 1747699 - protein, 24 aa, Staphylococcus epidermidis
VLLDWKLTVLILLISPVIFGIIFP

SEQ ID NO: 1747700 - protein, 19 aa, Staphylococcus epidermidis
VLLFFKGKKAFWFIFIGGF

SEQ ID NO: 1747701 - protein, 19 aa, Staphylococcus epidermidis
VLLMSGTLIGYGLTKDTQA

SEQ ID NO: 1747702 - protein, 20 aa, Staphylococcus epidermidis
VLMCIVSIFLSITVVIQNIS

SEQ ID NO: 1747703 - protein, 18 aa, Staphylococcus epidermidis
VMGTGFAFWSFVLAIVLI

SEQ ID NO: 1747704 - protein, 18 aa, Staphylococcus epidermidis
VNFLLKLLLSFVIVIFSG

SEQ ID NO: 1747705 - protein, 25 aa, Staphylococcus epidermidis
VNGQENLYRIAIQYYGSGTQENVDK

SEQ ID NO: 1747706 - protein, 24 aa, Staphylococcus epidermidis
VNKDNFNEHMNLSGSATYDPKTGI

SEQ ID NO: 1747707 - protein, 20 aa, Staphylococcus epidermidis
VNLPFQFTFPGSEWVVLILS

SEQ ID NO: 1747708 - protein, 18 aa, Staphylococcus epidermidis
VNLPQGWTKSFTINPNNN

SEQ ID NO: 1747709 - protein, 17 aa, Staphylococcus epidermidis
VNVWIFKFFVDVLNMNS

SEQ ID NO: 1747710 - protein, 17 aa, Staphylococcus epidermidis
VPFELCLLLKLFKPVKA

SEQ ID NO: 1747711 - protein, 24 aa, Staphylococcus epidermidis
VPSLGATLFRKGVKTKRQHEGLGA

SEQ ID NO: 1747712 - protein, 18 aa, Staphylococcus epidermidis
VQHFYDWINHVLKTGHSP

SEQ ID NO: 1747713 - protein, 18 aa, Staphylococcus epidermidis
VQHFYEWLNYVMKTGHSA

SEQ ID NO: 1747714 - protein, 21 aa, Staphylococcus epidermidis
VRMPRMLAGLVIGGALGIAGL

SEQ ID NO: 1747715 - protein, 19 aa, Staphylococcus epidermidis
VSAGYKWFFAYPDQHIETV

SEQ ID NO: 1747716 - protein, 24 aa, Staphylococcus epidermidis
VSFPKRVFTALGIGIVFGIVLHLI

SEQ ID NO: 1747717 - protein, 24 aa, Staphylococcus epidermidis
VSIVLRLCLYYILIFGIINYFVKR

SEQ ID NO: 1747718 - protein, 20 aa, Staphylococcus epidermidis
VSKLKALINRAHKQIDEAET

SEQ ID NO: 1747719 - protein, 17 aa, Staphylococcus epidermidis
VSRAYHWYELDEQFVDG

SEQ ID NO: 1747720 - protein, 19 aa, Staphylococcus epidermidis
VSWGEWFLYAAPWSILMSI

SEQ ID NO: 1747721 - protein, 22 aa, Staphylococcus epidermidis
VTCLWFLFCVFIFQYIKLLFSK

SEQ ID NO: 1747722 - protein, 19 aa, Staphylococcus epidermidis
VTCLYFEFAGNPVLHHLGI

SEQ ID NO: 1747723 - protein, 18 aa, Staphylococcus epidermidis
VTFCLPINLPVAPDQALI

SEQ ID NO: 1747724 - protein, 17 aa, Staphylococcus epidermidis
VVCFIISIIQGWYESRI

SEQ ID NO: 1747725 - protein, 26 aa, Staphylococcus epidermidis
VVGRAYRSALNWSLNHKWIVLIVSIF

SEQ ID NO: 1747726 - protein, 17 aa, Staphylococcus epidermidis
VVLGSLLILLSITHVCL

SEQ ID NO: 1747727 - protein, 18 aa, Staphylococcus epidermidis
VVQFFNWFALMYLWTYST

SEQ ID NO: 1747728 - protein, 28 aa, Staphylococcus epidermidis
VVSNGFIVAVAIVLAIFGLAKKSRKDDD

SEQ ID NO: 1747729 - protein, 24 aa, Staphylococcus epidermidis
VVVTCLWFLFCVFIFQYIKLLFSR

SEQ ID NO: 1747730 - protein, 19 aa, Staphylococcus epidermidis
VYIVLCYLSFLVITANILD

SEQ ID NO: 1747731 - protein, 18 aa, Staphylococcus epidermidis
VYMIRIGIQIAYLLNDLK

SEQ ID NO: 1747732 - protein, 19 aa, Staphylococcus epidermidis
VYNFDFPQPIYKIQVGDTF

SEQ ID NO: 1747733 - protein, 22 aa, Staphylococcus epidermidis
VYQFRTALRFNFKNNGNYIDKE

SEQ ID NO: 1747734 - protein, 20 aa, Staphylococcus epidermidis
WFKFWSVIESGGWVIFNHME

SEQ ID NO: 1747735 - protein, 17 aa, Staphylococcus epidermidis
WFYNLSLSFSFVLAQFL

SEQ ID NO: 1747736 - protein, 17 aa, Staphylococcus epidermidis
WGVMIITAFLVRDFSQG

SEQ ID NO: 1747737 - protein, 17 aa, Staphylococcus epidermidis
WIFWINIPIILIGLIGC

SEQ ID NO: 1747738 - protein, 17 aa, Staphylococcus epidermidis
WIKISFIDHLPLKHYSL

SEQ ID NO: 1747739 - protein, 17 aa, Staphylococcus epidermidis
WIRRIKRLLPAVFVLIV

SEQ ID NO: 1747740 - protein, 17 aa, Staphylococcus epidermidis
WIRRIKRLLPAVLALLI

SEQ ID NO: 1747741 - protein, 17 aa, Staphylococcus epidermidis
WIWPDLPIGAAFAIAAI

SEQ ID NO: 1747742 - protein, 27 aa, Staphylococcus epidermidis
WKLSLICLIPVILGFLLLRFMMGDESK

SEQ ID NO: 1747743 - protein, 17 aa, Staphylococcus epidermidis
WLSNIGYLFPLRYAGNG

SEQ ID NO: 1747744 - protein, 20 aa, Staphylococcus epidermidis
WLVGSFLFGWYISNFGNYNK

SEQ ID NO: 1747745 - protein, 17 aa, Staphylococcus epidermidis
WLYHFSLSLSFVIAQGL

SEQ ID NO: 1747746 - protein, 19 aa, Staphylococcus epidermidis
WNILSVLLLGFGFLSYSRK

SEQ ID NO: 1747747 - protein, 17 aa, Staphylococcus epidermidis
WPWDWAKPMGALMKDGS

SEQ ID NO: 1747748 - protein, 17 aa, Staphylococcus epidermidis
WTFRKLLNYGIDGLISF

SEQ ID NO: 1747749 - protein, 22 aa, Staphylococcus epidermidis
WTVPCYLCAFIAIVYGFTGIGI

SEQ ID NO: 1747750 - protein, 20 aa, Staphylococcus epidermidis
WVGWRFTFLFIIVVSVFVGI

SEQ ID NO: 1747751 - protein, 22 aa, Staphylococcus epidermidis
WVLMLIRLIHGIAFGFSSTATG

SEQ ID NO: 1747752 - protein, 17 aa, Staphylococcus epidermidis
WWLVIPVGLVYAVIYYF

SEQ ID NO: 1747753 - protein, 17 aa, Staphylococcus epidermidis
WYPEMPNWITAAATILI

SEQ ID NO: 1747754 - protein, 19 aa, Staphylococcus epidermidis
YAIFIKYNLGYSVWNNHKY

SEQ ID NO: 1747755 - protein, 17 aa, Staphylococcus epidermidis
YCGFNFILLLFGYLTFY

SEQ ID NO: 1747756 - protein, 17 aa, Staphylococcus epidermidis
YDISHTVPNEWKEFFYK

SEQ ID NO: 1747757 - protein, 24 aa, Staphylococcus epidermidis
YDLWRWDFGKLLIPFRIFLSTFPV

SEQ ID NO: 1747758 - protein, 19 aa, Staphylococcus epidermidis
YDRAVELYYYIKGGRVDYG

SEQ ID NO: 1747759 - protein, 22 aa, Staphylococcus epidermidis
YESFKQKRFNVFVDGGYMLDNV

SEQ ID NO: 1747760 - protein, 17 aa, Staphylococcus epidermidis
YEYKTMSSYNFKQGDKI

SEQ ID NO: 1747761 - protein, 17 aa, Staphylococcus epidermidis
YFFFRSTVSLVFKTIQH

SEQ ID NO: 1747762 - protein, 17 aa, Staphylococcus epidermidis
YFLFCIVIIIALVVSFP

SEQ ID NO: 1747763 - protein, 17 aa, Staphylococcus epidermidis
YFYSLYEMIQWLTHHVN

SEQ ID NO: 1747764 - protein, 18 aa, Staphylococcus epidermidis
YGVVLARTTNGWDRSVLD

SEQ ID NO: 1747765 - protein, 20 aa, Staphylococcus epidermidis
YHIMPGYKVKFMFMIIMTMM

SEQ ID NO: 1747766 - protein, 17 aa, Staphylococcus epidermidis
YHIQIPSDERFKVGQQL

SEQ ID NO: 1747767 - protein, 18 aa, Staphylococcus epidermidis
YHIQIPSDERFKVGQQLI

SEQ ID NO: 1747768 - protein, 17 aa, Staphylococcus epidermidis
YIFRFGFNLVDGVNNIT

SEQ ID NO: 1747769 - protein, 20 aa, Staphylococcus epidermidis
YIPFELCLLLKLFKPKKAFE

SEQ ID NO: 1747770 - protein, 17 aa, Staphylococcus epidermidis
YIVSCIFGYLLFGLGLG

SEQ ID NO: 1747771 - protein, 17 aa, Staphylococcus epidermidis
YIVTQAVRPTGTGNVYT

SEQ ID NO: 1747772 - protein, 17 aa, Staphylococcus epidermidis
YKFRVATYMSINLLSGY

SEQ ID NO: 1747773 - protein, 20 aa, Staphylococcus epidermidis
YKIYPVLMCIVSIFLSITVV

SEQ ID NO: 1747774 - protein, 17 aa, Staphylococcus epidermidis
YKNKGIDVLNIYGDVQD

SEQ ID NO: 1747775 - protein, 17 aa, Staphylococcus epidermidis
YLILFLILRSVMESINE

SEQ ID NO: 1747776 - protein, 17 aa, Staphylococcus epidermidis
YLKKIWVAIKFLAVYIY

SEQ ID NO: 1747777 - protein, 17 aa, Staphylococcus epidermidis
YLLIITIVLFISFILLY

SEQ ID NO: 1747778 - protein, 17 aa, Staphylococcus epidermidis
YMHFSRTYIRLMRNVYL

SEQ ID NO: 1747779 - protein, 19 aa, Staphylococcus epidermidis
YMSSWPWDWAKPMGALMKD

SEQ ID NO: 1747780 - protein, 17 aa, Staphylococcus epidermidis
YNTRISSLYGILILLFV

SEQ ID NO: 1747781 - protein, 19 aa, Staphylococcus epidermidis
YPEEIWRGVFAFMSMMENI

SEQ ID NO: 1747782 - protein, 18 aa, Staphylococcus epidermidis
YPIIHICVIVLKPITILL

SEQ ID NO: 1747783 - protein, 21 aa, Staphylococcus epidermidis
YPVIQGCVLFIGFFVVIINTI

SEQ ID NO: 1747784 - protein, 19 aa, Staphylococcus epidermidis
YPVMMAMTLFFSFLGLLGN

SEQ ID NO: 1747785 - protein, 19 aa, Staphylococcus epidermidis
YPYKNGFKNYVFKHKDEYY

SEQ ID NO: 1747786 - protein, 17 aa, Staphylococcus epidermidis
YRFSQMRSFIIKLVGGM

SEQ ID NO: 1747787 - protein, 17 aa, Staphylococcus epidermidis
YRIGKPTSFESASEEYT

SEQ ID NO: 1747788 - protein, 20 aa, Staphylococcus epidermidis
YRIIWIFALFLSLAIMYYFL

SEQ ID NO: 1747789 - protein, 17 aa, Staphylococcus epidermidis
YRIPRTLLGILIGSSLA

SEQ ID NO: 1747790 - protein, 17 aa, Staphylococcus epidermidis
YRIPRTLLGLVIGSSLA

SEQ ID NO: 1747791 - protein, 22 aa, Staphylococcus epidermidis
YSEFSFPLLIMVIIIIFYKQIK

SEQ ID NO: 1747792 - protein, 17 aa, Staphylococcus epidermidis
YSLFILFRFKELKKKGV

SEQ ID NO: 1747793 - protein, 19 aa, Staphylococcus epidermidis
YSLYEMIQWLTHHVNEPHL

SEQ ID NO: 1747794 - protein, 29 aa, Staphylococcus epidermidis
YSPDGVVGGDGIGFAFSPGPLGQIGKEGA

SEQ ID NO: 1747795 - protein, 28 aa, Staphylococcus epidermidis
YSSRAPKRKDFVVSFIASAIVGSALGLY

SEQ ID NO: 1747796 - protein, 18 aa, Staphylococcus epidermidis
YTISMNWSLEVARALTGG

SEQ ID NO: 1747797 - protein, 26 aa, Staphylococcus epidermidis
YTISYKLKDGYTLESIASKVSARETF

SEQ ID NO: 1747798 - protein, 25 aa, Staphylococcus epidermidis
YTISYKLKDGYTLESVASKVSARET

SEQ ID NO: 1747799 - protein, 17 aa, Staphylococcus epidermidis
YTKRIAVPIGIHMLMNG

SEQ ID NO: 1747800 - protein, 18 aa, Staphylococcus epidermidis
YVEGKKVYQAFVSVEVPK

SEQ ID NO: 1747801 - protein, 23 aa, Staphylococcus epidermidis
YVRKRKFQIFKWLAIGASILGLL

SEQ ID NO: 1747802 - protein, 17 aa, Staphylococcus epidermidis
YWIAILLIYYLGVQWHL

SEQ ID NO: 1747803 - protein, 26 aa, Staphylococcus epidermidis
AFFFEAIFLSIYLYTWERFKNKWTHF

SEQ ID NO: 1747804 - protein, 17 aa, Staphylococcus epidermidis
AFITIIMMPLSYSIATG

SEQ ID NO: 1747805 - protein, 25 aa, Staphylococcus epidermidis
AKLFDIILTVFLFSLAIIMTAGGAS

SEQ ID NO: 1747806 - protein, 22 aa, Staphylococcus epidermidis
ALDLIFGIPLIVGALITVFDVF

SEQ ID NO: 1747807 - protein, 24 aa, Staphylococcus epidermidis
AVAFYPVLVPIFIALGYDSIVSVG

SEQ ID NO: 1747808 - protein, 27 aa, Staphylococcus epidermidis
DIYSIGIVLYEMLVGEPPFNGETAVSI

SEQ ID NO: 1747809 - protein, 18 aa, Staphylococcus epidermidis
EEIAIRRAFGAKGRDIEI

SEQ ID NO: 1747810 - protein, 41 aa, Staphylococcus epidermidis
EEKQSVFVSILTTLIPVLIIALLFIFFLSQAQGGGGGGRMM

SEQ ID NO: 1747811 - protein, 20 aa, Staphylococcus epidermidis
EVEKSLVYFLAALKGNDTII

SEQ ID NO: 1747812 - protein, 17 aa, Staphylococcus epidermidis
FAYWYPQVPHWLTVLFI

SEQ ID NO: 1747813 - protein, 19 aa, Staphylococcus epidermidis
FFLIAFIVLIPVIILGFLG

SEQ ID NO: 1747814 - protein, 24 aa, Staphylococcus epidermidis
FGMTAFLLVLIYRTYRVTKEDEIS

SEQ ID NO: 1747815 - protein, 26 aa, Staphylococcus epidermidis
FLVESVVLCLIGGIIGLILGIIIATL

SEQ ID NO: 1747816 - protein, 27 aa, Staphylococcus epidermidis
FPQDWTIFYWSWWLVYAPFIGLFIARI

SEQ ID NO: 1747817 - protein, 25 aa, Staphylococcus epidermidis
GALMTPLMLIVFRFPPHVAVGTSMM

SEQ ID NO: 1747818 - protein, 28 aa, Staphylococcus epidermidis
GIIAAIAFLILCIGIVVVLISVKKNLDY

SEQ ID NO: 1747819 - protein, 20 aa, Staphylococcus epidermidis
GILGFLFDDLIEKYLFSVPT

SEQ ID NO: 1747820 - protein, 22 aa, Staphylococcus epidermidis
GLSLILNYTLGISPALSSFIIN

SEQ ID NO: 1747821 - protein, 28 aa, Staphylococcus epidermidis
GMTPFYTALSIWVGGLLMVSLLSVDNKH

SEQ ID NO: 1747822 - protein, 22 aa, Staphylococcus epidermidis
GSVFLPFLISGFLFYICLPFQN

SEQ ID NO: 1747823 - protein, 25 aa, Staphylococcus epidermidis
GSVYLFMGLAIFCFVLYIAFGKYGN

SEQ ID NO: 1747824 - protein, 26 aa, Staphylococcus epidermidis
GTLIAMIFYVIQLSMPLINLSTLVTD

SEQ ID NO: 1747825 - protein, 24 aa, Staphylococcus epidermidis
GYLEQLFGPLRRLVSSFTTLTQSF

SEQ ID NO: 1747826 - protein, 35 aa, Staphylococcus epidermidis
IAVIIVVALLILFSFVPVGLWISALAAGVHVGIGT

SEQ ID NO: 1747827 - protein, 26 aa, Staphylococcus epidermidis
IGGSLWIIIYLIVLAFLSFIGSKEFK

SEQ ID NO: 1747828 - protein, 27 aa, Staphylococcus epidermidis
IIKFGIPMLIPLLIKYAIDGVINNHSL

SEQ ID NO: 1747829 - protein, 25 aa, Staphylococcus epidermidis
IIMILAILLGLRTAGALGCGIFAIV

SEQ ID NO: 1747830 - protein, 24 aa, Staphylococcus epidermidis
IKGAPWNIVLFSIGMYLVVFGLKN

SEQ ID NO: 1747831 - protein, 29 aa, Staphylococcus epidermidis
IMSSTLVTIVVFLPLVFVSGSVGEMFRPF

SEQ ID NO: 1747832 - protein, 25 aa, Staphylococcus epidermidis
IPFDKKREFDPNLAPGTEKVVQKGE

SEQ ID NO: 1747833 - protein, 26 aa, Staphylococcus epidermidis
KAIKQVFWRILLFYVLSIAVIAAIIP

SEQ ID NO: 1747834 - protein, 24 aa, Staphylococcus epidermidis
KDKKLFNISWIVLTVLLVGYLISE

SEQ ID NO: 1747835 - protein, 24 aa, Staphylococcus epidermidis
LEAVFWMINKILKLAPIGVFAFIC

SEQ ID NO: 1747836 - protein, 25 aa, Staphylococcus epidermidis
LFLCTLLVWLMTPGLSLFYGGLVQS

SEQ ID NO: 1747837 - protein, 26 aa, Staphylococcus epidermidis
LIISVLGAWLGWTLLAGELPFIVAKD

SEQ ID NO: 1747838 - protein, 26 aa, Staphylococcus epidermidis
LLLISTITIISFIGLGAIIHNTIYQT

SEQ ID NO: 1747839 - protein, 27 aa, Staphylococcus epidermidis
LRANRLFWAFALCLLPFSLMLVGGERA

SEQ ID NO: 1747840 - protein, 21 aa, Staphylococcus epidermidis
LSILNYFVLLPLYGMIFNLGD

SEQ ID NO: 1747841 - protein, 41 aa, Staphylococcus epidermidis
LSTTQFVIWLQNGVWAIIVYFIVCLLISFLALISMNIRILS

SEQ ID NO: 1747842 - protein, 23 aa, Staphylococcus epidermidis
LVNIVFILFIFVFATKAGVFPMY

SEQ ID NO: 1747843 - protein, 27 aa, Staphylococcus epidermidis
MGPFGALLYGFFNRLLIPTGLHHALNN

SEQ ID NO: 1747844 - protein, 25 aa, Staphylococcus epidermidis
MIKTTLLITWLLPVGVAIIPYSIQF

SEQ ID NO: 1747845 - protein, 17 aa, Staphylococcus epidermidis
MTEPELLDKICGLLGGR

SEQ ID NO: 1747846 - protein, 18 aa, Staphylococcus epidermidis
PMIVHYFFDLMVSMGIFC

SEQ ID NO: 1747847 - protein, 21 aa, Staphylococcus epidermidis
PPYIQALIAGIITWLLTALGA

SEQ ID NO: 1747848 - protein, 21 aa, Staphylococcus epidermidis
PYTIVFYFSLFSVVVLIPFSI

SEQ ID NO: 1747849 - protein, 22 aa, Staphylococcus epidermidis
QTIAIWFRHLFMFSPNADLMLN

SEQ ID NO: 1747850 - protein, 17 aa, Staphylococcus epidermidis
RFDSFMFVLPLLNILLI

SEQ ID NO: 1747851 - protein, 20 aa, Staphylococcus epidermidis
RGQLMGIMFIGVGLVEALPI

SEQ ID NO: 1747852 - protein, 18 aa, Staphylococcus epidermidis
RTGLYIIDSQLLKGHVYN

SEQ ID NO: 1747853 - protein, 34 aa, Staphylococcus epidermidis
SLHTKLVIVYVLLIIIGMQIIGLYFTNSLEKELL

SEQ ID NO: 1747854 - protein, 24 aa, Staphylococcus epidermidis
SLIGMLMLIGIVVTNAIVLIDRVI

SEQ ID NO: 1747855 - protein, 19 aa, Staphylococcus epidermidis
SLLGFLFYNFHPAKIFLGD

SEQ ID NO: 1747856 - protein, 25 aa, Staphylococcus epidermidis
SLYGGMILLPLYLQNLRGFSALDSG

SEQ ID NO: 1747857 - protein, 17 aa, Staphylococcus epidermidis
SVNLGIMNLLPIPALDG

SEQ ID NO: 1747858 - protein, 28 aa, Staphylococcus epidermidis
TAISLFITVILGFFIARTITKPITDMRN

SEQ ID NO: 1747859 - protein, 24 aa, Staphylococcus epidermidis
TKAGVFPMYVWLPGAYYAPPVAII

SEQ ID NO: 1747860 - protein, 20 aa, Staphylococcus epidermidis
TLFILLVILTIVSLFIGVSQ

SEQ ID NO: 1747861 - protein, 25 aa, Staphylococcus epidermidis
TLVLVLIIMTLFLNFAPYGKQGLQA

SEQ ID NO: 1747862 - protein, 22 aa, Staphylococcus epidermidis
TVLVPFLTHLPISAALLASGIG

SEQ ID NO: 1747863 - protein, 26 aa, Staphylococcus epidermidis
VEALQNIYLRVYYPPIVIGLTAIVSV

SEQ ID NO: 1747864 - protein, 19 aa, Staphylococcus epidermidis
VFITPVILTLVLAFGLSAF

SEQ ID NO: 1747865 - protein, 25 aa, Staphylococcus epidermidis
VLDTITYFVAAVAGISLFIAGIGVM

SEQ ID NO: 1747866 - protein, 18 aa, Staphylococcus epidermidis
VMLLTIAIILGFGALEIG

SEQ ID NO: 1747867 - protein, 24 aa, Staphylococcus epidermidis
VRNKIFFTLAMLVIFKIGTYIPAP

SEQ ID NO: 1747868 - protein, 25 aa, Staphylococcus epidermidis
VVSTVIFFLVFFYALDIGINALKQL

SEQ ID NO: 1747869 - protein, 21 aa, Staphylococcus epidermidis
YFNIFLIFLGIGLVIPVLPVY

SEQ ID NO: 1747870 - protein, 19 aa, Staphylococcus epidermidis
YFVILMVIPMWAQHKVKSN

SEQ ID NO: 1747871 - protein, 23 aa, Staphylococcus epidermidis
YFVQTIVMFLIVLGSIGFPVLLE

SEQ ID NO: 1747872 - protein, 18 aa, Staphylococcus epidermidis
YVISDAVHIGWKGWVYVD

SEQ ID NO: 1747873 - protein, 21 aa, Staphylococcus epidermidis
AAIPIILFLLCLTVFKMKGIY

SEQ ID NO: 1747874 - protein, 24 aa, Staphylococcus epidermidis
ACGFFLFMFGGVASDAWIACLAGG

SEQ ID NO: 1747875 - protein, 23 aa, Staphylococcus epidermidis
ADPEYIFYAYKRYNFEQKDPNFT

SEQ ID NO: 1747876 - protein, 18 aa, Staphylococcus epidermidis
AFIQIFLGMILYLTPIPV

SEQ ID NO: 1747877 - protein, 25 aa, Staphylococcus epidermidis
AGGTRIRPILMTAIATIGALVPLLF

SEQ ID NO: 1747878 - protein, 24 aa, Staphylococcus epidermidis
AGLLILIGLILVLSIFKPTHRKPG

SEQ ID NO: 1747879 - protein, 31 aa, Staphylococcus epidermidis
AIEEQFYLFFPFILLGLLKFFKKRTTMIILL

SEQ ID NO: 1747880 - protein, 18 aa, Staphylococcus epidermidis
AIFILILLENVLPVVPSE

SEQ ID NO: 1747881 - protein, 30 aa, Staphylococcus epidermidis
AIGIFCIIMIFALLGFLPYNLNPAKVFMGD

SEQ ID NO: 1747882 - protein, 26 aa, Staphylococcus epidermidis
AIGMALGLVWYLLFNRKTLGSIGMKP

SEQ ID NO: 1747883 - protein, 24 aa, Staphylococcus epidermidis
AIINLLLGFIPFFTSSITIMFIML

SEQ ID NO: 1747884 - protein, 25 aa, Staphylococcus epidermidis
AIIVLVLFIRLILLPFMLSNYKNSH

SEQ ID NO: 1747885 - protein, 19 aa, Staphylococcus epidermidis
AILFTLLTETITFFTRVPL

SEQ ID NO: 1747886 - protein, 24 aa, Staphylococcus epidermidis
AIVAQLIMIFGFQLPPGSAPVTAV

SEQ ID NO: 1747887 - protein, 17 aa, Staphylococcus epidermidis
AIYWAMWPTTAEVILII

SEQ ID NO: 1747888 - protein, 28 aa, Staphylococcus epidermidis
AKQAKKDLEYILDPIKNRPSLLDRINKG

SEQ ID NO: 1747889 - protein, 20 aa, Staphylococcus epidermidis
ALIALLAFLSILFLIPKKQS

SEQ ID NO: 1747890 - protein, 20 aa, Staphylococcus epidermidis
ALITLFNILIHLGFASATSL

SEQ ID NO: 1747891 - protein, 26 aa, Staphylococcus epidermidis
ALLITFILVPILIPTLKRMKFGQSIR

SEQ ID NO: 1747892 - protein, 17 aa, Staphylococcus epidermidis
ALMIPLFGVGKTPAIIA

SEQ ID NO: 1747893 - protein, 32 aa, Staphylococcus epidermidis
ALNWSLNHKWIVLIVSIFILVGSVVIGARNLG

SEQ ID NO: 1747894 - protein, 29 aa, Staphylococcus epidermidis
ALSSFIINAILIIVGWKFLSRTTAIYTAI

SEQ ID NO: 1747895 - protein, 18 aa, Staphylococcus epidermidis
ALTSWLKGMQGANIIILA

SEQ ID NO: 1747896 - protein, 18 aa, Staphylococcus epidermidis
ALYSRLPLQFVLIKAIKK

SEQ ID NO: 1747897 - protein, 46 aa, Staphylococcus epidermidis
AMIAAIIIVYLILVITFRGGLAPFTILFSLPFTVIGVVLALIITGE

SEQ ID NO: 1747898 - protein, 36 aa, Staphylococcus epidermidis
ANAANNGIMGVIYKAQLYLAPYSPKGYIEKLGQNLS

SEQ ID NO: 1747899 - protein, 33 aa, Staphylococcus epidermidis
APLYALMILVVSVKLFGFLRAITRYIERLLSHK

SEQ ID NO: 1747900 - protein, 29 aa, Staphylococcus epidermidis
AQALLPIFSILFFGVAWLFSRKPSKILDY

SEQ ID NO: 1747901 - protein, 18 aa, Staphylococcus epidermidis
AQLRHEYYSLKNRLNDIA

SEQ ID NO: 1747902 - protein, 23 aa, Staphylococcus epidermidis
ASKFKLIFKHILPNTLGAIVVTS

SEQ ID NO: 1747903 - protein, 30 aa, Staphylococcus epidermidis
ASSQKFLIIYSIIFMLVIVAVVLSMFAIFI

SEQ ID NO: 1747904 - protein, 27 aa, Staphylococcus epidermidis
ATGIACGFIFYPITMIITKKYKEVHPI

SEQ ID NO: 1747905 - protein, 21 aa, Staphylococcus epidermidis
ATILFIIIVVFLMYANHLFIK

SEQ ID NO: 1747906 - protein, 29 aa, Staphylococcus epidermidis
ATNRPDILDPALLRPGRFDRQIQVGRPDV

SEQ ID NO: 1747907 - protein, 23 aa, Staphylococcus epidermidis
ATTAFFLVLAFRTYKELGTDNVE

SEQ ID NO: 1747908 - protein, 27 aa, Staphylococcus epidermidis
ATVLSYPVYLFIIGLIVLIVVGTFRVA

SEQ ID NO: 1747909 - protein, 20 aa, Staphylococcus epidermidis
AVEILFATIGLIIGLFISVM

SEQ ID NO: 1747910 - protein, 18 aa, Staphylococcus epidermidis
AVFFSWLTFLNIGPEMIK

SEQ ID NO: 1747911 - protein, 25 aa, Staphylococcus epidermidis
AVVLSMFAIFIFKYSYKKNSESGKM

SEQ ID NO: 1747912 - protein, 28 aa, Staphylococcus epidermidis
AWALIPLLLFVLLFLGVGIISGDFTTMP

SEQ ID NO: 1747913 - protein, 36 aa, Staphylococcus epidermidis
AYPGNFVQAVNQYWPEHMDFRWAQGSGTPSSRNAGS

SEQ ID NO: 1747914 - protein, 21 aa, Staphylococcus epidermidis
CATFLPQAFLSYAIGGVFHVK

SEQ ID NO: 1747915 - protein, 26 aa, Staphylococcus epidermidis
CIIGAIFVISYLFWYCKKIKKDPKSS

SEQ ID NO: 1747916 - protein, 17 aa, Staphylococcus epidermidis
CTPPIGLGLATFVRKHQ

SEQ ID NO: 1747917 - protein, 21 aa, Staphylococcus epidermidis
DANTTIDGLTYLNEAQRNKAK

SEQ ID NO: 1747918 - protein, 21 aa, Staphylococcus epidermidis
DEIFQVYMNKIYYSDGVTGIK

SEQ ID NO: 1747919 - protein, 25 aa, Staphylococcus epidermidis
DELSKFYILVLFAGLFHLMNHAVFK

SEQ ID NO: 1747920 - protein, 20 aa, Staphylococcus epidermidis
DFIRYSLISGLLIGFIAPLI

SEQ ID NO: 1747921 - protein, 24 aa, Staphylococcus epidermidis
DGESKWTFRKLLNYGIDGLISFNN

SEQ ID NO: 1747922 - protein, 18 aa, Staphylococcus epidermidis
DGLTYLNEAQRNKAKENV

SEQ ID NO: 1747923 - protein, 24 aa, Staphylococcus epidermidis
DGSRLLFYYAPVAILISLLSVTAS

SEQ ID NO: 1747924 - protein, 39 aa, Staphylococcus epidermidis
DKKRSKMKIAILSIIFVILLIGLFSFVAMAVFGNKYEEM

SEQ ID NO: 1747925 - protein, 26 aa, Staphylococcus epidermidis
DKWRSKFQLIIIFGIFSMISNFTGIE

SEQ ID NO: 1747926 - protein, 20 aa, Staphylococcus epidermidis
DLNLAEEAYLAGLPQVPNLY

SEQ ID NO: 1747927 - protein, 20 aa, Staphylococcus epidermidis
DLQVLAIYREMNAGSTLDPQ

SEQ ID NO: 1747928 - protein, 23 aa, Staphylococcus epidermidis
DNAKELLLKGLEKLEYRGYDSAG

SEQ ID NO: 1747929 - protein, 33 aa, Staphylococcus epidermidis
DNLLTPLLSIFITAFITFLFVGPVTRQLGYWLS

SEQ ID NO: 1747930 - protein, 28 aa, Staphylococcus epidermidis
DPKQPPFFFSVLLPIVFISALIGILQYT

SEQ ID NO: 1747931 - protein, 30 aa, Staphylococcus epidermidis
DRFLNNIWFYLIFFLFFGLFLLLITLIVEK

SEQ ID NO: 1747932 - protein, 27 aa, Staphylococcus epidermidis
DSFGYGFFIPIFFIMVGVDLDIPSLIK

SEQ ID NO: 1747933 - protein, 22 aa, Staphylococcus epidermidis
DVFFSLTWIIISISLILNLIKV

SEQ ID NO: 1747934 - protein, 26 aa, Staphylococcus epidermidis
DVLTRIIYAIRPSLLYVFVALIISVV

SEQ ID NO: 1747935 - protein, 27 aa, Staphylococcus epidermidis
DVVNPSNWGVWQTSQSAKFIVTNAKPN

SEQ ID NO: 1747936 - protein, 24 aa, Staphylococcus epidermidis
EADQYLIHMIPIDNISLTSDGKTK

SEQ ID NO: 1747937 - protein, 22 aa, Staphylococcus epidermidis
EADRIAKKLLSQNLSNSQIVEQ

SEQ ID NO: 1747938 - protein, 44 aa, Staphylococcus epidermidis
EDTNNAITIIILITAIIFTIASTIFAFFLSNRITKPLRQLKTQA

SEQ ID NO: 1747939 - protein, 25 aa, Staphylococcus epidermidis
EEFYLKKIWVAIKFLAVYLYQLITS

SEQ ID NO: 1747940 - protein, 24 aa, Staphylococcus epidermidis
EIADKWQNRYNRRGSANYKTNTVA

SEQ ID NO: 1747941 - protein, 22 aa, Staphylococcus epidermidis
EIIHKLILKYLLWYIKTVKGSV

SEQ ID NO: 1747942 - protein, 33 aa, Staphylococcus epidermidis
EKMRFIPYLIFVSLWVLLIYSPVAHWVWGGGWI

SEQ ID NO: 1747943 - protein, 34 aa, Staphylococcus epidermidis
EKNLALVGHIDPGNYFITVKFGDKVEQFEIRSKP

SEQ ID NO: 1747944 - protein, 28 aa, Staphylococcus epidermidis
EMFRPFALAITFSLLASLLVSITLVPSL

SEQ ID NO: 1747945 - protein, 23 aa, Staphylococcus epidermidis
EMGIYMFVLLLLGGMSLYIAVSR

SEQ ID NO: 1747946 - protein, 22 aa, Staphylococcus epidermidis
ENEAWLWVLVLVAFAVTVIATI

SEQ ID NO: 1747947 - protein, 27 aa, Staphylococcus epidermidis
ENLITKVIMILIYILVAIVVIAILNKI

SEQ ID NO: 1747948 - protein, 23 aa, Staphylococcus epidermidis
EPALVSAISVLVIACPCALGLAT

SEQ ID NO: 1747949 - protein, 28 aa, Staphylococcus epidermidis
EPSLLLIIPVLIFSFIISKLIPVFYIRR

SEQ ID NO: 1747950 - protein, 25 aa, Staphylococcus epidermidis
ERDKKDFWIQMYPSSAKKLMRKEQL

SEQ ID NO: 1747951 - protein, 25 aa, Staphylococcus epidermidis
ERNINRIILMFSLTNDLKITINGET

SEQ ID NO: 1747952 - protein, 25 aa, Staphylococcus epidermidis
ETLNKWCFWFFMIGFNVCFLPQFIL

SEQ ID NO: 1747953 - protein, 18 aa, Staphylococcus epidermidis
EVFKPIMSSTLVTIVVFL

SEQ ID NO: 1747954 - protein, 18 aa, Staphylococcus epidermidis
EVTNVFFVFFFVGFIGFF

SEQ ID NO: 1747955 - protein, 30 aa, Staphylococcus epidermidis
FADMAILLGLNWLAILLYMEAVVSPFGTGV

SEQ ID NO: 1747956 - protein, 22 aa, Staphylococcus epidermidis
FAINFFVYLCMYLLIVVIASYS

SEQ ID NO: 1747957 - protein, 17 aa, Staphylococcus epidermidis
FAPFAFLTGIPWQDAVQ

SEQ ID NO: 1747958 - protein, 26 aa, Staphylococcus epidermidis
FATMLLLGILMIFVTAVFLSRGLLSL

SEQ ID NO: 1747959 - protein, 26 aa, Staphylococcus epidermidis
FDIKGLIIFYIFIALLMFGLLNQHHI

SEQ ID NO: 1747960 - protein, 19 aa, Staphylococcus epidermidis
FFLLAPLFVSMVAGIAFLK

SEQ ID NO: 1747961 - protein, 19 aa, Staphylococcus epidermidis
FFSSWFLTFGYVCVVALNA

SEQ ID NO: 1747962 - protein, 25 aa, Staphylococcus epidermidis
FFTLFLNFIILVISILLIIYGVPIY

SEQ ID NO: 1747963 - protein, 24 aa, Staphylococcus epidermidis
FGSKILLMIVLRLLGINVSVSIIF

SEQ ID NO: 1747964 - protein, 22 aa, Staphylococcus epidermidis
FIKPLMLMFIVSSFIGALISYI

SEQ ID NO: 1747965 - protein, 17 aa, Staphylococcus epidermidis
FILAFPMAIIWPTIQNG

SEQ ID NO: 1747966 - protein, 23 aa, Staphylococcus epidermidis
FILTLIFVIWQPKGLDIGITALI

SEQ ID NO: 1747967 - protein, 24 aa, Staphylococcus epidermidis
FIQNFFMLAFFTTIGLGASLKLFK

SEQ ID NO: 1747968 - protein, 17 aa, Staphylococcus epidermidis
FKRTRVSMFIWLVLLLP

SEQ ID NO: 1747969 - protein, 22 aa, Staphylococcus epidermidis
FLFKRLSWPYGLIIAAVIITSL

SEQ ID NO: 1747970 - protein, 17 aa, Staphylococcus epidermidis
FLIIFMAFLLIITKSKS

SEQ ID NO: 1747971 - protein, 28 aa, Staphylococcus epidermidis
FLLAFISLFLVIWFPASPFIIIFSAIML

SEQ ID NO: 1747972 - protein, 20 aa, Staphylococcus epidermidis
FLLIMVPFFLIYMLKDHEKF

SEQ ID NO: 1747973 - protein, 22 aa, Staphylococcus epidermidis
FLSFGRYVSFFSSWFLTFGYVC

SEQ ID NO: 1747974 - protein, 17 aa, Staphylococcus epidermidis
FLTFGYVCVVALNATAF

SEQ ID NO: 1747975 - protein, 28 aa, Staphylococcus epidermidis
FLTTGTPYWFVILVYTIRMIALGLLVMP

SEQ ID NO: 1747976 - protein, 19 aa, Staphylococcus epidermidis
FMILFILTVVAVIATWIIP

SEQ ID NO: 1747977 - protein, 28 aa, Staphylococcus epidermidis
FMIYIVILMFMFLLLFNGTEFKITAIFI

SEQ ID NO: 1747978 - protein, 26 aa, Staphylococcus epidermidis
FMLGVTIFILIYWLNPPGHAWLDNLS

SEQ ID NO: 1747979 - protein, 18 aa, Staphylococcus epidermidis
FMLLTLISGFWELIEEFM

SEQ ID NO: 1747980 - protein, 25 aa, Staphylococcus epidermidis
FNPVFALWFLLTLFFFHVVLVIVRR

SEQ ID NO: 1747981 - protein, 19 aa, Staphylococcus epidermidis
FRMNSIMQILTLVSVIFSP

SEQ ID NO: 1747982 - protein, 24 aa, Staphylococcus epidermidis
FSILPIMMIIYGIVAKIIVIWFFR

SEQ ID NO: 1747983 - protein, 26 aa, Staphylococcus epidermidis
FSLIASILVLWLYFRKSIPRKFDAVN

SEQ ID NO: 1747984 - protein, 17 aa, Staphylococcus epidermidis
FTIGLYLVIGPFFALPR

SEQ ID NO: 1747985 - protein, 20 aa, Staphylococcus epidermidis
FTSKRWLIISISIFIIMMII

SEQ ID NO: 1747986 - protein, 26 aa, Staphylococcus epidermidis
FTYIEALFALFVTTLILALLPTILKL

SEQ ID NO: 1747987 - protein, 19 aa, Staphylococcus epidermidis
FVDLFSWRMPFYLVSAIAA

SEQ ID NO: 1747988 - protein, 21 aa, Staphylococcus epidermidis
FVILITLRKRLKLGETFFGYL

SEQ ID NO: 1747989 - protein, 17 aa, Staphylococcus epidermidis
FVKRIHLGWFVLPVPIV

SEQ ID NO: 1747990 - protein, 19 aa, Staphylococcus epidermidis
FVLINLIITFPILRKFKVA

SEQ ID NO: 1747991 - protein, 17 aa, Staphylococcus epidermidis
FVLLRLIPTLIINFLLL

SEQ ID NO: 1747992 - protein, 19 aa, Staphylococcus epidermidis
FVYSIKFILHIFFGSYKPE

SEQ ID NO: 1747993 - protein, 17 aa, Staphylococcus epidermidis
FYISMFALLLAIVVAVP

SEQ ID NO: 1747994 - protein, 25 aa, Staphylococcus epidermidis
GAFGWLIFEYILKKTTSLLGLLSGA

SEQ ID NO: 1747995 - protein, 25 aa, Staphylococcus epidermidis
GAFLLMFLIFTIFVGLPLLIMEFTV

SEQ ID NO: 1747996 - protein, 26 aa, Staphylococcus epidermidis
GAIIIYPMLLLLPPLVGLPTYSAYIA

SEQ ID NO: 1747997 - protein, 29 aa, Staphylococcus epidermidis
GASALIPLFKLLVVVVFAMVFFVIVVLGI

SEQ ID NO: 1747998 - protein, 23 aa, Staphylococcus epidermidis
GAYILWGILPIYWRLIDEIGAFE

SEQ ID NO: 1747999 - protein, 21 aa, Staphylococcus epidermidis
GDGKWGFSFLDKDGDLAGSYT

SEQ ID NO: 1748000 - protein, 17 aa, Staphylococcus epidermidis
GFTLFAMFFGAGNLIFP

SEQ ID NO: 1748001 - protein, 24 aa, Staphylococcus epidermidis
GGSTSHIPVVIYYSDGSSEEATET

SEQ ID NO: 1748002 - protein, 26 aa, Staphylococcus epidermidis
GHDVSWGEWFLYAAPWSIIMSIALYF

SEQ ID NO: 1748003 - protein, 18 aa, Staphylococcus epidermidis
GHIALIFGLGAILGKLLA

SEQ ID NO: 1748004 - protein, 29 aa, Staphylococcus epidermidis
GIIATFIGWRWIFVLSIIFSIIALILLRG

SEQ ID NO: 1748005 - protein, 25 aa, Staphylococcus epidermidis
GIICLIMLKLMLAIAFFVVSLTISL

SEQ ID NO: 1748006 - protein, 18 aa, Staphylococcus epidermidis
GIIFFLALAVLFSSDRKN

SEQ ID NO: 1748007 - protein, 24 aa, Staphylococcus epidermidis
GIIGLILGIIIATLIDLVTPEMVK

SEQ ID NO: 1748008 - protein, 37 aa, Staphylococcus epidermidis
GISFDPFTPLLVAALLYFLLTFALTRVMNFIEGRMSA

SEQ ID NO: 1748009 - protein, 24 aa, Staphylococcus epidermidis
GIVAKIIVIWFFRKYDNHMRGSVG

SEQ ID NO: 1748010 - protein, 22 aa, Staphylococcus epidermidis
GIVIWIVFHLILMPIMHVVPNA

SEQ ID NO: 1748011 - protein, 32 aa, Staphylococcus epidermidis
GIVPEILITKVIILGLFGIGFMVVGYCLKPVT

SEQ ID NO: 1748012 - protein, 17 aa, Staphylococcus epidermidis
GLDLIVVILLAPAVTFG

SEQ ID NO: 1748013 - protein, 23 aa, Staphylococcus epidermidis
GLGLILGIFAYAASFFGAFVMIN

SEQ ID NO: 1748014 - protein, 25 aa, Staphylococcus epidermidis
GLLLKIAFNFGLPLLIALLHALFAA

SEQ ID NO: 1748015 - protein, 27 aa, Staphylococcus epidermidis
GLSLIPQNLIIVGLFIICMFVSISMGT

SEQ ID NO: 1748016 - protein, 21 aa, Staphylococcus epidermidis
GLTWLYEFGGAIGGLIFGLLY

SEQ ID NO: 1748017 - protein, 22 aa, Staphylococcus epidermidis
GLVIIFLFIWMNFKTVQLQCFN

SEQ ID NO: 1748018 - protein, 17 aa, Staphylococcus epidermidis
GMLMLSGFFLGIGGAIF

SEQ ID NO: 1748019 - protein, 19 aa, Staphylococcus epidermidis
GMMLIGEACLFLLNIPSGV

SEQ ID NO: 1748020 - protein, 25 aa, Staphylococcus epidermidis
GMNTVIFTVFLYALLPIIKNTYTGI

SEQ ID NO: 1748021 - protein, 23 aa, Staphylococcus epidermidis
GMPMLWANFFWVWGHPEVYIVIL

SEQ ID NO: 1748022 - protein, 24 aa, Staphylococcus epidermidis
GNGLKMFVYIMLLGAIVAAFFAND

SEQ ID NO: 1748023 - protein, 24 aa, Staphylococcus epidermidis
GPIIVLFTLLFLLLGSSFGSIASG

SEQ ID NO: 1748024 - protein, 30 aa, Staphylococcus epidermidis
GQYMGYLILIFFVFVFALLFINVDTRRAIY

SEQ ID NO: 1748025 - protein, 24 aa, Staphylococcus epidermidis
GRFEVLYLTIPLLILAFVFANHFT

SEQ ID NO: 1748026 - protein, 28 aa, Staphylococcus epidermidis
GSLAGIIILFLWLYITSFIIIIGAEINA

SEQ ID NO: 1748027 - protein, 32 aa, Staphylococcus epidermidis
GSQKRIEFYRLYLLMIHLLKFGGMYADSVQRS

SEQ ID NO: 1748028 - protein, 23 aa, Staphylococcus epidermidis
GTHWLMHLLPPVVVGPVIMVIGL

SEQ ID NO: 1748029 - protein, 23 aa, Staphylococcus epidermidis
GTIIALLLIYLVAITFQFGNQII

SEQ ID NO: 1748030 - protein, 24 aa, Staphylococcus epidermidis
GTSAAYFYSIYEMMMWLTHQTHHP

SEQ ID NO: 1748031 - protein, 22 aa, Staphylococcus epidermidis
GTVFAILCWFVISVAIFLVRHI

SEQ ID NO: 1748032 - protein, 21 aa, Staphylococcus epidermidis
GVLASFLFRNTQPSIDLLVEA

SEQ ID NO: 1748033 - protein, 22 aa, Staphylococcus epidermidis
GVSFMVPFIVVGGLLIAIALTL

SEQ ID NO: 1748034 - protein, 21 aa, Staphylococcus epidermidis
GVTLFLLLKAFSSGASSLTGV

SEQ ID NO: 1748035 - protein, 28 aa, Staphylococcus epidermidis
GWIGVTLIFGAFAFFWFVGIHGPSIVEP

SEQ ID NO: 1748036 - protein, 23 aa, Staphylococcus epidermidis
GWLGWLVTILLWGTTLWGILYKS

SEQ ID NO: 1748037 - protein, 19 aa, Staphylococcus epidermidis
GWRSIFIVSIILTILSMFL

SEQ ID NO: 1748038 - protein, 26 aa, Staphylococcus epidermidis
HAITLVSFIALPMIIINSLGTAIFLT

SEQ ID NO: 1748039 - protein, 25 aa, Staphylococcus epidermidis
HAYAKVWLYFMYYWMIFGIGCYFGQ

SEQ ID NO: 1748040 - protein, 30 aa, Staphylococcus epidermidis
HFVPMIITIILCYLGFQFGLKKRDEMLMFL

SEQ ID NO: 1748041 - protein, 21 aa, Staphylococcus epidermidis
HHVFWISFVAIFVGTALPLAA

SEQ ID NO: 1748042 - protein, 21 aa, Staphylococcus epidermidis
HIPFYILGFLAAFIVGLIAIK

SEQ ID NO: 1748043 - protein, 34 aa, Staphylococcus epidermidis
HKRNKLIISAILSLPLLLVMVVHISPISIPSILV

SEQ ID NO: 1748044 - protein, 23 aa, Staphylococcus epidermidis
HKVRGLLSFWIGTLLIAFTLLSN

SEQ ID NO: 1748045 - protein, 31 aa, Staphylococcus epidermidis
HLGVAIGIALFIFLIVRPPIEFIRQYLAQWT

SEQ ID NO: 1748046 - protein, 27 aa, Staphylococcus epidermidis
HPTGSSLKPFLAYGPAIENMKWSTNHA

SEQ ID NO: 1748047 - protein, 24 aa, Staphylococcus epidermidis
HSLFTWIFTLFFIALSFFLVIDAS

SEQ ID NO: 1748048 - protein, 24 aa, Staphylococcus epidermidis
HSNIILMMLIFILAGAFSTTAEKM

SEQ ID NO: 1748049 - protein, 22 aa, Staphylococcus epidermidis
HSSNVYMFKTALKLAGDPYTSG

SEQ ID NO: 1748050 - protein, 31 aa, Staphylococcus epidermidis
HVASEFVYNMPLLSEKPLFIYISQSGETADS

SEQ ID NO: 1748051 - protein, 18 aa, Staphylococcus epidermidis
HVKLIFIIVSAISFFMVP

SEQ ID NO: 1748052 - protein, 19 aa, Staphylococcus epidermidis
HYNTYYQPIGKPPKKKKSK

SEQ ID NO: 1748053 - protein, 25 aa, Staphylococcus epidermidis
IAGIITWLLTALGAAAVFIFKKVND

SEQ ID NO: 1748054 - protein, 19 aa, Staphylococcus epidermidis
IAIVFIIGALILAASTNLA

SEQ ID NO: 1748055 - protein, 31 aa, Staphylococcus epidermidis
IALLISVLYIPIFFLMIYSFNSAGNMSHFEH

SEQ ID NO: 1748056 - protein, 17 aa, Staphylococcus epidermidis
IAMPVIMAGIRTAMVLI

SEQ ID NO: 1748057 - protein, 25 aa, Staphylococcus epidermidis
IANYLTIMFLLLVLVGMLLNKETVV

SEQ ID NO: 1748058 - protein, 18 aa, Staphylococcus epidermidis
IASLFIPFGASIGLDTMA

SEQ ID NO: 1748059 - protein, 22 aa, Staphylococcus epidermidis
IAVISYFKLWKYLYKEWFTSVD

SEQ ID NO: 1748060 - protein, 19 aa, Staphylococcus epidermidis
ICASYVVNDILKDIPVRRI

SEQ ID NO: 1748061 - protein, 51 aa, Staphylococcus epidermidis
IDYVLLGILPNKTAWWLVIPVGIIYAVIYYFVFRFLIVKFNYKTPGREDKK

SEQ ID NO: 1748062 - protein, 20 aa, Staphylococcus epidermidis
IEYTVPPLSLLKQPTKQKTT

SEQ ID NO: 1748063 - protein, 20 aa, Staphylococcus epidermidis
IFAIFLTGAISLLIGLTYYK

SEQ ID NO: 1748064 - protein, 29 aa, Staphylococcus epidermidis
IFANAPFTLLPILIGFSAAKRFGGNPYLG

SEQ ID NO: 1748065 - protein, 18 aa, Staphylococcus epidermidis
IFFLVIGIMYFIITLLLM

SEQ ID NO: 1748066 - protein, 18 aa, Staphylococcus epidermidis
IFLIRVISGIVIFRQGWE

SEQ ID NO: 1748067 - protein, 29 aa, Staphylococcus epidermidis
IFQTINPLFILLFAPVVTLLWQKLGKKQP

SEQ ID NO: 1748068 - protein, 21 aa, Staphylococcus epidermidis
IFRFIIFLVQIYYFGMIIYFF

SEQ ID NO: 1748069 - protein, 26 aa, Staphylococcus epidermidis
IFSGFIIGAFFLPLVMLGLHHIFTPI

SEQ ID NO: 1748070 - protein, 19 aa, Staphylococcus epidermidis
IFVSFFFSGSETALTAANR

SEQ ID NO: 1748071 - protein, 20 aa, Staphylococcus epidermidis
IGALLLAFYFYRDNPDLKNA

SEQ ID NO: 1748072 - protein, 25 aa, Staphylococcus epidermidis
IGIPKWIQFLFIVIVAMVISASMRV

SEQ ID NO: 1748073 - protein, 25 aa, Staphylococcus epidermidis
IGKALMLPVAILPAAGLLLAIGTAF

SEQ ID NO: 1748074 - protein, 17 aa, Staphylococcus epidermidis
IGSMLFGLFFGAGNLIF

SEQ ID NO: 1748075 - protein, 17 aa, Staphylococcus epidermidis
IGTLLYILITKAKIPAY

SEQ ID NO: 1748076 - protein, 30 aa, Staphylococcus epidermidis
IGVILLVTFLIYLFYSPRLKFDVLENPNKN

SEQ ID NO: 1748077 - protein, 26 aa, Staphylococcus epidermidis
IIAAIIWNLITWLYGIPSSSSHALIG

SEQ ID NO: 1748078 - protein, 25 aa, Staphylococcus epidermidis
IIALLIFLPILLKGGLILMLFAFLL

SEQ ID NO: 1748079 - protein, 17 aa, Staphylococcus epidermidis
IIANFWWIQAAGAVYLI

SEQ ID NO: 1748080 - protein, 21 aa, Staphylococcus epidermidis
IIGISFLLYFIQTPMYYMVAI

SEQ ID NO: 1748081 - protein, 40 aa, Staphylococcus epidermidis
IIGRMIDSFFNYLFGMSRYLTYILVLIATIFITYSKQIPR

SEQ ID NO: 1748082 - protein, 24 aa, Staphylococcus epidermidis
IIGSWRMLIIYIISGLYGNFVSLS

SEQ ID NO: 1748083 - protein, 17 aa, Staphylococcus epidermidis
IIIAFALAFIGLIKPVI

SEQ ID NO: 1748084 - protein, 18 aa, Staphylococcus epidermidis
IIILSLIIIVACLKTAIG

SEQ ID NO: 1748085 - protein, 30 aa, Staphylococcus epidermidis
IIISGVIFIIFLFLPASWFTGLVTNKTLAD

SEQ ID NO: 1748086 - protein, 27 aa, Staphylococcus epidermidis
IIIVCLSLFIVFFGISWGPVLWVMLPE

SEQ ID NO: 1748087 - protein, 23 aa, Staphylococcus epidermidis
IILFTLILQVFFYKNLPVKNQIS

SEQ ID NO: 1748088 - protein, 20 aa, Staphylococcus epidermidis
IILPPFFMATGALMYVVPYF

SEQ ID NO: 1748089 - protein, 31 aa, Staphylococcus epidermidis
IIMFIKLVFMIDYVLFHLIQRSYFKYQEEVM

SEQ ID NO: 1748090 - protein, 20 aa, Staphylococcus epidermidis
IISIIIIIEAIRRFLEPPEV

SEQ ID NO: 1748091 - protein, 23 aa, Staphylococcus epidermidis
IIVKTLLFFVIGSLVYMSGYRNY

SEQ ID NO: 1748092 - protein, 24 aa, Staphylococcus epidermidis
IKSNFIVIIIFLFNIKDFKYDDFS

SEQ ID NO: 1748093 - protein, 33 aa, Staphylococcus epidermidis
ILAIIGLLIVFVVTGFIFFSMISDQIFFKHVKP

SEQ ID NO: 1748094 - protein, 26 aa, Staphylococcus epidermidis
ILASIGIIIYVSLRFEWRMGLSSVLA

SEQ ID NO: 1748095 - protein, 19 aa, Staphylococcus epidermidis
ILDKLLKNTKETLSIHGFS

SEQ ID NO: 1748096 - protein, 24 aa, Staphylococcus epidermidis
ILGGFILFFLMKYAHVMTPEMTDS

SEQ ID NO: 1748097 - protein, 29 aa, Staphylococcus epidermidis
ILVVILIAIGVLFYMRSNKRNLIEKTEER

SEQ ID NO: 1748098 - protein, 18 aa, Staphylococcus epidermidis
IMLGFLYKYIIAYLIQTY

SEQ ID NO: 1748099 - protein, 31 aa, Staphylococcus epidermidis
IMMIGVEVIFFILRLFLEPTRFNYLIIVAIG

SEQ ID NO: 1748100 - protein, 19 aa, Staphylococcus epidermidis
IMSLIISFLIWYFSRNWRK

SEQ ID NO: 1748101 - protein, 18 aa, Staphylococcus epidermidis
IQSPYFIPDQAFLDSIKI

SEQ ID NO: 1748102 - protein, 32 aa, Staphylococcus epidermidis
IQTTPEFFQAISPYLPFTYSIDALRETVGGIV

SEQ ID NO: 1748103 - protein, 17 aa, Staphylococcus epidermidis
ISAIILNFFFNGIKYKQ

SEQ ID NO: 1748104 - protein, 25 aa, Staphylococcus epidermidis
ISEVPWLVIILVSVVAMIVISQTAT

SEQ ID NO: 1748105 - protein, 23 aa, Staphylococcus epidermidis
ISFLLCVMGILTFGIFPNLMPQF

SEQ ID NO: 1748106 - protein, 26 aa, Staphylococcus epidermidis
ISFTFAIIIVIFIQSFIIVGAVISNN

SEQ ID NO: 1748107 - protein, 17 aa, Staphylococcus epidermidis
ISGYLITSLLLSEYYRN

SEQ ID NO: 1748108 - protein, 24 aa, Staphylococcus epidermidis
ISIVLIVRFILLPFMLIQVKNMHM

SEQ ID NO: 1748109 - protein, 27 aa, Staphylococcus epidermidis
ISLSILIVIIGLIIISIFKLNLGIDFS

SEQ ID NO: 1748110 - protein, 31 aa, Staphylococcus epidermidis
ISNTVRFIIILAIIILLVFQVVRNKKLSFSY

SEQ ID NO: 1748111 - protein, 29 aa, Staphylococcus epidermidis
ISVVFAIIYNLWWFVYNIVQVAGIHLEQL

SEQ ID NO: 1748112 - protein, 18 aa, Staphylococcus epidermidis
ISVYAISVALIGPLMRII

SEQ ID NO: 1748113 - protein, 19 aa, Staphylococcus epidermidis
ISYILLIILKRRGLLDRFN

SEQ ID NO: 1748114 - protein, 18 aa, Staphylococcus epidermidis
ITDLKRVAKTPGVWVILA

SEQ ID NO: 1748115 - protein, 30 aa, Staphylococcus epidermidis
ITEPLEFSFLFVAPFLFVIHAVLDGLSFLT

SEQ ID NO: 1748116 - protein, 25 aa, Staphylococcus epidermidis
ITLIGGILVWLGWYGFNVGSAFTFD

SEQ ID NO: 1748117 - protein, 18 aa, Staphylococcus epidermidis
ITLWLSLVITMIFTVVEF

SEQ ID NO: 1748118 - protein, 23 aa, Staphylococcus epidermidis
ITNKIIGFLALLVILIGARMTVW

SEQ ID NO: 1748119 - protein, 27 aa, Staphylococcus epidermidis
ITVFDVFLLLFIMKFGFRKIEAIVGTL

SEQ ID NO: 1748120 - protein, 28 aa, Staphylococcus epidermidis
ITYMGIPVFLIFFFYHKFRYKTKKIPLN

SEQ ID NO: 1748121 - protein, 17 aa, Staphylococcus epidermidis
IVAIIVAIVIVTLVQKF

SEQ ID NO: 1748122 - protein, 32 aa, Staphylococcus epidermidis
IVGAKWVFFWSFIVLLLPIFLLGQAQSPGMLM

SEQ ID NO: 1748123 - protein, 22 aa, Staphylococcus epidermidis
IVIQWGVLALIVIFQPEIRRAL

SEQ ID NO: 1748124 - protein, 18 aa, Staphylococcus epidermidis
IVLAGKYKSRMTSFGTGK

SEQ ID NO: 1748125 - protein, 23 aa, Staphylococcus epidermidis
IVTFALMVLMYRCFGKQGLIAWV

SEQ ID NO: 1748126 - protein, 19 aa, Staphylococcus epidermidis
IVVDVIIYYPFLKVYDEQV

SEQ ID NO: 1748127 - protein, 19 aa, Staphylococcus epidermidis
IVVLWLVITAWKNIGYIKE

SEQ ID NO: 1748128 - protein, 18 aa, Staphylococcus epidermidis
IWNFALILLGRLLSDSFD

SEQ ID NO: 1748129 - protein, 17 aa, Staphylococcus epidermidis
IWNFLFLRRSLPLTKEE

SEQ ID NO: 1748130 - protein, 25 aa, Staphylococcus epidermidis
KAFIPLFILGMLFWSIQEQGSNVLN

SEQ ID NO: 1748131 - protein, 18 aa, Staphylococcus epidermidis
KAKLFPFGPIFAGILCVI

SEQ ID NO: 1748132 - protein, 19 aa, Staphylococcus epidermidis
KALYYWIRYLNYNVIYRDK

SEQ ID NO: 1748133 - protein, 21 aa, Staphylococcus epidermidis
KDETLYTIRLLPVGGYVRMAG

SEQ ID NO: 1748134 - protein, 26 aa, Staphylococcus epidermidis
KDGTIRDEVWLNKKLNYISKKTYQGI

SEQ ID NO: 1748135 - protein, 23 aa, Staphylococcus epidermidis
KDKSLFIPFIAFILLHIGQWMYT

SEQ ID NO: 1748136 - protein, 24 aa, Staphylococcus epidermidis
KDNLKVFYCLFISLTLLIMFISMY

SEQ ID NO: 1748137 - protein, 19 aa, Staphylococcus epidermidis
KELWLPIITICFILAISKI

SEQ ID NO: 1748138 - protein, 21 aa, Staphylococcus epidermidis
KFILPIVVGLIIWALTPIKPD

SEQ ID NO: 1748139 - protein, 25 aa, Staphylococcus epidermidis
KFLNPVFLILLGIVVVLAFIRPMGG

SEQ ID NO: 1748140 - protein, 35 aa, Staphylococcus epidermidis
KFYKFRFILIMFIIFLMAIMVLFISGLAQGLAREN

SEQ ID NO: 1748141 - protein, 26 aa, Staphylococcus epidermidis
KGELLPIIFFAVFFGLGLAAIGEKAE

SEQ ID NO: 1748142 - protein, 23 aa, Staphylococcus epidermidis
KGGLILMLFAFLLALIALKELLN

SEQ ID NO: 1748143 - protein, 20 aa, Staphylococcus epidermidis
KGGLLSDLFDDDGNISLPAT

SEQ ID NO: 1748144 - protein, 27 aa, Staphylococcus epidermidis
KGTSPNDFFSLRTGGPVDARIVWVNNQ

SEQ ID NO: 1748145 - protein, 19 aa, Staphylococcus epidermidis
KILGLIVALILLTVGAIFV

SEQ ID NO: 1748146 - protein, 24 aa, Staphylococcus epidermidis
KIMMPLLFIFLIIVVAQSLTLEGA

SEQ ID NO: 1748147 - protein, 18 aa, Staphylococcus epidermidis
KKHWLFIIIVMCASFIIS

SEQ ID NO: 1748148 - protein, 23 aa, Staphylococcus epidermidis
KKPLIFSLIIFTIASLGIIFVTN

SEQ ID NO: 1748149 - protein, 41 aa, Staphylococcus epidermidis
KKPLPKFLTLFAGPLFNFILALVLFIGLAYYQGTPTNVIGE

SEQ ID NO: 1748150 - protein, 24 aa, Staphylococcus epidermidis
KNRIKRMLFDRPVLLKHTDDFINA

SEQ ID NO: 1748151 - protein, 24 aa, Staphylococcus epidermidis
KPQYAIFKMPFKQLLFMSMTSGAI

SEQ ID NO: 1748152 - protein, 17 aa, Staphylococcus epidermidis
KQMGYVYFSWLLGLLVG

SEQ ID NO: 1748153 - protein, 36 aa, Staphylococcus epidermidis
KQNETPLRYIFSIIVVILIILGAFQLGIIGRMIDSF

SEQ ID NO: 1748154 - protein, 23 aa, Staphylococcus epidermidis
KQNLMMFWMIITVILGLVFVGFE

SEQ ID NO: 1748155 - protein, 31 aa, Staphylococcus epidermidis
KRDWMSTWTLYYWGWWLSWSPFVGVFIARVS

SEQ ID NO: 1748156 - protein, 18 aa, Staphylococcus epidermidis
KRFSIFAMGIMPYITASI

SEQ ID NO: 1748157 - protein, 24 aa, Staphylococcus epidermidis
KRFVSILFIFTYVVSFLPVVLYSG

SEQ ID NO: 1748158 - protein, 26 aa, Staphylococcus epidermidis
KRIHLGWFVLPVPIVLFIYFISLISM

SEQ ID NO: 1748159 - protein, 45 aa, Staphylococcus epidermidis
KRVAKTPGVWVILAGLAILPSFYAWFNLWAMWDPYGHTGHIKVAV

SEQ ID NO: 1748160 - protein, 25 aa, Staphylococcus epidermidis
KSVTKIVVFILLTFGFYVFFAGHNN

SEQ ID NO: 1748161 - protein, 17 aa, Staphylococcus epidermidis
KTEVRKLSRRGDTNNKK

SEQ ID NO: 1748162 - protein, 24 aa, Staphylococcus epidermidis
KTTRNAFFIGRTIDYNVSLEGALK

SEQ ID NO: 1748163 - protein, 38 aa, Staphylococcus epidermidis
KVDRLLLNRYLGIPIFLGIMWLIFQTTFTWIGTPLSDQ

SEQ ID NO: 1748164 - protein, 30 aa, Staphylococcus epidermidis
KVLNPLTWSLIFLTLLFLINIFSVKAFGET

SEQ ID NO: 1748165 - protein, 19 aa, Staphylococcus epidermidis
KVLVIPGFILLISMTFLYS

SEQ ID NO: 1748166 - protein, 24 aa, Staphylococcus epidermidis
KWIDFPHIYLPFKDYTPSFHLGLI

SEQ ID NO: 1748167 - protein, 22 aa, Staphylococcus epidermidis
KWIPISIIILITFFIGYTIHPI

SEQ ID NO: 1748168 - protein, 21 aa, Staphylococcus epidermidis
KWLGIVFAVLITVTFAFVFNT

SEQ ID NO: 1748169 - protein, 23 aa, Staphylococcus epidermidis
KWLLVLCVLVIIINASWNTISRA

SEQ ID NO: 1748170 - protein, 17 aa, Staphylococcus epidermidis
KYYYLQLFMGSILFFKF

SEQ ID NO: 1748171 - protein, 18 aa, Staphylococcus epidermidis
LAFYFYRDNPDLKNALMQ

SEQ ID NO: 1748172 - protein, 26 aa, Staphylococcus epidermidis
LAVLLQYVFAVKLEWFPVAGWEGFST

SEQ ID NO: 1748173 - protein, 17 aa, Staphylococcus epidermidis
LAWLKILGLIVALILLT

SEQ ID NO: 1748174 - protein, 29 aa, Staphylococcus epidermidis
LCYMFVSLFIVITITFFLMKLMPGSPFND

SEQ ID NO: 1748175 - protein, 23 aa, Staphylococcus epidermidis
LDGGRILFVLYEAIFRKPVNKKA

SEQ ID NO: 1748176 - protein, 24 aa, Staphylococcus epidermidis
LDIPVRSGFSMDAKIPLKTKKLPN

SEQ ID NO: 1748177 - protein, 19 aa, Staphylococcus epidermidis
LDYKRLFGAIGKNLTGGFG

SEQ ID NO: 1748178 - protein, 25 aa, Staphylococcus epidermidis
LEIVRTIFIIEFIGALLLAFYFYRD

SEQ ID NO: 1748179 - protein, 18 aa, Staphylococcus epidermidis
LEMRALLLHLRPIGLKDK

SEQ ID NO: 1748180 - protein, 27 aa, Staphylococcus epidermidis
LERVGLIILLAYILMNINHFKTMMSER

SEQ ID NO: 1748181 - protein, 18 aa, Staphylococcus epidermidis
LFDDLIEKYLFSVPTVLI

SEQ ID NO: 1748182 - protein, 19 aa, Staphylococcus epidermidis
LFFTGLILGIIPYLLTISN

SEQ ID NO: 1748183 - protein, 30 aa, Staphylococcus epidermidis
LFIFVFILVNIFLVIVYIDKVNKSQVNDSE

SEQ ID NO: 1748184 - protein, 20 aa, Staphylococcus epidermidis
LFIVSLYWHFLDVVWVFIFT

SEQ ID NO: 1748185 - protein, 26 aa, Staphylococcus epidermidis
LFTTNLIAMVLWMIAAIRLFAKKDKT

SEQ ID NO: 1748186 - protein, 20 aa, Staphylococcus epidermidis
LFVEAFKELWLPIITICFIL

SEQ ID NO: 1748187 - protein, 26 aa, Staphylococcus epidermidis
LGFILGLFLVYLLHRVLPGQFYLVRI

SEQ ID NO: 1748188 - protein, 21 aa, Staphylococcus epidermidis
LGIVYFIIWIGVGSLWMKLIG

SEQ ID NO: 1748189 - protein, 21 aa, Staphylococcus epidermidis
LGLLIVAIVGFLLFMYIDDSR

SEQ ID NO: 1748190 - protein, 25 aa, Staphylococcus epidermidis
LGLVNFCRLIPILLLSVWAGSIADK

SEQ ID NO: 1748191 - protein, 28 aa, Staphylococcus epidermidis
LGTIVAIIVILLFLRNIRTTAISIVSIP

SEQ ID NO: 1748192 - protein, 25 aa, Staphylococcus epidermidis
LGTKSNAITLLQAISADVQVKPQAF

SEQ ID NO: 1748193 - protein, 17 aa, Staphylococcus epidermidis
LGYGLFALGLKYLTIKK

SEQ ID NO: 1748194 - protein, 18 aa, Staphylococcus epidermidis
LHLILIMTFALLISSYTC

SEQ ID NO: 1748195 - protein, 17 aa, Staphylococcus epidermidis
LHNEAYPRLYRIKTRDT

SEQ ID NO: 1748196 - protein, 67 aa, Staphylococcus epidermidis
LHQSNIIINILLVSAFLLNLVFAFIIIFMERRTANSIWAWLLVLVFLPLVGFILYLLLGRQIQREHI

SEQ ID NO: 1748197 - protein, 24 aa, Staphylococcus epidermidis
LIAIKTFLHLINKVKLVPFAIYRI

SEQ ID NO: 1748198 - protein, 19 aa, Staphylococcus epidermidis
LIGLFIGAIYMIIADKYSK

SEQ ID NO: 1748199 - protein, 19 aa, Staphylococcus epidermidis
LIIALFTALMRISTSKLLR

SEQ ID NO: 1748200 - protein, 24 aa, Staphylococcus epidermidis
LIILTFIILITLVNVIISIIERRK

SEQ ID NO: 1748201 - protein, 20 aa, Staphylococcus epidermidis
LIITFPILRKFKVATPIFKP

SEQ ID NO: 1748202 - protein, 22 aa, Staphylococcus epidermidis
LIKMIIIPIVFCSLALSISNLG

SEQ ID NO: 1748203 - protein, 18 aa, Staphylococcus epidermidis
LILGIALPIIYFTTMIRS

SEQ ID NO: 1748204 - protein, 17 aa, Staphylococcus epidermidis
LISCTFLLCFLKVDTSY

SEQ ID NO: 1748205 - protein, 26 aa, Staphylococcus epidermidis
LKGKKFTFIISPQWFTNHGLTNQNFD

SEQ ID NO: 1748206 - protein, 25 aa, Staphylococcus epidermidis
LKIHPLTIIFILLCAGNLMGIVGVI

SEQ ID NO: 1748207 - protein, 19 aa, Staphylococcus epidermidis
LLASLLVSITLVPSLGATF

SEQ ID NO: 1748208 - protein, 27 aa, Staphylococcus epidermidis
LLGIALFFFIIFIHNFDFMIYIVILMF

SEQ ID NO: 1748209 - protein, 25 aa, Staphylococcus epidermidis
LLLITLFYVFFIPQSFLAFGPYIKV

SEQ ID NO: 1748210 - protein, 21 aa, Staphylococcus epidermidis
LLLPYVIFFAFFSLYYYFTGK

SEQ ID NO: 1748211 - protein, 24 aa, Staphylococcus epidermidis
LLNHWTFWILSCGFVILVAPVTGI

SEQ ID NO: 1748212 - protein, 27 aa, Staphylococcus epidermidis
LLPLIFALIIPFLYRFVKRIHLGWFVL

SEQ ID NO: 1748213 - protein, 20 aa, Staphylococcus epidermidis
LMQGILGYGLFALGLKYLTI

SEQ ID NO: 1748214 - protein, 18 aa, Staphylococcus epidermidis
LNERAKLILALDSYMPNI

SEQ ID NO: 1748215 - protein, 32 aa, Staphylococcus epidermidis
LNGFSWPIVLVLLILFYFYSHYLFASATAHVS

SEQ ID NO: 1748216 - protein, 23 aa, Staphylococcus epidermidis
LNNISLHIYQGEALGIIGEPGSS

SEQ ID NO: 1748217 - protein, 24 aa, Staphylococcus epidermidis
LNTKYTPTSILYFNPKKDNDVTIS

SEQ ID NO: 1748218 - protein, 25 aa, Staphylococcus epidermidis
LNTTLIHYFVMLLLALVTVASIQTV

SEQ ID NO: 1748219 - protein, 18 aa, Staphylococcus epidermidis
LNYGPWRIVFVILTMFGI

SEQ ID NO: 1748220 - protein, 19 aa, Staphylococcus epidermidis
LPLLFVTPISYRNFYFIYT

SEQ ID NO: 1748221 - protein, 17 aa, Staphylococcus epidermidis
LPVYLKDLGLKGSDLGM

SEQ ID NO: 1748222 - protein, 29 aa, Staphylococcus epidermidis
LQTLLLGVLLAFIWPPFKLNPNPPKGLKT

SEQ ID NO: 1748223 - protein, 17 aa, Staphylococcus epidermidis
LSLPFAMVGLFTSMFFI

SEQ ID NO: 1748224 - protein, 24 aa, Staphylococcus epidermidis
LSNFFLQFLMIAIVGLIALVVSIF

SEQ ID NO: 1748225 - protein, 27 aa, Staphylococcus epidermidis
LSNTNNVINVYFVPSDKVNPSITVGNY

SEQ ID NO: 1748226 - protein, 17 aa, Staphylococcus epidermidis
LSSLFYMYRKHIFMASV

SEQ ID NO: 1748227 - protein, 24 aa, Staphylococcus epidermidis
LSTLGFIFLMFLSGLEIDFNAFKK

SEQ ID NO: 1748228 - protein, 19 aa, Staphylococcus epidermidis
LSYQFLNRALITSILVGIV

SEQ ID NO: 1748229 - protein, 23 aa, Staphylococcus epidermidis
LTNTMLILSIVPLLGIIITVSIK

SEQ ID NO: 1748230 - protein, 26 aa, Staphylococcus epidermidis
LVHYYQMNFGYLWELFVNHLLMSVYG

SEQ ID NO: 1748231 - protein, 26 aa, Staphylococcus epidermidis
LVIAIIGVIIFGLFSFLNGNGNMPKQ

SEQ ID NO: 1748232 - protein, 24 aa, Staphylococcus epidermidis
LVILIIVTIILRPYLDVLLLGRAQ

SEQ ID NO: 1748233 - protein, 19 aa, Staphylococcus epidermidis
LVNFIILPPKYYHQLEEQL

SEQ ID NO: 1748234 - protein, 21 aa, Staphylococcus epidermidis
LVQIFLISMLFTKSAYHFAFS

SEQ ID NO: 1748235 - protein, 28 aa, Staphylococcus epidermidis
LVSVVTMQLISYYAALQRDLDVDKPRNL

SEQ ID NO: 1748236 - protein, 17 aa, Staphylococcus epidermidis
LVTFIFCFIIAAINLFV

SEQ ID NO: 1748237 - protein, 21 aa, Staphylococcus epidermidis
LVTFILGLIIALFTALMRIST

SEQ ID NO: 1748238 - protein, 27 aa, Staphylococcus epidermidis
LYFETSAILITLILLGKYLEARAKSQT

SEQ ID NO: 1748239 - protein, 26 aa, Staphylococcus epidermidis
MAIVYIGMVLIILLLNIDQIVPMIGT

SEQ ID NO: 1748240 - protein, 25 aa, Staphylococcus epidermidis
MATTILFSTLFIVSIFIVDILYGVI

SEQ ID NO: 1748241 - protein, 25 aa, Staphylococcus epidermidis
MDEKKILDYVIPLAKDGFEVDSELE

SEQ ID NO: 1748242 - protein, 23 aa, Staphylococcus epidermidis
MDGLSWLGVLKNIVFAFLGNYIG

SEQ ID NO: 1748243 - protein, 18 aa, Staphylococcus epidermidis
MFICITLIGLFSQWARTT

SEQ ID NO: 1748244 - protein, 18 aa, Staphylococcus epidermidis
MFLTNGQPALFDPAPLYG

SEQ ID NO: 1748245 - protein, 24 aa, Staphylococcus epidermidis
MGYTFFHWGISQWSIFAISGLIVA

SEQ ID NO: 1748246 - protein, 31 aa, Staphylococcus epidermidis
MHHNSLIETIWFVVPILIVIALAIPTVKTLY

SEQ ID NO: 1748247 - protein, 18 aa, Staphylococcus epidermidis
MIAAIFYVSNWWYIAKDV

SEQ ID NO: 1748248 - protein, 18 aa, Staphylococcus epidermidis
MIAATNRPDILDPALLRP

SEQ ID NO: 1748249 - protein, 17 aa, Staphylococcus epidermidis
MKAFQIDAPVNPGNSGG

SEQ ID NO: 1748250 - protein, 22 aa, Staphylococcus epidermidis
MLNVPWSFKLHILLGFTVFACW

SEQ ID NO: 1748251 - protein, 18 aa, Staphylococcus epidermidis
MMFILIVFTIELIVEFTG

SEQ ID NO: 1748252 - protein, 24 aa, Staphylococcus epidermidis
MPVVAMYSLWLTKKYKKNVSYVCP

SEQ ID NO: 1748253 - protein, 23 aa, Staphylococcus epidermidis
MQALMRILFYMSPILWVPKNHGV

SEQ ID NO: 1748254 - protein, 25 aa, Staphylococcus epidermidis
MQGEFPVMMFGLPAAALAIYQTAKP

SEQ ID NO: 1748255 - protein, 23 aa, Staphylococcus epidermidis
MTEIVQFFMYLSATINLLLIKIN

SEQ ID NO: 1748256 - protein, 28 aa, Staphylococcus epidermidis
MTFGTFFYFIFLLLFLFAALTSSISLLE

SEQ ID NO: 1748257 - protein, 25 aa, Staphylococcus epidermidis
MTLQLLIVPAIIAAILWFFVKPDKP

SEQ ID NO: 1748258 - protein, 24 aa, Staphylococcus epidermidis
MVKAGIFLLFRFTPLLGLSNVYIY

SEQ ID NO: 1748259 - protein, 24 aa, Staphylococcus epidermidis
MVKYPVIMIPIFLTAAISGIASGI

SEQ ID NO: 1748260 - protein, 17 aa, Staphylococcus epidermidis
MWLYMYAYSLYLFFDFA

SEQ ID NO: 1748261 - protein, 33 aa, Staphylococcus epidermidis
MYSTPVLMFIYPLAITLILLALLSPLFKHSKIV

SEQ ID NO: 1748262 - protein, 38 aa, Staphylococcus epidermidis
NEIIDLQKDLWKYLSIVGVIVLFTVYLASRSINRTYIR

SEQ ID NO: 1748263 - protein, 40 aa, Staphylococcus epidermidis
NEKSSKTKKWLIAIIVILLIIVAIFITRAIINHNNDKVSN

SEQ ID NO: 1748264 - protein, 25 aa, Staphylococcus epidermidis
NELFKSGIFIPFAFVLIVIVGPIVE

SEQ ID NO: 1748265 - protein, 22 aa, Staphylococcus epidermidis
NFTPLFILAIIYIAHKLIKRTH

SEQ ID NO: 1748266 - protein, 28 aa, Staphylococcus epidermidis
NFVAMFIPLFFIYKYRQPMFGKLSSQPL

SEQ ID NO: 1748267 - protein, 27 aa, Staphylococcus epidermidis
NGQTENVNVLFKVKPNKPVIDSNSVIS

SEQ ID NO: 1748268 - protein, 26 aa, Staphylococcus epidermidis
NGTNTIQQVPLTPVKRQNAIATINAK

SEQ ID NO: 1748269 - protein, 24 aa, Staphylococcus epidermidis
NGVIWRILIFYIGAIFVIVSVYPW

SEQ ID NO: 1748270 - protein, 24 aa, Staphylococcus epidermidis
NHPDTLDHKALQDLLNKIDQAHNE

SEQ ID NO: 1748271 - protein, 29 aa, Staphylococcus epidermidis
NHQGTRTVDIPITIYPTVTAKNPVRDQKG

SEQ ID NO: 1748272 - protein, 24 aa, Staphylococcus epidermidis
NIGMIIYVVLIIAFAYFYAFVQVN

SEQ ID NO: 1748273 - protein, 20 aa, Staphylococcus epidermidis
NIIIAFILTRWAWFCRVIRT

SEQ ID NO: 1748274 - protein, 27 aa, Staphylococcus epidermidis
NIMKTLTLFTVLLTLPTLVFSFFGMNV

SEQ ID NO: 1748275 - protein, 22 aa, Staphylococcus epidermidis
NIPGYFTTIAAILLLGGIQLMS

SEQ ID NO: 1748276 - protein, 25 aa, Staphylococcus epidermidis
NITEWIYFTYLILGVLLAIYLTILI

SEQ ID NO: 1748277 - protein, 23 aa, Staphylococcus epidermidis
NIVIWLCMILYLNRFSDVKLLEV

SEQ ID NO: 1748278 - protein, 26 aa, Staphylococcus epidermidis
NIVKYIVWFVVITTILSKFGISVEGI

SEQ ID NO: 1748279 - protein, 18 aa, Staphylococcus epidermidis
NLFVFFEVFLMSSYCLLV

SEQ ID NO: 1748280 - protein, 17 aa, Staphylococcus epidermidis
NLLPSVLTLIGSLVMLF

SEQ ID NO: 1748281 - protein, 26 aa, Staphylococcus epidermidis
NLVLLSIPVIYFYSKDNKFFKCYFDR

SEQ ID NO: 1748282 - protein, 24 aa, Staphylococcus epidermidis
NMNSFSIFLPWTTPGPLGIVMGTG

SEQ ID NO: 1748283 - protein, 24 aa, Staphylococcus epidermidis
NNSYWTWWLTYGVIALLLITLFYV

SEQ ID NO: 1748284 - protein, 27 aa, Staphylococcus epidermidis
NPGKAVAIILLVLQIAGGGGTFPIQTT

SEQ ID NO: 1748285 - protein, 22 aa, Staphylococcus epidermidis
NRNFVMMLVILFLMEFARGMYI

SEQ ID NO: 1748286 - protein, 25 aa, Staphylococcus epidermidis
NSIFDRPSLLDKLHSRGSILDKLDH

SEQ ID NO: 1748287 - protein, 23 aa, Staphylococcus epidermidis
NSKAFIRFQNFNELFQFVFNEYY

SEQ ID NO: 1748288 - protein, 25 aa, Staphylococcus epidermidis
NSVNKWLFLLCTLIGLIVLVALLIQ

SEQ ID NO: 1748289 - protein, 21 aa, Staphylococcus epidermidis
NSWTDLFKPRYIKRIILATAI

SEQ ID NO: 1748290 - protein, 34 aa, Staphylococcus epidermidis
NTGLAVFLFGFIKRLLIPFGLHHIFHAPFWFEFG

SEQ ID NO: 1748291 - protein, 29 aa, Staphylococcus epidermidis
NTGPLLAFLPVITIGLLFGLAIDYELFLM

SEQ ID NO: 1748292 - protein, 22 aa, Staphylococcus epidermidis
NTTMDWDRKYPYGDTLRGIFGD

SEQ ID NO: 1748293 - protein, 24 aa, Staphylococcus epidermidis
NVIYGMVILLLICGCIPKLGALAN

SEQ ID NO: 1748294 - protein, 47 aa, Staphylococcus epidermidis
NVKRTIIKIIGFMIIAFFVLLLLGILLFAYYAWKAPAFSESKLDDPI

SEQ ID NO: 1748295 - protein, 20 aa, Staphylococcus epidermidis
NVVYFRFFSDFLTFSTLNQA

SEQ ID NO: 1748296 - protein, 27 aa, Staphylococcus epidermidis
NYDNLVKSLYIVALAFGLIATIITAGV

SEQ ID NO: 1748297 - protein, 25 aa, Staphylococcus epidermidis
PAITFILVLLVFWGLSFEAKLYTLI

SEQ ID NO: 1748298 - protein, 23 aa, Staphylococcus epidermidis
PALQIMVYWLVFGLGIRSNAPIH

SEQ ID NO: 1748299 - protein, 32 aa, Staphylococcus epidermidis
PGQLFTIQFLIVILTFLFIDFFDTAGTLVAVA

SEQ ID NO: 1748300 - protein, 23 aa, Staphylococcus epidermidis
PIAGFLVMFGFNSLTKVIIYGVV

SEQ ID NO: 1748301 - protein, 23 aa, Staphylococcus epidermidis
PIHGIPFVFWLLVGISMWFFINQ

SEQ ID NO: 1748302 - protein, 31 aa, Staphylococcus epidermidis
PIINILRSIPFIILLIAIVPFTKLLVGTSIG

SEQ ID NO: 1748303 - protein, 28 aa, Staphylococcus epidermidis
PIISIIFILLILALLFIFVGYPLITGTV

SEQ ID NO: 1748304 - protein, 23 aa, Staphylococcus epidermidis
PILLLVVMYFLLIRPQQKRAKEH

SEQ ID NO: 1748305 - protein, 35 aa, Staphylococcus epidermidis
PIMTKRQVYLGKSGFFFLLGIIQALIVSIGDLVIL

SEQ ID NO: 1748306 - protein, 24 aa, Staphylococcus epidermidis
PITYTLILINIVIWLCMILYLNRF

SEQ ID NO: 1748307 - protein, 28 aa, Staphylococcus epidermidis
PKPEFKLPLYPILPAITFILVLLVFWGL

SEQ ID NO: 1748308 - protein, 36 aa, Staphylococcus epidermidis
PLVLNPVFFIPFIFAPIVNIWIFKFFVDVLNMNSFS

SEQ ID NO: 1748309 - protein, 18 aa, Staphylococcus epidermidis
PMALSFFSGKRLVPIMTA

SEQ ID NO: 1748310 - protein, 32 aa, Staphylococcus epidermidis
PMQGIPAWVWSCIFLIIIFALNSLSVRVYGES

SEQ ID NO: 1748311 - protein, 54 aa, Staphylococcus epidermidis
PNFGGGLIGFYLLKLFIPLISIVGVIIITILLLASSFILLLNLRHRDVTKSLFD

SEQ ID NO: 1748312 - protein, 21 aa, Staphylococcus epidermidis
PNKRDHPFVYWATLKNVASLL

SEQ ID NO: 1748313 - protein, 24 aa, Staphylococcus epidermidis
PQLGKIHIFPALLGSIILIFIISL

SEQ ID NO: 1748314 - protein, 27 aa, Staphylococcus epidermidis
PRFSLIFLIIIYLTIGPLFAIPRTAST

SEQ ID NO: 1748315 - protein, 29 aa, Staphylococcus epidermidis
PSYIALGIWLVIGLIFFIIRLPKLKKMNN

SEQ ID NO: 1748316 - protein, 30 aa, Staphylococcus epidermidis
PTFEKMMHPLFELLHLPSPLTTTISFVVSF

SEQ ID NO: 1748317 - protein, 25 aa, Staphylococcus epidermidis
PTIVFGFFALTFVTPILRNLIPNLG

SEQ ID NO: 1748318 - protein, 21 aa, Staphylococcus epidermidis
PTLAVLALMIPLFGVGKTPAI

SEQ ID NO: 1748319 - protein, 29 aa, Staphylococcus epidermidis
PVSISKLFMIFLIRTIITLPIIALLAHLF

SEQ ID NO: 1748320 - protein, 25 aa, Staphylococcus epidermidis
PYGNDWFAYFMRRLAERPQNLSLAI

SEQ ID NO: 1748321 - protein, 24 aa, Staphylococcus epidermidis
QAILITIVMLAVAFLLIMIQNYIF

SEQ ID NO: 1748322 - protein, 21 aa, Staphylococcus epidermidis
QAYVLIVAVLFILFNTLADII

SEQ ID NO: 1748323 - protein, 27 aa, Staphylococcus epidermidis
QEANSKLNKILLDAKKQIGLAHTNNEV

SEQ ID NO: 1748324 - protein, 21 aa, Staphylococcus epidermidis
QFFIWAIPCYLCAFIAIIYGF

SEQ ID NO: 1748325 - protein, 19 aa, Staphylococcus epidermidis
QFFYFYLTVVISCLIAAMI

SEQ ID NO: 1748326 - protein, 22 aa, Staphylococcus epidermidis
QGDEFIIYKFGDDYIRVYNTEF

SEQ ID NO: 1748327 - protein, 23 aa, Staphylococcus epidermidis
QGQIPWFVYICEVILMFVMAEVS

SEQ ID NO: 1748328 - protein, 19 aa, Staphylococcus epidermidis
QILFHPLVGGFLLAAILAA

SEQ ID NO: 1748329 - protein, 19 aa, Staphylococcus epidermidis
QIVFKLPLIVSLVGSVFLG

SEQ ID NO: 1748330 - protein, 24 aa, Staphylococcus epidermidis
QLNKLGFIPWLSKLIAQGLNGFSW

SEQ ID NO: 1748331 - protein, 31 aa, Staphylococcus epidermidis
QMTYHFVLALFPMLIFLLTLLGQFITIDANQ

SEQ ID NO: 1748332 - protein, 18 aa, Staphylococcus epidermidis
QPAWGWIISIPGLIVWQA

SEQ ID NO: 1748333 - protein, 25 aa, Staphylococcus epidermidis
QRKTYYFMMVFSPIFITYASLHSAA

SEQ ID NO: 1748334 - protein, 25 aa, Staphylococcus epidermidis
QRYINILFIISWIQLIGGLTRANQP

SEQ ID NO: 1748335 - protein, 17 aa, Staphylococcus epidermidis
QSYLPQVFKSMLIPIVI

SEQ ID NO: 1748336 - protein, 33 aa, Staphylococcus epidermidis
QSYQDYFLQFNWFQPLLIGLAGLLILIGLILVL

SEQ ID NO: 1748337 - protein, 28 aa, Staphylococcus epidermidis
QTKFIQPIIFFILGIFIVSLYLVIMLPM

SEQ ID NO: 1748338 - protein, 19 aa, Staphylococcus epidermidis
QTLIGFIFAPFAFLTGIPW

SEQ ID NO: 1748339 - protein, 25 aa, Staphylococcus epidermidis
QTLLLGCLLAFIWPPFSFRKDISKG

SEQ ID NO: 1748340 - protein, 20 aa, Staphylococcus epidermidis
QVFKSMLIPIVIIITMCFVH

SEQ ID NO: 1748341 - protein, 18 aa, Staphylococcus epidermidis
RANGLSSNNIHNGQTLVI

SEQ ID NO: 1748342 - protein, 25 aa, Staphylococcus epidermidis
RDIKPQNILIDKNKKLQIFDFGIAK

SEQ ID NO: 1748343 - protein, 18 aa, Staphylococcus epidermidis
RDLTMRILKSAFLSGLML

SEQ ID NO: 1748344 - protein, 23 aa, Staphylococcus epidermidis
RFNKFEWLAIIFALVGVLYMTIK

SEQ ID NO: 1748345 - protein, 25 aa, Staphylococcus epidermidis
RFPKSIIFIAPMIVFVFVFGIGTAN

SEQ ID NO: 1748346 - protein, 21 aa, Staphylococcus epidermidis
RFYQHGALDYKRLFGAIGKNL

SEQ ID NO: 1748347 - protein, 19 aa, Staphylococcus epidermidis
RGAYPCMISMEGLNKEGDT

SEQ ID NO: 1748348 - protein, 29 aa, Staphylococcus epidermidis
RHKNTPIVFWLLIGFVFGFAPPIQTTINS

SEQ ID NO: 1748349 - protein, 28 aa, Staphylococcus epidermidis
RIGWLNPLILILIAIFIVTLIAFYIFEK

SEQ ID NO: 1748350 - protein, 18 aa, Staphylococcus epidermidis
RIMILPFIPRKEAYKVIR

SEQ ID NO: 1748351 - protein, 23 aa, Staphylococcus epidermidis
RITKLVEELLLLTKDRVNHNVLE

SEQ ID NO: 1748352 - protein, 23 aa, Staphylococcus epidermidis
RIWTLKLFILPNHPIIKSGLYKV

SEQ ID NO: 1748353 - protein, 25 aa, Staphylococcus epidermidis
RKDGNYHFLLFNKINDRYLSDSQQR

SEQ ID NO: 1748354 - protein, 24 aa, Staphylococcus epidermidis
RKNEIEQLPLDDNLRKLTGLNLKG

SEQ ID NO: 1748355 - protein, 37 aa, Staphylococcus epidermidis
RKNIRWRYVGLLLVIQLIFAFILLKTNLGISVIGSIS

SEQ ID NO: 1748356 - protein, 33 aa, Staphylococcus epidermidis
RLTEKILGWFSWVFLLILTIVSMFIALVSFSND

SEQ ID NO: 1748357 - protein, 36 aa, Staphylococcus epidermidis
RNEISIILIILLFFALIFYVFSLPFDAYVLAISIIL

SEQ ID NO: 1748358 - protein, 22 aa, Staphylococcus epidermidis
RNIFTMIGIIIGIASVITIMSL

SEQ ID NO: 1748359 - protein, 19 aa, Staphylococcus epidermidis
RRIELSRLLLLKPDIVIFD

SEQ ID NO: 1748360 - protein, 17 aa, Staphylococcus epidermidis
RSALNWSLNHKWIVLIV

SEQ ID NO: 1748361 - protein, 25 aa, Staphylococcus epidermidis
RTNRNFRFFQIFTAALQSFSHGTND

SEQ ID NO: 1748362 - protein, 20 aa, Staphylococcus epidermidis
RTTTFAILILFVINFNNTGD

SEQ ID NO: 1748363 - protein, 29 aa, Staphylococcus epidermidis
RVIIILIISLILAIAFFFGLKAYQGHKNL

SEQ ID NO: 1748364 - protein, 23 aa, Staphylococcus epidermidis
RVSPRKVIAPLIKAHKAGLNLTT

SEQ ID NO: 1748365 - protein, 24 aa, Staphylococcus epidermidis
RYKQPVIIFIVPGIIPLVPGGAAY

SEQ ID NO: 1748366 - protein, 17 aa, Staphylococcus epidermidis
SALWHFIGDLLNSLGII

SEQ ID NO: 1748367 - protein, 22 aa, Staphylococcus epidermidis
SAQFPFHIWLPKAMAAPTPVSA

SEQ ID NO: 1748368 - protein, 27 aa, Staphylococcus epidermidis
SAVAFVLTFIKFPLPFIPPYLTLDFSD

SEQ ID NO: 1748369 - protein, 25 aa, Staphylococcus epidermidis
SCSARLPVYALFVGAFFSAHQSLVV

SEQ ID NO: 1748370 - protein, 24 aa, Staphylococcus epidermidis
SEKARRLLIQLSQFFRSNLNGARN

SEQ ID NO: 1748371 - protein, 18 aa, Staphylococcus epidermidis
SETNLPMALSFFSGKRLV

SEQ ID NO: 1748372 - protein, 21 aa, Staphylococcus epidermidis
SFAYVIFIVFWQVGFSNAVNL

SEQ ID NO: 1748373 - protein, 29 aa, Staphylococcus epidermidis
SFEAKLYTLIWFIVGIIIYLIYGIRHSKK

SEQ ID NO: 1748374 - protein, 25 aa, Staphylococcus epidermidis
SFFWLIGIFIFYLIMAILTPLSTTD

SEQ ID NO: 1748375 - protein, 17 aa, Staphylococcus epidermidis
SFGMMLIGEACLFLLNI

SEQ ID NO: 1748376 - protein, 46 aa, Staphylococcus epidermidis
SFNNKPLRMMIYLGMFTFSISILYIIYLLINILINGINIPGYFTTI

SEQ ID NO: 1748377 - protein, 34 aa, Staphylococcus epidermidis
SGIVCAVILFLIIVVIFRQPLLALIVGGSLTCAM

SEQ ID NO: 1748378 - protein, 23 aa, Staphylococcus epidermidis
SIDRQRNIIIDQLNGASNKKQAT

SEQ ID NO: 1748379 - protein, 19 aa, Staphylococcus epidermidis
SIILMILTLFEQAVPMSNV

SEQ ID NO: 1748380 - protein, 20 aa, Staphylococcus epidermidis
SIVFGLLGYTLFVGAAGLGN

SEQ ID NO: 1748381 - protein, 25 aa, Staphylococcus epidermidis
SIVSFVFLCLLLIPGSPAALSIPSY

SEQ ID NO: 1748382 - protein, 28 aa, Staphylococcus epidermidis
SIVSIPMSILIALIALKLSNVSLNILTL

SEQ ID NO: 1748383 - protein, 23 aa, Staphylococcus epidermidis
SKAALVIFMWLPKAYAVLNTELA

SEQ ID NO: 1748384 - protein, 27 aa, Staphylococcus epidermidis
SKDGKKYVFFDNYQFNVPQKTITLVSS

SEQ ID NO: 1748385 - protein, 30 aa, Staphylococcus epidermidis
SKNYKLYYLSLWYFITFGAFVAFGIFLPNF

SEQ ID NO: 1748386 - protein, 24 aa, Staphylococcus epidermidis
SLAIPLIIIVLVQVVFMVLFSIFI

SEQ ID NO: 1748387 - protein, 38 aa, Staphylococcus epidermidis
SLALLGLMIPIFGIGRLPAIIALVVYALLPILRNTYTG

SEQ ID NO: 1748388 - protein, 18 aa, Staphylococcus epidermidis
SLFFPILSDALSTEWVFL

SEQ ID NO: 1748389 - protein, 29 aa, Staphylococcus epidermidis
SLGNKFAIFLMVVLIILGGVYSSAKLKLE

SEQ ID NO: 1748390 - protein, 18 aa, Staphylococcus epidermidis
SMMFIGMIILLSFALLFL

SEQ ID NO: 1748391 - protein, 41 aa, Staphylococcus epidermidis
SNKSNKKTWLIVTIVLAIIIALVVIFTIAKNQMSPEKQATH

SEQ ID NO: 1748392 - protein, 18 aa, Staphylococcus epidermidis
SNPLLVYMEPYASSTAEL

SEQ ID NO: 1748393 - protein, 21 aa, Staphylococcus epidermidis
SPFIILTVIVMIWSAPSFKAL

SEQ ID NO: 1748394 - protein, 24 aa, Staphylococcus epidermidis
SPLQIIRYFLLPEALGSLILAITT

SEQ ID NO: 1748395 - protein, 43 aa, Staphylococcus epidermidis
SQSNSLKRKDFVVSFIASAIVGSAVGLYYKNKIYKKTDELKEK

SEQ ID NO: 1748396 - protein, 40 aa, Staphylococcus epidermidis
SQSTKELLYVALRISLIKVLKPYYPFPVIVDDAFVHFDKY

SEQ ID NO: 1748397 - protein, 23 aa, Staphylococcus epidermidis
SRHPLFIPMILMLLLGAFTKSAQ

SEQ ID NO: 1748398 - protein, 32 aa, Staphylococcus epidermidis
SSLLPTLVAVFLFAAIFLPLLMEYGLLELLGP

SEQ ID NO: 1748399 - protein, 17 aa, Staphylococcus epidermidis
SSVLPLLFVTPISYRNF

SEQ ID NO: 1748400 - protein, 24 aa, Staphylococcus epidermidis
STEWVFLIFAFIGVLAMIFVIKFL

SEQ ID NO: 1748401 - protein, 24 aa, Staphylococcus epidermidis
STIQAFIHSILFGFPTKKSKEPRL

SEQ ID NO: 1748402 - protein, 28 aa, Staphylococcus epidermidis
SVCAHKRWLFISSTLIKQTVRRSLFKGE

SEQ ID NO: 1748403 - protein, 20 aa, Staphylococcus epidermidis
SVITMLFLSPLHALVITLSM

SEQ ID NO: 1748404 - protein, 21 aa, Staphylococcus epidermidis
SVLRNFPVLGRIRYISEKIGP

SEQ ID NO: 1748405 - protein, 27 aa, Staphylococcus epidermidis
SYAALITMYIIHLIILSVLGINPVKYV

SEQ ID NO: 1748406 - protein, 23 aa, Staphylococcus epidermidis
TAFSLLIKFLLPNVLNNGKLYTV

SEQ ID NO: 1748407 - protein, 19 aa, Staphylococcus epidermidis
TAGFFFTISSKFIQLRMLP

SEQ ID NO: 1748408 - protein, 22 aa, Staphylococcus epidermidis
TALLLLIPIFISYKEGLHIIKD

SEQ ID NO: 1748409 - protein, 27 aa, Staphylococcus epidermidis
TASKRLPWLIVLTFLGMITATILGSFE

SEQ ID NO: 1748410 - protein, 27 aa, Staphylococcus epidermidis
TDNLPRFFIYLLLFMFSMIGIVIANNT

SEQ ID NO: 1748411 - protein, 19 aa, Staphylococcus epidermidis
TEDNRFYQHGALDYKRLFG

SEQ ID NO: 1748412 - protein, 49 aa, Staphylococcus epidermidis
TEPHNLLFLIVITLLVALAVYLFRFVWVYVLYPYFYLSVSPFQKMISKN

SEQ ID NO: 1748413 - protein, 28 aa, Staphylococcus epidermidis
TEPLEFTFLFIAPFLFVLHALLAATMDT

SEQ ID NO: 1748414 - protein, 39 aa, Staphylococcus epidermidis
TEQLALLYSRPLFYFGNFMKPLIWLMNGSSRVIVRMFGF

SEQ ID NO: 1748415 - protein, 25 aa, Staphylococcus epidermidis
TFFTSLFCMLLNLTPIFAILTAIVT

SEQ ID NO: 1748416 - protein, 23 aa, Staphylococcus epidermidis
TFLTMRTILTLKGYRYVAAVVSF

SEQ ID NO: 1748417 - protein, 25 aa, Staphylococcus epidermidis
TFSNYMRLIWFVSSLGLLAGAMGST

SEQ ID NO: 1748418 - protein, 25 aa, Staphylococcus epidermidis
TGAISLLIGLTYYKSIKSVDLSGYS

SEQ ID NO: 1748419 - protein, 24 aa, Staphylococcus epidermidis
TGIFFIMLFILIKLFMEVHEVFAP

SEQ ID NO: 1748420 - protein, 25 aa, Staphylococcus epidermidis
TGILLFVTSFLGITFLIAAGCIIYI

SEQ ID NO: 1748421 - protein, 25 aa, Staphylococcus epidermidis
THYAIYLLSLVISVVLYFSFVTLKY

SEQ ID NO: 1748422 - protein, 51 aa, Staphylococcus epidermidis
TIIIALSIMFFLDVKLTFAAIFIFPFYILTVYFFFGRLRKLTRVRSQALAE

SEQ ID NO: 1748423 - protein, 27 aa, Staphylococcus epidermidis
TISALPWLFMFFLILFAGAISDKILNT

SEQ ID NO: 1748424 - protein, 26 aa, Staphylococcus epidermidis
TITFIVFMILLITKLNQVWPILLFLP

SEQ ID NO: 1748425 - protein, 29 aa, Staphylococcus epidermidis
TLAIINFFIPFLLIFIVDGFKGIKETLPS

SEQ ID NO: 1748426 - protein, 19 aa, Staphylococcus epidermidis
TLAVLAIMIPIFGVGKTPA

SEQ ID NO: 1748427 - protein, 25 aa, Staphylococcus epidermidis
TLIAMVFFSLLLFQVIFKLGHFSVY

SEQ ID NO: 1748428 - protein, 24 aa, Staphylococcus epidermidis
TLILGMFMFLLLLPLEKVFKLSSY

SEQ ID NO: 1748429 - protein, 27 aa, Staphylococcus epidermidis
TLINYVILYLLLIISITLFVPVELFNS

SEQ ID NO: 1748430 - protein, 30 aa, Staphylococcus epidermidis
TLIQNLISYVVWFIVLTSILSRFGISVSAI

SEQ ID NO: 1748431 - protein, 21 aa, Staphylococcus epidermidis
TLVGMRLRRVSPRKVIAPLIK

SEQ ID NO: 1748432 - protein, 26 aa, Staphylococcus epidermidis
TLVVTLLIAIPFFKLPVGIASGAVVE

SEQ ID NO: 1748433 - protein, 18 aa, Staphylococcus epidermidis
TMIILLIISLLSLTAMIT

SEQ ID NO: 1748434 - protein, 26 aa, Staphylococcus epidermidis
TMILTPFWYVFLIIYSLLIGFILWQG

SEQ ID NO: 1748435 - protein, 37 aa, Staphylococcus epidermidis
TNMIAIKMLFHPFKPYYIFRFRIPFTPGLIPKRREEI

SEQ ID NO: 1748436 - protein, 27 aa, Staphylococcus epidermidis
TNNGTAISLSRLAVRPGDSIEAIATEG

SEQ ID NO: 1748437 - protein, 26 aa, Staphylococcus epidermidis
TNPAKTFILNVGKLADDLNPVGLSRD

SEQ ID NO: 1748438 - protein, 23 aa, Staphylococcus epidermidis
TPMIVQLFIIFYGIPELGRLVTN

SEQ ID NO: 1748439 - protein, 24 aa, Staphylococcus epidermidis
TPMLVQVFIVFFGTTAALGLDISA

SEQ ID NO: 1748440 - protein, 19 aa, Staphylococcus epidermidis
TRMFLILVALLVSISTALI

SEQ ID NO: 1748441 - protein, 23 aa, Staphylococcus epidermidis
TSASYFFIFYAIASLITRPIAGR

SEQ ID NO: 1748442 - protein, 35 aa, Staphylococcus epidermidis
TSQALLILDAIIVLSFIVVLPITNVLYTIVMLFIV

SEQ ID NO: 1748443 - protein, 23 aa, Staphylococcus epidermidis
TTVLTGLLLFPSVNDTTTHAAEV

SEQ ID NO: 1748444 - protein, 24 aa, Staphylococcus epidermidis
TVQLLPITGIPLPFISYGGSSLWS

SEQ ID NO: 1748445 - protein, 22 aa, Staphylococcus epidermidis
TYGVWFMAAVVCYLIIPKPGIA

SEQ ID NO: 1748446 - protein, 18 aa, Staphylococcus epidermidis
VAAYLSLEQARYPNRFNI

SEQ ID NO: 1748447 - protein, 18 aa, Staphylococcus epidermidis
VAIYIIVGAALGVIIIPE

SEQ ID NO: 1748448 - protein, 18 aa, Staphylococcus epidermidis
VAQALIAFVLLLAGGGDG

SEQ ID NO: 1748449 - protein, 25 aa, Staphylococcus epidermidis
VCTATAIMILLYSGLQFGDSAPQGV

SEQ ID NO: 1748450 - protein, 25 aa, Staphylococcus epidermidis
VDHLTWLMMTFILTLGFIIQKFSMR

SEQ ID NO: 1748451 - protein, 18 aa, Staphylococcus epidermidis
VEFNQDNGKVVFSANTIK

SEQ ID NO: 1748452 - protein, 26 aa, Staphylococcus epidermidis
VEKKLNRLFVSLRSKYYLFVSDPVVD

SEQ ID NO: 1748453 - protein, 23 aa, Staphylococcus epidermidis
VFFIIVLLTLVVSIGILGVEWTR

SEQ ID NO: 1748454 - protein, 21 aa, Staphylococcus epidermidis
VFGTIIFLILLMKGRKNYANE

SEQ ID NO: 1748455 - protein, 24 aa, Staphylococcus epidermidis
VFMVLFSIFILFKGLGKDYDAAVM

SEQ ID NO: 1748456 - protein, 19 aa, Staphylococcus epidermidis
VFTWISLIVFLVISYIGVA

SEQ ID NO: 1748457 - protein, 24 aa, Staphylococcus epidermidis
VGFTLFIFTLIMNLLSQWISKRFR

SEQ ID NO: 1748458 - protein, 35 aa, Staphylococcus epidermidis
VGIIFLPIIIMRTSWWFIFFIFLGGLSYTIGAWFY

SEQ ID NO: 1748459 - protein, 23 aa, Staphylococcus epidermidis
VGPALLIPLYVQNALGLSALLSG

SEQ ID NO: 1748460 - protein, 25 aa, Staphylococcus epidermidis
VGQGILHLVFFWTGIPSVVAIIHAI

SEQ ID NO: 1748461 - protein, 27 aa, Staphylococcus epidermidis
VGVSTLIGIIFGWIPARSASKKELIDI

SEQ ID NO: 1748462 - protein, 17 aa, Staphylococcus epidermidis
VIAFLWVLFQDEDEFKF

SEQ ID NO: 1748463 - protein, 26 aa, Staphylococcus epidermidis
VIFNFGLPLIIALLHAYFASLAYMHL

SEQ ID NO: 1748464 - protein, 32 aa, Staphylococcus epidermidis
VIGLIFVAIYYFLFKYLILKFDIPLPGRKKGE

SEQ ID NO: 1748465 - protein, 17 aa, Staphylococcus epidermidis
VIGPFFALPRLATTSFE

SEQ ID NO: 1748466 - protein, 29 aa, Staphylococcus epidermidis
VIGVGLFIHWIWPELPIGAAFAIAAILCP

SEQ ID NO: 1748467 - protein, 17 aa, Staphylococcus epidermidis
VIPVLPVYLKDLGLKGS

SEQ ID NO: 1748468 - protein, 34 aa, Staphylococcus epidermidis
VITIIVLVVIGVLGFWFWHNTTSYVTTDNAKVDG

SEQ ID NO: 1748469 - protein, 20 aa, Staphylococcus epidermidis
VITLIILAFIPKISKAMKGI

SEQ ID NO: 1748470 - protein, 24 aa, Staphylococcus epidermidis
VIVTFIWIMIGFSLSFDGGNQWIG

SEQ ID NO: 1748471 - protein, 19 aa, Staphylococcus epidermidis
VIVWISWIKPLATINAFFG

SEQ ID NO: 1748472 - protein, 17 aa, Staphylococcus epidermidis
VKHDMIAAIFYVSNWWY

SEQ ID NO: 1748473 - protein, 20 aa, Staphylococcus epidermidis
VLAFAFKWLGLVNDVLLMVI

SEQ ID NO: 1748474 - protein, 20 aa, Staphylococcus epidermidis
VLAMIFVIKFLPETRGRSLE

SEQ ID NO: 1748475 - protein, 30 aa, Staphylococcus epidermidis
VLGGPGAVFWMWIIAFIGAASAFMEATLAQ

SEQ ID NO: 1748476 - protein, 18 aa, Staphylococcus epidermidis
VLLIVFMLITIRGASVSG

SEQ ID NO: 1748477 - protein, 47 aa, Staphylococcus epidermidis
VLTLIGSLVMLFIMDWKLTLLTFITIPVFILIIVPLGRVMQKISTNT

SEQ ID NO: 1748478 - protein, 19 aa, Staphylococcus epidermidis
VMFEIMLLASFVLVTLGQS

SEQ ID NO: 1748479 - protein, 21 aa, Staphylococcus epidermidis
VNEVYLISHALLETGAAKSEL

SEQ ID NO: 1748480 - protein, 25 aa, Staphylococcus epidermidis
VNMVYIIIALLALILMFIKVAPSTS

SEQ ID NO: 1748481 - protein, 23 aa, Staphylococcus epidermidis
VNTFFIIMWLLGQMAIWNFLFLR

SEQ ID NO: 1748482 - protein, 19 aa, Staphylococcus epidermidis
VQPKVNQAIALLQPKENNS

SEQ ID NO: 1748483 - protein, 27 aa, Staphylococcus epidermidis
VRIVIPLIIIFIIFTVLYSVAPNVKTK

SEQ ID NO: 1748484 - protein, 21 aa, Staphylococcus epidermidis
VTSNIILMPFLGAALTTIIAM

SEQ ID NO: 1748485 - protein, 19 aa, Staphylococcus epidermidis
VVIFLMTILSIISITTREI

SEQ ID NO: 1748486 - protein, 22 aa, Staphylococcus epidermidis
VVNPILPYALAFAAGAMIFVVV

SEQ ID NO: 1748487 - protein, 31 aa, Staphylococcus epidermidis
VVSYLNWQWVYFILTILYLILVLVIYKNVPE

SEQ ID NO: 1748488 - protein, 23 aa, Staphylococcus epidermidis
VVTVVLIYTLLFKPELIISIKHD

SEQ ID NO: 1748489 - protein, 22 aa, Staphylococcus epidermidis
VWLITVFALDLSFIIDMLISFG

SEQ ID NO: 1748490 - protein, 23 aa, Staphylococcus epidermidis
VWLSFLLLAFVFIVGPTVFIMET

SEQ ID NO: 1748491 - protein, 32 aa, Staphylococcus epidermidis
VYLKLSCSALLLSGSLVGYGFTKDAFADSEST

SEQ ID NO: 1748492 - protein, 18 aa, Staphylococcus epidermidis
WDVIGFVILITLRKRLKL

SEQ ID NO: 1748493 - protein, 25 aa, Staphylococcus epidermidis
WGPIAWAIYVLPALPIGYLVFVKKK

SEQ ID NO: 1748494 - protein, 24 aa, Staphylococcus epidermidis
WGPVLWVMLPELFPMRARGAATGI

SEQ ID NO: 1748495 - protein, 23 aa, Staphylococcus epidermidis
WKLMLYNVIIILLFFIVGSILHR

SEQ ID NO: 1748496 - protein, 20 aa, Staphylococcus epidermidis
WLMVLAIFIINVCYVTFLTM

SEQ ID NO: 1748497 - protein, 17 aa, Staphylococcus epidermidis
WLVFGRLLAILIAIIFW

SEQ ID NO: 1748498 - protein, 19 aa, Staphylococcus epidermidis
WLVLRVLAVFFSWLTFLNI

SEQ ID NO: 1748499 - protein, 24 aa, Staphylococcus epidermidis
WQMAYNFSMWRLFGISIIAIIGML

SEQ ID NO: 1748500 - protein, 21 aa, Staphylococcus epidermidis
YAAGYFKPFWPLAIINVFEEF

SEQ ID NO: 1748501 - protein, 23 aa, Staphylococcus epidermidis
YDIRDPYWKLIKQNKRKIKRDYE

SEQ ID NO: 1748502 - protein, 30 aa, Staphylococcus epidermidis
YDYNLIKVIPYLLVLILALVGINVIIVLIG

SEQ ID NO: 1748503 - protein, 18 aa, Staphylococcus epidermidis
YEEKLAYGLALDGSVTLN

SEQ ID NO: 1748504 - protein, 19 aa, Staphylococcus epidermidis
YFGVFMIFVSILLMIRHKI

SEQ ID NO: 1748505 - protein, 17 aa, Staphylococcus epidermidis
YFLLIRPQQKRAKEHRA

SEQ ID NO: 1748506 - protein, 20 aa, Staphylococcus epidermidis
YFVVQFVIALFLIWLPTYLT

SEQ ID NO: 1748507 - protein, 22 aa, Staphylococcus epidermidis
YGPRPLIFTGFILLISCTFLLC

SEQ ID NO: 1748508 - protein, 17 aa, Staphylococcus epidermidis
YIGFIDDSIEKLIIESF

SEQ ID NO: 1748509 - protein, 24 aa, Staphylococcus epidermidis
YITKVLYRLTFVGSIFLAAIAILP

SEQ ID NO: 1748510 - protein, 23 aa, Staphylococcus epidermidis
YIVSIFMGIVKFAPIAQAKWIDF

SEQ ID NO: 1748511 - protein, 17 aa, Staphylococcus epidermidis
YIVVALILIGFINFFLI

SEQ ID NO: 1748512 - protein, 39 aa, Staphylococcus epidermidis
YKWMLITTLITFTTILLFCLIIIFFLKDTLRSSEIDEAE

SEQ ID NO: 1748513 - protein, 18 aa, Staphylococcus epidermidis
YLCMYLLIVVIASYSKSE

SEQ ID NO: 1748514 - protein, 25 aa, Staphylococcus epidermidis
YLDNWWIVFFIFVAQFILSLSYEYT

SEQ ID NO: 1748515 - protein, 19 aa, Staphylococcus epidermidis
YLQIGLYLLSLYPHSFIQY

SEQ ID NO: 1748516 - protein, 19 aa, Staphylococcus epidermidis
YLQLFMGSILFFKFLTEFI

SEQ ID NO: 1748517 - protein, 20 aa, Staphylococcus epidermidis
YLWVLLVLVFLEGLLAADNA

SEQ ID NO: 1748518 - protein, 25 aa, Staphylococcus epidermidis
YPEEYRYGFYITPYLNRVNGVFFGQ

SEQ ID NO: 1748519 - protein, 27 aa, Staphylococcus epidermidis
YRNFYFIYTLWIVILLCLIQQCDVLFK

SEQ ID NO: 1748520 - protein, 36 aa, Staphylococcus epidermidis
YRNSSQKRHTFPWIKTIIVAIIAGIIGALLVLGIGK

SEQ ID NO: 1748521 - protein, 18 aa, Staphylococcus epidermidis
YSHLITLTNHYPFTLDEE

SEQ ID NO: 1748522 - protein, 17 aa, Staphylococcus epidermidis
YTAIFILILLENVLPVV

SEQ ID NO: 1748523 - protein, 31 aa, Staphylococcus epidermidis
YVDGFIGIIIFFIIFGLFINKVTYAFKQFEQ

SEQ ID NO: 1748524 - protein, 18 aa, Staphylococcus epidermidis
YYYFSIMFMLIGIIGSFT

SEQ ID NO: 1748525 - protein, 24 aa, Staphylococcus epidermidis
AAAIIATSFLYLQGGRLVDIITAV

SEQ ID NO: 1748526 - protein, 21 aa, Staphylococcus epidermidis
AALSFIIFLGVTQINWFAVIA

SEQ ID NO: 1748527 - protein, 26 aa, Staphylococcus epidermidis
AAVALFLVVFCWQPIHFYALAIKRSD

SEQ ID NO: 1748528 - protein, 24 aa, Staphylococcus epidermidis
ADHQIFLLMIIFNMVMFVSSIIQM

SEQ ID NO: 1748529 - protein, 18 aa, Staphylococcus epidermidis
AEELLEKFKFTAAQTEID

SEQ ID NO: 1748530 - protein, 18 aa, Staphylococcus epidermidis
AFAEQLWNIGKNSAFALI

SEQ ID NO: 1748531 - protein, 29 aa, Staphylococcus epidermidis
AFVAAFPHLYHFKVLIACLLVLFILMMNL

SEQ ID NO: 1748532 - protein, 24 aa, Staphylococcus epidermidis
AGKLVLIIIAFVISFVALADLIDR

SEQ ID NO: 1748533 - protein, 24 aa, Staphylococcus epidermidis
AGSLFYLLVLLSFPMPIKAVRRFN

SEQ ID NO: 1748534 - protein, 24 aa, Staphylococcus epidermidis
AGVNGDVTFYYRDGSVDVIDAENV

SEQ ID NO: 1748535 - protein, 17 aa, Staphylococcus epidermidis
AIILNFFFNGIKYKQTE

SEQ ID NO: 1748536 - protein, 18 aa, Staphylococcus epidermidis
AIKSLFSFTKPPLAEVKP

SEQ ID NO: 1748537 - protein, 28 aa, Staphylococcus epidermidis
AILEFASWHWLFYINIPIAIVAIILVLM

SEQ ID NO: 1748538 - protein, 21 aa, Staphylococcus epidermidis
AISVLFIFFKAPDLALTQFVV

SEQ ID NO: 1748539 - protein, 18 aa, Staphylococcus epidermidis
AITAIKLINANAHKRQDA

SEQ ID NO: 1748540 - protein, 20 aa, Staphylococcus epidermidis
AKLGILMSLLFFPNGPILIK

SEQ ID NO: 1748541 - protein, 20 aa, Staphylococcus epidermidis
ALGWNYWFNWVITVAADVTI

SEQ ID NO: 1748542 - protein, 18 aa, Staphylococcus epidermidis
ALIMIVLLVVLWFISKKV

SEQ ID NO: 1748543 - protein, 22 aa, Staphylococcus epidermidis
ALITFIWIMITFIHAIKNYSDN

SEQ ID NO: 1748544 - protein, 17 aa, Staphylococcus epidermidis
ALKKLKAIGFKDIHVEQ

SEQ ID NO: 1748545 - protein, 41 aa, Staphylococcus epidermidis
ALLIPFILMVLTAIALVVVWFIFNQLVAGIATAILIVMIII

SEQ ID NO: 1748546 - protein, 20 aa, Staphylococcus epidermidis
ALLPALFWGSVVIINVFVGG

SEQ ID NO: 1748547 - protein, 17 aa, Staphylococcus epidermidis
ALPLILSGIRLSSVYVI

SEQ ID NO: 1748548 - protein, 17 aa, Staphylococcus epidermidis
AMVFFVIVVLGIVARMV

SEQ ID NO: 1748549 - protein, 26 aa, Staphylococcus epidermidis
APTIFNFSLALLIGLLSGVFSSIFIA

SEQ ID NO: 1748550 - protein, 27 aa, Staphylococcus epidermidis
ASFLLLSWLIIIFVLLILAYQRAQVLK

SEQ ID NO: 1748551 - protein, 23 aa, Staphylococcus epidermidis
ASHRSWLFLPYIGMVFLGGIIHN

SEQ ID NO: 1748552 - protein, 19 aa, Staphylococcus epidermidis
ATFNMLIQFLGDHLAFKVK

SEQ ID NO: 1748553 - protein, 20 aa, Staphylococcus epidermidis
ATFPDKISKLVYPIIHICVI

SEQ ID NO: 1748554 - protein, 30 aa, Staphylococcus epidermidis
ATIKNIRQNLFWAFGYNVAGIPIAACGLLA

SEQ ID NO: 1748555 - protein, 25 aa, Staphylococcus epidermidis
ATNYNQLYVEPYKNYRNRVQSNVQV

SEQ ID NO: 1748556 - protein, 26 aa, Staphylococcus epidermidis
AWQMSRNLLWFYLIVLICVMIASEPS

SEQ ID NO: 1748557 - protein, 30 aa, Staphylococcus epidermidis
AYSILGFFAFIFIILLINSATRYAVLSAPV

SEQ ID NO: 1748558 - protein, 23 aa, Staphylococcus epidermidis
AYSIPFVIVSLNFPLFNLVDQFT

SEQ ID NO: 1748559 - protein, 19 aa, Staphylococcus epidermidis
AYTAQIAVLSILSQIVAKN

SEQ ID NO: 1748560 - protein, 19 aa, Staphylococcus epidermidis
CFIIYVIWQVALIMYYYQS

SEQ ID NO: 1748561 - protein, 20 aa, Staphylococcus epidermidis
CIGFIVFILLFMFANMITRW

SEQ ID NO: 1748562 - protein, 20 aa, Staphylococcus epidermidis
CIGLFILLVILSLLLYFSYL

SEQ ID NO: 1748563 - protein, 20 aa, Staphylococcus epidermidis
CIPLAWFLGLQDFFIKPLML

SEQ ID NO: 1748564 - protein, 19 aa, Staphylococcus epidermidis
CLVVTQLLYFIPGSVWFLM

SEQ ID NO: 1748565 - protein, 19 aa, Staphylococcus epidermidis
DAFVVRMTLIPALTKLFGK

SEQ ID NO: 1748566 - protein, 17 aa, Staphylococcus epidermidis
DAYVLAISIILLLMCVR

SEQ ID NO: 1748567 - protein, 39 aa, Staphylococcus epidermidis; identical to SEQ ID NO: 1740572

SEQ ID NO: 1748568 - protein, 27 aa, Staphylococcus epidermidis
DDGEKSYLLNSNPIQVLDLVEPDNGYG

SEQ ID NO: 1748569 - protein, 35 aa, Staphylococcus epidermidis
DEISWVRWILYIVALFLPIFIFYTVARPVDRNNRY

SEQ ID NO: 1748570 - protein, 33 aa, Staphylococcus epidermidis
DFKHGSATNYAFYDGVNNFSDFARGGELYFDRE

SEQ ID NO: 1748571 - protein, 23 aa, Staphylococcus epidermidis
DGFGQIFLMPSIIGGLLILIGIF

SEQ ID NO: 1748572 - protein, 24 aa, Staphylococcus epidermidis
DGKQKLQRIVLSTQTKTQAKADIA

SEQ ID NO: 1748573 - protein, 25 aa, Staphylococcus epidermidis
DHSNPIILLLFVTIGFGLIGFIDDY

SEQ ID NO: 1748574 - protein, 19 aa, Staphylococcus epidermidis
DIQPLVVKKPTAKSKIESA

SEQ ID NO: 1748575 - protein, 19 aa, Staphylococcus epidermidis
DKLKTLVNPVKASLNYRNA

SEQ ID NO: 1748576 - protein, 24 aa, Staphylococcus epidermidis
DKNVKTMKIGLKALGYPIDNETNI

SEQ ID NO: 1748577 - protein, 22 aa, Staphylococcus epidermidis
DLKTYRMVFNTISVERMNSILF

SEQ ID NO: 1748578 - protein, 20 aa, Staphylococcus epidermidis
DLPPEKTYKIGDYVWEDVDK

SEQ ID NO: 1748579 - protein, 24 aa, Staphylococcus epidermidis
DNDKDTIYVAKNKSPLLVGVGEGF

SEQ ID NO: 1748580 - protein, 31 aa, Staphylococcus epidermidis
DNKKVLMFSFIIISLFMLVEIIGGFLANSLA

SEQ ID NO: 1748581 - protein, 27 aa, Staphylococcus epidermidis
DNLIIIFNIFFVLCLISLFITVITIIF

SEQ ID NO: 1748582 - protein, 22 aa, Staphylococcus epidermidis
DQAWFMFAIFVSTIIACITQPM

SEQ ID NO: 1748583 - protein, 20 aa, Staphylococcus epidermidis
DQHVFPPYQGAPLFKEKYLK

SEQ ID NO: 1748584 - protein, 22 aa, Staphylococcus epidermidis
DRWHWIFVVNIISAILCLILGN

SEQ ID NO: 1748585 - protein, 40 aa, Staphylococcus epidermidis
DSAWLSLLLIVIAFFVVPFLVAWILDLILRRLIHLYENDI

SEQ ID NO: 1748586 - protein, 30 aa, Staphylococcus epidermidis
DSHHNPETLLPVNLYVKPELKHTIELYHDN

SEQ ID NO: 1748587 - protein, 20 aa, Staphylococcus epidermidis
DSKPIIATIFLDNYDEITQN

SEQ ID NO: 1748588 - protein, 25 aa, Staphylococcus epidermidis
DSNMLILLLVLITGTLLMVWLADQN

SEQ ID NO: 1748589 - protein, 31 aa, Staphylococcus epidermidis
DTFKDDIFKTKDALNGIERLTAAKSKAEKLI

SEQ ID NO: 1748590 - protein, 25 aa, Staphylococcus epidermidis
DTSYTYLIVIYAIRMFAVSLLMMPI

SEQ ID NO: 1748591 - protein, 18 aa, Staphylococcus epidermidis
DVFIVFYVALFLGMILLA

SEQ ID NO: 1748592 - protein, 34 aa, Staphylococcus epidermidis
DVFSRDFLNSNFWLYWKTMFAFEPWHSAMEMRRY

SEQ ID NO: 1748593 - protein, 22 aa, Staphylococcus epidermidis
EAETFVSVETIVRNFKVEADKL

SEQ ID NO: 1748594 - protein, 22 aa, Staphylococcus epidermidis
EASAKLQEVLKKAIAKIDKGQT

SEQ ID NO: 1748595 - protein, 20 aa, Staphylococcus epidermidis
EATTLDTAMLGLRKSIKDKN

SEQ ID NO: 1748596 - protein, 30 aa, Staphylococcus epidermidis
EEGIGFVVIILFILKLLAAILIGFGAAFLF

SEQ ID NO: 1748597 - protein, 24 aa, Staphylococcus epidermidis
EEQFYLFFPAVLLLFMAIVKKKKN

SEQ ID NO: 1748598 - protein, 36 aa, Staphylococcus epidermidis
EFSSNLNNMNFLRWVNIRDDYTISWTSSKIQGRNTD

SEQ ID NO: 1748599 - protein, 28 aa, Staphylococcus epidermidis
EHIQLSFIALFIATLIAVPIAILLTKTK

SEQ ID NO: 1748600 - protein, 27 aa, Staphylococcus epidermidis
EHQQKSEVFIIKELDILNNAQKAAIIN

SEQ ID NO: 1748601 - protein, 17 aa, Staphylococcus epidermidis
EKNKGIGTIRDIQPLVV

SEQ ID NO: 1748602 - protein, 31 aa, Staphylococcus epidermidis
EKSRVRLIIFLILGLIFIGIGYYLAIKPNTA

SEQ ID NO: 1748603 - protein, 26 aa, Staphylococcus epidermidis
ELEINTRYYVFISSYIDRIQTNGRSG

SEQ ID NO: 1748604 - protein, 17 aa, Staphylococcus epidermidis
ELKLIMTLGFILGGIIG

SEQ ID NO: 1748605 - protein, 18 aa, Staphylococcus epidermidis
ENVFAWPGLGPLSIKAIT

SEQ ID NO: 1748606 - protein, 42 aa, Staphylococcus epidermidis
EPMMKIEFYQNLLVNLLIILAYILMGMIVIAISRKLVTKFFN

SEQ ID NO: 1748607 - protein, 25 aa, Staphylococcus epidermidis
ERQFQPHFLFNTMQTIQYLIPLSPK

SEQ ID NO: 1748608 - protein, 25 aa, Staphylococcus epidermidis
ESIVSFTVNIKPLNEKYRITTSSSN

SEQ ID NO: 1748609 - protein, 17 aa, Staphylococcus epidermidis
ETKIFLKLVLPLSKRSI

SEQ ID NO: 1748610 - protein, 24 aa, Staphylococcus epidermidis
EVANNLVIATKQKSLDNINSLSSN

SEQ ID NO: 1748611 - protein, 27 aa, Staphylococcus epidermidis
EVSQKMKTILPRVDTKAVARSVLNALA

SEQ ID NO: 1748612 - protein, 19 aa, Staphylococcus epidermidis
FALIIPILAGFIARSIADK

SEQ ID NO: 1748613 - protein, 32 aa, Staphylococcus epidermidis
FASIVGIALIYLFMLGFYRLPGLVAIIALTTY

SEQ ID NO: 1748614 - protein, 23 aa, Staphylococcus epidermidis
FFAPVLFPLIVWIVGQPPASTYS

SEQ ID NO: 1748615 - protein, 27 aa, Staphylococcus epidermidis
FFGGQLTLFFWFFKLKYSFGHIINSKI

SEQ ID NO: 1748616 - protein, 25 aa, Staphylococcus epidermidis
FFPNGPILIKLLFAVVLSIVGTFLF

SEQ ID NO: 1748617 - protein, 27 aa, Staphylococcus epidermidis
FGFIVFIFAIVVLRLGYLQIAQGSHYK

SEQ ID NO: 1748618 - protein, 20 aa, Staphylococcus epidermidis
FGLFSPFILGLIAIFVISLI

SEQ ID NO: 1748619 - protein, 29 aa, Staphylococcus epidermidis
FIAKNKWLSVIGWLVILGVIITPLMINSP

SEQ ID NO: 1748620 - protein, 23 aa, Staphylococcus epidermidis
FIAVPLWGMLKKRQFKKTKNNKL

SEQ ID NO: 1748621 - protein, 17 aa, Staphylococcus epidermidis
FIQFGKINRLWLVLLFA

SEQ ID NO: 1748622 - protein, 18 aa, Staphylococcus epidermidis
FISVILCLMLLLPLSHMK

SEQ ID NO: 1748623 - protein, 24 aa, Staphylococcus epidermidis
FITMSLLGIILFLVPIPVVQDGKQ

SEQ ID NO: 1748624 - protein, 33 aa, Staphylococcus epidermidis
FIVNLFRAIPFIILILLLIPFTSILLGTISGPT

SEQ ID NO: 1748625 - protein, 24 aa, Staphylococcus epidermidis
FKRNYLCFVFIFLIGSILGLLSFN

SEQ ID NO: 1748626 - protein, 35 aa, Staphylococcus epidermidis
FKTQRSLFWSFLIVFLLIFIILQIRIFTISEDNIY

SEQ ID NO: 1748627 - protein, 19 aa, Staphylococcus epidermidis
FLIVMEFILIYIPLLYHGL

SEQ ID NO: 1748628 - protein, 17 aa, Staphylococcus epidermidis
FLLLLIMVIFGGKKGLI

SEQ ID NO: 1748629 - protein, 23 aa, Staphylococcus epidermidis
FLRLYILTLMFFSANAILNVFIP

SEQ ID NO: 1748630 - protein, 18 aa, Staphylococcus epidermidis
FMFFITLVIAILSGLIFL

SEQ ID NO: 1748631 - protein, 19 aa, Staphylococcus epidermidis
FMKYRFWLPFIISSIIFSS

SEQ ID NO: 1748632 - protein, 17 aa, Staphylococcus epidermidis
FNLIFTILFFSFNILIT

SEQ ID NO: 1748633 - protein, 26 aa, Staphylococcus epidermidis
FQFSFLISLFIILAKPYISALKPLKC

SEQ ID NO: 1748634 - protein, 25 aa, Staphylococcus epidermidis
FQNILLMLLIIPTWINLLLKTYAFI

SEQ ID NO: 1748635 - protein, 22 aa, Staphylococcus epidermidis
FQSDLMLFFKILGVSIIPMALI

SEQ ID NO: 1748636 - protein, 23 aa, Staphylococcus epidermidis
FQWAMMVFVFFVITMALSVILRD

SEQ ID NO: 1748637 - protein, 23 aa, Staphylococcus epidermidis
FSGFILYTILIFGLSTITNIYIV

SEQ ID NO: 1748638 - protein, 21 aa, Staphylococcus epidermidis
FSHYVILFLALLTIIFGCIGA

SEQ ID NO: 1748639 - protein, 35 aa, Staphylococcus epidermidis
FSIRKFNIGIFSALIATVAFLAHPGQATASELEPS

SEQ ID NO: 1748640 - protein, 17 aa, Staphylococcus epidermidis
FSNWQWFISIASIVVLF

SEQ ID NO: 1748641 - protein, 18 aa, Staphylococcus epidermidis
FSRTIIVLILLVPSAFIV

SEQ ID NO: 1748642 - protein, 24 aa, Staphylococcus epidermidis
FTQIGFPIIDIILANILGLLIVYT

SEQ ID NO: 1748643 - protein, 18 aa, Staphylococcus epidermidis
FVAPTIKFHVWRVAIQTD

SEQ ID NO: 1748644 - protein, 20 aa, Staphylococcus epidermidis
FVIIAFVLALFIKEPNHLTH

SEQ ID NO: 1748645 - protein, 18 aa, Staphylococcus epidermidis
FVSKYVPMMLLAGILVSL

SEQ ID NO: 1748646 - protein, 25 aa, Staphylococcus epidermidis
FVSLIFTCIIFIGFLYQLYSKRINL

SEQ ID NO: 1748647 - protein, 29 aa, Staphylococcus epidermidis
FYGVIIYIIILFLFIRIFGEAFFHQIFGD

SEQ ID NO: 1748648 - protein, 37 aa, Staphylococcus epidermidis
GAHKSMLFFIAFVIYIMVFIALIVWLPKDLNIVTQSH

SEQ ID NO: 1748649 - protein, 23 aa, Staphylococcus epidermidis
GAINGWILPITLGAILIASRKKS

SEQ ID NO: 1748650 - protein, 29 aa, Staphylococcus epidermidis
GAIVLQLALLFIAQLYFHFSHNITSQREP

SEQ ID NO: 1748651 - protein, 23 aa, Staphylococcus epidermidis
GDLKFIDWGVLLVLGIFIGSYIA

SEQ ID NO: 1748652 - protein, 23 aa, Staphylococcus epidermidis
GEGQPILQLISSNPQINATITEF

SEQ ID NO: 1748653 - protein, 23 aa, Staphylococcus epidermidis
GFFKGFLSLIPVLIGIIVGYIVS

SEQ ID NO: 1748654 - protein, 25 aa, Staphylococcus epidermidis
GFFSVRLLLSLVFINLTSPVGMHLI

SEQ ID NO: 1748655 - protein, 27 aa, Staphylococcus epidermidis
GFGSGAPLPQFWRSAGAINSSVANDFK

SEQ ID NO: 1748656 - protein, 25 aa, Staphylococcus epidermidis
GFLGSMLYLLLKKPLKLKLCYRFNN

SEQ ID NO: 1748657 - protein, 31 aa, Staphylococcus epidermidis
GGLEWSPDHKSLIYKYDATLGRQINTNDVLT

SEQ ID NO: 1748658 - protein, 19 aa, Staphylococcus epidermidis
GIDFLAVMGFASAISVLFA

SEQ ID NO: 1748659 - protein, 25 aa, Staphylococcus epidermidis
GIFAFFLLTVFTITLKTYFSYYVDF

SEQ ID NO: 1748660 - protein, 24 aa, Staphylococcus epidermidis
GIFIFSLIYILIYSLVTLIPNVAI

SEQ ID NO: 1748661 - protein, 24 aa, Staphylococcus epidermidis
GIIALLTYIFDIPNFTLTLAVMIG

SEQ ID NO: 1748662 - protein, 20 aa, Staphylococcus epidermidis
GIIIVVVTILFIASAWSGLS

SEQ ID NO: 1748663 - protein, 25 aa, Staphylococcus epidermidis
GILVLISYLLFLLSGLANGLIKMNT

SEQ ID NO: 1748664 - protein, 30 aa, Staphylococcus epidermidis
GILVVLIAPFFSYLVKFFPPVVTGSVVTII

SEQ ID NO: 1748665 - protein, 18 aa, Staphylococcus epidermidis
GIMYFIITLLLMTQVYGF

SEQ ID NO: 1748666 - protein, 17 aa, Staphylococcus epidermidis
GINVYIVRILKLPFDIS

SEQ ID NO: 1748667 - protein, 23 aa, Staphylococcus epidermidis
GISLLTAILPVILMLISTIVQLI

SEQ ID NO: 1748668 - protein, 25 aa, Staphylococcus epidermidis
GISNILWFFIAVVVGSLVTMFTVLL

SEQ ID NO: 1748669 - protein, 27 aa, Staphylococcus epidermidis
GITIYLLLQMILGYFLSRLLINTKRKS

SEQ ID NO: 1748670 - protein, 25 aa, Staphylococcus epidermidis
GKVGLLNSVLERTSVFDSADPKNYQ

SEQ ID NO: 1748671 - protein, 27 aa, Staphylococcus epidermidis
GLDQILGVFMYPFALLLGLPFNEAWEV

SEQ ID NO: 1748672 - protein, 25 aa, Staphylococcus epidermidis
GLRDVNVNLPQGWTKTFTINPNNNT

SEQ ID NO: 1748673 - protein, 25 aa, Staphylococcus epidermidis
GLVQNLILLMNPYSLIALVLSVFLF

SEQ ID NO: 1748674 - protein, 18 aa, Staphylococcus epidermidis
GNNRVYRVSTYNLTNDEI

SEQ ID NO: 1748675 - protein, 31 aa, Staphylococcus epidermidis
GQDDMTIDSGFYQTPKYSLGNYVWYDTNKDG

SEQ ID NO: 1748676 - protein, 24 aa, Staphylococcus epidermidis
GSDLPNRDFTSISAIGSLPSSSEI

SEQ ID NO: 1748677 - protein, 18 aa, Staphylococcus epidermidis
GSIFTFVYSIKFILHIFF

SEQ ID NO: 1748678 - protein, 19 aa, Staphylococcus epidermidis
GSVWFLMMVRLMNGLATAV

SEQ ID NO: 1748679 - protein, 24 aa, Staphylococcus epidermidis
GTLIFAIVLALFKGIGLPGGMALV

SEQ ID NO: 1748680 - protein, 22 aa, Staphylococcus epidermidis
GTVFIIFFILRELRMKAPMLSL

SEQ ID NO: 1748681 - protein, 26 aa, Staphylococcus epidermidis
GTYAWLFLFIILFIKLARIPFWFLIK

SEQ ID NO: 1748682 - protein, 24 aa, Staphylococcus epidermidis
GVGLPLFTALPIVSSMLEKYGIRN

SEQ ID NO: 1748683 - protein, 22 aa, Staphylococcus epidermidis
GWKAILYFEIITTIAIGLGLII

SEQ ID NO: 1748684 - protein, 38 aa, Staphylococcus epidermidis
HFNQFQWIGLLSNFIFVPFYSFILFPSVIIYFILIHFF

SEQ ID NO: 1748685 - protein, 19 aa, Staphylococcus epidermidis
HPHELFIPAIILSLLILFF

SEQ ID NO: 1748686 - protein, 23 aa, Staphylococcus epidermidis
HRQIPIKTIKGVKVALLSYTFGT

SEQ ID NO: 1748687 - protein, 24 aa, Staphylococcus epidermidis
HVTDEWIIQIAYDKLIIMAKSEMD

SEQ ID NO: 1748688 - protein, 25 aa, Staphylococcus epidermidis
HYQGFTKIIIVLIISPIIAFCVGYM

SEQ ID NO: 1748689 - protein, 35 aa, Staphylococcus epidermidis
IAIYAITVILFSALMSFLFTNIYYHFHLKASNDAK

SEQ ID NO: 1748690 - protein, 23 aa, Staphylococcus epidermidis
IALLILFCFLISICFIFAPFVLL

SEQ ID NO: 1748691 - protein, 21 aa, Staphylococcus epidermidis
IALLVVMGVVLILLVIFGYIS

SEQ ID NO: 1748692 - protein, 27 aa, Staphylococcus epidermidis
IALTTYIYLTLVAFNFISGVLTLPGLA

SEQ ID NO: 1748693 - protein, 25 aa, Staphylococcus epidermidis
IANIFIPLIPAFIGAGLIGGIAAIL

SEQ ID NO: 1748694 - protein, 26 aa, Staphylococcus epidermidis
IASLLIMAILIWTIGIASSAWIIIVC

SEQ ID NO: 1748695 - protein, 69 aa, Staphylococcus epidermidis
IASTDIQGGGVYRLFKLPDNVHRLKVQFLPMNEIHSDFKRIQQLHDGYRYYSFIDTIGVNSGSHLYVKS

SEQ ID NO: 1748696 - protein, 17 aa, Staphylococcus epidermidis
IATIFLDNYDEITQNMN

SEQ ID NO: 1748697 - protein, 31 aa, Staphylococcus epidermidis
ICSFFVLLVSSLMIMFGLKLPLLIAFAVVFA

SEQ ID NO: 1748698 - protein, 19 aa, Staphylococcus epidermidis
IEEVLGLSQAIYDTKNALN

SEQ ID NO: 1748699 - protein, 18 aa, Staphylococcus epidermidis
IESLIQIPSKTFNKYMGN

SEQ ID NO: 1748700 - protein, 24 aa, Staphylococcus epidermidis
IFGIIVTVILYAMKIPGSIFIGMI

SEQ ID NO: 1748701 - protein, 19 aa, Staphylococcus epidermidis
IFSIILALAVLWLLFKIEN

SEQ ID NO: 1748702 - protein, 17 aa, Staphylococcus epidermidis
IGALVPLLFGHDSSILI

SEQ ID NO: 1748703 - protein, 25 aa, Staphylococcus epidermidis
IGIVFMTMLLFIFLIYANHFVMNHR

SEQ ID NO: 1748704 - protein, 19 aa, Staphylococcus epidermidis
IGIVSLKIDMHNVEGMAFA

SEQ ID NO: 1748705 - protein, 23 aa, Staphylococcus epidermidis
IGMILLIQIPIGVSLIALPFSVK

SEQ ID NO: 1748706 - protein, 30 aa, Staphylococcus epidermidis
IGSVLLILLFLFLIFHLIRLASKIDSQFNK

SEQ ID NO: 1748707 - protein, 18 aa, Staphylococcus epidermidis
IHTWNKFKDQVLFTGVYE

SEQ ID NO: 1748708 - protein, 23 aa, Staphylococcus epidermidis
IHWILFFLMIFFVFIVLAAPTYI

SEQ ID NO: 1748709 - protein, 18 aa, Staphylococcus epidermidis
IIAYILKIKGTALSAGFG

SEQ ID NO: 1748710 - protein, 25 aa, Staphylococcus epidermidis
IICGWCFIVLMFALPIYLSYHVSDG

SEQ ID NO: 1748711 - protein, 17 aa, Staphylococcus epidermidis
IICMIVAFNFNTFKIGF

SEQ ID NO: 1748712 - protein, 29 aa, Staphylococcus epidermidis
IIGIVIIVVLIIAAFILKQVNGSGSKDSN

SEQ ID NO: 1748713 - protein, 28 aa, Staphylococcus epidermidis
IIITIIVLIFIVLFYKELFILSFDEEYS

SEQ ID NO: 1748714 - protein, 17 aa, Staphylococcus epidermidis
IIMGFIIHIPISKAFIL

SEQ ID NO: 1748715 - protein, 38 aa, Staphylococcus epidermidis
IKLWLTIILIVATVLILLSVSLITFIQYYFTQETENAI

SEQ ID NO: 1748716 - protein, 23 aa, Staphylococcus epidermidis
IKRLNIIILLLMFISAISSFFLI

SEQ ID NO: 1748717 - protein, 25 aa, Staphylococcus epidermidis
ILGKGWKLLLIDIIVIIFSISLTLL

SEQ ID NO: 1748718 - protein, 21 aa, Staphylococcus epidermidis
ILGVITFWLFAQSLVNLVVPL

SEQ ID NO: 1748719 - protein, 19 aa, Staphylococcus epidermidis
ILIGAIPAALLAIIFDFIL

SEQ ID NO: 1748720 - protein, 26 aa, Staphylococcus epidermidis
ILINNFYFAYYFLIIGIGYTLIRIIY

SEQ ID NO: 1748721 - protein, 38 aa, Staphylococcus epidermidis
ILLVILSLLLYFSYLNHWWPFTSYIFLGLGLLSILNTC

SEQ ID NO: 1748722 - protein, 21 aa, Staphylococcus epidermidis
ILLVLFIVGTIAVILILTVGS

SEQ ID NO: 1748723 - protein, 19 aa, Staphylococcus epidermidis
ILMYVFWELTSISSFLLIS

SEQ ID NO: 1748724 - protein, 19 aa, Staphylococcus epidermidis
ILPSFISLILYRFELNLRS

SEQ ID NO: 1748725 - protein, 23 aa, Staphylococcus epidermidis
IMIWTIIMIAYLGYLRHEPKQHK

SEQ ID NO: 1748726 - protein, 33 aa, Staphylococcus epidermidis
IMTAFFCTILAIILLLIWPPVYNGIVTFGKWIV

SEQ ID NO: 1748727 - protein, 27 aa, Staphylococcus epidermidis
INFGNIDSPYIIKVISKYDPNKDDYTT

SEQ ID NO: 1748728 - protein, 19 aa, Staphylococcus epidermidis
INMFTFIQLLTPFVTYLIA

SEQ ID NO: 1748729 - protein, 25 aa, Staphylococcus epidermidis
INNVPFRILLFYIGSLAVIMSVVPW

SEQ ID NO: 1748730 - protein, 22 aa, Staphylococcus epidermidis
INQPYIYHLFIKLILKGKNSQE

SEQ ID NO: 1748731 - protein, 48 aa, Staphylococcus epidermidis
INTFDPIIFIILSTGVLLWILGIHPYIVFFPIILILIGYYIVRFKMQA

SEQ ID NO: 1748732 - protein, 18 aa, Staphylococcus epidermidis
IPCYLCAFIAIIYGFTGI

SEQ ID NO: 1748733 - protein, 20 aa, Staphylococcus epidermidis
IPFLGPWLSFAPAAILGIID

SEQ ID NO: 1748734 - protein, 18 aa, Staphylococcus epidermidis
IPITLVTFILGLIIALFT

SEQ ID NO: 1748735 - protein, 19 aa, Staphylococcus epidermidis
ISAIVIGILCLMISHWFKS

SEQ ID NO: 1748736 - protein, 30 aa, Staphylococcus epidermidis
ISEANANIRSYLLQNNPILAGVNGDVTFYY

SEQ ID NO: 1748737 - protein, 23 aa, Staphylococcus epidermidis
ISIFTYLYLFISASVIVLILSSK

SEQ ID NO: 1748738 - protein, 23 aa, Staphylococcus epidermidis
ISLIIFIMLFVVALFKCITNYKH

SEQ ID NO: 1748739 - protein, 25 aa, Staphylococcus epidermidis
ISLPFILLIVFFPLFYKLSHNHYGF

SEQ ID NO: 1748740 - protein, 19 aa, Staphylococcus epidermidis
ISVLLIYFLLTVLAQGIVI

SEQ ID NO: 1748741 - protein, 19 aa, Staphylococcus epidermidis
ITAFIFAVFMTPLLFVLKQ

SEQ ID NO: 1748742 - protein, 30 aa, Staphylococcus epidermidis
ITHSLPFTILWPILITFFIFVIFSQTNPLH

SEQ ID NO: 1748743 - protein, 19 aa, Staphylococcus epidermidis
ITIIILFFLTNGISIDHTK

SEQ ID NO: 1748744 - protein, 32 aa, Staphylococcus epidermidis
ITILFFSTAFLILIFSLIFLTKKKLYNAELLL

SEQ ID NO: 1748745 - protein, 26 aa, Staphylococcus epidermidis
ITVLVILLIIIFYRPLMISTFDATFS

SEQ ID NO: 1748746 - protein, 24 aa, Staphylococcus epidermidis
IVASLLIWGFNFTIADPIASILVS

SEQ ID NO: 1748747 - protein, 27 aa, Staphylococcus epidermidis
IVGGVFVWLMYLPHWKVTEDPAVKLGV

SEQ ID NO: 1748748 - protein, 26 aa, Staphylococcus epidermidis
IVGLMLFFLLLQFKIVPESWINVGAD

SEQ ID NO: 1748749 - protein, 18 aa, Staphylococcus epidermidis
IVGYILVIVFSLTYWKWL

SEQ ID NO: 1748750 - protein, 17 aa, Staphylococcus epidermidis
IVHFDKPSGMTQTTTDS

SEQ ID NO: 1748751 - protein, 27 aa, Staphylococcus epidermidis
IVIIPAFLCILLVLTFIIFTLASLAAP

SEQ ID NO: 1748752 - protein, 19 aa, Staphylococcus epidermidis
IVIIVILIDVLLRLLEKKL

SEQ ID NO: 1748753 - protein, 26 aa, Staphylococcus epidermidis
IVISTFVFLFIGKPVSLLIIAGAING

SEQ ID NO: 1748754 - protein, 18 aa, Staphylococcus epidermidis
IVLILLVPSAFIVFGAYD

SEQ ID NO: 1748755 - protein, 23 aa, Staphylococcus epidermidis
IVMIWSAPSFKALFAPKGKLSAL

SEQ ID NO: 1748756 - protein, 26 aa, Staphylococcus epidermidis
IYAIRSLLWEHIIQLKMPFFDKNESG

SEQ ID NO: 1748757 - protein, 27 aa, Staphylococcus epidermidis
IYFCINLILPIFFLSGIFIMLSIYLPQ

SEQ ID NO: 1748758 - protein, 17 aa, Staphylococcus epidermidis
IYNGGFYLISTMTLLII

SEQ ID NO: 1748759 - protein, 17 aa, Staphylococcus epidermidis
KALMLYARENNKGVYDR

SEQ ID NO: 1748760 - protein, 29 aa, Staphylococcus epidermidis
KDKFNLFLPWYYLIKFIMPIVIILVFIVQ

SEQ ID NO: 1748761 - protein, 22 aa, Staphylococcus epidermidis
KEEALKQVDTLVNHSFITINNV

SEQ ID NO: 1748762 - protein, 17 aa, Staphylococcus epidermidis
KEGILFHYLFSKNKQET

SEQ ID NO: 1748763 - protein, 18 aa, Staphylococcus epidermidis
KFMAPLSFVLASLAIYWA

SEQ ID NO: 1748764 - protein, 28 aa, Staphylococcus epidermidis
KGYHSLWVWPILLIAIFFIVNFIITNRQ

SEQ ID NO: 1748765 - protein, 18 aa, Staphylococcus epidermidis
KHRRLLYGSVFLMATSAI

SEQ ID NO: 1748766 - protein, 20 aa, Staphylococcus epidermidis
KIFLKLVLPLSKRSILAGIM

SEQ ID NO: 1748767 - protein, 20 aa, Staphylococcus epidermidis
KIIYIAVVGVLLFALGSLMS

SEQ ID NO: 1748768 - protein, 26 aa, Staphylococcus epidermidis
KIKIDFHCIFFLFLEKITPIPRKINN

SEQ ID NO: 1748769 - protein, 40 aa, Staphylococcus epidermidis
KKKKSKRIFLKAIITILILLIIFFGVMYFISSRANVDDLK

SEQ ID NO: 1748770 - protein, 24 aa, Staphylococcus epidermidis
KKLEAKAYIDGYSDDKINDISSRA

SEQ ID NO: 1748771 - protein, 33 aa, Staphylococcus epidermidis
KKRMRKLPFIILVILIILISIIVYITHQYNSGM

SEQ ID NO: 1748772 - protein, 20 aa, Staphylococcus epidermidis
KLIMTLGFILGGIIGFFQGV

SEQ ID NO: 1748773 - protein, 23 aa, Staphylococcus epidermidis
KLSPLIVIILISSLLYLVFKQDH

SEQ ID NO: 1748774 - protein, 41 aa, Staphylococcus epidermidis
KNGVLTFRSSDYLKDLPLSGELKAIVYYNQYVQSNFSNSVP

SEQ ID NO: 1748775 - protein, 31 aa, Staphylococcus epidermidis
KNIIAVLAIILIIYIALQHAPFLKNQEWNPL

SEQ ID NO: 1748776 - protein, 41 aa, Staphylococcus epidermidis
KNSKHIKIKLWHFILVILGIILLTSIITVVSTILISHQKSG

SEQ ID NO: 1748777 - protein, 24 aa, Staphylococcus epidermidis
KNYVLMIPLTFIFGATLLLISDVL

SEQ ID NO: 1748778 - protein, 25 aa, Staphylococcus epidermidis
KPVIAVIVSLIILILAAIPVSGMRL

SEQ ID NO: 1748779 - protein, 23 aa, Staphylococcus epidermidis
KQGIRHIILDLRNNPGGLLDEAV

SEQ ID NO: 1748780 - protein, 36 aa, Staphylococcus epidermidis
KQIHEPWLFSLPAVILMLLIPVIFFVPNVFGNFVIL

SEQ ID NO: 1748781 - protein, 21 aa, Staphylococcus epidermidis
KQNARTLINEIVSNALSQLNK

SEQ ID NO: 1748782 - protein, 19 aa, Staphylococcus epidermidis
KSFFIYLVVGIIAAVVFSF

SEQ ID NO: 1748783 - protein, 28 aa, Staphylococcus epidermidis
KTQGAPTARLYYAAGARSGEYKQATNYN

SEQ ID NO: 1748784 - protein, 28 aa, Staphylococcus epidermidis
KTSFSIILITGLIIWSFIYTGFSIGDLM

SEQ ID NO: 1748785 - protein, 20 aa, Staphylococcus epidermidis
KVDWILVLVISLLALTSVIL

SEQ ID NO: 1748786 - protein, 30 aa, Staphylococcus epidermidis
KVIERLLLALILPLIILMIGLFSFNTYADS

SEQ ID NO: 1748787 - protein, 21 aa, Staphylococcus epidermidis
KWTHFFISIPVIIGGSFSAFF

SEQ ID NO: 1748788 - protein, 32 aa, Staphylococcus epidermidis
LAGIKWQQIIFILPFLLLAIFVTIFMGRQLTI

SEQ ID NO: 1748789 - protein, 43 aa, Staphylococcus epidermidis
LAIIFDFILRYMERLSYKKLLISLGTIVIVIIIAIAIPMAAQK

SEQ ID NO: 1748790 - protein, 27 aa, Staphylococcus epidermidis
LATAGIISSLFYFLKNKNKSPQQLKSI

SEQ ID NO: 1748791 - protein, 29 aa, Staphylococcus epidermidis
LAWIANILSLLFLIFGILSIFVINNTSNQ

SEQ ID NO: 1748792 - protein, 24 aa, Staphylococcus epidermidis
LEEKAEANRLLQNVLTSTSDEIAN

SEQ ID NO: 1748793 - protein, 20 aa, Staphylococcus epidermidis
LEELLFRGIFKETLFMKYRF

SEQ ID NO: 1748794 - protein, 31 aa, Staphylococcus epidermidis
LFIPAIILSLLILFFYLFSDGLRDAFDPKMR

SEQ ID NO: 1748795 - protein, 23 aa, Staphylococcus epidermidis
LGALYLPLLFKIVQLQLNLSKGL

SEQ ID NO: 1748796 - protein, 23 aa, Staphylococcus epidermidis
LGETFFGYLIWYSVGRFFVEAMR

SEQ ID NO: 1748797 - protein, 21 aa, Staphylococcus epidermidis
LGFTTLVIQHGFMGSLFGIEN

SEQ ID NO: 1748798 - protein, 26 aa, Staphylococcus epidermidis
LGGVTLLIILILQRFTKGFLKSIAIL

SEQ ID NO: 1748799 - protein, 19 aa, Staphylococcus epidermidis
LGLFKSPYVLLVTFISMVF

SEQ ID NO: 1748800 - protein, 39 aa, Staphylococcus epidermidis
LGRSAQDVARFLPNKILNIRYKLRPVNISTPREVTFNEA

SEQ ID NO: 1748801 - protein, 23 aa, Staphylococcus epidermidis
LIFMGIICLIYWIGSILILVLTC

SEQ ID NO: 1748802 - protein, 23 aa, Staphylococcus epidermidis
LIGGPWVAIIVGIISGLCRLYIG

SEQ ID NO: 1748803 - protein, 26 aa, Staphylococcus epidermidis
LIKGYPILGWTFFIAALSLAGIPPFS

SEQ ID NO: 1748804 - protein, 17 aa, Staphylococcus epidermidis
LIKLILNYPLIMLLHTP

SEQ ID NO: 1748805 - protein, 62 aa, Staphylococcus epidermidis
LILVYSMLIAFLFIDKVFVNIIFFQGMFYTQIFGIPVFLFLNLLIVLLCIIVGSVLAYKINQ

SEQ ID NO: 1748806 - protein, 17 aa, Staphylococcus epidermidis
LINEIVSNALSQLNKVT

SEQ ID NO: 1748807 - protein, 18 aa, Staphylococcus epidermidis
LIPPFIIQILVENSIKHA

SEQ ID NO: 1748808 - protein, 18 aa, Staphylococcus epidermidis
LIQWIISFFLLITGFLVS

SEQ ID NO: 1748809 - protein, 17 aa, Staphylococcus epidermidis
LITLIRFFIPLHPDFDT

SEQ ID NO: 1748810 - protein, 18 aa, Staphylococcus epidermidis
LIVILWQVVDSFTIIRLL

SEQ ID NO: 1748811 - protein, 17 aa, Staphylococcus epidermidis
LIYLTLLLDFNKIVRAL

SEQ ID NO: 1748812 - protein, 23 aa, Staphylococcus epidermidis
LKFSLFLAMLLACLLIQAATNMF

SEQ ID NO: 1748813 - protein, 35 aa, Staphylococcus epidermidis
LKNRLTLVVIVIFIIFLILLFMFVNLSDEDTGQIT

SEQ ID NO: 1748814 - protein, 26 aa, Staphylococcus epidermidis
LKQSPILIILLIIISTLLLLICTGFA

SEQ ID NO: 1748815 - protein, 20 aa, Staphylococcus epidermidis
LLALVLYRFAYYFVPVMIAL

SEQ ID NO: 1748816 - protein, 26 aa, Staphylococcus epidermidis
LLGAILLIFILIFGDLKFILESYTLA

SEQ ID NO: 1748817 - protein, 18 aa, Staphylococcus epidermidis
LLIPLVFTVAKRANVSIL

SEQ ID NO: 1748818 - protein, 21 aa, Staphylococcus epidermidis
LLISFSYWVRLLQAHPYQLTL

SEQ ID NO: 1748819 - protein, 19 aa, Staphylococcus epidermidis
LLLIMLFPIIIKFTKKVKN

SEQ ID NO: 1748820 - protein, 25 aa, Staphylococcus epidermidis
LLQLKRASLQYSFLTNLIAAFVACG

SEQ ID NO: 1748821 - protein, 21 aa, Staphylococcus epidermidis
LLVGLFMWNLMQWSTNPAIQS

SEQ ID NO: 1748822 - protein, 19 aa, Staphylococcus epidermidis
LLYFIPGSVWFLMMVRLMN

SEQ ID NO: 1748823 - protein, 22 aa, Staphylococcus epidermidis
LLYPYLVLLIKWQWVKLNKNVF

SEQ ID NO: 1748824 - protein, 17 aa, Staphylococcus epidermidis
LMDAFYELNDRKSLHEL

SEQ ID NO: 1748825 - protein, 25 aa, Staphylococcus epidermidis
LMPPIQLVFILLTFSICDEILSESG

SEQ ID NO: 1748826 - protein, 17 aa, Staphylococcus epidermidis
LMSILICVTFSLLMVTP

SEQ ID NO: 1748827 - protein, 19 aa, Staphylococcus epidermidis
LNALLYLLVLINPKKMNPI

SEQ ID NO: 1748828 - protein, 28 aa, Staphylococcus epidermidis
LNDAWAFLYPMLPYLFIGVFIGAFIYGF

SEQ ID NO: 1748829 - protein, 19 aa, Staphylococcus epidermidis
LNFFIPLILIVMYVSLIKK

SEQ ID NO: 1748830 - protein, 31 aa, Staphylococcus epidermidis
LNGFERLNHARPRALEYIKSLEKINNAQKSA

SEQ ID NO: 1748831 - protein, 29 aa, Staphylococcus epidermidis
LPFSTITIILFLISAFLFLATTFDSGSYI

SEQ ID NO: 1748832 - protein, 25 aa, Staphylococcus epidermidis
LPGMIPWFMILFSHLRFRRLHPEKV

SEQ ID NO: 1748833 - protein, 18 aa, Staphylococcus epidermidis
LPSPLTTTISFVVSFIVV

SEQ ID NO: 1748834 - protein, 48 aa, Staphylococcus epidermidis
LPTKRNILLMFCPLLPFIGFAFIFLIPSKGILICLTFMILNAILSFKL

SEQ ID NO: 1748835 - protein, 29 aa, Staphylococcus epidermidis
LQNAARSGRPIQFLVGFDVEDSHHNPETL

SEQ ID NO: 1748836 - protein, 26 aa, Staphylococcus epidermidis
LSIASWRMIFIFLTIITLIVILGILL

SEQ ID NO: 1748837 - protein, 22 aa, Staphylococcus epidermidis
LSLLLFVIILQVAVLKYYRFNR

SEQ ID NO: 1748838 - protein, 27 aa, Staphylococcus epidermidis
LSNNSNQQFPPRNAQRRKRRRETATNQ

SEQ ID NO: 1748839 - protein, 19 aa, Staphylococcus epidermidis
LSQVALLAAFIPIISGMSG

SEQ ID NO: 1748840 - protein, 32 aa, Staphylococcus epidermidis
LTKNLYLTFLLLFVTIILFVTVIQNSILALII

SEQ ID NO: 1748841 - protein, 17 aa, Staphylococcus epidermidis
LTLLPALISIFHKSIKI

SEQ ID NO: 1748842 - protein, 18 aa, Staphylococcus epidermidis
LTLMIPLLIVVTFMTFMM

SEQ ID NO: 1748843 - protein, 26 aa, Staphylococcus epidermidis
LTTTISFVVSFIVVTYLHVVLGELAP

SEQ ID NO: 1748844 - protein, 17 aa, Staphylococcus epidermidis
LTYSFSRTAFNELNVNI

SEQ ID NO: 1748845 - protein, 19 aa, Staphylococcus epidermidis
LVLALFILFFIELTEYRIE

SEQ ID NO: 1748846 - protein, 21 aa, Staphylococcus epidermidis
LVLMLILTMIIQKLKIKFKKG

SEQ ID NO: 1748847 - protein, 22 aa, Staphylococcus epidermidis
LVPYLLWMVIFIIIPVILLVYF

SEQ ID NO: 1748848 - protein, 26 aa, Staphylococcus epidermidis
LVTPFLIIMVILIAVFYLFTGSISLG

SEQ ID NO: 1748849 - protein, 18 aa, Staphylococcus epidermidis
LYCLFSCTMLYSNLTKEL

SEQ ID NO: 1748850 - protein, 17 aa, Staphylococcus epidermidis
MGSRIPKGVLLVGPPGT

SEQ ID NO: 1748851 - protein, 24 aa, Staphylococcus epidermidis
MGVVLILLVIFGYISADRMAKRQS

SEQ ID NO: 1748852 - protein, 25 aa, Staphylococcus epidermidis
MIILLSFALLFLSFYDKVLPKNFKN

SEQ ID NO: 1748853 - protein, 18 aa, Staphylococcus epidermidis
MIPLLIVVTFMTFMMTYL

SEQ ID NO: 1748854 - protein, 19 aa, Staphylococcus epidermidis
MISLVFLVAFSSKAALVIF

SEQ ID NO: 1748855 - protein, 21 aa, Staphylococcus epidermidis
MLLPFVCALILVFTKNKNRIS

SEQ ID NO: 1748856 - protein, 22 aa, Staphylococcus epidermidis
MMIGIFILLLLTLVIGKNINGS

SEQ ID NO: 1748857 - protein, 24 aa, Staphylococcus epidermidis
MNIILLIIGYFVIPFAGAFIVHKI

SEQ ID NO: 1748858 - protein, 25 aa, Staphylococcus epidermidis
MRRYLMRFVHHIGGLADFSALKFTK

SEQ ID NO: 1748859 - protein, 32 aa, Staphylococcus epidermidis
MTTLFIISILVILAILFLIFDTNLFKNDVKHT

SEQ ID NO: 1748860 - protein, 26 aa, Staphylococcus epidermidis
MVLAYAFLLGLFILGLVASLAIVHAY

SEQ ID NO: 1748861 - protein, 18 aa, Staphylococcus epidermidis
NDFKFIPVYFGMGVIFSL

SEQ ID NO: 1748862 - protein, 24 aa, Staphylococcus epidermidis
NDFNSFISNIPAHSTLTWNEEPNS

SEQ ID NO: 1748863 - protein, 41 aa, Staphylococcus epidermidis
NDTELPETGLSNEYDYTTTVFGSIALISSLLLLRRQRKESK

SEQ ID NO: 1748864 - protein, 19 aa, Staphylococcus epidermidis
NEIATIIPATTIKTDAKTA

SEQ ID NO: 1748865 - protein, 49 aa, Staphylococcus epidermidis
NENSTNIRLRKIVPIGISVFILILIIVLFFLLRNYNSPNAQAKILVNAV

SEQ ID NO: 1748866 - protein, 24 aa, Staphylococcus epidermidis
NFILIPTYILLQSIIPIIVVFGSL

SEQ ID NO: 1748867 - protein, 20 aa, Staphylococcus epidermidis
NFPRLFTHDSHIPNFITIII

SEQ ID NO: 1748868 - protein, 22 aa, Staphylococcus epidermidis
NFSIIHYFILLLGIAIIVVFAL

SEQ ID NO: 1748869 - protein, 20 aa, Staphylococcus epidermidis
NGQQILVRNVPQNAQVTLYQ

SEQ ID NO: 1748870 - protein, 27 aa, Staphylococcus epidermidis
NHTVEQTIYINPLRYSAKETNVNISGN

SEQ ID NO: 1748871 - protein, 25 aa, Staphylococcus epidermidis
NHVKEQLSLVFNAIEKDRKDIQVAQ

SEQ ID NO: 1748872 - protein, 18 aa, Staphylococcus epidermidis
NIERVSHLVLTRTGLYII

SEQ ID NO: 1748873 - protein, 19 aa, Staphylococcus epidermidis
NIKAHLKLTSYIDKSKVPN

SEQ ID NO: 1748874 - protein, 17 aa, Staphylococcus epidermidis
NILIFIGMILLIQIPIG

SEQ ID NO: 1748875 - protein, 23 aa, Staphylococcus epidermidis
NISRIWIVFMFLIGFVAVITLRL

SEQ ID NO: 1748876 - protein, 17 aa, Staphylococcus epidermidis
NKPNYVEFNQDNGKVVF

SEQ ID NO: 1748877 - protein, 60 aa, Staphylococcus epidermidis
NKRQKFLRIGFIVLTILSAALSIFSFFTANLIFGIIFALLTVIFVVGIIFSRSKAVDYST

SEQ ID NO: 1748878 - protein, 18 aa, Staphylococcus epidermidis
NLLPLMNVVFFKSNHLTL

SEQ ID NO: 1748879 - protein, 34 aa, Staphylococcus epidermidis
NNITEYRPEYNKKKNAILKLYDVSDTQEAIINGY

SEQ ID NO: 1748880 - protein, 28 aa, Staphylococcus epidermidis
NNKLNYYIMITLFIFVAIVVYGYLTVGF

SEQ ID NO: 1748881 - protein, 24 aa, Staphylococcus epidermidis
NPILLLILAIIFFSVLKIFKYVSL

SEQ ID NO: 1748882 - protein, 26 aa, Staphylococcus epidermidis
NPISNQPWMLLLQGVVFFIIYYVIFR

SEQ ID NO: 1748883 - protein, 25 aa, Staphylococcus epidermidis
NPNNLGWFFILPPLVGMIVQPLIGY

SEQ ID NO: 1748884 - protein, 25 aa, Staphylococcus epidermidis
NPNSEIIFSFNTMTAKNRKGGTQLV

SEQ ID NO: 1748885 - protein, 22 aa, Staphylococcus epidermidis
NQSLLFIVILGSLTAFGPLAID

SEQ ID NO: 1748886 - protein, 18 aa, Staphylococcus epidermidis
NQVGLGLKTGIDLPNETP

SEQ ID NO: 1748887 - protein, 22 aa, Staphylococcus epidermidis
NQYKVYRPMLNLKKTEILAYQY

SEQ ID NO: 1748888 - protein, 33 aa, Staphylococcus epidermidis
NQYSLLILIILTLIFLYILVYRGFVTSVLSFLI

SEQ ID NO: 1748889 - protein, 17 aa, Staphylococcus epidermidis
NSKKWYRPLGYDAEDIN

SEQ ID NO: 1748890 - protein, 18 aa, Staphylococcus epidermidis
NTFLPWLSLVPVVSVIGL

SEQ ID NO: 1748891 - protein, 25 aa, Staphylococcus epidermidis
NTMRKMVQNLWWGAGYNIVAVPLAA

SEQ ID NO: 1748892 - protein, 25 aa, Staphylococcus epidermidis
NTRYNYVIPKEGSNLWFDNMVIPKT

SEQ ID NO: 1748893 - protein, 41 aa, Staphylococcus epidermidis
NVLDKRLPMLDLPIIPIIVSRYWVQLISNVPKEMVYPLMNS

SEQ ID NO: 1748894 - protein, 27 aa, Staphylococcus epidermidis
NWAGWLLFFGIVFFSGSLYFLALTQVR

SEQ ID NO: 1748895 - protein, 24 aa, Staphylococcus epidermidis
NYQHPTWMLVFGIIAVIVTIMTGI

SEQ ID NO: 1748896 - protein, 28 aa, Staphylococcus epidermidis
PALIYYGLKFLNPSYLLVSAFIISAMTS

SEQ ID NO: 1748897 - protein, 20 aa, Staphylococcus epidermidis
PALTKLFGKASWYLPKWLGA

SEQ ID NO: 1748898 - protein, 22 aa, Staphylococcus epidermidis
PDKLLPYKAPFYPVGPIIVLFT

SEQ ID NO: 1748899 - protein, 27 aa, Staphylococcus epidermidis
PFDISLHFYFFFFVGVIITGILKMFFY

SEQ ID NO: 1748900 - protein, 24 aa, Staphylococcus epidermidis
PGQFYLVRIYRIIMLIITFLTELI

SEQ ID NO: 1748901 - protein, 32 aa, Staphylococcus epidermidis
PIHFNLLTMLIYGIVLIIISLLGSLFSVLSII

SEQ ID NO: 1748902 - protein, 33 aa, Staphylococcus epidermidis
PIVVSIAVITFIIWIIFVHPGQFEPALVSAISV

SEQ ID NO: 1748903 - protein, 33 aa, Staphylococcus epidermidis
PKAIKQVFWRILLFYILAIFIIGMLIPYDSKAL

SEQ ID NO: 1748904 - protein, 43 aa, Staphylococcus epidermidis
PKAMAPIMPIIIIPILSSLIVGLIFIFVIGAPISNIFGALTSW

SEQ ID NO: 1748905 - protein, 19 aa, Staphylococcus epidermidis
PLKAVLGFILSLMATLGFT

SEQ ID NO: 1748906 - protein, 20 aa, Staphylococcus epidermidis
PLKRLLLYIIILLTMCAFLN

SEQ ID NO: 1748907 - protein, 20 aa, Staphylococcus epidermidis
PLMDGLYLHMLLWSKEKGYK

SEQ ID NO: 1748908 - protein, 26 aa, Staphylococcus epidermidis
PLSAYAFMIFILLYVPCISTVATIRK

SEQ ID NO: 1748909 - protein, 19 aa, Staphylococcus epidermidis
PLVICYTNDVVKNFTANGL

SEQ ID NO: 1748910 - protein, 20 aa, Staphylococcus epidermidis
PMLLNTFLIGLFLFGHSGGP

SEQ ID NO: 1748911 - protein, 25 aa, Staphylococcus epidermidis
PNLIVVILFVLIFEPSIWTIILAMS

SEQ ID NO: 1748912 - protein, 23 aa, Staphylococcus epidermidis
PNWLRRLITRSLAVIPVIICLIV

SEQ ID NO: 1748913 - protein, 53 aa, Staphylococcus epidermidis
PQAIEGLKPTLIYPLLSVSITGLLMVYVFNPPAAWLNHLLLNGLNSLSGSNIM

SEQ ID NO: 1748914 - protein, 26 aa, Staphylococcus epidermidis
PRAKLIFVFFFILLIFFCHSLGTYAW

SEQ ID NO: 1748915 - protein, 26 aa, Staphylococcus epidermidis
PREVTFNEAIKYKTFSEYYINTNDNT

SEQ ID NO: 1748916 - protein, 20 aa, Staphylococcus epidermidis
PTALLLMALMFIGGAPLSAA

SEQ ID NO: 1748917 - protein, 22 aa, Staphylococcus epidermidis
PTGPVTFTIINRDGSSTSTGGV

SEQ ID NO: 1748918 - protein, 18 aa, Staphylococcus epidermidis
PVHIAFIPIVIPPLVSLF

SEQ ID NO: 1748919 - protein, 51 aa, Staphylococcus epidermidis
PYSLIALVLSVFLFFKGKKAFWFIFIGGFLLTFLLYANVVYFRFFSDFLTF

SEQ ID NO: 1748920 - protein, 19 aa, Staphylococcus epidermidis
PYVIMTWITLLIPNQLKTL

SEQ ID NO: 1748921 - protein, 19 aa, Staphylococcus epidermidis
QAILTTKNALDGEEQLRRA

SEQ ID NO: 1748922 - protein, 29 aa, Staphylococcus epidermidis
QAKKQLRGKQKLYQTIDLADKELSKLDDL

SEQ ID NO: 1748923 - protein, 23 aa, Staphylococcus epidermidis
QDKYEVNILYLISHALVETGNGQ

SEQ ID NO: 1748924 - protein, 18 aa, Staphylococcus epidermidis
QDVLFKALMLYARENNKG

SEQ ID NO: 1748925 - protein, 18 aa, Staphylococcus epidermidis
QFEVAVPAFITIIMMPLS

SEQ ID NO: 1748926 - protein, 33 aa, Staphylococcus epidermidis; identical to SEQ ID NO: 1593949

SEQ ID NO: 1748927 - protein, 52 aa, Staphylococcus epidermidis
QGNAYITTKRLKDGYQWDILFNSNHKGHEYMYYWFGLPSDQTPTGPVTFTII

SEQ ID NO: 1748928 - protein, 25 aa, Staphylococcus epidermidis
QGVVFFIIYYVIFRVVIQVFNLSTI

SEQ ID NO: 1748929 - protein, 18 aa, Staphylococcus epidermidis
QHHFILFTIYGVTSYILG

SEQ ID NO: 1748930 - protein, 28 aa, Staphylococcus epidermidis
QIGRDLTLHAEIFFDGETTPIRKDTTYK

SEQ ID NO: 1748931 - protein, 20 aa, Staphylococcus epidermidis
QLSHHMVFDKSLIEITKEPM

SEQ ID NO: 1748932 - protein, 24 aa, Staphylococcus epidermidis
QNELTYKVTLPENFEYVDNSTEVS

SEQ ID NO: 1748933 - protein, 23 aa, Staphylococcus epidermidis
QQLKSIPPFFSGQAPYIFAHRGG

SEQ ID NO: 1748934 - protein, 29 aa, Staphylococcus epidermidis
QQSLLLLLSVIFISLILRATFNMLIQFLG

SEQ ID NO: 1748935 - protein, 46 aa, Staphylococcus epidermidis
QSEGKKKGGFMKILLPLIAAILILGAIAIFGGMALNNHNDSKSDDQ

SEQ ID NO: 1748936 - protein, 33 aa, Staphylococcus epidermidis
QSFNDSLHNFNYLHSKFDARLREKDVANHIVQT

SEQ ID NO: 1748937 - protein, 19 aa, Staphylococcus epidermidis
QSRFKKFILILLVGASIGT

SEQ ID NO: 1748938 - protein, 20 aa, Staphylococcus epidermidis
QTAYNKLIENVSTNGKKPAS

SEQ ID NO: 1748939 - protein, 30 aa, Staphylococcus epidermidis
QVGSYFLFIIIVVFLLYANFLFLKRRGREL

SEQ ID NO: 1748940 - protein, 36 aa, Staphylococcus epidermidis
QVNKDIIPSNYTLASYNKYNKLKERAQTVLDEETNN

SEQ ID NO: 1748941 - protein, 25 aa, Staphylococcus epidermidis
QYGYTLLFIILISSLSAMLLQSMTV

SEQ ID NO: 1748942 - protein, 25 aa, Staphylococcus epidermidis
RAFTLIEMLLVLLIISLLLILIIPN

SEQ ID NO: 1748943 - protein, 26 aa, Staphylococcus epidermidis
RGAFLSLVIYIILSIAKYMTGYVYDS

SEQ ID NO: 1748944 - protein, 48 aa, Staphylococcus epidermidis
RIERYNHAKPPRFLVRFWTLFVSFLIGLVLMSVLFFNNLGMVKLGNIN

SEQ ID NO: 1748945 - protein, 23 aa, Staphylococcus epidermidis
RLSLARLLLRPSAGFWILDEPTT

SEQ ID NO: 1748946 - protein, 19 aa, Staphylococcus epidermidis
RMVVTWVITLPISAVLAAI

SEQ ID NO: 1748947 - protein, 25 aa, Staphylococcus epidermidis
RQRRYEWFGDIIAQLRADVLLTAHH

SEQ ID NO: 1748948 - protein, 18 aa, Staphylococcus epidermidis
RSINAYNKAIQSLETQIT

SEQ ID NO: 1748949 - protein, 28 aa, Staphylococcus epidermidis
RTIVTLIMLLPFIFILVGAFDKFGKDTI

SEQ ID NO: 1748950 - protein, 31 aa, Staphylococcus epidermidis
RTRVSMFIWLVLLLPLPFLLSNLGVTFVVIA

SEQ ID NO: 1748951 - protein, 30 aa, Staphylococcus epidermidis
RVAIFISPLWFIFLFFYYKKYKNNAESLAD

SEQ ID NO: 1748952 - protein, 24 aa, Staphylococcus epidermidis
RYSVPPLFAFITTLFIGLLTGLFG

SEQ ID NO: 1748953 - protein, 23 aa, Staphylococcus epidermidis
SAALKESISLIDSIEIQAHKKLE

SEQ ID NO: 1748954 - protein, 26 aa, Staphylococcus epidermidis
SAISVLFAVLAALTLLPALISIFHKS

SEQ ID NO: 1748955 - protein, 36 aa, Staphylococcus epidermidis
SASFKWYDFVYFIDTIIYLAILIFKRKWLDNRAFSK

SEQ ID NO: 1748956 - protein, 22 aa, Staphylococcus epidermidis
SAWGYWFSAFLGNVAYATLLMS

SEQ ID NO: 1748957 - protein, 24 aa, Staphylococcus epidermidis
SDGWWLLNFISTIGAVLMAIGFLF

SEQ ID NO: 1748958 - protein, 24 aa, Staphylococcus epidermidis
SECNTIPVYMPYVTAYFMPRAYKD

SEQ ID NO: 1748959 - protein, 18 aa, Staphylococcus epidermidis
SFLLFLGNWIGQVGLNWF

SEQ ID NO: 1748960 - protein, 24 aa, Staphylococcus epidermidis
SGILAFHIDPIFAIIIMGFSAMMT

SEQ ID NO: 1748961 - protein, 33 aa, Staphylococcus epidermidis
SGYLKYILLIMIAWLFIFILMKAGLTQVNQLRD

SEQ ID NO: 1748962 - protein, 23 aa, Staphylococcus epidermidis
SIFILYLNHILISGTLYALDVYH

SEQ ID NO: 1748963 - protein, 24 aa, Staphylococcus epidermidis
SIIIIMLSTFTLFISPSTYANEDE

SEQ ID NO: 1748964 - protein, 32 aa, Staphylococcus epidermidis
SIILVLLVLMSIVLTYMVWNFSPDLSNIDNTD

SEQ ID NO: 1748965 - protein, 17 aa, Staphylococcus epidermidis
SIKGFPLALGALYLPLL

SEQ ID NO: 1748966 - protein, 37 aa, Staphylococcus epidermidis
SILGSFIALLKISKIRPLQWIASIYIEFLRGTPMLVQ

SEQ ID NO: 1748967 - protein, 20 aa, Staphylococcus epidermidis
SIPYFFGTVGILYDKEKYPN

SEQ ID NO: 1748968 - protein, 25 aa, Staphylococcus epidermidis
SKAEKLIDSLKFINKAQFTHANDEI

SEQ ID NO: 1748969 - protein, 39 aa, Staphylococcus epidermidis
SKETQLTEALLKEPSIAKAQTKLKRIPTLITESKKHSNN

SEQ ID NO: 1748970 - protein, 27 aa, Staphylococcus epidermidis
SKLVYPIIHICVIVLKPITILLNKMTD

SEQ ID NO: 1748971 - protein, 20 aa, Staphylococcus epidermidis
SKSKYLTYSFSRTAFNELNV

SEQ ID NO: 1748972 - protein, 26 aa, Staphylococcus epidermidis
SKVFDYILVFFLFGIAVTMIAGSGST

SEQ ID NO: 1748973 - protein, 23 aa, Staphylococcus epidermidis
SLDQINNFRPDFSKKRNAVAEIV

SEQ ID NO: 1748974 - protein, 38 aa, Staphylococcus epidermidis
SLFASTIFPVFMVMIIGLISFYAIYIWVEHRTIHQHTY

SEQ ID NO: 1748975 - protein, 18 aa, Staphylococcus epidermidis
SLLFFPNGPILIKLLFAV

SEQ ID NO: 1748976 - protein, 23 aa, Staphylococcus epidermidis
SLLMLWIGFLIYQFGFHEGRLSW

SEQ ID NO: 1748977 - protein, 25 aa, Staphylococcus epidermidis
SLNSIPIFIILLYATFRGILSAVET

SEQ ID NO: 1748978 - protein, 25 aa, Staphylococcus epidermidis
SNCGALLFFMILGQVNYFYGIIMAS

SEQ ID NO: 1748979 - protein, 25 aa, Staphylococcus epidermidis
SNNKMILFIFRCFVVLLVFVGAVAK

SEQ ID NO: 1748980 - protein, 33 aa, Staphylococcus epidermidis
SRLYYIILTIVIIAICVVVVILFNTLKTNRSHS

SEQ ID NO: 1748981 - protein, 22 aa, Staphylococcus epidermidis
SSDIFVWFKLVLNDTSEFHNIK

SEQ ID NO: 1748982 - protein, 25 aa, Staphylococcus epidermidis
SSFIITALLCLLTYSLNSIPIFIIL

SEQ ID NO: 1748983 - protein, 24 aa, Staphylococcus epidermidis
SSGVLFFTLLPKLFLNFPKQYRNV

SEQ ID NO: 1748984 - protein, 28 aa, Staphylococcus epidermidis
SSITIMFIMLFLVGWFQGMGWPPSGRVL

SEQ ID NO: 1748985 - protein, 18 aa, Staphylococcus epidermidis
STVNPFSVNFDRQNHTLT

SEQ ID NO: 1748986 - protein, 29 aa, Staphylococcus epidermidis
SVLALLHDVFIIIAIFSLFRLEVDLTFIA

SEQ ID NO: 1748987 - protein, 44 aa, Staphylococcus epidermidis
SVYDPLSYVKNVTGTVLGIYPSYLPYNQERWQGANAMNAYQIEE

SEQ ID NO: 1748988 - protein, 32 aa, Staphylococcus epidermidis
SYKPVWIIISFIILITILLLPTPAGLPVMAKA

SEQ ID NO: 1748989 - protein, 26 aa, Staphylococcus epidermidis
TAIFNYWWMFAISFIFFIIAGLLTIF

SEQ ID NO: 1748990 - protein, 30 aa, Staphylococcus epidermidis
TAIIMIVTAPFIPLFYVIFGLKTRDESKDQ

SEQ ID NO: 1748991 - protein, 23 aa, Staphylococcus epidermidis
TATLFLCLSLLFILFNKRYALID

SEQ ID NO: 1748992 - protein, 25 aa, Staphylococcus epidermidis
TEIIQMGCILLFTNNLHHAITLVSF

SEQ ID NO: 1748993 - protein, 23 aa, Staphylococcus epidermidis
TERQPFFSFLGDSVLAAGKLVLI

SEQ ID NO: 1748994 - protein, 23 aa, Staphylococcus epidermidis
TFIFSLVWILFNLYTVYLLIKYT

SEQ ID NO: 1748995 - protein, 17 aa, Staphylococcus epidermidis
TFMILNAILSFKLKKSY

SEQ ID NO: 1748996 - protein, 33 aa, Staphylococcus epidermidis; identical to SEQ ID NO: 1594022

SEQ ID NO: 1748997 - protein, 24 aa, Staphylococcus epidermidis
TGSFMLFTLLLFGFDFLSAAGNAK

SEQ ID NO: 1748998 - protein, 24 aa, Staphylococcus epidermidis
THAGWLHYLIGMLIAFVVSVVVTL

SEQ ID NO: 1748999 - protein, 31 aa, Staphylococcus epidermidis
TIKLYKHFYYKLFALLLLATIIFAFLPFVDQ

SEQ ID NO: 1749000 - protein, 18 aa, Staphylococcus epidermidis
TIKSLPEAGNADKSLPLA

SEQ ID NO: 1749001 - protein, 26 aa, Staphylococcus epidermidis
TIVCILFMIIVPWFKFKHLRYFLDDK

SEQ ID NO: 1749002 - protein, 27 aa, Staphylococcus epidermidis
TLINVLPIVIVPLVTERKRIKEHPDVQ

SEQ ID NO: 1749003 - protein, 22 aa, Staphylococcus epidermidis
TLLLLLFIIIIYIATTLTYYLR

SEQ ID NO: 1749004 - protein, 18 aa, Staphylococcus epidermidis
TLPYLKKAVIFSITFGFF

SEQ ID NO: 1749005 - protein, 24 aa, Staphylococcus epidermidis
TLVVPFMFMWLTKSKRNKAIGRAS

SEQ ID NO: 1749006 - protein, 20 aa, Staphylococcus epidermidis
TLWKNLANQSPEFGRPEKFC

SEQ ID NO: 1749007 - protein, 33 aa, Staphylococcus epidermidis
TNGTDVYNYIIFENNNRLGGTASWKDNRQPDKN

SEQ ID NO: 1749008 - protein, 30 aa, Staphylococcus epidermidis
TPLDMMIISLYIITAIVLSAFFYVMTIQKT

SEQ ID NO: 1749009 - protein, 25 aa, Staphylococcus epidermidis
TQIDDLLHELQTTLINRVSASREIN

SEQ ID NO: 1749010 - protein, 26 aa, Staphylococcus epidermidis
TRLPKLTFIFIFISGIAFFITYKFYY

SEQ ID NO: 1749011 - protein, 23 aa, Staphylococcus epidermidis
TSKRFIQWLNLNNIVPGYYGVNS

SEQ ID NO: 1749012 - protein, 27 aa, Staphylococcus epidermidis
TSLLRYYFWMTIVIIMLLVGVIAWLFD

SEQ ID NO: 1749013 - protein, 36 aa, Staphylococcus epidermidis
TTIMTLIFAIIIYYIILYLLFLIAEIVLLPSGFLGQ

SEQ ID NO: 1749014 - protein, 26 aa, Staphylococcus epidermidis
TTLFGLLYLLLLVTSAYVLIRMFKNQ

SEQ ID NO: 1749015 - protein, 29 aa, Staphylococcus epidermidis
TTPEKAIMGGAWFVRYHYFKNNQLSLYQM

SEQ ID NO: 1749016 - protein, 30 aa, Staphylococcus epidermidis
TTSDQWQSLAYTRTPFVKTGTYDVVNPSNW

SEQ ID NO: 1749017 - protein, 24 aa, Staphylococcus epidermidis
TTYLHIMWIYIVRSFGMAFVMMPI

SEQ ID NO: 1749018 - protein, 25 aa, Staphylococcus epidermidis
TVHLTIFLIIRLIQGLAGGGAIVIA

SEQ ID NO: 1749019 - protein, 26 aa, Staphylococcus epidermidis
TVIGLILLSLTFLPNAWYIASSVIGY

SEQ ID NO: 1749020 - protein, 23 aa, Staphylococcus epidermidis
TVIVFFCVFLIFSPIGKLKLGKP

SEQ ID NO: 1749021 - protein, 17 aa, Staphylococcus epidermidis
TYDNGTFDILPDNSRNS

SEQ ID NO: 1749022 - protein, 25 aa, Staphylococcus epidermidis
VAGWNLLLFIVFRSISGIVLAGLVS

SEQ ID NO: 1749023 - protein, 17 aa, Staphylococcus epidermidis
VDKIKRANGLSSNNIHN

SEQ ID NO: 1749024 - protein, 17 aa, Staphylococcus epidermidis
VDKQPLINAKTALQQSL

SEQ ID NO: 1749025 - protein, 17 aa, Staphylococcus epidermidis
VENIIIAFILTRWAWFC

SEQ ID NO: 1749026 - protein, 26 aa, Staphylococcus epidermidis
VFRVILIPFFILFALVDFGFGQISIL

SEQ ID NO: 1749027 - protein, 25 aa, Staphylococcus epidermidis
VGIDYSLFILFRFKELKKKGVDTVE

SEQ ID NO: 1749028 - protein, 26 aa, Staphylococcus epidermidis
VGIIVAFVILLITFGSLIAAGMPIIS

SEQ ID NO: 1749029 - protein, 23 aa, Staphylococcus epidermidis
VGWRFTFLFIIIVSVFVGVLMLI

SEQ ID NO: 1749030 - protein, 27 aa, Staphylococcus epidermidis
VICLWFLFCVFIFQYIKLLFSRPRFKA

SEQ ID NO: 1749031 - protein, 31 aa, Staphylococcus epidermidis
VILKASIESPILFVSIAVFSSLVFNSIIYTS

SEQ ID NO: 1749032 - protein, 27 aa, Staphylococcus epidermidis
VIMAVAIFIALAFNIQKAYWVPLSAHT

SEQ ID NO: 1749033 - protein, 19 aa, Staphylococcus epidermidis
VIMLIAMVMVPIVALLKLN

SEQ ID NO: 1749034 - protein, 17 aa, Staphylococcus epidermidis
VITLPISAVLAAIIYFI

SEQ ID NO: 1749035 - protein, 19 aa, Staphylococcus epidermidis
VKSSLSMTKILGTRNYVNE

SEQ ID NO: 1749036 - protein, 20 aa, Staphylococcus epidermidis
VLFAWSPFIILTVIVMIWSA

SEQ ID NO: 1749037 - protein, 17 aa, Staphylococcus epidermidis
VLLLGYQLDILNLGDHV

SEQ ID NO: 1749038 - protein, 30 aa, Staphylococcus epidermidis
VLLNVLSWQLILFSLVMIVLVRPISVLLST

SEQ ID NO: 1749039 - protein, 18 aa, Staphylococcus epidermidis
VLNAILIIVGYKYLSKRS

SEQ ID NO: 1749040 - protein, 39 aa, Staphylococcus epidermidis
VLSDNFIILYLFWELTSFSSFLLISFWREKKASIYGAQK

SEQ ID NO: 1749041 - protein, 26 aa, Staphylococcus epidermidis
VLSFFIFIFILLFFSKDTRVAIFISP

SEQ ID NO: 1749042 - protein, 30 aa, Staphylococcus epidermidis; identical to SEQ ID NO: 1588964

SEQ ID NO: 1749043 - protein, 17 aa, Staphylococcus epidermidis
VMNIFKNKMARLAQQKN

SEQ ID NO: 1749044 - protein, 17 aa, Staphylococcus epidermidis
VNDILKDIPVRRIKDKG

SEQ ID NO: 1749045 - protein, 27 aa, Staphylococcus epidermidis
VQFFNWFALMYLWTYSTGAIAKNVWNV

SEQ ID NO: 1749046 - protein, 26 aa, Staphylococcus epidermidis
VQSKKEEVYRRLLASNLTSVPERFII

SEQ ID NO: 1749047 - protein, 23 aa, Staphylococcus epidermidis
VRSYLIILSIFAILMFFLGDKNE

SEQ ID NO: 1749048 - protein, 17 aa, Staphylococcus epidermidis
VSFIIMFVGIQVIIENF

SEQ ID NO: 1749049 - protein, 31 aa, Staphylococcus epidermidis
VSMSPIFIVMIIYTIVYFIFAMISFIHSSRM

SEQ ID NO: 1749050 - protein, 23 aa, Staphylococcus epidermidis
VTEPHLKLFNQMSFFHDVKQWLK

SEQ ID NO: 1749051 - protein, 22 aa, Staphylococcus epidermidis
VTLILFIFVANMLGLPFAIVTH

SEQ ID NO: 1749052 - protein, 23 aa, Staphylococcus epidermidis
VTQALNKIKAIQPKLTEAINMLQ

SEQ ID NO: 1749053 - protein, 27 aa, Staphylococcus epidermidis
VVDSLNGFTMVNGGKVGLLNSVLERTS

SEQ ID NO: 1749054 - protein, 18 aa, Staphylococcus epidermidis
VVLGVLAPLITFYEPNHI

SEQ ID NO: 1749055 - protein, 22 aa, Staphylococcus epidermidis
VVMGLIAMILLVVGISLTSLKA

SEQ ID NO: 1749056 - protein, 20 aa, Staphylococcus epidermidis
VVTYYLIKWLFDVTMKYLKW

SEQ ID NO: 1749057 - protein, 30 aa, Staphylococcus epidermidis
VVVYPAFIFLVLSFVLLMLSFNGWVLLIAG

SEQ ID NO: 1749058 - protein, 22 aa, Staphylococcus epidermidis
VYMMILVTFFIVVSGCSINQSF

SEQ ID NO: 1749059 - protein, 17 aa, Staphylococcus epidermidis
WDNKLKLESFIRPNSRF

SEQ ID NO: 1749060 - protein, 17 aa, Staphylococcus epidermidis
WELFVNHLLMSVYGVLL

SEQ ID NO: 1749061 - protein, 26 aa, Staphylococcus epidermidis
WITNNLGWYYLILTTVIVFFCVFLIF

SEQ ID NO: 1749062 - protein, 28 aa, Staphylococcus epidermidis
WNRHPYLWWFMFAVYISNALFTLVNLYL

SEQ ID NO: 1749063 - protein, 17 aa, Staphylococcus epidermidis
WQISVVQFFNWFALMYL

SEQ ID NO: 1749064 - protein, 25 aa, Staphylococcus epidermidis
WRLIVISVLLLFFWSTEKVLHPIDS

SEQ ID NO: 1749065 - protein, 25 aa, Staphylococcus epidermidis
WSIIMSIALYFIMIKFMPPEHDAIE

SEQ ID NO: 1749066 - protein, 37 aa, Staphylococcus epidermidis
YDWNVMFYGMFFIGIIAIVIGLFWFKLYQSTTNPKAD

SEQ ID NO: 1749067 - protein, 33 aa, Staphylococcus epidermidis
YFYLMLFLLTTLIGAFLLYLPYTGKKPINFIDA

SEQ ID NO: 1749068 - protein, 21 aa, Staphylococcus epidermidis
YIIGILLLISFSYWVRLLQAH

SEQ ID NO: 1749069 - protein, 24 aa, Staphylococcus epidermidis
YIIGTIMYLIKFYGYQVIQDNHQL

SEQ ID NO: 1749070 - protein, 18 aa, Staphylococcus epidermidis
YILIGIMLYFLMSSIGEL

SEQ ID NO: 1749071 - protein, 41 aa, Staphylococcus epidermidis
YKKVKHICVVIFLVVFLIGFIILLSLVLYFQQLTKDASSIS

SEQ ID NO: 1749072 - protein, 28 aa, Staphylococcus epidermidis
YLDISTPYALLFFDLIVVLISLTEIPLV

SEQ ID NO: 1749073 - protein, 19 aa, Staphylococcus epidermidis
YLMITFLVLVANSVTFVFI

SEQ ID NO: 1749074 - protein, 25 aa, Staphylococcus epidermidis
YLTIYLLVALMYWVVCFVISIIQGW

SEQ ID NO: 1749075 - protein, 17 aa, Staphylococcus epidermidis
YLYTFPLTVIIGLVIIF

SEQ ID NO: 1749076 - protein, 17 aa, Staphylococcus epidermidis
YPHFLWFDLTQPDLIMT

SEQ ID NO: 1749077 - protein, 23 aa, Staphylococcus epidermidis
YQKWLISFILICNIFGTIYGYHW

SEQ ID NO: 1749078 - protein, 19 aa, Staphylococcus epidermidis
YRKYFPFFTLITAFASLAW

SEQ ID NO: 1749079 - protein, 23 aa, Staphylococcus epidermidis
YSRIMYVIIIIAVIYFVIRYLMK

SEQ ID NO: 1749080 - protein, 21 aa, Staphylococcus epidermidis
YSYRKLFIIGLALFTLGSLVC

SEQ ID NO: 1749081 - protein, 23 aa, Staphylococcus epidermidis
YTGLFILIGLFAVNWKVGISAMI

SEQ ID NO: 1749082 - protein, 24 aa, Staphylococcus epidermidis
YVPDKWILGLLGLIPIYLGIKVAI

SEQ ID NO: 1749083 - protein, 18 aa, Staphylococcus epidermidis
YWVNLLESFIILPIVLPP

SEQ ID NO: 1749084 - protein, 27 aa, Staphylococcus epidermidis
YYSLNWAFLLELFFKHLLMSVYGVLFA

SEQ ID NO: 1749085 - protein, 17 aa, Staphylococcus epidermidis
AFEIPLRYKIMGIVGSV

SEQ ID NO: 1749086 - protein, 20 aa, Staphylococcus epidermidis
AFSPLVLYSLYWKDLTRAGA

SEQ ID NO: 1749087 - protein, 27 aa, Staphylococcus epidermidis
AGIPIAACGLLAPWIAGAAMALSSVSV

SEQ ID NO: 1749088 - protein, 26 aa, Staphylococcus epidermidis
AGISPFLMLQYSIYPILLGVCGLVAI

SEQ ID NO: 1749089 - protein, 31 aa, Staphylococcus epidermidis
AGVIPVIFAMAFFLLPRTLTLFFPKAEWAQN

SEQ ID NO: 1749090 - protein, 24 aa, Staphylococcus epidermidis
AIAGILTLWYYWIKRRKNIKKMVD

SEQ ID NO: 1749091 - protein, 34 aa, Staphylococcus epidermidis
AIFSLLGQHAFVLGLIVLLFIPLTVVLNVQEGVI

SEQ ID NO: 1749092 - protein, 25 aa, Staphylococcus epidermidis
AIILGILTYWLFAQSFLNIAPHVQR

SEQ ID NO: 1749093 - protein, 19 aa, Staphylococcus epidermidis
AIQAAKDLITAHPTIMDKN

SEQ ID NO: 1749094 - protein, 19 aa, Staphylococcus epidermidis
AKDLITAHPTIMDKNQIDQ

SEQ ID NO: 1749095 - protein, 20 aa, Staphylococcus epidermidis
ALNEITIQLDTQRDLIKNNK

SEQ ID NO: 1749096 - protein, 31 aa, Staphylococcus epidermidis
ALVITLSMLLTLWIVPWLSAMKARKLKQQVT

SEQ ID NO: 1749097 - protein, 25 aa, Staphylococcus epidermidis
ANEGYFFTVYVPYGNDWFAYFMRRL

SEQ ID NO: 1749098 - protein, 32 aa, Staphylococcus epidermidis
ANFYYIFFEKIGFLLVLLLGCVLVYVGYVYFH

SEQ ID NO: 1749099 - protein, 30 aa, Staphylococcus epidermidis
ANWQTYVMIIVYFIILLIIGFYGYRQATGN

SEQ ID NO: 1749100 - protein, 19 aa, Staphylococcus epidermidis
AQATLNALNYLNQAQRGNL

SEQ ID NO: 1749101 - protein, 24 aa, Staphylococcus epidermidis
ARSQLTLNREPYINHINNESHLNN

SEQ ID NO: 1749102 - protein, 24 aa, Staphylococcus epidermidis
AVIIFFMVIVFGFSLFLAGHYTPG

SEQ ID NO: 1749103 - protein, 20 aa, Staphylococcus epidermidis
AWSFILAWLSLLIAVILLYI

SEQ ID NO: 1749104 - protein, 29 aa, Staphylococcus epidermidis
CFKLYQHYYYKLFAIATWILLIGSFSQWF

SEQ ID NO: 1749105 - protein, 21 aa, Staphylococcus epidermidis
DAIKTIDVLVKQKIKDIDSNN

SEQ ID NO: 1749106 - protein, 28 aa, Staphylococcus epidermidis
DASYELPILYVTVWLDDQGNIIKDAVED

SEQ ID NO: 1749107 - protein, 23 aa, Staphylococcus epidermidis
DDQFETIIYRLFTGRSTRNSLGM

SEQ ID NO: 1749108 - protein, 23 aa, Staphylococcus epidermidis
DEAKRLLEISKNKTITNINQAQT

SEQ ID NO: 1749109 - protein, 27 aa, Staphylococcus epidermidis
DFEEIDQFDPKRFTLNKAKKDIITDVN

SEQ ID NO: 1749110 - protein, 18 aa, Staphylococcus epidermidis
DIIMYRHNNKTYFSRIIG

SEQ ID NO: 1749111 - protein, 36 aa, Staphylococcus epidermidis
DKSQQVHPPLDKNALQAFFDASYHNYRMIDRDRADA

SEQ ID NO: 1749112 - protein, 18 aa, Staphylococcus epidermidis
DLIVVILLAPAVTFGLAN

SEQ ID NO: 1749113 - protein, 20 aa, Staphylococcus epidermidis
DMHNVEGMAFAIPINDVRKI

SEQ ID NO: 1749114 - protein, 27 aa, Staphylococcus epidermidis
DPFVHYLRFPIGVWLLYIGVFFTILSG

SEQ ID NO: 1749115 - protein, 20 aa, Staphylococcus epidermidis
DRDGRLIGIVSLKIDMHNVE

SEQ ID NO: 1749116 - protein, 19 aa, Staphylococcus epidermidis
DTFWVYILPSLYSVYNILI

SEQ ID NO: 1749117 - protein, 23 aa, Staphylococcus epidermidis
DTRLFKISWIILALLLIGYLVSE

SEQ ID NO: 1749118 - protein, 24 aa, Staphylococcus epidermidis
DTVGFKWMYILCALLVTIAMTLSK

SEQ ID NO: 1749119 - protein, 22 aa, Staphylococcus epidermidis
DYNLKRQFNKALKEAKGVLNKN

SEQ ID NO: 1749120 - protein, 27 aa, Staphylococcus epidermidis
EDTKDALNGIQRLSKAKAKAIQYVQSL

SEQ ID NO: 1749121 - protein, 25 aa, Staphylococcus epidermidis
EEKASAIDKLIKTAARIAEAIDKAQ

SEQ ID NO: 1749122 - protein, 22 aa, Staphylococcus epidermidis
EGFYIQNTMFPLQATELHIDHT

SEQ ID NO: 1749123 - protein, 36 aa, Staphylococcus epidermidis
EHKVLYLMILPCLLFFLIFNYIPMTSLVLAFKDFRF

SEQ ID NO: 1749124 - protein, 17 aa, Staphylococcus epidermidis
ELILLLKEIGCTIKEIK

SEQ ID NO: 1749125 - protein, 19 aa, Staphylococcus epidermidis
ENHFECLWDLFRSIPSLEQ

SEQ ID NO: 1749126 - protein, 21 aa, Staphylococcus epidermidis
ENNAPQVGAGTPGAENTPQAG

SEQ ID NO: 1749127 - protein, 22 aa, Staphylococcus epidermidis
EPLKFQGGLTKRSYFNKNGHVS

SEQ ID NO: 1749128 - protein, 33 aa, Staphylococcus epidermidis
ERSVKWMFVALILIIVLFIFIKYKSLLTRTSMM

SEQ ID NO: 1749129 - protein, 19 aa, Staphylococcus epidermidis
ESIIGAMTLTDELKVNIVS

SEQ ID NO: 1749130 - protein, 35 aa, Staphylococcus epidermidis
ETFSEFRIFLAVLITLLLIISISLVIASTYSIIKP

SEQ ID NO: 1749131 - protein, 19 aa, Staphylococcus epidermidis
EVEMTERPIKIYNSLGVKD

SEQ ID NO: 1749132 - protein, 24 aa, Staphylococcus epidermidis
FAGLQIFLMIWVTKVIINMKFNFR

SEQ ID NO: 1749133 - protein, 24 aa, Staphylococcus epidermidis
FEREDLGLLVDFLAELFKVEGHKL

SEQ ID NO: 1749134 - protein, 25 aa, Staphylococcus epidermidis
FETPEGYTPTLKHSGTNPALDSEGN

SEQ ID NO: 1749135 - protein, 20 aa, Staphylococcus epidermidis
FFDNYLIVVIFLSIQALLTI

SEQ ID NO: 1749136 - protein, 24 aa, Staphylococcus epidermidis
FGEFEFWFALIKVVTIVLMIIAGL

SEQ ID NO: 1749137 - protein, 17 aa, Staphylococcus epidermidis
FIIGLALFTLGSLVCAI

SEQ ID NO: 1749138 - protein, 20 aa, Staphylococcus epidermidis
FILIHFFQHSFLLNTYINML

SEQ ID NO: 1749139 - protein, 36 aa, Staphylococcus epidermidis
FIVNIIIMIVLLTIMILGVIWLFKDKGQNQHSVLRN

SEQ ID NO: 1749140 - protein, 20 aa, Staphylococcus epidermidis
FKVSLISFMILFIGLELVDS

SEQ ID NO: 1749141 - protein, 26 aa, Staphylococcus epidermidis
FLILVLVIFTLFTYKAPSGMRAMGAL

SEQ ID NO: 1749142 - protein, 18 aa, Staphylococcus epidermidis
FLKPNILDQYYGAGNLYM

SEQ ID NO: 1749143 - protein, 19 aa, Staphylococcus epidermidis
FNELFQFVFNEYYNIDFTS

SEQ ID NO: 1749144 - protein, 17 aa, Staphylococcus epidermidis
FNEPILDKLLKNTKETL

SEQ ID NO: 1749145 - protein, 24 aa, Staphylococcus epidermidis
FPSLPNWIPGVIAVLFLMAANLVS

SEQ ID NO: 1749146 - protein, 25 aa, Staphylococcus epidermidis
FSLLASILILWFYFRKSIPKTFDIS

SEQ ID NO: 1749147 - protein, 24 aa, Staphylococcus epidermidis
FSLPQRRWVYFLALSTSVLIALFI

SEQ ID NO: 1749148 - protein, 24 aa, Staphylococcus epidermidis
FSVVVVFLIFLIISKIFKSDAKAS

SEQ ID NO: 1749149 - protein, 26 aa, Staphylococcus epidermidis
FVTNIWIMIILRFIQGLTGGAGAVIS

SEQ ID NO: 1749150 - protein, 17 aa, Staphylococcus epidermidis
FYALIFGLDASSIDLGS

SEQ ID NO: 1749151 - protein, 23 aa, Staphylococcus epidermidis
GAIFTSIIWLLGSFAFGYYISNF

SEQ ID NO: 1749152 - protein, 24 aa, Staphylococcus epidermidis
GETGRQIGWFISYDKDNPNMMMAI

SEQ ID NO: 1749153 - protein, 19 aa, Staphylococcus epidermidis
GGDLLLVPKAIKASKATIK

SEQ ID NO: 1749154 - protein, 21 aa, Staphylococcus epidermidis
GIGTIRDIQPLVVKKPTAKSK

SEQ ID NO: 1749155 - protein, 19 aa, Staphylococcus epidermidis
GIIILLTLIIGLKLNTFIS

SEQ ID NO: 1749156 - protein, 20 aa, Staphylococcus epidermidis
GILCYIFWGIYLKEGMYQYN

SEQ ID NO: 1749157 - protein, 24 aa, Staphylococcus epidermidis
GKDVDIDLGFSQWGLKQQPNESYI

SEQ ID NO: 1749158 - protein, 24 aa, Staphylococcus epidermidis
GKINRLWLVLLFAGGGLSLILLSL

SEQ ID NO: 1749159 - protein, 22 aa, Staphylococcus epidermidis
GKVNKLLKRNPTVEQVKESVAN

SEQ ID NO: 1749160 - protein, 17 aa, Staphylococcus epidermidis
GLCALFILLISTSRVYL

SEQ ID NO: 1749161 - protein, 17 aa, Staphylococcus epidermidis
GLLYFIRFLFGVGEAPM

SEQ ID NO: 1749162 - protein, 20 aa, Staphylococcus epidermidis
GLPLLIALLHALFAALAFMK

SEQ ID NO: 1749163 - protein, 25 aa, Staphylococcus epidermidis
GPIFRPIMRPLFTLPGRSTVDNLAS

SEQ ID NO: 1749164 - protein, 23 aa, Staphylococcus epidermidis
GQGEILINPVQILSIYSALENNG

SEQ ID NO: 1749165 - protein, 24 aa, Staphylococcus epidermidis
GRELGQFYLGIMDNIMRIEEADGI

SEQ ID NO: 1749166 - protein, 25 aa, Staphylococcus epidermidis
GSIALLSLLLFIASGIYLIAKYSTG

SEQ ID NO: 1749167 - protein, 19 aa, Staphylococcus epidermidis
GSIWLILSIIPISIILGIG

SEQ ID NO: 1749168 - protein, 17 aa, Staphylococcus epidermidis
GVKRFVFSIKDLAPFIA

SEQ ID NO: 1749169 - protein, 18 aa, Staphylococcus epidermidis
GVVLNFVLVFTTLKIFGY

SEQ ID NO: 1749170 - protein, 18 aa, Staphylococcus epidermidis
HFGIFSIPITVIWIVAIT

SEQ ID NO: 1749171 - protein, 26 aa, Staphylococcus epidermidis
HHELFFFAVLFFIVGWLTIRNAVKKL

SEQ ID NO: 1749172 - protein, 28 aa, Staphylococcus epidermidis
HIQNIIFFIIFPYLIIKLDINYFVLLSM

SEQ ID NO: 1749173 - protein, 25 aa, Staphylococcus epidermidis
HKNIMLWAAFFALTFFIIYAARTIF

SEQ ID NO: 1749174 - protein, 20 aa, Staphylococcus epidermidis
HQLRRSLFASTIFPVFMVMI

SEQ ID NO: 1749175 - protein, 29 aa, Staphylococcus epidermidis
HTGSFYVAAFFRFVLVMIGVLSSSVVNLI

SEQ ID NO: 1749176 - protein, 23 aa, Staphylococcus epidermidis
HTNRFYFILSFVLMVTVPNTIYS

SEQ ID NO: 1749177 - protein, 33 aa, Staphylococcus epidermidis
IARGQNYTIGPNLRKYFSLSNGSDLPNRDFTSI

SEQ ID NO: 1749178 - protein, 17 aa, Staphylococcus epidermidis
IEKGKVNKLLKRNPTVE

SEQ ID NO: 1749179 - protein, 31 aa, Staphylococcus epidermidis
IGLITIMIIVCIVLVIMMFVGGKKESYYGIM

SEQ ID NO: 1749180 - protein, 25 aa, Staphylococcus epidermidis
IGPMIHYFHWLGIGITYLVFLIGII

SEQ ID NO: 1749181 - protein, 21 aa, Staphylococcus epidermidis
IGVWFMSYFIFVKPMKKLQQV

SEQ ID NO: 1749182 - protein, 17 aa, Staphylococcus epidermidis
IIALFCFKLYQHYYYKL

SEQ ID NO: 1749183 - protein, 24 aa, Staphylococcus epidermidis
IIFGIILFLVVIVGAIFGLTRLVV

SEQ ID NO: 1749184 - protein, 20 aa, Staphylococcus epidermidis
IIILLILLIVSIVAAILIGK

SEQ ID NO: 1749185 - protein, 18 aa, Staphylococcus epidermidis
IIVTIICTILSAILNMLS

SEQ ID NO: 1749186 - protein, 34 aa, Staphylococcus epidermidis
IIVTPTITLLLIGLLTIFIIMPLAGFVSDGLVYV

SEQ ID NO: 1749187 - protein, 18 aa, Staphylococcus epidermidis
IIYFILIHFFQHSFLLNT

SEQ ID NO: 1749188 - protein, 20 aa, Staphylococcus epidermidis
IKFHIYLLVLPIITGLSGLI

SEQ ID NO: 1749189 - protein, 23 aa, Staphylococcus epidermidis
IKIKYYFFVLVISKLISITILGV

SEQ ID NO: 1749190 - protein, 31 aa, Staphylococcus epidermidis
ILFIHKPLRILTWLMAIIVYLTIYTGALVRH

SEQ ID NO: 1749191 - protein, 17 aa, Staphylococcus epidermidis
ILLITLSLIGHSYIIFR

SEQ ID NO: 1749192 - protein, 19 aa, Staphylococcus epidermidis
ILSFLYYLVILAIFISVTS

SEQ ID NO: 1749193 - protein, 29 aa, Staphylococcus epidermidis
ILTFISNAFIPLLWLLDVPTQLAPGILFS

SEQ ID NO: 1749194 - protein, 19 aa, Staphylococcus epidermidis
ILYGPFLYQFITKGIVFSG

SEQ ID NO: 1749195 - protein, 25 aa, Staphylococcus epidermidis
INEREFNMNLPFINKFILKMERDEA

SEQ ID NO: 1749196 - protein, 24 aa, Staphylococcus epidermidis
IPASIIGLAIWFIVGLQYKGDANT

SEQ ID NO: 1749197 - protein, 27 aa, Staphylococcus epidermidis
IQNMDDARALLNGIERLKDAQTKAHND

SEQ ID NO: 1749198 - protein, 25 aa, Staphylococcus epidermidis
IQNSPFFILVMILFMIGAFTKSAQV

SEQ ID NO: 1749199 - protein, 18 aa, Staphylococcus epidermidis
IQRSHGINYLVITEPIRS

SEQ ID NO: 1749200 - protein, 18 aa, Staphylococcus epidermidis
IQVIGFLSFLAILTIITL

SEQ ID NO: 1749201 - protein, 25 aa, Staphylococcus epidermidis
IRATWMLYLIGIYPLLIFLAELLNS

SEQ ID NO: 1749202 - protein, 19 aa, Staphylococcus epidermidis
ISIFDVMRMFFIGGVLSLI

SEQ ID NO: 1749203 - protein, 18 aa, Staphylococcus epidermidis
ISLESIIGAMTLTDELKV

SEQ ID NO: 1749204 - protein, 19 aa, Staphylococcus epidermidis
ISLKKQLPYIPKQRLYTLT

SEQ ID NO: 1749205 - protein, 21 aa, Staphylococcus epidermidis
ISMTFLYSFLTTGTPYWFVIL

SEQ ID NO: 1749206 - protein, 18 aa, Staphylococcus epidermidis
ISVAYIYSLYAFYMNNFS

SEQ ID NO: 1749207 - protein, 25 aa, Staphylococcus epidermidis
ITGIIGLFLSFIAGALWLIAGIMLL

SEQ ID NO: 1749208 - protein, 24 aa, Staphylococcus epidermidis
ITIYLFIFIYYFFITSRKLSPLIV

SEQ ID NO: 1749209 - protein, 23 aa, Staphylococcus epidermidis
ITLITFVILIFILVFTAQKLANI

SEQ ID NO: 1749210 - protein, 25 aa, Staphylococcus epidermidis
ITTTTYLFLFLFGVIVVLILEHSNA

SEQ ID NO: 1749211 - protein, 21 aa, Staphylococcus epidermidis
IVAIVIVTLVQKFLFASYTVK

SEQ ID NO: 1749212 - protein, 33 aa, Staphylococcus epidermidis; identical to SEQ ID NO: 1590493

SEQ ID NO: 1749213 - protein, 19 aa, Staphylococcus epidermidis
IVTFLIARFIKIFTPLATT

SEQ ID NO: 1749214 - protein, 20 aa, Staphylococcus epidermidis
IYFNIILFCLCMINLFFLTH

SEQ ID NO: 1749215 - protein, 27 aa, Staphylococcus epidermidis
KALLQGIEQILKVNVSIINQSFNDSLH

SEQ ID NO: 1749216 - protein, 27 aa, Staphylococcus epidermidis
KDKTIEAIHKIKPISTIKPQALNEITI

SEQ ID NO: 1749217 - protein, 18 aa, Staphylococcus epidermidis
KFMVPILAGYIAVSIADK

SEQ ID NO: 1749218 - protein, 31 aa, Staphylococcus epidermidis
KFSIRKYAIGTFSTVIATLVFMGINTNHASA

SEQ ID NO: 1749219 - protein, 39 aa, Staphylococcus epidermidis
KGIRQGFLMILPALIGYLLGFPMFGILISTGTLAHVYVF

SEQ ID NO: 1749220 - protein, 21 aa, Staphylococcus epidermidis
KGQFKQFRHGLSSFIEALVKD

SEQ ID NO: 1749221 - protein, 27 aa, Staphylococcus epidermidis
KGVRKKLWLSIALIGSLQYGGLITSIV

SEQ ID NO: 1749222 - protein, 23 aa, Staphylococcus epidermidis
KIGSYIFMFLIGTVAIAAIVGIF

SEQ ID NO: 1749223 - protein, 19 aa, Staphylococcus epidermidis
KINFLVIFIATLVIGVLGL

SEQ ID NO: 1749224 - protein, 24 aa, Staphylococcus epidermidis
KIPYKVFVIFFILVSFILANQGLN

SEQ ID NO: 1749225 - protein, 27 aa, Staphylococcus epidermidis
KKKKNVILMFWIISLVSLLMMVVISQP

SEQ ID NO: 1749226 - protein, 30 aa, Staphylococcus epidermidis
KKQSIDEISKILPVIEIKSAARNEIHQKAE

SEQ ID NO: 1749227 - protein, 32 aa, Staphylococcus epidermidis
KLNQVWPILLFLPFIVFIFIRIHVHYENIACE

SEQ ID NO: 1749228 - protein, 23 aa, Staphylococcus epidermidis
KLWLRNFMQAFFVVFFVYMAMYL

SEQ ID NO: 1749229 - protein, 17 aa, Staphylococcus epidermidis
KMKPYLITLLYLAIFIA

SEQ ID NO: 1749230 - protein, 20 aa, Staphylococcus epidermidis
KMVLFLILGTIFLDAYDITI

SEQ ID NO: 1749231 - protein, 71 aa, Staphylococcus epidermidis
KNIAGVQNLIALVNYPGISTPLEVPVKVWVYNFDFTQPIYKIQVGDTFPKGTWAGYYKHLENGEGLPIDGW

SEQ ID NO: 1749232 - protein, 17 aa, Staphylococcus epidermidis
KQKLTVFVILGSVLIKL

SEQ ID NO: 1749233 - protein, 21 aa, Staphylococcus epidermidis
KREVLKKYWLQIFGGIAVGTI

SEQ ID NO: 1749234 - protein, 20 aa, Staphylococcus epidermidis
KVKIIIIIALLAMSIMSQNL

SEQ ID NO: 1749235 - protein, 24 aa, Staphylococcus epidermidis
KVTLFTHIILYAIISFVFTEINYL

SEQ ID NO: 1749236 - protein, 18 aa, Staphylococcus epidermidis
KVYYTIFLVFHIILATVG

SEQ ID NO: 1749237 - protein, 17 aa, Staphylococcus epidermidis
LAGLIFWYPKMMGYKLN

SEQ ID NO: 1749238 - protein, 17 aa, Staphylococcus epidermidis
LCLTVFKMKGIYAAITT

SEQ ID NO: 1749239 - protein, 25 aa, Staphylococcus epidermidis
LGAMFLLFGAFLYFIGTEGYVNMQL

SEQ ID NO: 1749240 - protein, 18 aa, Staphylococcus epidermidis
LHNRAMIQYGTYARLHIF

SEQ ID NO: 1749241 - protein, 34 aa, Staphylococcus epidermidis
LHSKYLVVSVYLAITMLLVWLSLISITYRSDKKK

SEQ ID NO: 1749242 - protein, 23 aa, Staphylococcus epidermidis
LILIVVVVGFGIYFYASKDKEIN

SEQ ID NO: 1749243 - protein, 50 aa, Staphylococcus epidermidis
LISFIFVMSPLYFRFTIYWPFFSDTFIWLPLLLLGIERLLRDFKAGLFIL

SEQ ID NO: 1749244 - protein, 18 aa, Staphylococcus epidermidis
LITFLFLLTMCLYDIHSM

SEQ ID NO: 1749245 - protein, 20 aa, Staphylococcus epidermidis
LKVLAIIDILALLVLHSKYC

SEQ ID NO: 1749246 - protein, 20 aa, Staphylococcus epidermidis
LLLILLLVVVFILLALLIMS

SEQ ID NO: 1749247 - protein, 23 aa, Staphylococcus epidermidis
LLSFFKFIFATALFIFVIFTLYR

SEQ ID NO: 1749248 - protein, 20 aa, Staphylococcus epidermidis
LMILLTIVLYYVSKKIQDKY

SEQ ID NO: 1749249 - protein, 29 aa, Staphylococcus epidermidis
LMNPLMIFMLWALLGWKVAIVYFIVLAIF

SEQ ID NO: 1749250 - protein, 19 aa, Staphylococcus epidermidis
LNITLAILGGLWFPVNTFP

SEQ ID NO: 1749251 - protein, 19 aa, Staphylococcus epidermidis
LQIAKKDAIKTIDVLVKQK

SEQ ID NO: 1749252 - protein, 17 aa, Staphylococcus epidermidis
LQLLKKAPKQFWQISVV

SEQ ID NO: 1749253 - protein, 20 aa, Staphylococcus epidermidis
LRSTFFHWGFHAWAIYGVVA

SEQ ID NO: 1749254 - protein, 25 aa, Staphylococcus epidermidis
LSRLVSCLLILFLGSAIFSLLGQHA

SEQ ID NO: 1749255 - protein, 26 aa, Staphylococcus epidermidis
LSSSVVNLIFLPPKFETKIYYNSMNI

SEQ ID NO: 1749256 - protein, 19 aa, Staphylococcus epidermidis
LTIVLFLALGIFSQWLASR

SEQ ID NO: 1749257 - protein, 34 aa, Staphylococcus epidermidis
LTTIYNLNFWVWIPLIIIVLCLIFRISTVPSMLI

SEQ ID NO: 1749258 - protein, 23 aa, Staphylococcus epidermidis
LVRWPKPNLLLKAAWKSIQMFIV

SEQ ID NO: 1749259 - protein, 17 aa, Staphylococcus epidermidis
LYLRAIVPVLPLTLYVV

SEQ ID NO: 1749260 - protein, 25 aa, Staphylococcus epidermidis
MGKYYAGIYIPKKFTHEITGTLRKH

SEQ ID NO: 1749261 - protein, 17 aa, Staphylococcus epidermidis
MIRLVNDLLQLSKMDNE

SEQ ID NO: 1749262 - protein, 20 aa, Staphylococcus epidermidis
MMIPVYLKHLIIAIPLTING

SEQ ID NO: 1749263 - protein, 17 aa, Staphylococcus epidermidis
MPLMQFTLFTLFSKEHR

SEQ ID NO: 1749264 - protein, 24 aa, Staphylococcus epidermidis
MRKIFPLDFKILIGIGLLFCVGTP

SEQ ID NO: 1749265 - protein, 28 aa, Staphylococcus epidermidis
MSGPLFIIVLLFIFFCLGFIVPSSSGLA

SEQ ID NO: 1749266 - protein, 19 aa, Staphylococcus epidermidis
MTPWKYRYVAGIIVLALVV

SEQ ID NO: 1749267 - protein, 34 aa, Staphylococcus epidermidis
MVSMGIFCFIISGLYMLFLIVKKLRKYVTSNMML

SEQ ID NO: 1749268 - protein, 17 aa, Staphylococcus epidermidis
NALNYLNQAQRGNLETK

SEQ ID NO: 1749269 - protein, 29 aa, Staphylococcus epidermidis
NEPIKDSEWSITGYPNTLTLQNAVGRTNN

SEQ ID NO: 1749270 - protein, 18 aa, Staphylococcus epidermidis
NFFFFIVVFTFIIGGIFA

SEQ ID NO: 1749271 - protein, 27 aa, Staphylococcus epidermidis
NFSVLEIILLCLIIYAGAAQFIICTLV

SEQ ID NO: 1749272 - protein, 20 aa, Staphylococcus epidermidis
NGHLILNEIMLLIVGLGIAF

SEQ ID NO: 1749273 - protein, 21 aa, Staphylococcus epidermidis
NIIIGMIQNMDDARALLNGIE

SEQ ID NO: 1749274 - protein, 20 aa, Staphylococcus epidermidis
NIKFDSLLLNIKKAKSLAFR

SEQ ID NO: 1749275 - protein, 30 aa, Staphylococcus epidermidis
NIKHYGMFLFSLLISIILYFSFSTLKYSHS

SEQ ID NO: 1749276 - protein, 18 aa, Staphylococcus epidermidis
NILIMRTFFNQLPSSVIE

SEQ ID NO: 1749277 - protein, 27 aa, Staphylococcus epidermidis
NITFIALFFPIVILAVPFIDTLFAMIR

SEQ ID NO: 1749278 - protein, 25 aa, Staphylococcus epidermidis
NLNHLKWYIPKLNQYSLLILIILTL

SEQ ID NO: 1749279 - protein, 31 aa, Staphylococcus epidermidis
NNFIIMGVTVILLIAILFQFNLAHVATLASV

SEQ ID NO: 1749280 - protein, 18 aa, Staphylococcus epidermidis
NNTYFFKLISFRKNIKKD

SEQ ID NO: 1749281 - protein, 17 aa, Staphylococcus epidermidis
NPIPIYVTNFFGGAIAG

SEQ ID NO: 1749282 - protein, 26 aa, Staphylococcus epidermidis
NPMNSLFFFYSAFALPFIFNVRVVSK

SEQ ID NO: 1749283 - protein, 29 aa, Staphylococcus epidermidis
NSLQKGTSYFRFQYFNPLNSSKYYENLDD

SEQ ID NO: 1749284 - protein, 29 aa, Staphylococcus epidermidis
NTTGQSYIFAKNKLYPIPGGSIMGIPTDI

SEQ ID NO: 1749285 - protein, 17 aa, Staphylococcus epidermidis
NVAGIPIAACGLLAPWI

SEQ ID NO: 1749286 - protein, 17 aa, Staphylococcus epidermidis
NVNWAGWLLFFGIVFFS

SEQ ID NO: 1749287 - protein, 32 aa, Staphylococcus epidermidis
PELSNDFIVLDFTYDLPLSTYLSQVLDIDAKV

SEQ ID NO: 1749288 - protein, 23 aa, Staphylococcus epidermidis
PFDKKREFDPNLAPGTEKVVQKG

SEQ ID NO: 1749289 - protein, 27 aa, Staphylococcus epidermidis
PLGLPTLTWPFIFATWIMLFAGIKNQS

SEQ ID NO: 1749290 - protein, 21 aa, Staphylococcus epidermidis
PLHVWLWAQLAVFLHVFVDIF

SEQ ID NO: 1749291 - protein, 20 aa, Staphylococcus epidermidis
PLSLFMLFQMMFCTIAVSIL

SEQ ID NO: 1749292 - protein, 23 aa, Staphylococcus epidermidis
PNQSGQLGATVKPGSAPNQDTEA

SEQ ID NO: 1749293 - protein, 32 aa, Staphylococcus epidermidis
PPTINEPAGLVHKYYRGDHVEITLPVTDNTGG

SEQ ID NO: 1749294 - protein, 30 aa, Staphylococcus epidermidis
PTTAEVILIIILGLPIYFFYEYKMNWKNTK

SEQ ID NO: 1749295 - protein, 17 aa, Staphylococcus epidermidis
QAIALLQPKENNSELVQ

SEQ ID NO: 1749296 - protein, 26 aa, Staphylococcus epidermidis
QEYEPTLPWVVYKLTQAKAHKTVMNI

SEQ ID NO: 1749297 - protein, 24 aa, Staphylococcus epidermidis
QFMSYILVILAFYFLHINSFVDRV

SEQ ID NO: 1749298 - protein, 27 aa, Staphylococcus epidermidis
QGDSIVLWIVAIVAIVISLIALFKQAH

SEQ ID NO: 1749299 - protein, 17 aa, Staphylococcus epidermidis
QGLALIIGIDRLLDMVR

SEQ ID NO: 1749300 - protein, 22 aa, Staphylococcus epidermidis
QKIDIPYFLIGFIIMACINTFV

SEQ ID NO: 1749301 - protein, 22 aa, Staphylococcus epidermidis
QLNIYLILVIGLLYVIIHYYRN

SEQ ID NO: 1749302 - protein, 30 aa, Staphylococcus epidermidis
QLNQRLTDTINLLQPLANKESLKEARNRLE

SEQ ID NO: 1749303 - protein, 27 aa, Staphylococcus epidermidis
QLPSFLIIVIFIFVLINLIITFPILRK

SEQ ID NO: 1749304 - protein, 26 aa, Staphylococcus epidermidis
QRLSAFQLLLLVFFSSTFTACSVTMT

SEQ ID NO: 1749305 - protein, 21 aa, Staphylococcus epidermidis
QSIPTLMHLNQAQQNALNEKI

SEQ ID NO: 1749306 - protein, 33 aa, Staphylococcus epidermidis
QTNHVFSFKLLLSLLIIGFIVLAILLASVIPVE

SEQ ID NO: 1749307 - protein, 21 aa, Staphylococcus epidermidis
QTNKILAVRFLDANTLATLQP

SEQ ID NO: 1749308 - protein, 42 aa, Staphylococcus epidermidis
QVAQDELFGLNELNSIFINITQKPTARKAISGMASQLNNSIN

SEQ ID NO: 1749309 - protein, 18 aa, Staphylococcus epidermidis
QVFYFNPAGLYESHTFKK

SEQ ID NO: 1749310 - protein, 25 aa, Staphylococcus epidermidis
QYKKTTMIILFTLIIVVIIDYVSSK

SEQ ID NO: 1749311 - protein, 17 aa, Staphylococcus epidermidis
QYTVIMAVAIFIALAFN

SEQ ID NO: 1749312 - protein, 31 aa, Staphylococcus epidermidis
RATNEEKQIFVSKLKALINRTHKQIDEAETF

SEQ ID NO: 1749313 - protein, 17 aa, Staphylococcus epidermidis
RGDIIMYRHNNKTYFSR

SEQ ID NO: 1749314 - protein, 17 aa, Staphylococcus epidermidis
RILAPLFIVAFVSGSSI

SEQ ID NO: 1749315 - protein, 26 aa, Staphylococcus epidermidis
RKKIILTLFVLPFPIMVWGVMTQGWW

SEQ ID NO: 1749316 - protein, 18 aa, Staphylococcus epidermidis
RNIRQEATTLDTAMLGLR

SEQ ID NO: 1749317 - protein, 19 aa, Staphylococcus epidermidis
RQINTNDVLTLLQATAKNS

SEQ ID NO: 1749318 - protein, 20 aa, Staphylococcus epidermidis
RQNHTLTFSSNGLNLGRSAQ

SEQ ID NO: 1749319 - protein, 18 aa, Staphylococcus epidermidis
RSYSLYLWHFPVISFIHS

SEQ ID NO: 1749320 - protein, 21 aa, Staphylococcus epidermidis
RVSHLVLTRTGLYIIDSQLLK

SEQ ID NO: 1749321 - protein, 38 aa, Staphylococcus epidermidis
SDKVAGYLFYFAVIVGVISFIVWMLIQNDVDFALERLV

SEQ ID NO: 1749322 - protein, 21 aa, Staphylococcus epidermidis
SDNIFFARVALELGSKKFEKG

SEQ ID NO: 1749323 - protein, 23 aa, Staphylococcus epidermidis
SEINKISVIAIKKPEAIAEIQEL

SEQ ID NO: 1749324 - protein, 22 aa, Staphylococcus epidermidis
SEMQLWVFLLVSLFGQFFLENL

SEQ ID NO: 1749325 - protein, 59 aa, Staphylococcus epidermidis
SFLALISMNIRILSGLLFLIAAIVTIPLVLLIVTLIIPILFFIIAMMMFARRDRIETVP

SEQ ID NO: 1749326 - protein, 30 aa, Staphylococcus epidermidis
SFSIYFYVHQIWLFIVLYALFQGLFAPAMP

SEQ ID NO: 1749327 - protein, 22 aa, Staphylococcus epidermidis
SFSLAILIFLTSIIFFINNLTI

SEQ ID NO: 1749328 - protein, 25 aa, Staphylococcus epidermidis
SGKKQSLVFYHLKLDVEFASILGLT

SEQ ID NO: 1749329 - protein, 22 aa, Staphylococcus epidermidis
SHAPILLLLGRVLQGLSAACLL

SEQ ID NO: 1749330 - protein, 25 aa, Staphylococcus epidermidis
SILYSLLVIHYLGIFYFVYSVNPMN

SEQ ID NO: 1749331 - protein, 20 aa, Staphylococcus epidermidis
SIMIGIFYRKFDARYPKLGE

SEQ ID NO: 1749332 - protein, 19 aa, Staphylococcus epidermidis
SISFIFFVGVIIGISYLSI

SEQ ID NO: 1749333 - protein, 23 aa, Staphylococcus epidermidis
SKLIPVFYIRRWFDTKTTIASAF

SEQ ID NO: 1749334 - protein, 23 aa, Staphylococcus epidermidis
SKRLLKFAIILYGLKLNMGDILG

SEQ ID NO: 1749335 - protein, 18 aa, Staphylococcus epidermidis
SKYKVIIGDLDIPVRSGF

SEQ ID NO: 1749336 - protein, 25 aa, Staphylococcus epidermidis
SLGIILFIILFIYNSLGYLLKVSNF

SEQ ID NO: 1749337 - protein, 23 aa, Staphylococcus epidermidis
SLIKYTEMKWLTPDGHYIHGKGI

SEQ ID NO: 1749338 - protein, 18 aa, Staphylococcus epidermidis
SLYLWHFPVISFIHSYFI

SEQ ID NO: 1749339 - protein, 24 aa, Staphylococcus epidermidis
SNNIKLAEPILVIGNPLGTDFKGS

SEQ ID NO: 1749340 - protein, 17 aa, Staphylococcus epidermidis
SNQIGRDLTLHAEIFFD

SEQ ID NO: 1749341 - protein, 40 aa, Staphylococcus epidermidis
SPFIALFNRYGSPLPLMHLYKLIEPFLNEPLEIANNFLMS

SEQ ID NO: 1749342 - protein, 30 aa, Staphylococcus epidermidis
SPQQGIILYYLFAIVVAFLLLNLPYVHKQG

SEQ ID NO: 1749343 - protein, 21 aa, Staphylococcus epidermidis
SSIFYWFVIIFIINYTTAYTE

SEQ ID NO: 1749344 - protein, 17 aa, Staphylococcus epidermidis
SSLVFNSIIYTSVSLLG

SEQ ID NO: 1749345 - protein, 23 aa, Staphylococcus epidermidis
SSNFFKKQYWLFGVKKKDRHDIN

SEQ ID NO: 1749346 - protein, 47 aa, Staphylococcus epidermidis
STHQAQFKNQYPVVFVHGFLGFAGDNQFSLAPKYWGGTKYNIDRNLT

SEQ ID NO: 1749347 - protein, 20 aa, Staphylococcus epidermidis
STLKVLFGHALRNALIPIIT

SEQ ID NO: 1749348 - protein, 17 aa, Staphylococcus epidermidis
SVPTVLIGLFIGAIYMI

SEQ ID NO: 1749349 - protein, 23 aa, Staphylococcus epidermidis
SVSEYFHRILPKIPYKVFVIFFI

SEQ ID NO: 1749350 - protein, 26 aa, Staphylococcus epidermidis
SVSKMIWIFIFCFIGNILGGFILFFL

SEQ ID NO: 1749351 - protein, 27 aa, Staphylococcus epidermidis
SWIQQWTVFYWAWVISWSPFIGGFVAR

SEQ ID NO: 1749352 - protein, 23 aa, Staphylococcus epidermidis
TDLFLIFYVVIFSVKFNSGITII

SEQ ID NO: 1749353 - protein, 19 aa, Staphylococcus epidermidis
TFCAFVLVYLLMQSIMPHI

SEQ ID NO: 1749354 - protein, 19 aa, Staphylococcus epidermidis
TFLILLFFTVSDESDWIYN

SEQ ID NO: 1749355 - protein, 25 aa, Staphylococcus epidermidis
TGIPQWILVMLLTVITIFLVVKTIR

SEQ ID NO: 1749356 - protein, 21 aa, Staphylococcus epidermidis
TIFYFEIGALVASLLWGYISD

SEQ ID NO: 1749357 - protein, 17 aa, Staphylococcus epidermidis
TLLLIAVSYVLIVFQSY

SEQ ID NO: 1749358 - protein, 17 aa, Staphylococcus epidermidis
TPILTFISNAFIPLLWL

SEQ ID NO: 1749359 - protein, 22 aa, Staphylococcus epidermidis
TSATSEIYIVKAPQPEQVATHT

SEQ ID NO: 1749360 - protein, 23 aa, Staphylococcus epidermidis
TTLILALLPTILKLTSFYLNTAQ

SEQ ID NO: 1749361 - protein, 19 aa, Staphylococcus epidermidis
TTMLLTCITYIILFLYSFI

SEQ ID NO: 1749362 - protein, 24 aa, Staphylococcus epidermidis
TTVEEDIFFLLVQRQRSEAFYAAE

SEQ ID NO: 1749363 - protein, 18 aa, Staphylococcus epidermidis
TVFVILGSVLIKLILNYP

SEQ ID NO: 1749364 - protein, 17 aa, Staphylococcus epidermidis
TVLFIITTGLIGSILGS

SEQ ID NO: 1749365 - protein, 19 aa, Staphylococcus epidermidis
TVLYLMHKHNRINDKQYAD

SEQ ID NO: 1749366 - protein, 21 aa, Staphylococcus epidermidis
TYILKIYMSSTPLLKNIKKNS

SEQ ID NO: 1749367 - protein, 19 aa, Staphylococcus epidermidis
VFFNVPIQILLLISSAYAA

SEQ ID NO: 1749368 - protein, 17 aa, Staphylococcus epidermidis
VFMIILGAIIGGVTNMI

SEQ ID NO: 1749369 - protein, 25 aa, Staphylococcus epidermidis
VFVSFLILTIFIGGCGFINKEDSKE

SEQ ID NO: 1749370 - protein, 25 aa, Staphylococcus epidermidis
VGQTMLIVIIFFSIIFYSGIGVQNM

SEQ ID NO: 1749371 - protein, 20 aa, Staphylococcus epidermidis
VIIFMVTGIIPLVPGGLAYD

SEQ ID NO: 1749372 - protein, 18 aa, Staphylococcus epidermidis
VLILVLLNKLYSLALSPI

SEQ ID NO: 1749373 - protein, 17 aa, Staphylococcus epidermidis
VLTLLQATAKNSNLRSN

SEQ ID NO: 1749374 - protein, 46 aa, Staphylococcus epidermidis
VNEFKQLVVAFFKEHWPKMLIIIGIIVLLLILNAIFTTVNKNDHTN

SEQ ID NO: 1749375 - protein, 23 aa, Staphylococcus epidermidis
VPEKWILGLLGLIPIYLGIKVAI

SEQ ID NO: 1749376 - protein, 21 aa, Staphylococcus epidermidis
VPVLMFAFFGIVLGFATLFKN

SEQ ID NO: 1749377 - protein, 24 aa, Staphylococcus epidermidis
VSTPSYDVYPFMYGMSNEEYNKLT

SEQ ID NO: 1749378 - protein, 19 aa, Staphylococcus epidermidis
VTRYFAIILAFIQSIGMAF

SEQ ID NO: 1749379 - protein, 20 aa, Staphylococcus epidermidis
VVDMWFVILPVVMSIGTIAT

SEQ ID NO: 1749380 - protein, 19 aa, Staphylococcus epidermidis
VVGMFIFPSIIALIIGIVT

SEQ ID NO: 1749381 - protein, 22 aa, Staphylococcus epidermidis
VVIALLPNALLGELLKFFKEGN

SEQ ID NO: 1749382 - protein, 25 aa, Staphylococcus epidermidis
VVPWPTLFFGMFFNNLFFWCANQMI

SEQ ID NO: 1749383 - protein, 37 aa, Staphylococcus epidermidis
VVQLTRFEKILYIALITVIALISIYMLSLKMDAYDTR

SEQ ID NO: 1749384 - protein, 17 aa, Staphylococcus epidermidis
WAITFLTILIIITPGST

SEQ ID NO: 1749385 - protein, 17 aa, Staphylococcus epidermidis
WLSFIPITLFTALIIDG

SEQ ID NO: 1749386 - protein, 18 aa, Staphylococcus epidermidis
WRMPFYLVSAIAAVAFIL

SEQ ID NO: 1749387 - protein, 17 aa, Staphylococcus epidermidis
WVTINGQDDMTIDSGFY

SEQ ID NO: 1749388 - protein, 23 aa, Staphylococcus epidermidis
YCTPIWFILLGLMYLRYKKADKE

SEQ ID NO: 1749389 - protein, 22 aa, Staphylococcus epidermidis
YGHHRYGRTYKGIMRDWEPGKK

SEQ ID NO: 1749390 - protein, 20 aa, Staphylococcus epidermidis
YIFMANLIMYVLFAIVAITQ

SEQ ID NO: 1749391 - protein, 23 aa, Staphylococcus epidermidis
YILYSIFCVLLIGLLILPETSIT

SEQ ID NO: 1749392 - protein, 32 aa, Staphylococcus epidermidis
YKHLENGEGLPIDGWKFYWNQQSTGTTSDQWQ

SEQ ID NO: 1749393 - protein, 21 aa, Staphylococcus epidermidis
YLPLIPFIFLSFVVTSSVYHQ

SEQ ID NO: 1749394 - protein, 22 aa, Staphylococcus epidermidis
YLTGNLLLLPRLGAALTVVITV

SEQ ID NO: 1749395 - protein, 42 aa, Staphylococcus epidermidis
YQKSWFIILTLLFIFPLGLFLMWRYAHWKNWLKLTVSSVYII

SEQ ID NO: 1749396 - protein, 23 aa, Staphylococcus epidermidis
YQQEIRIKLTSNEPIKDSEWSIT

SEQ ID NO: 1749397 - protein, 20 aa, Staphylococcus epidermidis
YQQLEKALELARTLPQQSTT

SEQ ID NO: 1749398 - protein, 20 aa, Staphylococcus epidermidis
YRISFKTQGAPTARLYYAAG

SEQ ID NO: 1749399 - protein, 21 aa, Staphylococcus epidermidis
YTRILPLIINLLGFLISKING

SEQ ID NO: 1749400 - protein, 18 aa, Staphylococcus epidermidis
YVVMLLYTGWLSTQATSL

SEQ ID NO: 1749401 - protein, 23 aa, Staphylococcus epidermidis
YVVSFLPVVLYSGSLVFNKMFKV

SEQ ID NO: 1749402 - protein, 19 aa, Staphylococcus epidermidis
YWVASILIIYVSVKLNLLP

SEQ ID NO: 1749403 - protein, 25 aa, Staphylococcus epidermidis
YYDDPPIWVCLELMTFGQFSAFVEF

SEQ ID NO: 1749404 - protein, 18 aa, Staphylococcus epidermidis
YYYKPNHFFFIAGLKSRV

SEQ ID NO: 1749405 - protein, 26 aa, Staphylococcus epidermidis
YYYSLSPLMWINFSMIWILEQTINVN

SEQ ID NO: 1749406 - protein, 24 aa, Staphylococcus epidermidis
AANVINGLIHLNVAQREVMINTNT

SEQ ID NO: 1749407 - protein, 25 aa, Staphylococcus epidermidis
ADHLTAKVKVILADGSYVTVNVPVK

SEQ ID NO: 1749408 - protein, 17 aa, Staphylococcus epidermidis
AGMILFNLSFIVGGSPA

SEQ ID NO: 1749409 - protein, 30 aa, Staphylococcus epidermidis
AGVIPVIFAMAFFLLPRTLTLFFPKAEWAQ

SEQ ID NO: 1749410 - protein, 24 aa, Staphylococcus epidermidis
AIIALFLYVLLPILNNTIIGIQNI

SEQ ID NO: 1749411 - protein, 25 aa, Staphylococcus epidermidis
AIIALFLYVLLPILNNTIIGIQNID

SEQ ID NO: 1749412 - protein, 29 aa, Staphylococcus epidermidis
AISIILLLMCVRWWIKYLSFKKNEHLKDK

SEQ ID NO: 1749413 - protein, 23 aa, Staphylococcus epidermidis
AKGYPVQMLILTGLLFGALLNAL

SEQ ID NO: 1749414 - protein, 24 aa, Staphylococcus epidermidis
ALFFEVGLVLLIPLVFTVAKRANV

SEQ ID NO: 1749415 - protein, 45 aa, Staphylococcus epidermidis; identical to SEQ ID NO: 1593566

SEQ ID NO: 1749416 - protein, 17 aa, Staphylococcus epidermidis
AQRGAFLSLVIYIILSI

SEQ ID NO: 1749417 - protein, 24 aa, Staphylococcus epidermidis
AQVNPHFFFNAINTISALVRIDSE

SEQ ID NO: 1749418 - protein, 23 aa, Staphylococcus epidermidis
ARPKIEEIVPQVSKKRDVLNAIQ

SEQ ID NO: 1749419 - protein, 20 aa, Staphylococcus epidermidis
ARVKILKMILLVLAVMLAGA

SEQ ID NO: 1749420 - protein, 27 aa, Staphylococcus epidermidis
ATEKSKDLKLIKGLKDLNKAQLEDVTN

SEQ ID NO: 1749421 - protein, 23 aa, Staphylococcus epidermidis
AVDSILNRKVAIKAISIPPSEKE

SEQ ID NO: 1749422 - protein, 18 aa, Staphylococcus epidermidis
AVITIARGQNYTIGPNLR

SEQ ID NO: 1749423 - protein, 18 aa, Staphylococcus epidermidis
AYLKYIKAESDLKHVADK

SEQ ID NO: 1749424 - protein, 17 aa, Staphylococcus epidermidis
AYSLYLFFDFAGYSLFA

SEQ ID NO: 1749425 - protein, 18 aa, Staphylococcus epidermidis
AYSLYLFFDFAGYSLFAI

SEQ ID NO: 1749426 - protein, 20 aa, Staphylococcus epidermidis
DAHWFGFPVPFRFSGFGFDV

SEQ ID NO: 1749427 - protein, 23 aa, Staphylococcus epidermidis
DDCFYIVMEYIEGPTLAEYIHSH

SEQ ID NO: 1749428 - protein, 24 aa, Staphylococcus epidermidis
DDCFYIVMEYIEGPTLAEYIHSHG

SEQ ID NO: 1749429 - protein, 25 aa, Staphylococcus epidermidis
DEDLKLQYDYAINLANNVLDKENGT

SEQ ID NO: 1749430 - protein, 23 aa, Staphylococcus epidermidis
DGLSFLTLYLLNVHLGYTFSGGF

SEQ ID NO: 1749431 - protein, 29 aa, Staphylococcus epidermidis
DIVKDNVLANEKILFGAEKLSYDKSNAND

SEQ ID NO: 1749432 - protein, 27 aa, Staphylococcus epidermidis
DLIWSQYLIGLLLTAGFFFTISSKFIQ

SEQ ID NO: 1749433 - protein, 33 aa, Staphylococcus epidermidis
DLTHHFMFVMRDLKWIFLSYVLLSIGTTLITYL

SEQ ID NO: 1749434 - protein, 23 aa, Staphylococcus epidermidis
DPKLSFSIVYTNQPVPPPWLNGG

SEQ ID NO: 1749435 - protein, 18 aa, Staphylococcus epidermidis
DSKYLNEDSKYQQQYDRV

SEQ ID NO: 1749436 - protein, 22 aa, Staphylococcus epidermidis
DYDQSFINIKFKGANKLSDKSE

SEQ ID NO: 1749437 - protein, 18 aa, Staphylococcus epidermidis
EARAYLKYIKAESDLKHV

SEQ ID NO: 1749438 - protein, 33 aa, Staphylococcus epidermidis
EEGKYQFDGLKNGLTYKITFETPEGYTPTLKHS

SEQ ID NO: 1749439 - protein, 23 aa, Staphylococcus epidermidis
EGDKIGVPGFVRGLHDMHAKEGK

SEQ ID NO: 1749440 - protein, 24 aa, Staphylococcus epidermidis
EGWVWTITLVGLITLFWASLNATK

SEQ ID NO: 1749441 - protein, 25 aa, Staphylococcus epidermidis
EGWVWTITLVGLITLFWASLNATKQ

SEQ ID NO: 1749442 - protein, 39 aa, Staphylococcus epidermidis
EHAFNTLAHIIIWDTDQQPLVFELPELSLQNALVTSEVV

SEQ ID NO: 1749443 - protein, 17 aa, Staphylococcus epidermidis
ELSQLTQSTLELNDKMK

SEQ ID NO: 1749444 - protein, 25 aa, Staphylococcus epidermidis
ELSTLIYLIFPILAIFVDKRGNLFT

SEQ ID NO: 1749445 - protein, 22 aa, Staphylococcus epidermidis
EREDLGLLVDFLAELFKEEGHK

SEQ ID NO: 1749446 - protein, 38 aa, Staphylococcus epidermidis; identical to SEQ ID NO: 1593643

SEQ ID NO: 1749447 - protein, 19 aa, Staphylococcus epidermidis
ESILKLLNFFIPLILIVMY

SEQ ID NO: 1749448 - protein, 20 aa, Staphylococcus epidermidis
ESILKLLNFFIPLILIVMYV

SEQ ID NO: 1749449 - protein, 17 aa, Staphylococcus epidermidis
ETSLNGFERLNHARPRA

SEQ ID NO: 1749450 - protein, 32 aa, Staphylococcus epidermidis
FAGVIVVLAFFLLMIVFRSILVPLKAVLGFIL

SEQ ID NO: 1749451 - protein, 17 aa, Staphylococcus epidermidis
FAIGGVPPFSGFPGKVL

SEQ ID NO: 1749452 - protein, 20 aa, Staphylococcus epidermidis
FAIGGVPPFSGFPGKVLIFQ

SEQ ID NO: 1749453 - protein, 17 aa, Staphylococcus epidermidis
FFAGMILFNLSFIVGGS

SEQ ID NO: 1749454 - protein, 19 aa, Staphylococcus epidermidis
FFAGMILFNLSFIVGGSPA

SEQ ID NO: 1749455 - protein, 19 aa, Staphylococcus epidermidis
FFCIRLISLKILMQHAKQL

SEQ ID NO: 1749456 - protein, 18 aa, Staphylococcus epidermidis
FFCIRLISLKISMQHAKQ

SEQ ID NO: 1749457 - protein, 25 aa, Staphylococcus epidermidis
FFIHNQWLLIFSFVLIGINNLTMNT

SEQ ID NO: 1749458 - protein, 20 aa, Staphylococcus epidermidis
FGQYAMLFLAPTGLVMATLQ

SEQ ID NO: 1749459 - protein, 21 aa, Staphylococcus epidermidis
FIIGSLVYLILATICYFLFLQ

SEQ ID NO: 1749460 - protein, 28 aa, Staphylococcus epidermidis
FIIVIVAMILLLIKYRYIFKLQTGRFFI

SEQ ID NO: 1749461 - protein, 19 aa, Staphylococcus epidermidis
FISLILYRFELNLRSASIL

SEQ ID NO: 1749462 - protein, 17 aa, Staphylococcus epidermidis
FIVTSVIIPLLGVGSII

SEQ ID NO: 1749463 - protein, 21 aa, Staphylococcus epidermidis
FKFIITILSIVFWISVLISRL

SEQ ID NO: 1749464 - protein, 18 aa, Staphylococcus epidermidis
FLTYMTIVIVSCIIFSTF

SEQ ID NO: 1749465 - protein, 17 aa, Staphylococcus epidermidis
FMVPILAGYIAVSIADK

SEQ ID NO: 1749466 - protein, 23 aa, Staphylococcus epidermidis
FNFSCFIGLIVLIFTLILGVILN

SEQ ID NO: 1749467 - protein, 27 aa, Staphylococcus epidermidis
FNQLYVVFKMIFWFNPALYISKTMMDN

SEQ ID NO: 1749468 - protein, 19 aa, Staphylococcus epidermidis
FPVMMFGVPAAALAMYHTA

SEQ ID NO: 1749469 - protein, 18 aa, Staphylococcus epidermidis
FSLIFMTAFLILNLLTMK

SEQ ID NO: 1749470 - protein, 26 aa, Staphylococcus epidermidis
FSVLFFVDLIIILIFNKVKPSSEFDL

SEQ ID NO: 1749471 - protein, 20 aa, Staphylococcus epidermidis
FTMGWLYWGMWSLVTSVDII

SEQ ID NO: 1749472 - protein, 18 aa, Staphylococcus epidermidis
FWLFFAGMILFNLSFIVG

SEQ ID NO: 1749473 - protein, 19 aa, Staphylococcus epidermidis
FWVIMIIIGFLFVCKEVFY

SEQ ID NO: 1749474 - protein, 17 aa, Staphylococcus epidermidis
GALIAMKFNMTPLAIAV

SEQ ID NO: 1749475 - protein, 17 aa, Staphylococcus epidermidis
GFLYKYIIAYLIQTYAV

SEQ ID NO: 1749476 - protein, 19 aa, Staphylococcus epidermidis
GGAITAVALSRKESRDKLK

SEQ ID NO: 1749477 - protein, 21 aa, Staphylococcus epidermidis
GHFFWPAILAFALTGIGLPLL

SEQ ID NO: 1749478 - protein, 17 aa, Staphylococcus epidermidis
GICFLLALFFSPLIEVV

SEQ ID NO: 1749479 - protein, 17 aa, Staphylococcus epidermidis
GIKYGLFIQSIIDFIII

SEQ ID NO: 1749480 - protein, 24 aa, Staphylococcus epidermidis
GLHLLYVFLIGIFFIMTQTSDFKN

SEQ ID NO: 1749481 - protein, 18 aa, Staphylococcus epidermidis
GLLYFIRFLFGVGEAPMY

SEQ ID NO: 1749482 - protein, 22 aa, Staphylococcus epidermidis
GLSFLTLYLLNVHLGYTFSGGF

SEQ ID NO: 1749483 - protein, 17 aa, Staphylococcus epidermidis
GMNVPLPIDDHSYVSWI

SEQ ID NO: 1749484 - protein, 43 aa, Staphylococcus epidermidis
GNFKVKFFVSLIFAIPIILLSPLMGINLPFQFTFPGSEWVVLI

SEQ ID NO: 1749485 - protein, 29 aa, Staphylococcus epidermidis
GNLALFIFTVIYFLIVLYLCLNPNKMIDR

SEQ ID NO: 1749486 - protein, 25 aa, Staphylococcus epidermidis
GPAGIDLYLSIPWFAASISTVAGAI

SEQ ID NO: 1749487 - protein, 20 aa, Staphylococcus epidermidis
GSYLLGIHWRLGYTGIILVS

SEQ ID NO: 1749488 - protein, 27 aa, Staphylococcus epidermidis
GVIMIIFMAMPFIFGLWNVVIPLQLGA

SEQ ID NO: 1749489 - protein, 30 aa, Staphylococcus epidermidis
GVIMIIFMAMPFIFGLWNVVIPLQLGARDV

SEQ ID NO: 1749490 - protein, 18 aa, Staphylococcus epidermidis
GVMIQIVIWFINLNIGSR

SEQ ID NO: 1749491 - protein, 17 aa, Staphylococcus epidermidis
GVSLFLTLGLIIAQLND

SEQ ID NO: 1749492 - protein, 20 aa, Staphylococcus epidermidis
GVVILIFTLTLHLPLYVLLI

SEQ ID NO: 1749493 - protein, 19 aa, Staphylococcus epidermidis
GYVYFSWLLGLLVGMVIMN

SEQ ID NO: 1749494 - protein, 19 aa, Staphylococcus epidermidis
HFLYTFMFSMIIGELIRAT

SEQ ID NO: 1749495 - protein, 35 aa, Staphylococcus epidermidis
HGDYIKPFIALFLLSMGFYILYQFLFKRAHEHHHH

SEQ ID NO: 1749496 - protein, 22 aa, Staphylococcus epidermidis
HKDTLIDIIFYSAIVGFIVARI

SEQ ID NO: 1749497 - protein, 23 aa, Staphylococcus epidermidis
HKDTLIDIIFYSAIVGFIVARIY

SEQ ID NO: 1749498 - protein, 18 aa, Staphylococcus epidermidis
HLLGEKHIAEHKLGYVVV

SEQ ID NO: 1749499 - protein, 18 aa, Staphylococcus epidermidis
HQKAEVIRGLINDNEEAT

SEQ ID NO: 1749500 - protein, 25 aa, Staphylococcus epidermidis
HQQGYAPLRFRTALVPLANIGSSLS

SEQ ID NO: 1749501 - protein, 26 aa, Staphylococcus epidermidis
HQQGYAPLRFRTALVPLANIGSSLSY

SEQ ID NO: 1749502 - protein, 22 aa, Staphylococcus epidermidis
HSYVSWIIVVGISLILVAIVSI

SEQ ID NO: 1749503 - protein, 23 aa, Staphylococcus epidermidis
HSYVSWIIVVGISLILVAIVSIF

SEQ ID NO: 1749504 - protein, 24 aa, Staphylococcus epidermidis
HWLTVLFIVLLLISFNLLGARLFG

SEQ ID NO: 1749505 - protein, 18 aa, Staphylococcus epidermidis
IAGALWLIAGIMLLVRKP

SEQ ID NO: 1749506 - protein, 33 aa, Staphylococcus epidermidis
IALFLGLSFLWFPIFSIIFSLITLLLVLSVSAM

SEQ ID NO: 1749507 - protein, 17 aa, Staphylococcus epidermidis
IALFLIWLPTYLTEQYH

SEQ ID NO: 1749508 - protein, 25 aa, Staphylococcus epidermidis
IALIQIFRPFKHYFKLSWKKIYQVS

SEQ ID NO: 1749509 - protein, 45 aa, Staphylococcus epidermidis
ICIIGIGIIGWYMWSLWSLIIALLPILLFFVYAILYTRFSGFAFS

SEQ ID NO: 1749510 - protein, 17 aa, Staphylococcus epidermidis
IELLLIVLLYTKQSFTL

SEQ ID NO: 1749511 - protein, 17 aa, Staphylococcus epidermidis
IFGLWNVVIPLQLGARD

SEQ ID NO: 1749512 - protein, 18 aa, Staphylococcus epidermidis
IFNISMILIMILLEVFRK

SEQ ID NO: 1749513 - protein, 17 aa, Staphylococcus epidermidis
IFNPTFVVPLSAFYLVI

SEQ ID NO: 1749514 - protein, 39 aa, Staphylococcus epidermidis
IGAKGSSYPILKRLVKRLPAMVLPSWAYNKIAPVAIDDV

SEQ ID NO: 1749515 - protein, 17 aa, Staphylococcus epidermidis
IGFVFFNVPIQILLLIS

SEQ ID NO: 1749516 - protein, 18 aa, Staphylococcus epidermidis
IGGVPPFSGFPGKVLIFQ

SEQ ID NO: 1749517 - protein, 17 aa, Staphylococcus epidermidis
IGVFHSKYLLAWSKNKE

SEQ ID NO: 1749518 - protein, 19 aa, Staphylococcus epidermidis
IIIWLFYSNHFINLVNILF

SEQ ID NO: 1749519 - protein, 22 aa, Staphylococcus epidermidis
IIMIFPSAPLFVLPLGSFIGAL

SEQ ID NO: 1749520 - protein, 23 aa, Staphylococcus epidermidis
IISGFFFAFAALTYLISAQPNMN

SEQ ID NO: 1749521 - protein, 31 aa, Staphylococcus epidermidis
IITSLLDLLIVWYVLYLLITVFKGTKAIQLL

SEQ ID NO: 1749522 - protein, 25 aa, Staphylococcus epidermidis
IKTFVMLFFELLTLFIIVSFIVSLI

SEQ ID NO: 1749523 - protein, 22 aa, Staphylococcus epidermidis
ILETIRNVEPIVIVKPKANEII

SEQ ID NO: 1749524 - protein, 20 aa, Staphylococcus epidermidis
ILGYILWVGVLFIFTTLNMA

SEQ ID NO: 1749525 - protein, 20 aa, Staphylococcus epidermidis
ILIVLVIFYIKEAQFNLFMQ

SEQ ID NO: 1749526 - protein, 18 aa, Staphylococcus epidermidis
ILPVFVITITYTGIYFRN

SEQ ID NO: 1749527 - protein, 27 aa, Staphylococcus epidermidis
ILSGKMLFFYIITIIILIVLVIFYIKE

SEQ ID NO: 1749528 - protein, 21 aa, Staphylococcus epidermidis
ILTLLLLIMIKRLNIIILLLM

SEQ ID NO: 1749529 - protein, 18 aa, Staphylococcus epidermidis
ILVPLKAVLGFILSLMAT

SEQ ID NO: 1749530 - protein, 24 aa, Staphylococcus epidermidis
ILVVFCYFMMLFFSIAPFQMIFEE

SEQ ID NO: 1749531 - protein, 22 aa, Staphylococcus epidermidis
ILVVILACFIYMFLEGKLGSLE

SEQ ID NO: 1749532 - protein, 23 aa, Staphylococcus epidermidis
ILYKRIFFTCLILVIYIIGSNIS

SEQ ID NO: 1749533 - protein, 27 aa, Staphylococcus epidermidis
INTLFFLMIMIIIIPLIRQRAFKFIIT

SEQ ID NO: 1749534 - protein, 18 aa, Staphylococcus epidermidis
IPQVHELLTPLVSVVTMQ

SEQ ID NO: 1749535 - protein, 26 aa, Staphylococcus epidermidis
IRGLDTIYSFKGSGDVSYRISFKTQG

SEQ ID NO: 1749536 - protein, 24 aa, Staphylococcus epidermidis
ISGAFWTFLLVIALSILILLNELK

SEQ ID NO: 1749537 - protein, 17 aa, Staphylococcus epidermidis
ISQILMLITFLITIIHV

SEQ ID NO: 1749538 - protein, 17 aa, Staphylococcus epidermidis
ITACTWTSKKWPFTTPE

SEQ ID NO: 1749539 - protein, 22 aa, Staphylococcus epidermidis
ITQSFMIMTCVFIGFIVCGRWI

SEQ ID NO: 1749540 - protein, 30 aa, Staphylococcus epidermidis
ITSLLDLLIVWYVLYLLITVFKGTKAIQLL

SEQ ID NO: 1749541 - protein, 20 aa, Staphylococcus epidermidis
ITYTFTDYVDKYENIKAHLK

SEQ ID NO: 1749542 - protein, 18 aa, Staphylococcus epidermidis
IVFTLIFGIIAFFHESRL

SEQ ID NO: 1749543 - protein, 20 aa, Staphylococcus epidermidis
IVIITAFFKPAGSLFYLLVL

SEQ ID NO: 1749544 - protein, 28 aa, Staphylococcus epidermidis
IVKDNVLANEKILFGAEKLSYDKSNAND

SEQ ID NO: 1749545 - protein, 30 aa, Staphylococcus epidermidis
IVNFYSLLPWFIITVPIVLLLGYQLDILNL

SEQ ID NO: 1749546 - protein, 20 aa, Staphylococcus epidermidis
IWLFILILSMSLSLCWDVGK

SEQ ID NO: 1749547 - protein, 21 aa, Staphylococcus epidermidis
IWLFILILSMSLSLSWDVGKL

SEQ ID NO: 1749548 - protein, 20 aa, Staphylococcus epidermidis
IYVIFLGLAFILSFSTLKFA

SEQ ID NO: 1749549 - protein, 27 aa, Staphylococcus epidermidis
KDQIVGKVSLRYWPFSEFKSNFNPNNT

SEQ ID NO: 1749550 - protein, 17 aa, Staphylococcus epidermidis
KEDVIGYYMLGVLNLEN

SEQ ID NO: 1749551 - protein, 39 aa, Staphylococcus epidermidis
KEQKHTGWLIVLSIIFVLLIAALLYGAYYAYNHYISDEQ

SEQ ID NO: 1749552 - protein, 30 aa, Staphylococcus epidermidis
KGLNWIHYPWDFLVIVIVALIFYQLGTTSY

SEQ ID NO: 1749553 - protein, 31 aa, Staphylococcus epidermidis
KGLNWIHYPWDFLVIVIVALIFYQLGTTSYF

SEQ ID NO: 1749554 - protein, 17 aa, Staphylococcus epidermidis
KGYPVQMLILTGLLLGA

SEQ ID NO: 1749555 - protein, 37 aa, Staphylococcus epidermidis
KKKKRKKGWLFGCGGCLVLLILIIVGVTACTGTFVNE

SEQ ID NO: 1749556 - protein, 24 aa, Staphylococcus epidermidis
KKNNTKIILEQKGNEKKSAIAQTP

SEQ ID NO: 1749557 - protein, 33 aa, Staphylococcus epidermidis; identical to SEQ ID NO: 1592127

SEQ ID NO: 1749558 - protein, 30 aa, Staphylococcus epidermidis; identical to SEQ ID NO: 1590833

SEQ ID NO: 1749559 - protein, 27 aa, Staphylococcus epidermidis
KLEFSIWLFLLLLLVPDIFMLGYVINR

SEQ ID NO: 1749560 - protein, 20 aa, Staphylococcus epidermidis
KMEFQMLYGFRTELAQKIAN

SEQ ID NO: 1749561 - protein, 28 aa, Staphylococcus epidermidis
KNITFIALFFPIVILAVPFIDTLFAMIR

SEQ ID NO: 1749562 - protein, 20 aa, Staphylococcus epidermidis
KPIQVFFIQFSILVFCMALG

SEQ ID NO: 1749563 - protein, 21 aa, Staphylococcus epidermidis
KPIQVFFIQFSILVFCMALGT

SEQ ID NO: 1749564 - protein, 31 aa, Staphylococcus epidermidis; identical to SEQ ID NO: 1593805

SEQ ID NO: 1749565 - protein, 33 aa, Staphylococcus epidermidis
KRKNTLYTAIVLLVALVLLIFAVKSIQVEPVKS

SEQ ID NO: 1749566 - protein, 40 aa, Staphylococcus epidermidis; identical to SEQ ID NO: 1593806

SEQ ID NO: 1749567 - protein, 20 aa, Staphylococcus epidermidis
KVALGIGGAITAVALSRKES

SEQ ID NO: 1749568 - protein, 27 aa, Staphylococcus epidermidis
KVTDSDIYSLFRKQSFRGNEYLNSLQK

SEQ ID NO: 1749569 - protein, 21 aa, Staphylococcus epidermidis
KVWAWIFIVTSVIIPLLGVGS

SEQ ID NO: 1749570 - protein, 20 aa, Staphylococcus epidermidis
KYVPMMLLAGILVSLLTAAF

SEQ ID NO: 1749571 - protein, 25 aa, Staphylococcus epidermidis
LALGITFLALWILTNIFDNANAIPG

SEQ ID NO: 1749572 - protein, 17 aa, Staphylococcus epidermidis
LAVMGFASAISVLFAVL

SEQ ID NO: 1749573 - protein, 21 aa, Staphylococcus epidermidis
LEKWGFPRWASITTIFIGLIA

SEQ ID NO: 1749574 - protein, 22 aa, Staphylococcus epidermidis
LEKWGFPRWASITTIFIGLIVI

SEQ ID NO: 1749575 - protein, 23 aa, Staphylococcus epidermidis
LFGELFFMLFNKIVNTHQPQLSD

SEQ ID NO: 1749576 - protein, 18 aa, Staphylococcus epidermidis
LFTLIFIVIGFYDGFLGG

SEQ ID NO: 1749577 - protein, 53 aa, Staphylococcus epidermidis
LHKNDNDSLFKHLVDNFGKTVGVITLTGLLSSFWLVLAKRRKKEEEEKQSIKN

SEQ ID NO: 1749578 - protein, 18 aa, Staphylococcus epidermidis
LIAKYPLQLFGANAIIGV

SEQ ID NO: 1749579 - protein, 19 aa, Staphylococcus epidermidis
LIAKYPLQLFGANAIIGVV

SEQ ID NO: 1749580 - protein, 20 aa, Staphylococcus epidermidis
LIIMIMIFDLIIGLLLNFQI

SEQ ID NO: 1749581 - protein, 19 aa, Staphylococcus epidermidis
LIMISVIFVIYRRVKYQPI

SEQ ID NO: 1749582 - protein, 24 aa, Staphylococcus epidermidis
LITINLFIFYLFNSNIIVLRDMFI

SEQ ID NO: 1749583 - protein, 19 aa, Staphylococcus epidermidis
LIVLVIFYIKEAQFNLFMQ

SEQ ID NO: 1749584 - protein, 23 aa, Staphylococcus epidermidis
LKIIFRKKLYLVVSIFLPVVFYL

SEQ ID NO: 1749585 - protein, 23 aa, Staphylococcus epidermidis
LLTIPVLFLFPFVQKHFVKGITI

SEQ ID NO: 1749586 - protein, 19 aa, Staphylococcus epidermidis
LNFVLVFTTLKIFGYSKDT

SEQ ID NO: 1749587 - protein, 30 aa, Staphylococcus epidermidis
LNNQSASYFIKQWALDRIKQIQLETMNSIR

SEQ ID NO: 1749588 - protein, 17 aa, Staphylococcus epidermidis
LNQTTNPTLEPYKVDIV

SEQ ID NO: 1749589 - protein, 18 aa, Staphylococcus epidermidis
LNVILIPFWGIVGASVST

SEQ ID NO: 1749590 - protein, 23 aa, Staphylococcus epidermidis
LRHQPKWILKSIIVIVLAIISAF

SEQ ID NO: 1749591 - protein, 28 aa, Staphylococcus epidermidis
LRKKIILTLFVLPFPIMVWGVMTQGWWF

SEQ ID NO: 1749592 - protein, 21 aa, Staphylococcus epidermidis
LRSTFFHWGFHAWAIYGVVAL

SEQ ID NO: 1749593 - protein, 17 aa, Staphylococcus epidermidis
LSIFITPILLLMLIAMI

SEQ ID NO: 1749594 - protein, 19 aa, Staphylococcus epidermidis
LTHRFSSRSVLLWTLIVFI

SEQ ID NO: 1749595 - protein, 18 aa, Staphylococcus epidermidis
LTILIYSIGIIILLLLCN

SEQ ID NO: 1749596 - protein, 33 aa, Staphylococcus epidermidis
LTVSQPILFGLLLLIVVTIPYYTFNALKIAGPS

SEQ ID NO: 1749597 - protein, 18 aa, Staphylococcus epidermidis
LVIAFTFLFIVIAPKSYL

SEQ ID NO: 1749598 - protein, 17 aa, Staphylococcus epidermidis
LVKLTHRFSSRSVLLWT

SEQ ID NO: 1749599 - protein, 22 aa, Staphylococcus epidermidis
LYPTLMLIMSVFLSFTVVAQNI

SEQ ID NO: 1749600 - protein, 37 aa, Staphylococcus epidermidis
MFSIILLGFVAMNILFYLLPLIILGDATWGFVLSWLP

SEQ ID NO: 1749601 - protein, 50 aa, Staphylococcus epidermidis
MFSIILLGFVAMNILFYLLPLIILGDATWGFVLSWLPLHSKYLVVSVYLA

SEQ ID NO: 1749602 - protein, 24 aa, Staphylococcus epidermidis
MHNIIIVLVIFMIVGLIGTSLSFI

SEQ ID NO: 1749603 - protein, 24 aa, Staphylococcus epidermidis
MHNIIIVLVVFMIVGLIGTSLSFI

SEQ ID NO: 1749604 - protein, 17 aa, Staphylococcus epidermidis
MIFFIINFILISYLYDK

SEQ ID NO: 1749605 - protein, 17 aa, Staphylococcus epidermidis
MIQYGTYARLHIFSRSQ

SEQ ID NO: 1749606 - protein, 17 aa, Staphylococcus epidermidis
MLLLSIFILYLNHILIS

SEQ ID NO: 1749607 - protein, 29 aa, Staphylococcus epidermidis
MSGPLFIIVLLFIFFCLGFIVPSSSGLAV

SEQ ID NO: 1749608 - protein, 28 aa, Staphylococcus epidermidis
NDLIWSQYLIGLLLTAGFFFTISSKFIQ

SEQ ID NO: 1749609 - protein, 23 aa, Staphylococcus epidermidis
NEKLYVYNWGEYIDLSLIKKFEK

SEQ ID NO: 1749610 - protein, 28 aa, Staphylococcus epidermidis
NELPNSSEILLLNLTSRIIGKDANKEIR

SEQ ID NO: 1749611 - protein, 24 aa, Staphylococcus epidermidis
NGTKYLIFDNMSFTAPTKKPIIKP

SEQ ID NO: 1749612 - protein, 40 aa, Staphylococcus epidermidis; identical to SEQ ID NO: 1590369

SEQ ID NO: 1749613 - protein, 40 aa, Staphylococcus epidermidis; identical to SEQ ID NO: 1597023

SEQ ID NO: 1749614 - protein, 26 aa, Staphylococcus epidermidis
NIIDKRFIFFFFVAVTLHGIWDTEIT

SEQ ID NO: 1749615 - protein, 27 aa, Staphylococcus epidermidis
NIIDKRFIFFFFVAVTLHGIWDTEITL

SEQ ID NO: 1749616 - protein, 36 aa, Staphylococcus epidermidis; identical to SEQ ID NO: 1591776

SEQ ID NO: 1749617 - protein, 20 aa, Staphylococcus epidermidis
NIQKAYWVPLSAHTIMLGNV

SEQ ID NO: 1749618 - protein, 28 aa, Staphylococcus epidermidis
NLALFIFTVIYFLIVLYLCLNPNKMIDR

SEQ ID NO: 1749619 - protein, 26 aa, Staphylococcus epidermidis
NLTLNFMIVFLFIISATVIGVFLYVI

SEQ ID NO: 1749620 - protein, 23 aa, Staphylococcus epidermidis
NPKLSFSIVYTNQPVPPPWLNGG

SEQ ID NO: 1749621 - protein, 21 aa, Staphylococcus epidermidis
NPMIFFIINFILISYLYDKQY

SEQ ID NO: 1749622 - protein, 17 aa, Staphylococcus epidermidis
NRKILIITALFMGAVSF

SEQ ID NO: 1749623 - protein, 26 aa, Staphylococcus epidermidis
NTLFFLMIMIIIIPLIRQRAFKFIIT

SEQ ID NO: 1749624 - protein, 24 aa, Staphylococcus epidermidis
PAGIDLYLSIPWFAASISTVAGAI

SEQ ID NO: 1749625 - protein, 23 aa, Staphylococcus epidermidis
PALVSFIWFSVFGVLGIEAGKKD

SEQ ID NO: 1749626 - protein, 17 aa, Staphylococcus epidermidis
PIKNRPSLLDRINKGVG

SEQ ID NO: 1749627 - protein, 17 aa, Staphylococcus epidermidis
PIVLLLGYQLDILNLGD

SEQ ID NO: 1749628 - protein, 17 aa, Staphylococcus epidermidis
PLPIYRKGLLSVLVVVV

SEQ ID NO: 1749629 - protein, 23 aa, Staphylococcus epidermidis
PNQSGQLGATVKPGSAPNQDTEV

SEQ ID NO: 1749630 - protein, 17 aa, Staphylococcus epidermidis
PQVHELLTPLVSVVTMQ

SEQ ID NO: 1749631 - protein, 24 aa, Staphylococcus epidermidis
PSVIVGPNFYMGIGTPGGNKIPTI

SEQ ID NO: 1749632 - protein, 23 aa, Staphylococcus epidermidis
PTLVFSFFGMNVPLPIDDHSYVS

SEQ ID NO: 1749633 - protein, 25 aa, Staphylococcus epidermidis
PTLVFSFFGMNVPLPIDDHSYVSWI

SEQ ID NO: 1749634 - protein, 17 aa, Staphylococcus epidermidis
PVLSIIIWLFYSNHFIN

SEQ ID NO: 1749635 - protein, 17 aa, Staphylococcus epidermidis
QILSFYMNNIYYGDNQY

SEQ ID NO: 1749636 - protein, 18 aa, Staphylococcus epidermidis
QILSFYMNNIYYGDNQYT

SEQ ID NO: 1749637 - protein, 17 aa, Staphylococcus epidermidis
QLPYIPKQRLYTLTASA

SEQ ID NO: 1749638 - protein, 22 aa, Staphylococcus epidermidis
QNMLKWGALVAIGFIIVATFMF

SEQ ID NO: 1749639 - protein, 31 aa, Staphylococcus epidermidis
QSHTVYGQENLYRIAIQYYGEGTQANVDKIK

SEQ ID NO: 1749640 - protein, 20 aa, Staphylococcus epidermidis
QYGAISLFFLMTCAIIISTS

SEQ ID NO: 1749641 - protein, 23 aa, Staphylococcus epidermidis
RAFKFIITILSIAFWISVLISRL

SEQ ID NO: 1749642 - protein, 17 aa, Staphylococcus epidermidis
RAMIQYGTYARLHIFSR

SEQ ID NO: 1749643 - protein, 24 aa, Staphylococcus epidermidis
RERPIHVKQLKDKVAKIVIQMNTF

SEQ ID NO: 1749644 - protein, 19 aa, Staphylococcus epidermidis
RGVKLLYPLPFNIVSPIHF

SEQ ID NO: 1749645 - protein, 20 aa, Staphylococcus epidermidis
RGVKLLYPLPFNIVSPIHFK

SEQ ID NO: 1749646 - protein, 18 aa, Staphylococcus epidermidis
RHLILFPGILLQGAAIAA

SEQ ID NO: 1749647 - protein, 19 aa, Staphylococcus epidermidis
RHLILFPGILLQGAAIAAL

SEQ ID NO: 1749648 - protein, 17 aa, Staphylococcus epidermidis
RIKIFTKDNMQVIGDIT

SEQ ID NO: 1749649 - protein, 18 aa, Staphylococcus epidermidis
RIPRLLGITIIYVAIIGI

SEQ ID NO: 1749650 - protein, 17 aa, Staphylococcus epidermidis
RKDTVLYLMHKHNRIND

SEQ ID NO: 1749651 - protein, 18 aa, Staphylococcus epidermidis
RKDTVLYLMHKHNRINDK

SEQ ID NO: 1749652 - protein, 26 aa, Staphylococcus epidermidis
RKMTRLIIAIIVVSVGLVFLLQILLN

SEQ ID NO: 1749653 - protein, 26 aa, Staphylococcus epidermidis
RLSDTDKIDPIVITKRKIDKEEQIQN

SEQ ID NO: 1749654 - protein, 25 aa, Staphylococcus epidermidis
RNQNNINQFIWNKNGFFKSQNNTEH

SEQ ID NO: 1749655 - protein, 43 aa, Staphylococcus epidermidis
RRKKQKRIQYTIITLLILIIVLILLYMFTPLSKISNVNVKGNN

SEQ ID NO: 1749656 - protein, 36 aa, Staphylococcus epidermidis
RVVRRRIALFGGILLAIILILLVLLVIQRHNNDQDA

SEQ ID NO: 1749657 - protein, 22 aa, Staphylococcus epidermidis
RYTIVLLLLIFSTIFSLCIGSV

SEQ ID NO: 1749658 - protein, 33 aa, Staphylococcus epidermidis
SACISIMTPLLIIYVFTQFFYKKYITTSINYLN

SEQ ID NO: 1749659 - protein, 18 aa, Staphylococcus epidermidis
SAGYKWFFAYPDQHIETV

SEQ ID NO: 1749660 - protein, 25 aa, Staphylococcus epidermidis
SDGITKFIYRKISTAQSPIVENNQQ

SEQ ID NO: 1749661 - protein, 22 aa, Staphylococcus epidermidis
SEHPHFLWFNLTKPDIWITVIA

SEQ ID NO: 1749662 - protein, 24 aa, Staphylococcus epidermidis
SEKLNKLLLIISLLSIFQVVEIFF

SEQ ID NO: 1749663 - protein, 22 aa, Staphylococcus epidermidis
SFFLVFTMLFSVGVVPLYILLN

SEQ ID NO: 1749664 - protein, 25 aa, Staphylococcus epidermidis
SFMLTGFAFMVTTSLFSHQAHAEGN

SEQ ID NO: 1749665 - protein, 22 aa, Staphylococcus epidermidis
SGHFFWPAILAFALTGIGLPLL

SEQ ID NO: 1749666 - protein, 19 aa, Staphylococcus epidermidis
SIFEIFPYIVIASAATILY

SEQ ID NO: 1749667 - protein, 25 aa, Staphylococcus epidermidis
SIMQILTLVSVIFSPLTFIAGVYGM

SEQ ID NO: 1749668 - protein, 18 aa, Staphylococcus epidermidis
SIPEFVIMIALASFFHPS

SEQ ID NO: 1749669 - protein, 28 aa, Staphylococcus epidermidis
SLIAIGFLCIFIFSFIGLTIAAIAFQSI

SEQ ID NO: 1749670 - protein, 28 aa, Staphylococcus epidermidis
SLLILNLISIIILLFLALLSPIYELVEI

SEQ ID NO: 1749671 - protein, 25 aa, Staphylococcus epidermidis
SMSPILLAWIVAAVLRISLGSATVA

SEQ ID NO: 1749672 - protein, 43 aa, Staphylococcus epidermidis
SPISIPSILVNPWVQLILSTPVQFIIGWQFYVGAYKNLRNGSA

SEQ ID NO: 1749673 - protein, 20 aa, Staphylococcus epidermidis
SPLMLLKLAVVWTLVQFFEG

SEQ ID NO: 1749674 - protein, 23 aa, Staphylococcus epidermidis
SRRFWPSLKFLLPILVGMLIAIG

SEQ ID NO: 1749675 - protein, 29 aa, Staphylococcus epidermidis
SSTLLTLFVVPVIYEILFTLKNKITKKFN

SEQ ID NO: 1749676 - protein, 24 aa, Staphylococcus epidermidis
SSWKWTLLAVVYPIATAYILTFVF

SEQ ID NO: 1749677 - protein, 23 aa, Staphylococcus epidermidis
STLGFGLMLYAFSSAGNLGFSNP

SEQ ID NO: 1749678 - protein, 23 aa, Staphylococcus epidermidis
STLNILFKHLLPKVLPSIFVIMI

SEQ ID NO: 1749679 - protein, 28 aa, Staphylococcus epidermidis
SVFKTIYFIVIFIVILVLLLSYIIGTIM

SEQ ID NO: 1749680 - protein, 31 aa, Staphylococcus epidermidis
SVIYSPLRLIILMVIAILGMAGWLFYAHQLI

SEQ ID NO: 1749681 - protein, 24 aa, Staphylococcus epidermidis
SVLLWTLIVFIFGNGMIAIAPHFG

SEQ ID NO: 1749682 - protein, 20 aa, Staphylococcus epidermidis
SVQPNVIKKPTAINSLTQEA

SEQ ID NO: 1749683 - protein, 26 aa, Staphylococcus epidermidis
SWTLIIYALLLLFFPIYHLLNKDTPL

SEQ ID NO: 1749684 - protein, 26 aa, Staphylococcus epidermidis
SYHIFRIFFILFVIAPLIGYFINVKL

SEQ ID NO: 1749685 - protein, 25 aa, Staphylococcus epidermidis
TAVAKYVSFWYPTIPNWLTAATTIL

SEQ ID NO: 1749686 - protein, 30 aa, Staphylococcus epidermidis
TDLLITLFVFLILIFFLVFTAQKLANIPGV

SEQ ID NO: 1749687 - protein, 24 aa, Staphylococcus epidermidis
TFAVIIIYFLFYIASMILSNQTGS

SEQ ID NO: 1749688 - protein, 18 aa, Staphylococcus epidermidis
TGICFLLALFFSPLIEVV

SEQ ID NO: 1749689 - protein, 26 aa, Staphylococcus epidermidis
THENTLNLFFLTLTIFNNGTFVIEII

SEQ ID NO: 1749690 - protein, 19 aa, Staphylococcus epidermidis
TIPITIALMELWFKLRGVN

SEQ ID NO: 1749691 - protein, 25 aa, Staphylococcus epidermidis
TKAVARSVLNALAKQLIKTFENTAD

SEQ ID NO: 1749692 - protein, 29 aa, Staphylococcus epidermidis
TLLNLFHGWPWYAIWLVLLGFGGGMIVPA

SEQ ID NO: 1749693 - protein, 30 aa, Staphylococcus epidermidis
TLLNLFHGWPWYAIWLVLLGFGGGMIVPAI

SEQ ID NO: 1749694 - protein, 21 aa, Staphylococcus epidermidis
TLLTLLFTVVVGVPLGLLAGY

SEQ ID NO: 1749695 - protein, 21 aa, Staphylococcus epidermidis
TLNILFKHLLPKVLPSIFVIM

SEQ ID NO: 1749696 - protein, 34 aa, Staphylococcus epidermidis
TLQMLNMRYSHWLRFVWPVVAFVLIFGGGLLITQ

SEQ ID NO: 1749697 - protein, 19 aa, Staphylococcus epidermidis
TLVALGISVAYIYSLYAFY

SEQ ID NO: 1749698 - protein, 19 aa, Staphylococcus epidermidis
TMGWLYWGMWSLVTSVDII

SEQ ID NO: 1749699 - protein, 35 aa, Staphylococcus epidermidis
TMTNILLFSYLSGSLPMFLIYLKNANTITYTISMN

SEQ ID NO: 1749700 - protein, 29 aa, Staphylococcus epidermidis
TNFWKQPHYIFSFTSACISIMTPLLIIYV

SEQ ID NO: 1749701 - protein, 37 aa, Staphylococcus epidermidis
TNSLISRFRQLATGAYKYNPFLINQVKNLNQLDGKVT

SEQ ID NO: 1749702 - protein, 17 aa, Staphylococcus epidermidis
TQLKPNNDPAVTGTPNT

SEQ ID NO: 1749703 - protein, 24 aa, Staphylococcus epidermidis
TRDKDSIRITYLGNVTLNKHIRQT

SEQ ID NO: 1749704 - protein, 18 aa, Staphylococcus epidermidis
TRYFAIILAFIQSIGMAF

SEQ ID NO: 1749705 - protein, 26 aa, Staphylococcus epidermidis
TSMSPILLAWIVAAVLRISLGSATVA

SEQ ID NO: 1749706 - protein, 36 aa, Staphylococcus epidermidis; identical to SEQ ID NO: 1591798

SEQ ID NO: 1749707 - protein, 20 aa, Staphylococcus epidermidis
TTLGTLFIGFSLLATGHAAF

SEQ ID NO: 1749708 - protein, 21 aa, Staphylococcus epidermidis
TTLGTLFIGFSLLATGHAAFD

SEQ ID NO: 1749709 - protein, 33 aa, Staphylococcus epidermidis
TVADITWIIRIISMVVIFIPVLATWRGIFQGYK

SEQ ID NO: 1749710 - protein, 34 aa, Staphylococcus epidermidis
TVADITWIIRIISMVVIFIPVLATWRGIFQGYKS

SEQ ID NO: 1749711 - protein, 24 aa, Staphylococcus epidermidis
TVDDLIRPLLLKYRIQFIEQKTQI

SEQ ID NO: 1749712 - protein, 23 aa, Staphylococcus epidermidis
TYGFLRLEIIVAFLNGLALIVIS

SEQ ID NO: 1749713 - protein, 26 aa, Staphylococcus epidermidis
TYPLQLAFFIILLMSHSLLAKVSLKE

SEQ ID NO: 1749714 - protein, 25 aa, Staphylococcus epidermidis
VAIPVFIYGFIFIALSERSVKWMFV

SEQ ID NO: 1749715 - protein, 36 aa, Staphylococcus epidermidis
VEWGTTFVTLVTFVILIILLKKFAWGPLKEVMDKRE

SEQ ID NO: 1749716 - protein, 21 aa, Staphylococcus epidermidis
VGALFVVIIMILVTWNDIQRY

SEQ ID NO: 1749717 - protein, 22 aa, Staphylococcus epidermidis
VGALFVVIIMILVTWNDIQRYF

SEQ ID NO: 1749718 - protein, 18 aa, Staphylococcus epidermidis
VGFLVIFIVAIFSIIFGI

SEQ ID NO: 1749719 - protein, 23 aa, Staphylococcus epidermidis
VIEIFFGIMLLIKRPASWLKKGI

SEQ ID NO: 1749720 - protein, 19 aa, Staphylococcus epidermidis
VIITAFFKPAGSLFYLLVL

SEQ ID NO: 1749721 - protein, 19 aa, Staphylococcus epidermidis
VKEDGMWKLDWDHSVIIPG

SEQ ID NO: 1749722 - protein, 23 aa, Staphylococcus epidermidis
VKSYYTIFLLCALVGILAGVPSV

SEQ ID NO: 1749723 - protein, 18 aa, Staphylococcus epidermidis
VLIFTLILGVILNKISQN

SEQ ID NO: 1749724 - protein, 17 aa, Staphylococcus epidermidis
VLIFTLMYPLLVFLAQR

SEQ ID NO: 1749725 - protein, 24 aa, Staphylococcus epidermidis
VLNNKWVWAIAFTNIFVYFVRYGV

SEQ ID NO: 1749726 - protein, 25 aa, Staphylococcus epidermidis
VLNNKWVWAIAFTNIFVYFVRYGVL

SEQ ID NO: 1749727 - protein, 19 aa, Staphylococcus epidermidis
VNYDYWILPGRYKRHTKEY

SEQ ID NO: 1749728 - protein, 19 aa, Staphylococcus epidermidis
VSAGYKWFFAYPDQHIETV

SEQ ID NO: 1749729 - protein, 29 aa, Staphylococcus epidermidis
VSLPSFFIGLILLYIFSLKLNILPTSDEG

SEQ ID NO: 1749730 - protein, 24 aa, Staphylococcus epidermidis
VSVGLVFLLQILLNVLEFSNFGKS

SEQ ID NO: 1749731 - protein, 17 aa, Staphylococcus epidermidis
VSVIFSPLTFIAGVYGM

SEQ ID NO: 1749732 - protein, 19 aa, Staphylococcus epidermidis
VSWQQIISGFFFAFAALTY

SEQ ID NO: 1749733 - protein, 22 aa, Staphylococcus epidermidis
VTLLTLLFTVVVGVPLGLLAGY

SEQ ID NO: 1749734 - protein, 19 aa, Staphylococcus epidermidis
VVDMWFVILPVVMSIGTIA

SEQ ID NO: 1749735 - protein, 24 aa, Staphylococcus epidermidis
VVFIIFYSIMYWITSRIYYTMING

SEQ ID NO: 1749736 - protein, 21 aa, Staphylococcus epidermidis
VVIALLPNALLGELLKFFKEG

SEQ ID NO: 1749737 - protein, 32 aa, Staphylococcus epidermidis; identical to SEQ ID NO: 1578471

SEQ ID NO: 1749738 - protein, 41 aa, Staphylococcus epidermidis
VYDWITNWFGWLFLIIVFILDVFLIFLAFSRYGRFKLGSDE

SEQ ID NO: 1749739 - protein, 27 aa, Staphylococcus epidermidis
WGVMTQGWWFPVMASAFLIFTIVIMFI

SEQ ID NO: 1749740 - protein, 26 aa, Staphylococcus epidermidis
WNNHKYAFLLLAFVNILLLGMFLQKY

SEQ ID NO: 1749741 - protein, 24 aa, Staphylococcus epidermidis
YETITFLTLPPKDVFLASVLIGTL

SEQ ID NO: 1749742 - protein, 38 aa, Staphylococcus epidermidis; identical to SEQ ID NO: 1592900

SEQ ID NO: 1749743 - protein, 18 aa, Staphylococcus epidermidis
YIHWFKTNKEITIKDLML

SEQ ID NO: 1749744 - protein, 31 aa, Staphylococcus epidermidis
YKGIMRDWEPGKKIHFIGHSMGGQTIRQMEE

SEQ ID NO: 1749745 - protein, 40 aa, Staphylococcus epidermidis
YKQEWFIVLSLLFIFPLGLFLMWKFSKWPSIARTIITVAI

SEQ ID NO: 1749746 - protein, 21 aa, Staphylococcus epidermidis
YLFNWFFFVYHLGVLITISMM

SEQ ID NO: 1749747 - protein, 25 aa, Staphylococcus epidermidis
YPLQLAFFIILLMSHSLLAKVSLKE

SEQ ID NO: 1749748 - protein, 19 aa, Staphylococcus epidermidis
YSAPNPLGGTLMLQGLKID

SEQ ID NO: 1749749 - protein, 18 aa, Staphylococcus epidermidis
YSMPVLALILVAFFSKRT

SEQ ID NO: 1749750 - protein, 24 aa, Staphylococcus epidermidis
YTYGFLRLEIIVAFLNGLALIVIS

SEQ ID NO: 1749751 - protein, 17 aa, Staphylococcus epidermidis
YVALFLGMILLAIVAYY

SEQ ID NO: 1749752 - protein, 17 aa, Staphylococcus epidermidis
YVFLVGIFFIMTQTSEF

SEQ ID NO: 1749753 - protein, 22 aa, Staphylococcus epidermidis
YYLFNWFFFVYHLGVLITISMM

SEQ ID NO: 1749754 - protein, 24 aa, Staphylococcus epidermidis
AANVINGLIHLNVAQREVMINANT

SEQ ID NO: 1749755 - protein, 26 aa, Staphylococcus epidermidis
ADHLTAKVKVILADGSFVTVNVPVKV

SEQ ID NO: 1749756 - protein, 20 aa, Staphylococcus epidermidis
AFLIFTIIIMFIAGTGKYGL

SEQ ID NO: 1749757 - protein, 27 aa, Staphylococcus epidermidis
AGIPIAAIGLLAPWVAGAAMALSSVSV

SEQ ID NO: 1749758 - protein, 25 aa, Staphylococcus epidermidis
AGISPFLMLQYSIYPILLGVCGLVA

SEQ ID NO: 1749759 - protein, 21 aa, Staphylococcus epidermidis
AGIVLIFMIIVLGGLVVQVPM

SEQ ID NO: 1749760 - protein, 31 aa, Staphylococcus epidermidis
AGVIVVLAFFLLMIVFRSILVPLKAVLGFIL

SEQ ID NO: 1749761 - protein, 22 aa, Staphylococcus epidermidis
AIFTSIIWLLGSFAFGYYISNF

SEQ ID NO: 1749762 - protein, 45 aa, Staphylococcus epidermidis
AIIALFCFKLYQHYYYKLFAIATWILLIGSFFQWFDSAFNGFSLP

SEQ ID NO: 1749763 - protein, 25 aa, Staphylococcus epidermidis
AIILGILTYWLFAQSFLIIAPHVQR

SEQ ID NO: 1749764 - protein, 24 aa, Staphylococcus epidermidis
AISWPVLAIIGVIVALIGIIVWLW

SEQ ID NO: 1749765 - protein, 18 aa, Staphylococcus epidermidis
AIYLSLFKVFGPLFTVLP

SEQ ID NO: 1749766 - protein, 28 aa, Staphylococcus epidermidis
ALIVLVIIIIIFFYTKIKLYSILVVLFT

SEQ ID NO: 1749767 - protein, 27 aa, Staphylococcus epidermidis
ALIVLVIIITIFFYTKIKLYSILVVLF

SEQ ID NO: 1749768 - protein, 21 aa, Staphylococcus epidermidis
ALLPALFWGSVVIINVFVGGG

SEQ ID NO: 1749769 - protein, 31 aa, Staphylococcus epidermidis
ALVITLSMLLTLWIVPWLSAKKARKLKQQVT

SEQ ID NO: 1749770 - protein, 22 aa, Staphylococcus epidermidis
ALVSFIWFSVFGVLGIEAGKKD

SEQ ID NO: 1749771 - protein, 31 aa, Staphylococcus epidermidis
ANFYYIFFEKIGFLLVLLLGCVLVYVGYVYF

SEQ ID NO: 1749772 - protein, 27 aa, Staphylococcus epidermidis
ANKSNKYAIRKFTVGTASIVIGATLLF

SEQ ID NO: 1749773 - protein, 23 aa, Staphylococcus epidermidis
AQVNPHFFFNAINTISALVRIDS

SEQ ID NO: 1749774 - protein, 22 aa, Staphylococcus epidermidis
ARVKILKMILLVLAVMLAGASI

SEQ ID NO: 1749775 - protein, 22 aa, Staphylococcus epidermidis
ASIYTIWLVYAAGLDYLLLTML

SEQ ID NO: 1749776 - protein, 27 aa, Staphylococcus epidermidis
ATISVSWIWFVFLAILGRITGKIDKSG

SEQ ID NO: 1749777 - protein, 19 aa, Staphylococcus epidermidis
AYVFNFFSRLLTALIGLVT

SEQ ID NO: 1749778 - protein, 21 aa, Staphylococcus epidermidis
DAHWFGFPVPFRFSGFGFDVS

SEQ ID NO: 1749779 - protein, 18 aa, Staphylococcus epidermidis
DALQLRFILDWNSQSHRP

SEQ ID NO: 1749780 - protein, 23 aa, Staphylococcus epidermidis
DDYKLIIFYFLIALGEEFLFREV

SEQ ID NO: 1749781 - protein, 25 aa, Staphylococcus epidermidis
DEDHKLQYDYAINLANNVLDKENGT

SEQ ID NO: 1749782 - protein, 18 aa, Staphylococcus epidermidis
DHPFVYWATFSNAADLLD

SEQ ID NO: 1749783 - protein, 25 aa, Staphylococcus epidermidis
DITILGGDLLLIPKAIKASKSTIRN

SEQ ID NO: 1749784 - protein, 26 aa, Staphylococcus epidermidis
DKARPKIEAIVPQVSKKRDALNAIQE

SEQ ID NO: 1749785 - protein, 21 aa, Staphylococcus epidermidis
DKMEFQMLYGFRTELAQKIAN

SEQ ID NO: 1749786 - protein, 24 aa, Staphylococcus epidermidis
DKQKLTVFIILGSVLIKLILNYPL

SEQ ID NO: 1749787 - protein, 22 aa, Staphylococcus epidermidis
DNSFQDFVIDYNGDTKVMTVTY

SEQ ID NO: 1749788 - protein, 26 aa, Staphylococcus epidermidis
DNVSPAITISVIDKTPPAVKAISNKT

SEQ ID NO: 1749789 - protein, 25 aa, Staphylococcus epidermidis
DPPIQSYVFVYILIVTGGRFGEVQK

SEQ ID NO: 1749790 - protein, 20 aa, Staphylococcus epidermidis
DRAVELYYYVKGGRVDYGAA

SEQ ID NO: 1749791 - protein, 39 aa, Staphylococcus epidermidis
DRRTASSTWAWLFVLFVLPVIGFILYLFLGRTVSKKKME

SEQ ID NO: 1749792 - protein, 26 aa, Staphylococcus epidermidis
DSDGNYHIQIPSDERFKVGQQLIVKV

SEQ ID NO: 1749793 - protein, 17 aa, Staphylococcus epidermidis
DTCIPNFLFYNVPLMIF

SEQ ID NO: 1749794 - protein, 17 aa, Staphylococcus epidermidis
DTCIPNFLFYNVPLMVF

SEQ ID NO: 1749795 - protein, 22 aa, Staphylococcus epidermidis
DYDQSFINIKFKGASKLSDKSE

SEQ ID NO: 1749796 - protein, 21 aa, Staphylococcus epidermidis
DYNLKRQFNKALKEAKGILNK

SEQ ID NO: 1749797 - protein, 26 aa, Staphylococcus epidermidis
DYVKSYYIIFLLCALVGILAGVPSVG

SEQ ID NO: 1749798 - protein, 21 aa, Staphylococcus epidermidis
EARAYLKYIKAESDLKHVADK

SEQ ID NO: 1749799 - protein, 21 aa, Staphylococcus epidermidis
EAYVFNFFSRLLTALIGLVTA

SEQ ID NO: 1749800 - protein, 33 aa, Staphylococcus epidermidis
EDGKYQFDGLKNGLTYKITFETPEGYTPTLKHS

SEQ ID NO: 1749801 - protein, 23 aa, Staphylococcus epidermidis
EGDKIGVPGLVRGLHDMHEKEGK

SEQ ID NO: 1749802 - protein, 24 aa, Staphylococcus epidermidis
EIGVWAPILLLLARVLQGFSTGGE

SEQ ID NO: 1749803 - protein, 17 aa, Staphylococcus epidermidis
EIYIVKAPQPEQVATHT

SEQ ID NO: 1749804 - protein, 26 aa, Staphylococcus epidermidis
EKPLSNVLVTLTYPDGTSKSVRTDED

SEQ ID NO: 1749805 - protein, 26 aa, Staphylococcus epidermidis
EKPLSNVLVTLTYPDGTSKSVRTDEE

SEQ ID NO: 1749806 - protein, 25 aa, Staphylococcus epidermidis
ELDFWTWMMIIPMVLGSVLIGPMIH

SEQ ID NO: 1749807 - protein, 24 aa, Staphylococcus epidermidis
ELSTLIYLIFPILAIFVDKRGNFL

SEQ ID NO: 1749808 - protein, 36 aa, Staphylococcus epidermidis
ENVKHSKKLLLCISFLLITIFIGGCGFINKDDSKET

SEQ ID NO: 1749809 - protein, 25 aa, Staphylococcus epidermidis
EPGTKTITTPILVNPITGEKVGEGK

SEQ ID NO: 1749810 - protein, 21 aa, Staphylococcus epidermidis
EPLKFQGGLTKRSYFNKNGHV

SEQ ID NO: 1749811 - protein, 39 aa, Staphylococcus epidermidis; identical to SEQ ID NO: 1593226

SEQ ID NO: 1749812 - protein, 18 aa, Staphylococcus epidermidis
ETLLLIAVSYVLIVFQSY

SEQ ID NO: 1749813 - protein, 23 aa, Staphylococcus epidermidis
ETTKKLIIAKAEAKQMIKELSQK

SEQ ID NO: 1749814 - protein, 25 aa, Staphylococcus epidermidis
EVKGSLLLELAVVFGISALVTSFLK

SEQ ID NO: 1749815 - protein, 18 aa, Staphylococcus epidermidis
EVLKRYWLQIFGGIAVGT

SEQ ID NO: 1749816 - protein, 37 aa, Staphylococcus epidermidis
EYLMRMFIPNLFSLLASILVLWFYFRKSIPKTFDISS

SEQ ID NO: 1749817 - protein, 17 aa, Staphylococcus epidermidis
FAFLPFVDQLFNGFSAP

SEQ ID NO: 1749818 - protein, 17 aa, Staphylococcus epidermidis
FAVFMTPLLFVLKQDKN

SEQ ID NO: 1749819 - protein, 25 aa, Staphylococcus epidermidis
FEPALVAAIAVLVIACPCALGLATP

SEQ ID NO: 1749820 - protein, 24 aa, Staphylococcus epidermidis
FERFSHFLIIPFLSIYLIQEFSYS

SEQ ID NO: 1749821 - protein, 19 aa, Staphylococcus epidermidis
FFISLIHLMLILLSLFYPL

SEQ ID NO: 1749822 - protein, 17 aa, Staphylococcus epidermidis
FFITLTLIIWQPKGLDI

SEQ ID NO: 1749823 - protein, 32 aa, Staphylococcus epidermidis
FGDGLINVFTQLGPLFLWTAKGLDNLGKKFQN

SEQ ID NO: 1749824 - protein, 17 aa, Staphylococcus epidermidis
FGIFSIPITVIWIVAIT

SEQ ID NO: 1749825 - protein, 17 aa, Staphylococcus epidermidis
FGIIAFFHESRLGKWID

SEQ ID NO: 1749826 - protein, 18 aa, Staphylococcus epidermidis
FGQYAMLFLAPTGLVMAT

SEQ ID NO: 1749827 - protein, 23 aa, Staphylococcus epidermidis
FIGHNHFFILIFGRLVQGVGSAA

SEQ ID NO: 1749828 - protein, 17 aa, Staphylococcus epidermidis
FILLISTSRVYLGVHYP

SEQ ID NO: 1749829 - protein, 29 aa, Staphylococcus epidermidis
FKNKTWINIISWLLIIVLSGLNVYLIIQT

SEQ ID NO: 1749830 - protein, 30 aa, Staphylococcus epidermidis
FKNKTWINIISWLLIIVLSGLNVYLIIQTF

SEQ ID NO: 1749831 - protein, 25 aa, Staphylococcus epidermidis
FLALGITFLALWILTNIFGNANAIP

SEQ ID NO: 1749832 - protein, 24 aa, Staphylococcus epidermidis
FLRLYILTLMFFSANAILNVFIPL

SEQ ID NO: 1749833 - protein, 19 aa, Staphylococcus epidermidis
FNNKLVFPFIIACGFIADS

SEQ ID NO: 1749834 - protein, 26 aa, Staphylococcus epidermidis
FNQILANRFTYFGLGLLLILLSTYIF

SEQ ID NO: 1749835 - protein, 18 aa, Staphylococcus epidermidis
FPVMMFGVPAAALAMYHT

SEQ ID NO: 1749836 - protein, 17 aa, Staphylococcus epidermidis
FRRIISFFLVFTMLFSV

SEQ ID NO: 1749837 - protein, 21 aa, Staphylococcus epidermidis
FSHYVILFLALLTIIFGCVGA

SEQ ID NO: 1749838 - protein, 29 aa, Staphylococcus epidermidis
FSLIAIGFLCIFIFSFIGLTIAAIAFQNI

SEQ ID NO: 1749839 - protein, 25 aa, Staphylococcus epidermidis
FSYYEAIVIGFYFIYRFAIPHEKDI

SEQ ID NO: 1749840 - protein, 26 aa, Staphylococcus epidermidis
FSYYEAIVIGFYFIYRFAIPHEKDIV

SEQ ID NO: 1749841 - protein, 25 aa, Staphylococcus epidermidis
FTHTWITPILFIDIVIFTPIIEELL

SEQ ID NO: 1749842 - protein, 25 aa, Staphylococcus epidermidis
FVLQLIHFTFFVIITLIIAYLTQLL

SEQ ID NO: 1749843 - protein, 26 aa, Staphylococcus epidermidis
FVNILLLGMFLQKYPITSLLIFISLL

SEQ ID NO: 1749844 - protein, 17 aa, Staphylococcus epidermidis
FYYKDIIVCFVAVAFFN

SEQ ID NO: 1749845 - protein, 17 aa, Staphylococcus epidermidis
GAFWTLLLVIALSILIL

SEQ ID NO: 1749846 - protein, 30 aa, Staphylococcus epidermidis
GAVIAALLIIFFRWGWADPLASVIVAILVL

SEQ ID NO: 1749847 - protein, 34 aa, Staphylococcus epidermidis
GDYIKPFIALFLLSMGFYILYQFLFKRAHEHHHH

SEQ ID NO: 1749848 - protein, 22 aa, Staphylococcus epidermidis
GEAIVILIFYLLHKKTMITIAM

SEQ ID NO: 1749849 - protein, 36 aa, Staphylococcus epidermidis
GEDGVVSNGFIVAVAIVLAIFGLAKKSRKDDDDQDG

SEQ ID NO: 1749850 - protein, 23 aa, Staphylococcus epidermidis
GEFEFWFALIKVVTIVLMIIAGL

SEQ ID NO: 1749851 - protein, 28 aa, Staphylococcus epidermidis
GFSLPQRRWVYFLALSTSVLIALFIQHL

SEQ ID NO: 1749852 - protein, 18 aa, Staphylococcus epidermidis
GGAITAVALSRKESRDKL

SEQ ID NO: 1749853 - protein, 18 aa, Staphylococcus epidermidis
GGDLLLVPKAIKASKATI

SEQ ID NO: 1749854 - protein, 25 aa, Staphylococcus epidermidis
GHGLKMFIYIMILGALIAAFFANDG

SEQ ID NO: 1749855 - protein, 20 aa, Staphylococcus epidermidis
GIIILLTLIIGLKLNTFISL

SEQ ID NO: 1749856 - protein, 21 aa, Staphylococcus epidermidis
GIIVLLVILLLMNAIAILLRN

SEQ ID NO: 1749857 - protein, 23 aa, Staphylococcus epidermidis
GILSLFIILIPVVIIALLILFCF

SEQ ID NO: 1749858 - protein, 26 aa, Staphylococcus epidermidis
GIPIAACGLLAPWIAGAAMALSSVSV

SEQ ID NO: 1749859 - protein, 20 aa, Staphylococcus epidermidis
GKNIPFMLGLFSGGLIFSIV

SEQ ID NO: 1749860 - protein, 24 aa, Staphylococcus epidermidis
GKPIDLFFIWFAANLGILGIVYGA

SEQ ID NO: 1749861 - protein, 24 aa, Staphylococcus epidermidis
GLADIIPWVVIVLAITMIVIFVKR

SEQ ID NO: 1749862 - protein, 25 aa, Staphylococcus epidermidis
GLDYLLLTMLLYIPGLLVYSYVQRD

SEQ ID NO: 1749863 - protein, 27 aa, Staphylococcus epidermidis
GLIISVLGAWLGWTLLAGELPFIVAKD

SEQ ID NO: 1749864 - protein, 43 aa, Staphylococcus epidermidis; identical to SEQ ID NO: 1593694

SEQ ID NO: 1749865 - protein, 25 aa, Staphylococcus epidermidis
GNGAFLMFIAFYFKKIRTQKIVFSI

SEQ ID NO: 1749866 - protein, 24 aa, Staphylococcus epidermidis
GPIFRPIMRPLFTLPGRSTVDNLA

SEQ ID NO: 1749867 - protein, 17 aa, Staphylococcus epidermidis
GQIGKEGAAVGIGGLNN

SEQ ID NO: 1749868 - protein, 29 aa, Staphylococcus epidermidis
GQVANQVLGFLFISLINGLVTAFQSLWTV

SEQ ID NO: 1749869 - protein, 24 aa, Staphylococcus epidermidis
GSLIKYTEMKWLTPDGHYIHGKGI

SEQ ID NO: 1749870 - protein, 23 aa, Staphylococcus epidermidis
GTKYLIFDNMSFTAPTKKPIIKP

SEQ ID NO: 1749871 - protein, 23 aa, Staphylococcus epidermidis
GTTFSLSMTASTGGAKNLQQVQF

SEQ ID NO: 1749872 - protein, 18 aa, Staphylococcus epidermidis
GVFQIMSGTLHNTVGSGI

SEQ ID NO: 1749873 - protein, 20 aa, Staphylococcus epidermidis
GVSFIIISLIIRAIVYKTTK

SEQ ID NO: 1749874 - protein, 21 aa, Staphylococcus epidermidis
GVSFIIISLIIRAIVYKTTKQ

SEQ ID NO: 1749875 - protein, 28 aa, Staphylococcus epidermidis
GYSNNKPVYLTHTWTTNDGAIAEESIQV

SEQ ID NO: 1749876 - protein, 21 aa, Staphylococcus epidermidis
HAPILLLLGRVLQGLSAACLL

SEQ ID NO: 1749877 - protein, 29 aa, Staphylococcus epidermidis
HDIQTYHLIIYYLVILFGLEPIRAINNLI

SEQ ID NO: 1749878 - protein, 20 aa, Staphylococcus epidermidis
HFLYTFMFSMIIGELIRATN

SEQ ID NO: 1749879 - protein, 20 aa, Staphylococcus epidermidis
HFWVIMIIIGFLFVCKEVFY

SEQ ID NO: 1749880 - protein, 18 aa, Staphylococcus epidermidis
HHKDIRLSDTDKIDPIVI

SEQ ID NO: 1749881 - protein, 26 aa, Staphylococcus epidermidis
HIQNILYFLFLPWLVLHLPLSTNIFY

SEQ ID NO: 1749882 - protein, 26 aa, Staphylococcus epidermidis
HKNIMLWAAFFALTFFIIYAARTIFI

SEQ ID NO: 1749883 - protein, 34 aa, Staphylococcus epidermidis
HQISIFSLFIFYKILILWTLPTLIFTIAMGLFVT

SEQ ID NO: 1749884 - protein, 17 aa, Staphylococcus epidermidis
HQKAEVIRGLINDNEEA

SEQ ID NO: 1749885 - protein, 19 aa, Staphylococcus epidermidis
IAEESIQVASITPTLDSKA

SEQ ID NO: 1749886 - protein, 19 aa, Staphylococcus epidermidis
IAGALWLIAGIMLLVRKPQ

SEQ ID NO: 1749887 - protein, 32 aa, Staphylococcus epidermidis
IALFLGLSFLWFPIFSIIFSLITLLLVLSVSA

SEQ ID NO: 1749888 - protein, 24 aa, Staphylococcus epidermidis
IANIFIPLIPAFIGAGLIGGIAAI

SEQ ID NO: 1749889 - protein, 17 aa, Staphylococcus epidermidis
IAYIMLFIVIKTLGRIW

SEQ ID NO: 1749890 - protein, 19 aa, Staphylococcus epidermidis
IDIVIFTPIIEELLFRHLI

SEQ ID NO: 1749891 - protein, 17 aa, Staphylococcus epidermidis
IDQLSLMSTFPNFKEKE

SEQ ID NO: 1749892 - protein, 25 aa, Staphylococcus epidermidis
IDYLLLTMLLYIPGIIVYIVVQKNN

SEQ ID NO: 1749893 - protein, 25 aa, Staphylococcus epidermidis
IDYLLLTMLLYIPGIIVYVVVQKNN

SEQ ID NO: 1749894 - protein, 18 aa, Staphylococcus epidermidis
IDYPLLITYVVLCLIGLV

SEQ ID NO: 1749895 - protein, 22 aa, Staphylococcus epidermidis
IEIFFGIMLLIKRPASWLKKGI

SEQ ID NO: 1749896 - protein, 24 aa, Staphylococcus epidermidis
IETTKKLIIAKAEAKQVIKELSQK

SEQ ID NO: 1749897 - protein, 18 aa, Staphylococcus epidermidis
IFEIFPYIVIASAATILY

SEQ ID NO: 1749898 - protein, 27 aa, Staphylococcus epidermidis
IFFIHNQWLLIFSFILIGINNLTMNTQ

SEQ ID NO: 1749899 - protein, 23 aa, Staphylococcus epidermidis
IFIIITILFFLIALVLYVFNIIK

SEQ ID NO: 1749900 - protein, 17 aa, Staphylococcus epidermidis
IFIQWWDWLNQLFHFDL

SEQ ID NO: 1749901 - protein, 24 aa, Staphylococcus epidermidis
IFISFIYFINFIFFLFSSIEEKRS

SEQ ID NO: 1749902 - protein, 19 aa, Staphylococcus epidermidis
IFMANLIMYVLFAIVAITQ

SEQ ID NO: 1749903 - protein, 33 aa, Staphylococcus epidermidis
IFSLLGQHAFVLGLIVLLFIPLTVVLNVQEGVI

SEQ ID NO: 1749904 - protein, 18 aa, Staphylococcus epidermidis
IFYALIFGLDASSIDLGS

SEQ ID NO: 1749905 - protein, 17 aa, Staphylococcus epidermidis
IFYIIYSKYIMHLDGYL

SEQ ID NO: 1749906 - protein, 18 aa, Staphylococcus epidermidis
IGDVSLKYYPFKEFNYQF

SEQ ID NO: 1749907 - protein, 32 aa, Staphylococcus epidermidis
IGLIVAILVAVLFFILFLIANHSKKKVKNQTE

SEQ ID NO: 1749908 - protein, 32 aa, Staphylococcus epidermidis
IGLIVAILVAVLFFILFLVANHSKKKVKNQTE

SEQ ID NO: 1749909 - protein, 32 aa, Staphylococcus epidermidis
IGLIVAILVAVLFFVLFLVANHSKKKVKNQTE

SEQ ID NO: 1749910 - protein, 22 aa, Staphylococcus epidermidis
IGSYIFMFLIGTVAIAAIVGIF

SEQ ID NO: 1749911 - protein, 27 aa, Staphylococcus epidermidis
IHNIYFYNIFHFSIFIILSLILAHLFK

SEQ ID NO: 1749912 - protein, 31 aa, Staphylococcus epidermidis; identical to SEQ ID NO: 1593291

SEQ ID NO: 1749913 - protein, 19 aa, Staphylococcus epidermidis
IIILLILLIVSIVAAILIG

SEQ ID NO: 1749914 - protein, 26 aa, Staphylococcus epidermidis
IISSYFIFLFILLLSTLVVYLFYVNN

SEQ ID NO: 1749915 - protein, 33 aa, Staphylococcus epidermidis
IIVTPTITLLLIGLLTIFIIMPLAGFVSDGLVY

SEQ ID NO: 1749916 - protein, 23 aa, Staphylococcus epidermidis
IKHRDLIRMLLMKQDAFLTENNK

SEQ ID NO: 1749917 - protein, 24 aa, Staphylococcus epidermidis
IKRNKAYVLLLLGSIFFVFGYSQI

SEQ ID NO: 1749918 - protein, 24 aa, Staphylococcus epidermidis
IKTFVMLFFELLTLFIIVSFIVSL

SEQ ID NO: 1749919 - protein, 23 aa, Staphylococcus epidermidis
ILETIRNVEPIVIVKPKANEIIR

SEQ ID NO: 1749920 - protein, 28 aa, Staphylococcus epidermidis
ILGDATWGFVLSWLPLHSKYLVVSVYLA

SEQ ID NO: 1749921 - protein, 19 aa, Staphylococcus epidermidis
ILIILCCLLTIIVFKRSEK

SEQ ID NO: 1749922 - protein, 23 aa, Staphylococcus epidermidis
ILPSFISLILYRFELNLRSASIL

SEQ ID NO: 1749923 - protein, 30 aa, Staphylococcus epidermidis
ILSGKMLFFYIITIIILIVLVIFYIKEAQF

SEQ ID NO: 1749924 - protein, 23 aa, Staphylococcus epidermidis
ILTILLVVGFITNVVLAFVIIFL

SEQ ID NO: 1749925 - protein, 22 aa, Staphylococcus epidermidis
ILTLLLLIMIKRLNIIILLLMF

SEQ ID NO: 1749926 - protein, 20 aa, Staphylococcus epidermidis
ILVQLFLISMLFTDSAYQFA

SEQ ID NO: 1749927 - protein, 22 aa, Staphylococcus epidermidis
ILYKRIFFTCLILVIYIIGSNI

SEQ ID NO: 1749928 - protein, 23 aa, Staphylococcus epidermidis
ILYQNWFFITHWKLSLYNLAFLL

SEQ ID NO: 1749929 - protein, 17 aa, Staphylococcus epidermidis
INIWRILVVTGLRGQEI

SEQ ID NO: 1749930 - protein, 27 aa, Staphylococcus epidermidis
INKQVIWVFLIPVIVAIIHTLAAFRII

SEQ ID NO: 1749931 - protein, 28 aa, Staphylococcus epidermidis
INKQVIWVFLIPVIVAIIHTLAAFRIIY

SEQ ID NO: 1749932 - protein, 25 aa, Staphylococcus epidermidis
IPASIIGLAIWFIVGLQFKGDANTQ

SEQ ID NO: 1749933 - protein, 18 aa, Staphylococcus epidermidis
IQIIGFLSFLAILTIITL

SEQ ID NO: 1749934 - protein, 17 aa, Staphylococcus epidermidis
ISFFLLITGFLVSYVLG

SEQ ID NO: 1749935 - protein, 27 aa, Staphylococcus epidermidis
ISISIFIIMMIILNLLLPGTGLLLVGL

SEQ ID NO: 1749936 - protein, 18 aa, Staphylococcus epidermidis
ISLKKQLPYIPKQRLYTL

SEQ ID NO: 1749937 - protein, 30 aa, Staphylococcus epidermidis
ISLLILNLISIIILLFLALLSPIYELVEIL

SEQ ID NO: 1749938 - protein, 20 aa, Staphylococcus epidermidis
ISMTFLYSFLTTGTPYWFVI

SEQ ID NO: 1749939 - protein, 30 aa, Staphylococcus epidermidis
ISSTLLTLFVVPVIYEILFTLKNKITKKFN

SEQ ID NO: 1749940 - protein, 23 aa, Staphylococcus epidermidis
ISSYFIFLSILLLSTLVVYLFYV

SEQ ID NO: 1749941 - protein, 25 aa, Staphylococcus epidermidis
ISTLADIFMVIFSILVFSKILKLRE

SEQ ID NO: 1749942 - protein, 19 aa, Staphylococcus epidermidis
ITAYLFWTVSCVIGAIFGE

SEQ ID NO: 1749943 - protein, 20 aa, Staphylococcus epidermidis
ITLMLIAIYIFYEAIERFKN

SEQ ID NO: 1749944 - protein, 27 aa, Staphylococcus epidermidis
ITNVVLAFVIIFLERDRRTASSTWAWL

SEQ ID NO: 1749945 - protein, 25 aa, Staphylococcus epidermidis
ITTTTYLFLFLFGVIVVLILEHSNV

SEQ ID NO: 1749946 - protein, 19 aa, Staphylococcus epidermidis
ITYTFTDYVDKYENIKAHL

SEQ ID NO: 1749947 - protein, 18 aa, Staphylococcus epidermidis
IVAIAVAIALIAIITKFV

SEQ ID NO: 1749948 - protein, 22 aa, Staphylococcus epidermidis
IVAIVIVTLVQKFLFASYTVKG

SEQ ID NO: 1749949 - protein, 19 aa, Staphylococcus epidermidis
IVAYIMLFIVIKTLGRIWT

SEQ ID NO: 1749950 - protein, 32 aa, Staphylococcus epidermidis
IVSFCFIFLLLLFFRYILKRYFNYMLNYKVWY

SEQ ID NO: 1749951 - protein, 17 aa, Staphylococcus epidermidis
IVSLFSWGLGYFGQPHI

SEQ ID NO: 1749952 - protein, 17 aa, Staphylococcus epidermidis
IVTFLIARFIKIFTPLA

SEQ ID NO: 1749953 - protein, 33 aa, Staphylococcus epidermidis
IVVGIAIFTFIIWISLVQPGQFEPALVAAIAVL

SEQ ID NO: 1749954 - protein, 17 aa, Staphylococcus epidermidis
IWLILSIIPISIILGIG

SEQ ID NO: 1749955 - protein, 25 aa, Staphylococcus epidermidis
IYDYLLNLIAMFSIFMCLVLGAQQI

SEQ ID NO: 1749956 - protein, 27 aa, Staphylococcus epidermidis
IYFYVHQIWLFIVLYALFQGLFAPAMP

SEQ ID NO: 1749957 - protein, 17 aa, Staphylococcus epidermidis
IYGYLFTIGLYLVIGPF

SEQ ID NO: 1749958 - protein, 25 aa, Staphylococcus epidermidis
IYISLLILTIFIGGCGFINKEDSKE

SEQ ID NO: 1749959 - protein, 20 aa, Staphylococcus epidermidis
IYSYFLNYGLLFVSSIFLVI

SEQ ID NO: 1749960 - protein, 24 aa, Staphylococcus epidermidis
KADPRNVGGGGAFGAFVSTDRNGM

SEQ ID NO: 1749961 - protein, 23 aa, Staphylococcus epidermidis
KAKRELGFVLMALNIRKVTAQRA

SEQ ID NO: 1749962 - protein, 40 aa, Staphylococcus epidermidis
KEKFNGLLVTTPHQVFLNWFSHDPAFDYFKNMDSTTVATV

SEQ ID NO: 1749963 - protein, 39 aa, Staphylococcus epidermidis
KEQKHTGWLIVLSIIFVLLIAALLYGAYYTYNHYISDEQ

SEQ ID NO: 1749964 - protein, 19 aa, Staphylococcus epidermidis
KFMAPLSFVLASLAIYWAM

SEQ ID NO: 1749965 - protein, 23 aa, Staphylococcus epidermidis
KGAPWNIVIFSIGMYLVIFGLKN

SEQ ID NO: 1749966 - protein, 24 aa, Staphylococcus epidermidis
KGLFYSVLFWLCILSFFSVLNEMV

SEQ ID NO: 1749967 - protein, 25 aa, Staphylococcus epidermidis
KGLTPIFFFLVFTFFMHVLFTNGGI

SEQ ID NO: 1749968 - protein, 39 aa, Staphylococcus epidermidis
KHAFNTLAHIIIWDTDQQPLVFELPELSLQNALVTSEVV

SEQ ID NO: 1749969 - protein, 25 aa, Staphylococcus epidermidis
KHPERIHIHRSHGINYLVITEPIRS

SEQ ID NO: 1749970 - protein, 20 aa, Staphylococcus epidermidis
KIALGIGGAITAVALSRKES

SEQ ID NO: 1749971 - protein, 28 aa, Staphylococcus epidermidis
KIKLSYTPPYFYLLITVSCIGIILSILF

SEQ ID NO: 1749972 - protein, 27 aa, Staphylococcus epidermidis
KILKKLTLGIGIFATLLTSLILGIKRH

SEQ ID NO: 1749973 - protein, 21 aa, Staphylococcus epidermidis
KIYVIFLGLAFILSFSTLKFA

SEQ ID NO: 1749974 - protein, 28 aa, Staphylococcus epidermidis
KKKKNVILIFWIISLVSLLMMVVISQPH

SEQ ID NO: 1749975 - protein, 23 aa, Staphylococcus epidermidis
KKNILGYILWVGVLFIFTTLNMA

SEQ ID NO: 1749976 - protein, 25 aa, Staphylococcus epidermidis
KLARIPFWFLIKGLTPIFFFLVFTF

SEQ ID NO: 1749977 - protein, 36 aa, Staphylococcus epidermidis
KLARIPFWFLIKGLTPIFFFLVFTFSMHVLFTNGGI

SEQ ID NO: 1749978 - protein, 25 aa, Staphylococcus epidermidis
KLDYTLFIFIIVLAIIGIVRLITGN

SEQ ID NO: 1749979 - protein, 32 aa, Staphylococcus epidermidis
KLNQVWPILLFLPFVVFIFIRIHVHYENIACE

SEQ ID NO: 1749980 - protein, 18 aa, Staphylococcus epidermidis
KLTYQRFLNGHPTFNKQN

SEQ ID NO: 1749981 - protein, 19 aa, Staphylococcus epidermidis
KLYAILLLGIMVFLSVVIL

SEQ ID NO: 1749982 - protein, 21 aa, Staphylococcus epidermidis
KMMIPVYLKHLIIAIPLTING

SEQ ID NO: 1749983 - protein, 17 aa, Staphylococcus epidermidis
KNILGYILWVGVLFIFT

SEQ ID NO: 1749984 - protein, 25 aa, Staphylococcus epidermidis
KPNVNLIIYLYILLAIVMGVFLTTS

SEQ ID NO: 1749985 - protein, 18 aa, Staphylococcus epidermidis
KRTPIFYSLGNTTSDNFL

SEQ ID NO: 1749986 - protein, 39 aa, Staphylococcus epidermidis
KRYFNYMLNYKVWYLTLLAGLIPFIPIKFSFFKFNNVNN

SEQ ID NO: 1749987 - protein, 19 aa, Staphylococcus epidermidis
KRYLLIITIVLFISFILLY

SEQ ID NO: 1749988 - protein, 31 aa, Staphylococcus epidermidis
KSTIRNIRQNLFWAFGYNVAGIPIAAIGLLA

SEQ ID NO: 1749989 - protein, 24 aa, Staphylococcus epidermidis
KTLNIILFFINFFALLIFTTPFAI

SEQ ID NO: 1749990 - protein, 19 aa, Staphylococcus epidermidis
KVKIIIIIALLAMSIMSQN

SEQ ID NO: 1749991 - protein, 20 aa, Staphylococcus epidermidis
KVSWQQIISGFFFAFAALTY

SEQ ID NO: 1749992 - protein, 26 aa, Staphylococcus epidermidis
KVTDSDIYSLFRKQSFRGNEYLNSLQ

SEQ ID NO: 1749993 - protein, 28 aa, Staphylococcus epidermidis
KVVTHTVTGLPQGLKFDASTNSIVGTPT

SEQ ID NO: 1749994 - protein, 20 aa, Staphylococcus epidermidis
KYTFLFIALIIIVSLSRPSL

SEQ ID NO: 1749995 - protein, 30 aa, Staphylococcus epidermidis
LAISIILLLMCVRWWIKYLSFKKNEHLKDK

SEQ ID NO: 1749996 - protein, 45 aa, Staphylococcus epidermidis
LCIIGMGIIGWYMWSLWSLIIALLPILLFFVYAILYTRFSGFAFS

SEQ ID NO: 1749997 - protein, 31 aa, Staphylococcus epidermidis
LCVKVLKLKIRWPFWLSQIGLILLGVQIGST

SEQ ID NO: 1749998 - protein, 22 aa, Staphylococcus epidermidis
LDFWTWMMIITMVLGSVLIGPM

SEQ ID NO: 1749999 - protein, 17 aa, Staphylococcus epidermidis
LDGLMGALKESIKDNTN

SEQ ID NO: 1750000 - protein, 18 aa, Staphylococcus epidermidis
LDGLMGALKESIKDYTNI

SEQ ID NO: 1750001 - protein, 26 aa, Staphylococcus epidermidis
LEAKQTKWFVGITISTAIGGLSLIIG

SEQ ID NO: 1750002 - protein, 20 aa, Staphylococcus epidermidis
LFFVIWIIIQYLYKGQPILS

SEQ ID NO: 1750003 - protein, 23 aa, Staphylococcus epidermidis
LFGELFFMLFNKLVNTHQPQLSD

SEQ ID NO: 1750004 - protein, 30 aa, Staphylococcus epidermidis
LFIHKPLRILTWLMAIIVYLTIYTGALVRH

SEQ ID NO: 1750005 - protein, 25 aa, Staphylococcus epidermidis
LGILSLFIILIPVVIIALLILFCFL

SEQ ID NO: 1750006 - protein, 22 aa, Staphylococcus epidermidis
LGKIRGLFQGVLYIPHFLSWVV

SEQ ID NO: 1750007 - protein, 23 aa, Staphylococcus epidermidis
LGKIRGLFQGVLYIPHFLSWVVV

SEQ ID NO: 1750008 - protein, 19 aa, Staphylococcus epidermidis
LGLPIYFFYEYKMNWKNTK

SEQ ID NO: 1750009 - protein, 29 aa, Staphylococcus epidermidis
LGTSAAFFYSIYESIKWLINTNYEPHLYF

SEQ ID NO: 1750010 - protein, 53 aa, Staphylococcus epidermidis
LHKNDNDSLFKHLVDNFGKTVGVITLTGLLSSFWLVLAKRRKKEEEKQSIKNY

SEQ ID NO: 1750011 - protein, 17 aa, Staphylococcus epidermidis
LHLIIFHIFSIAMSYNP

SEQ ID NO: 1750012 - protein, 17 aa, Staphylococcus epidermidis
LIFTLILGVILNKISQN

SEQ ID NO: 1750013 - protein, 19 aa, Staphylococcus epidermidis
LIIALVGLFINIIVAWIML

SEQ ID NO: 1750014 - protein, 18 aa, Staphylococcus epidermidis
LIICYFIVIGFRRGIWLS

SEQ ID NO: 1750015 - protein, 29 aa, Staphylococcus epidermidis
LIISISIFIIMMIILNLLLPGTGLLLVGL

SEQ ID NO: 1750016 - protein, 17 aa, Staphylococcus epidermidis
LIKLVVSAVLAAPLLMT

SEQ ID NO: 1750017 - protein, 17 aa, Staphylococcus epidermidis
LIMIPFIITIISSIMIG

SEQ ID NO: 1750018 - protein, 24 aa, Staphylococcus epidermidis
LIPIFLVIICMIVVFNFSTFKSGF

SEQ ID NO: 1750019 - protein, 17 aa, Staphylococcus epidermidis
LISKWFFISLIHLMLIL

SEQ ID NO: 1750020 - protein, 17 aa, Staphylococcus epidermidis
LIVVILLAPAVTFGLAN

SEQ ID NO: 1750021 - protein, 21 aa, Staphylococcus epidermidis
LIYFNIILFCLCMINLFFLTH

SEQ ID NO: 1750022 - protein, 29 aa, Staphylococcus epidermidis
LKIIFRKKLYLVMSIFLPVVFYLLFTSIL

SEQ ID NO: 1750023 - protein, 19 aa, Staphylococcus epidermidis
LKVGRLMKFIPRSVMIGFV

SEQ ID NO: 1750024 - protein, 17 aa, Staphylococcus epidermidis
LKVRFIYTMQLIVAFIA

SEQ ID NO: 1750025 - protein, 18 aa, Staphylococcus epidermidis
LLAPIIVLIIWNMTTHLT

SEQ ID NO: 1750026 - protein, 19 aa, Staphylococcus epidermidis
LLIAALLNFIFPDAIKLFI

SEQ ID NO: 1750027 - protein, 20 aa, Staphylococcus epidermidis
LLIAALLNFIFPDAIKLFIY

SEQ ID NO: 1750028 - protein, 17 aa, Staphylococcus epidermidis
LLTLPYVQVITQSLGKL

SEQ ID NO: 1750029 - protein, 18 aa, Staphylococcus epidermidis
LLTLPYVQVITQSLGKLV

SEQ ID NO: 1750030 - protein, 17 aa, Staphylococcus epidermidis
LMLYAFSSAGNLGFSNP

SEQ ID NO: 1750031 - protein, 22 aa, Staphylococcus epidermidis
LNDPIFIQWWDWLNQLFHFDLG

SEQ ID NO: 1750032 - protein, 19 aa, Staphylococcus epidermidis
LNITLAILGGLWFPVYTFP

SEQ ID NO: 1750033 - protein, 18 aa, Staphylococcus epidermidis
LNLLQLLKKAPKQFWQIS

SEQ ID NO: 1750034 - protein, 29 aa, Staphylococcus epidermidis
LNNQSASYFIKQWALDRIKEIQLETMNSI

SEQ ID NO: 1750035 - protein, 19 aa, Staphylococcus epidermidis
LPIALFICLIFGAIFFTPS

SEQ ID NO: 1750036 - protein, 32 aa, Staphylococcus epidermidis
LPLGILIGIINLPFIWLGYKQIGRKFAIFSII

SEQ ID NO: 1750037 - protein, 29 aa, Staphylococcus epidermidis
LQAATQLIFGLFTALIQLLTGDFSGAWQT

SEQ ID NO: 1750038 - protein, 32 aa, Staphylococcus epidermidis
LQMLNMRYSHWLRFVWPVVAFVLIFGGGLLIT

SEQ ID NO: 1750039 - protein, 30 aa, Staphylococcus epidermidis
LQQEFNNRYKHILNQAHLLGEKHIAEHKLG

SEQ ID NO: 1750040 - protein, 24 aa, Staphylococcus epidermidis
LRHQPKWILKSIIVIVLAIISAFI

SEQ ID NO: 1750041 - protein, 17 aa, Staphylococcus epidermidis
LRLIILIELFIQFIISA

SEQ ID NO: 1750042 - protein, 25 aa, Staphylococcus epidermidis
LSDTDKIDPIVITKRKIDKEEQIQN

SEQ ID NO: 1750043 - protein, 24 aa, Staphylococcus epidermidis
LSEHPHFLWFNLTKPDIWITVIAG

SEQ ID NO: 1750044 - protein, 32 aa, Staphylococcus epidermidis
LSVILVITIIISFIFYFYTTEKKVDKDKLYEN

SEQ ID NO: 1750045 - protein, 31 aa, Staphylococcus epidermidis
LSVILVITIIISFLFYFYTTEKKVDKDKLYE

SEQ ID NO: 1750046 - protein, 32 aa, Staphylococcus epidermidis
LSVILVITIIISFLFYFYTTEKKVDKDKLYEN

SEQ ID NO: 1750047 - protein, 22 aa, Staphylococcus epidermidis
LSYTPPYFYLLITVSCIGIILS

SEQ ID NO: 1750048 - protein, 23 aa, Staphylococcus epidermidis
LSYTPPYFYLLITVSCIGIILSI

SEQ ID NO: 1750049 - protein, 20 aa, Staphylococcus epidermidis
LTFLILLFFTVSDESDWIYN

SEQ ID NO: 1750050 - protein, 18 aa, Staphylococcus epidermidis
LTFSFVQKYIQIKFFSEF

SEQ ID NO: 1750051 - protein, 18 aa, Staphylococcus epidermidis
LTIVLFLALGIFSQWLAS

SEQ ID NO: 1750052 - protein, 33 aa, Staphylococcus epidermidis
LTVSQPILFGLLLLVVVTIPYYTFNALKIAGPS

SEQ ID NO: 1750053 - protein, 17 aa, Staphylococcus epidermidis
LTYQRFLNGHPTFNKHN

SEQ ID NO: 1750054 - protein, 21 aa, Staphylococcus epidermidis
LTYVVMLLYTGWLGTQATSLN

SEQ ID NO: 1750055 - protein, 17 aa, Staphylococcus epidermidis
LVPLKAVLGFILSLMAT

SEQ ID NO: 1750056 - protein, 20 aa, Staphylococcus epidermidis
LYPTLMLIMSVFLSFTVVAQ

SEQ ID NO: 1750057 - protein, 24 aa, Staphylococcus epidermidis
MFSKTFLFYCLLIIIFTVLNCQQV

SEQ ID NO: 1750058 - protein, 18 aa, Staphylococcus epidermidis
MGIPTDIKPFIKTRLISP

SEQ ID NO: 1750059 - protein, 22 aa, Staphylococcus epidermidis
MGIPTDIKPFIKTRLISPIGKL

SEQ ID NO: 1750060 - protein, 24 aa, Staphylococcus epidermidis
MGKYYAGIYIPKKFTHEITGTLRK

SEQ ID NO: 1750061 - protein, 24 aa, Staphylococcus epidermidis
MIIMIFPSAPLFVLPLGSFIGALT

SEQ ID NO: 1750062 - protein, 25 aa, Staphylococcus epidermidis
MILVVFCYFMMLFFSIAPFQMIFEE

SEQ ID NO: 1750063 - protein, 17 aa, Staphylococcus epidermidis
MLIMFVAILMILGGTLC

SEQ ID NO: 1750064 - protein, 17 aa, Staphylococcus epidermidis
MLIMSVFLSFTVVAQNI

SEQ ID NO: 1750065 - protein, 24 aa, Staphylococcus epidermidis
MSISIICFMLFTTNYNWTFLILFT

SEQ ID NO: 1750066 - protein, 18 aa, Staphylococcus epidermidis
MSRFKIIYIAVVGVLLFA

SEQ ID NO: 1750067 - protein, 21 aa, Staphylococcus epidermidis
MTNILLFSYLSGSLPMFLIYL

SEQ ID NO: 1750068 - protein, 33 aa, Staphylococcus epidermidis
MTNILLFSYLSGSLPMFLIYLKNANTITYTISM

SEQ ID NO: 1750069 - protein, 19 aa, Staphylococcus epidermidis
MWLTTFMFIFVMGGLSFTK

SEQ ID NO: 1750070 - protein, 17 aa, Staphylococcus epidermidis
NDNPRINLLAATEDTKP

SEQ ID NO: 1750071 - protein, 28 aa, Staphylococcus epidermidis
NESFGLPFWLSSFILVILILITLFLKFD

SEQ ID NO: 1750072 - protein, 17 aa, Staphylococcus epidermidis
NFLVIFIATLVIGVLGL

SEQ ID NO: 1750073 - protein, 24 aa, Staphylococcus epidermidis
NHSNNLDLLHQNRLQDKVVKQPTK

SEQ ID NO: 1750074 - protein, 40 aa, Staphylococcus epidermidis; identical to SEQ ID NO: 1593897

SEQ ID NO: 1750075 - protein, 19 aa, Staphylococcus epidermidis
NIKFDSLLLNIKKAKSLAF

SEQ ID NO: 1750076 - protein, 30 aa, Staphylococcus epidermidis
NIKHYGMFLFSLLISIILYFSFSTLKYSNS

SEQ ID NO: 1750077 - protein, 24 aa, Staphylococcus epidermidis
NIKQAFPHFLIPNVPFNLETLQII

SEQ ID NO: 1750078 - protein, 19 aa, Staphylococcus epidermidis
NIPFIFWLIVGISMWFFVN

SEQ ID NO: 1750079 - protein, 33 aa, Staphylococcus epidermidis
NIVNFYSLLPWFIITVPIVLLLGYQLDILNLGD

SEQ ID NO: 1750080 - protein, 23 aa, Staphylococcus epidermidis
NKDNFNEHMNLSGSATYDPKTGI

SEQ ID NO: 1750081 - protein, 23 aa, Staphylococcus epidermidis
NKKTLLISFIIITSYMIVEGLGG

SEQ ID NO: 1750082 - protein, 26 aa, Staphylococcus epidermidis
NKQVIWVFLIPVIVAIIHTLAAFRII

SEQ ID NO: 1750083 - protein, 32 aa, Staphylococcus epidermidis
NKSTLFGTLVASLGALLLFFKRRKKDENDEKE

SEQ ID NO: 1750084 - protein, 23 aa, Staphylococcus epidermidis
NLLSYFIILLILIVYVDDYKLII

SEQ ID NO: 1750085 - protein, 25 aa, Staphylococcus epidermidis
NLNHFKWYIPKLNQYSLLILIILTL

SEQ ID NO: 1750086 - protein, 17 aa, Staphylococcus epidermidis
NLPMALSFFSGKRLVPI

SEQ ID NO: 1750087 - protein, 25 aa, Staphylococcus epidermidis
NLTLNFMIVFLFIISATVIGVFLYV

SEQ ID NO: 1750088 - protein, 18 aa, Staphylococcus epidermidis
NNPIFIQWWDWLNQLFHF

SEQ ID NO: 1750089 - protein, 23 aa, Staphylococcus epidermidis
NPKKIELEFQPLTSFSNKRYIYN

SEQ ID NO: 1750090 - protein, 17 aa, Staphylococcus epidermidis
NPLGLEFANSVTSGIIS

SEQ ID NO: 1750091 - protein, 17 aa, Staphylococcus epidermidis
NPMIFFIINFILISYLY

SEQ ID NO: 1750092 - protein, 19 aa, Staphylococcus epidermidis
NQVFYFNPAGLYESHTFKK

SEQ ID NO: 1750093 - protein, 18 aa, Staphylococcus epidermidis
NSGNYIVHFDKPSGMTQT

SEQ ID NO: 1750094 - protein, 20 aa, Staphylococcus epidermidis
NSGNYIVHFDKPSGMTQTTT

SEQ ID NO: 1750095 - protein, 17 aa, Staphylococcus epidermidis
NSIVGTPTQIGTNTITI

SEQ ID NO: 1750096 - protein, 21 aa, Staphylococcus epidermidis
NSSNIFDWLVKMTAKFREWSE

SEQ ID NO: 1750097 - protein, 25 aa, Staphylococcus epidermidis
NSWGWRIPFLLGMFLGLFGLYLRRK

SEQ ID NO: 1750098 - protein, 26 aa, Staphylococcus epidermidis
NVTSKQFTITIQDTISPVVNVTPSQA

SEQ ID NO: 1750099 - protein, 18 aa, Staphylococcus epidermidis
NWAITFLTILIIITPGST

SEQ ID NO: 1750100 - protein, 18 aa, Staphylococcus epidermidis
NYGLLFVSSIFLVINYLI

SEQ ID NO: 1750101 - protein, 21 aa, Staphylococcus epidermidis
NYHKDIRLSDTDKIDPIVITK

SEQ ID NO: 1750102 - protein, 32 aa, Staphylococcus epidermidis
PELSNNFIVLDFTYDLPLSTYLSQVLDIDAKV

SEQ ID NO: 1750103 - protein, 20 aa, Staphylococcus epidermidis
PFSILFLTIVGAFLFFRSSV

SEQ ID NO: 1750104 - protein, 25 aa, Staphylococcus epidermidis
PHWLTVLFIVLLLISFNLLGARLFG

SEQ ID NO: 1750105 - protein, 19 aa, Staphylococcus epidermidis
PLMLLKLAVVWTLVQFFEG

SEQ ID NO: 1750106 - protein, 19 aa, Staphylococcus epidermidis
PLSLFMLFQMMFCTIAVSI

SEQ ID NO: 1750107 - protein, 21 aa, Staphylococcus epidermidis
PLSTTSAQPSIKRVTVNQLAA

SEQ ID NO: 1750108 - protein, 17 aa, Staphylococcus epidermidis
PLWAIFYIICVIAVVFH

SEQ ID NO: 1750109 - protein, 22 aa, Staphylococcus epidermidis
PNQSGQLGATVKPGSAPNQDTE

SEQ ID NO: 1750110 - protein, 34 aa, Staphylococcus epidermidis
PQSDNFTGFTNLMATPLNLRNDNPRINLLAATED

SEQ ID NO: 1750111 - protein, 21 aa, Staphylococcus epidermidis
PSAIMYYFWQSKALIVLVIII

SEQ ID NO: 1750112 - protein, 23 aa, Staphylococcus epidermidis
PSDLTDSFAIPKIKDNSGEIIAT

SEQ ID NO: 1750113 - protein, 24 aa, Staphylococcus epidermidis
PSIQIFMYWFIFGLGFRNNRTVEN

SEQ ID NO: 1750114 - protein, 26 aa, Staphylococcus epidermidis
PTTAEVILIIILGLPIYFFYEYKMNW

SEQ ID NO: 1750115 - protein, 21 aa, Staphylococcus epidermidis
PYIHSYYGFLFFTIINTIASS

SEQ ID NO: 1750116 - protein, 26 aa, Staphylococcus epidermidis
QALQQLIYAETSLNGFERLNHARPRA

SEQ ID NO: 1750117 - protein, 25 aa, Staphylococcus epidermidis
QEYEPTLPWVVYKLTQAKAHKTVMN

SEQ ID NO: 1750118 - protein, 24 aa, Staphylococcus epidermidis
QGFFKGFLSLIPVLIGIIVGYIVS

SEQ ID NO: 1750119 - protein, 24 aa, Staphylococcus epidermidis
QIISGFFFAFAALTYLISAQPNMN

SEQ ID NO: 1750120 - protein, 27 aa, Staphylococcus epidermidis
QIRGLDTIYSFKGSGDVSYRISFKTQG

SEQ ID NO: 1750121 - protein, 26 aa, Staphylococcus epidermidis
QLPSFLIIVIFIFVLINLIITFPILR

SEQ ID NO: 1750122 - protein, 18 aa, Staphylococcus epidermidis
QLQDYNQLNIAMQALRNS

SEQ ID NO: 1750123 - protein, 20 aa, Staphylococcus epidermidis
QLSHAKFLNGKMEELKVAVA

SEQ ID NO: 1750124 - protein, 21 aa, Staphylococcus epidermidis
QLSHAKFLNGKMEELKVAVAK

SEQ ID NO: 1750125 - protein, 29 aa, Staphylococcus epidermidis
QNFSVLEIILLCLIIYAGAAQFIICTLVI

SEQ ID NO: 1750126 - protein, 17 aa, Staphylococcus epidermidis
QNIVLLFIGIMTLGIFS

SEQ ID NO: 1750127 - protein, 23 aa, Staphylococcus epidermidis
QNMLKWGALVAIGFIIVATFMFM

SEQ ID NO: 1750128 - protein, 31 aa, Staphylococcus epidermidis; identical to SEQ ID NO: 1592459

SEQ ID NO: 1750129 - protein, 30 aa, Staphylococcus epidermidis
QSHTVYGQENLYRIAIQYYGEGTQANVDKI

SEQ ID NO: 1750130 - protein, 25 aa, Staphylococcus epidermidis
QSKKEEVYRRLLASNLTSVPERFII

SEQ ID NO: 1750131 - protein, 19 aa, Staphylococcus epidermidis
QSRFKKFILILLVGAAIGT

SEQ ID NO: 1750132 - protein, 28 aa, Staphylococcus epidermidis
QSTLELNDKMKLLRDKLKTLVNPVKASL

SEQ ID NO: 1750133 - protein, 22 aa, Staphylococcus epidermidis
QTNKILAVRFLDANTLATLQPY

SEQ ID NO: 1750134 - protein, 17 aa, Staphylococcus epidermidis
QYWSPMQGIPAWVWSCI

SEQ ID NO: 1750135 - protein, 28 aa, Staphylococcus epidermidis
RDTRLFKISWIILALLLIGYLVSEFIHI

SEQ ID NO: 1750136 - protein, 18 aa, Staphylococcus epidermidis
REDEVIQWFYKEVDWFEA

SEQ ID NO: 1750137 - protein, 20 aa, Staphylococcus epidermidis
RFAMLVIIVISFIALISISI

SEQ ID NO: 1750138 - protein, 27 aa, Staphylococcus epidermidis
RFSIRKYAVGVVSIITGVTIFIGGQQA

SEQ ID NO: 1750139 - protein, 28 aa, Staphylococcus epidermidis
RFSIRKYAVGVVSIITGVTIFIGGQQAQ

SEQ ID NO: 1750140 - protein, 24 aa, Staphylococcus epidermidis
RGNLFTYLIVCTIFIFSYVTMILF

SEQ ID NO: 1750141 - protein, 17 aa, Staphylococcus epidermidis
RILLIIIGALITAYGLE

SEQ ID NO: 1750142 - protein, 18 aa, Staphylococcus epidermidis
RKAFLKMDSYVDDLSGHI

SEQ ID NO: 1750143 - protein, 27 aa, Staphylococcus epidermidis
RLVERLPAMVLPSWAYNKIAPVAIDDV

SEQ ID NO: 1750144 - protein, 17 aa, Staphylococcus epidermidis
RMPFYLVSAIAAVAFIL

SEQ ID NO: 1750145 - protein, 24 aa, Staphylococcus epidermidis
RNQNNINQFIWNKNGFFKSQNNTE

SEQ ID NO: 1750146 - protein, 25 aa, Staphylococcus epidermidis
RPDQAHMYLFDFGTNGLMPVSDVPH

SEQ ID NO: 1750147 - protein, 17 aa, Staphylococcus epidermidis
RPLILKYRIQFIEQKTQ

SEQ ID NO: 1750148 - protein, 18 aa, Staphylococcus epidermidis
RPLPIYRKGLLSVLVVVV

SEQ ID NO: 1750149 - protein, 22 aa, Staphylococcus epidermidis
RRFWPSLKFLLPILVGMLIAIG

SEQ ID NO: 1750150 - protein, 44 aa, Staphylococcus epidermidis
RRKKQKRIQYTIITLLILIIVLILLYMFTPLSKISNVNIKGNNN

SEQ ID NO: 1750151 - protein, 20 aa, Staphylococcus epidermidis
RSLYIPILIEQLFILIMGQA

SEQ ID NO: 1750152 - protein, 25 aa, Staphylococcus epidermidis
RSVLLWTLIVFIFGNGMIAIAPHFG

SEQ ID NO: 1750153 - protein, 35 aa, Staphylococcus epidermidis
RVVRRRIALFGGILLAIILILLVLLVIQRHNNDQD

SEQ ID NO: 1750154 - protein, 20 aa, Staphylococcus epidermidis
SAIMYYFWQSKALIVLVIII

SEQ ID NO: 1750155 - protein, 22 aa, Staphylococcus epidermidis
SAWGYWFAAFLGNVAYATLLMS

SEQ ID NO: 1750156 - protein, 23 aa, Staphylococcus epidermidis
SERPIHVKQLKDKVAKIVIQMNT

SEQ ID NO: 1750157 - protein, 36 aa, Staphylococcus epidermidis
SERSVKWMFVALILIIVLFIFIKYKSLLTRTSMMVL

SEQ ID NO: 1750158 - protein, 24 aa, Staphylococcus epidermidis
SEVGKYLITITTIDKDGNTATTTL

SEQ ID NO: 1750159 - protein, 59 aa, Staphylococcus epidermidis
SFLALISMNIRILSGFLFLIAAIVTIPLVLLIVTLIIPILFFIIAMMMFARRDRIETVP

SEQ ID NO: 1750160 - protein, 24 aa, Staphylococcus epidermidis
SFMLTGFAFMVTTSLFSHQAHAEG

SEQ ID NO: 1750161 - protein, 17 aa, Staphylococcus epidermidis
SIFDVMRMFFIGGVLSL

SEQ ID NO: 1750162 - protein, 22 aa, Staphylococcus epidermidis
SIMQILTLVSVIFSPLTFIAGV

SEQ ID NO: 1750163 - protein, 26 aa, Staphylococcus epidermidis
SIYDYLLNLIAMFSIFMCLVLGAQQI

SEQ ID NO: 1750164 - protein, 42 aa, Staphylococcus epidermidis
SKLIQTYLSKKTIRYGTASALTLALYLFNSNVTAYANENTAN

SEQ ID NO: 1750165 - protein, 42 aa, Staphylococcus epidermidis
SKLIQTYLSKKTLRYGTASALTLALYLFNSNVTVYADENTAN

SEQ ID NO: 1750166 - protein, 22 aa, Staphylococcus epidermidis
SKNWLTIVFVTILLILLALIIA

SEQ ID NO: 1750167 - protein, 17 aa, Staphylococcus epidermidis
SLILYRFELNLRSASIL

SEQ ID NO: 1750168 - protein, 28 aa, Staphylococcus epidermidis
SLQKGTSYFRFQYFNPLNSSKYYENLDD

SEQ ID NO: 1750169 - protein, 17 aa, Staphylococcus epidermidis
SNFIFNVLNRILGTNIT

SEQ ID NO: 1750170 - protein, 31 aa, Staphylococcus epidermidis
SNKYTIIILFIFLIVVIIRYLVYKFKPLKVI

SEQ ID NO: 1750171 - protein, 30 aa, Staphylococcus epidermidis
SNKYTIIILFIFLIVVIIRYLVYKFRPLKV

SEQ ID NO: 1750172 - protein, 35 aa, Staphylococcus epidermidis
SNQSSPTSFANLRTFSRFTVLNTMAAPTTTSTTTT

SEQ ID NO: 1750173 - protein, 27 aa, Staphylococcus epidermidis
SNTTGADGWGFMFSKKDGDDFLKNGGI

SEQ ID NO: 1750174 - protein, 22 aa, Staphylococcus epidermidis
SPFFILAMILFMIGAFTKSAQV

SEQ ID NO: 1750175 - protein, 43 aa, Staphylococcus epidermidis
SPISIPSILVNPWVQLILSTPVQFIIGWQFYVGAYKNLRNGST

SEQ ID NO: 1750176 - protein, 31 aa, Staphylococcus epidermidis
SPQQGIILYYLFAIVVAFLLLNLPYVHKQGV

SEQ ID NO: 1750177 - protein, 34 aa, Staphylococcus epidermidis
SQDNTGSVIKLNLTKWLSLQSDFVNGGKVNLSFA

SEQ ID NO: 1750178 - protein, 24 aa, Staphylococcus epidermidis
SRLVSCLLILFLGSAIFSLLGQHA

SEQ ID NO: 1750179 - protein, 24 aa, Staphylococcus epidermidis
SRNFLAFFEMFLGVLGIGLAAWSA

SEQ ID NO: 1750180 - protein, 20 aa, Staphylococcus epidermidis
SSIFYWFVIIFIINYTTAYT

SEQ ID NO: 1750181 - protein, 21 aa, Staphylococcus epidermidis
SSWKWTLLAVVYPIVTAYILT

SEQ ID NO: 1750182 - protein, 28 aa, Staphylococcus epidermidis
SSYHIFRIFFILFVIAPLIGYFINVKLN

SEQ ID NO: 1750183 - protein, 19 aa, Staphylococcus epidermidis
STAIGGLSLIIGAIGLIVN

SEQ ID NO: 1750184 - protein, 25 aa, Staphylococcus epidermidis
STEEIPFDKKRVFNPDLKPGEERVK

SEQ ID NO: 1750185 - protein, 23 aa, Staphylococcus epidermidis
STLADIFMVIFSILVFSKILKLR

SEQ ID NO: 1750186 - protein, 21 aa, Staphylococcus epidermidis
STLGFGLMLYAFSSAGNLGFS

SEQ ID NO: 1750187 - protein, 27 aa, Staphylococcus epidermidis
SVFKTIYFIVIFIVILVLLLSYIIGTI

SEQ ID NO: 1750188 - protein, 50 aa, Staphylococcus epidermidis
SVHTFKPNENFLQTDYRAVLYIKEQVNKELIPYIDPNSVKLYVSDPDGNP

SEQ ID NO: 1750189 - protein, 23 aa, Staphylococcus epidermidis
SVIVGPNFYMGIGTPGGNKIPTI

SEQ ID NO: 1750190 - protein, 18 aa, Staphylococcus epidermidis
SVPTVLIGLFIGAIYMII

SEQ ID NO: 1750191 - protein, 23 aa, Staphylococcus epidermidis
SVSEYFHRIIPKIPYKVFVVFFI

SEQ ID NO: 1750192 - protein, 27 aa, Staphylococcus epidermidis
SWTLIIYALLLLFFPIYHLLNKDTPLY

SEQ ID NO: 1750193 - protein, 24 aa, Staphylococcus epidermidis
TAEVDTNINLTFNDGRTLNGKVDS

SEQ ID NO: 1750194 - protein, 26 aa, Staphylococcus epidermidis
TAVAKYVSFWYPTIPNWLTAAATILV

SEQ ID NO: 1750195 - protein, 26 aa, Staphylococcus epidermidis
TEKSKDLKLIKGLKDLNKAQLEDVTN

SEQ ID NO: 1750196 - protein, 35 aa, Staphylococcus epidermidis
TELSQLTQSTLKLNDKMKLLRDKLKTLVNPVKASL

SEQ ID NO: 1750197 - protein, 22 aa, Staphylococcus epidermidis
TFAIAFLLRPIGGIVFGIIGDK

SEQ ID NO: 1750198 - protein, 18 aa, Staphylococcus epidermidis
TFCAFVLVYLLMQSIMPH

SEQ ID NO: 1750199 - protein, 17 aa, Staphylococcus epidermidis
TFLIARFIKIFTPLATT

SEQ ID NO: 1750200 - protein, 24 aa, Staphylococcus epidermidis
TFNFSCFIGLIVLIFTLILGVILN

SEQ ID NO: 1750201 - protein, 22 aa, Staphylococcus epidermidis
TFTIFIYIIILIGLNIMIFTKS

SEQ ID NO: 1750202 - protein, 26 aa, Staphylococcus epidermidis
TGNGAFLMFIAFYFKKLRTQKIVFSI

SEQ ID NO: 1750203 - protein, 27 aa, Staphylococcus epidermidis
TGNGAFLMFIAFYFKKLRTQKIVFSIG

SEQ ID NO: 1750204 - protein, 18 aa, Staphylococcus epidermidis
THRFTSRSVLLWTLIVFI

SEQ ID NO: 1750205 - protein, 37 aa, Staphylococcus epidermidis; identical to SEQ ID NO: 1591204

SEQ ID NO: 1750206 - protein, 26 aa, Staphylococcus epidermidis
TISVSWIWFVFLAILGRITGKIDKSG

SEQ ID NO: 1750207 - protein, 21 aa, Staphylococcus epidermidis
TITFLTLPPKDVFLASVLIGT

SEQ ID NO: 1750208 - protein, 26 aa, Staphylococcus epidermidis
TKAVARSVLNALAKQLIKTFENTADV

SEQ ID NO: 1750209 - protein, 26 aa, Staphylococcus epidermidis
TLDQYTLALIFLLSLLIFIVYCHYLQ

SEQ ID NO: 1750210 - protein, 17 aa, Staphylococcus epidermidis
TLFAMFFGAGNLIFPTQ

SEQ ID NO: 1750211 - protein, 26 aa, Staphylococcus epidermidis
TLGAMFLLFGAFLYFIGTEGYVNMQL

SEQ ID NO: 1750212 - protein, 17 aa, Staphylococcus epidermidis
TLLLVIALSILILLNEL

SEQ ID NO: 1750213 - protein, 25 aa, Staphylococcus epidermidis
TLVGSLLAIVGSLFIFGRRKKGNEK

SEQ ID NO: 1750214 - protein, 26 aa, Staphylococcus epidermidis
TMRKIFPLDFKILIGIGLLFCVGTPL

SEQ ID NO: 1750215 - protein, 22 aa, Staphylococcus epidermidis
TNLLVMLIVLFTLSHRQLRKVA

SEQ ID NO: 1750216 - protein, 23 aa, Staphylococcus epidermidis
TNLLVMLIVLFTLSHRQLRKVAG

SEQ ID NO: 1750217 - protein, 26 aa, Staphylococcus epidermidis
TNYNWTFLILFTIFFVIFIKHISRVS

SEQ ID NO: 1750218 - protein, 21 aa, Staphylococcus epidermidis
TPFSILFLTIVGAFLFFRSSV

SEQ ID NO: 1750219 - protein, 26 aa, Staphylococcus epidermidis
TPFTWMMIIFSCLFLGTLIFTFFNDR

SEQ ID NO: 1750220 - protein, 25 aa, Staphylococcus epidermidis
TREVGKTINPITITTTDNSKDVLTT

SEQ ID NO: 1750221 - protein, 22 aa, Staphylococcus epidermidis
TRVFTILVLAYLPVLLVSIYFV

SEQ ID NO: 1750222 - protein, 23 aa, Staphylococcus epidermidis
TSDLILFLNTFVFILVSTVFGFK

SEQ ID NO: 1750223 - protein, 20 aa, Staphylococcus epidermidis
TSMMVLLVVLFLAQQVLMTN

SEQ ID NO: 1750224 - protein, 28 aa, Staphylococcus epidermidis
TTSISLDPAIFYPLIKKLKENNDYVVVN

SEQ ID NO: 1750225 - protein, 18 aa, Staphylococcus epidermidis
TTTKINYEVTRNSASDST

SEQ ID NO: 1750226 - protein, 19 aa, Staphylococcus epidermidis
TWFKFFIGVLLISLLASII

SEQ ID NO: 1750227 - protein, 20 aa, Staphylococcus epidermidis
TWFKFFIGVLLISLLASIIN

SEQ ID NO: 1750228 - protein, 18 aa, Staphylococcus epidermidis
VAAIIGQAKILDHAMENL

SEQ ID NO: 1750229 - protein, 34 aa, Staphylococcus epidermidis
VAGIATAILIVMIIISGVLLRKAFLKMDNYVDDL

SEQ ID NO: 1750230 - protein, 35 aa, Staphylococcus epidermidis
VAGIATAILIVMIIISGVLLRKAFLKMDSYVDDLS

SEQ ID NO: 1750231 - protein, 23 aa, Staphylococcus epidermidis
VEPVFGFMKAILGFTRMSVRGID

SEQ ID NO: 1750232 - protein, 17 aa, Staphylococcus epidermidis
VFPFIIACGFIADSTSL

SEQ ID NO: 1750233 - protein, 17 aa, Staphylococcus epidermidis
VFTLIRFYYKDIIVCFV

SEQ ID NO: 1750234 - protein, 33 aa, Staphylococcus epidermidis
VGIYLAIILIICSIYLAFILIGSLNGKDMSNSV

SEQ ID NO: 1750235 - protein, 34 aa, Staphylococcus epidermidis
VGIYLAIILIICSSYLAFILIGSLNGKDMSNSVL

SEQ ID NO: 1750236 - protein, 24 aa, Staphylococcus epidermidis
VGQTMLIVIIFFSIIFYSGIGVQN

SEQ ID NO: 1750237 - protein, 26 aa, Staphylococcus epidermidis
VGTASIVIGATLLFGLGHNEAKAEEN

SEQ ID NO: 1750238 - protein, 17 aa, Staphylococcus epidermidis
VILLLMNAIAILLRNKF

SEQ ID NO: 1750239 - protein, 23 aa, Staphylococcus epidermidis
VILVVILACFIYMFLEGKLGSLE

SEQ ID NO: 1750240 - protein, 18 aa, Staphylococcus epidermidis
VISNLIFYIIYSKYIMHL

SEQ ID NO: 1750241 - protein, 27 aa, Staphylococcus epidermidis
VIVALIGIIVWLWKTNENFRKTCVEAW

SEQ ID NO: 1750242 - protein, 30 aa, Staphylococcus epidermidis
VIYSPLRLIILMVIAILGMAGWLFYAHQLI

SEQ ID NO: 1750243 - protein, 20 aa, Staphylococcus epidermidis
VKHVLLEVVPTTRTTVRGQQ

SEQ ID NO: 1750244 - protein, 21 aa, Staphylococcus epidermidis
VKHVLLEVVPTTRTTVRGQQF

SEQ ID NO: 1750245 - protein, 17 aa, Staphylococcus epidermidis
VKMYYLSSILFGIALLG

SEQ ID NO: 1750246 - protein, 27 aa, Staphylococcus epidermidis
VKRDFLLVPLYVLAIFILPDLFANITT

SEQ ID NO: 1750247 - protein, 19 aa, Staphylococcus epidermidis
VLFTLIFIVIGFYDGFLGG

SEQ ID NO: 1750248 - protein, 17 aa, Staphylococcus epidermidis
VLTFIIFTLASLAAPLM

SEQ ID NO: 1750249 - protein, 20 aa, Staphylococcus epidermidis
VMEQLNHLINGKNQMINSSK

SEQ ID NO: 1750250 - protein, 21 aa, Staphylococcus epidermidis
VPEKWILGLLGLIPIYLGIKV

SEQ ID NO: 1750251 - protein, 17 aa, Staphylococcus epidermidis
VPVKHVLLEVVPTTRTT

SEQ ID NO: 1750252 - protein, 17 aa, Staphylococcus epidermidis
VRAITRFKIPEGYSIKD

SEQ ID NO: 1750253 - protein, 31 aa, Staphylococcus epidermidis
VRSVITFIFSFYLFSYLRLKPAPMFIATILY

SEQ ID NO: 1750254 - protein, 31 aa, Staphylococcus epidermidis
VRTVITFIFSFYLFSYLRLKPAPMFIATILY

SEQ ID NO: 1750255 - protein, 20 aa, Staphylococcus epidermidis
VSHLVLTRTGLYIIDSQLLK

SEQ ID NO: 1750256 - protein, 28 aa, Staphylococcus epidermidis
VSLPSFFIGLILLYIFSLKLNVLPTSDE

SEQ ID NO: 1750257 - protein, 25 aa, Staphylococcus epidermidis
VTNIWIMIILRFIQGLTGGAGAVIS

SEQ ID NO: 1750258 - protein, 24 aa, Staphylococcus epidermidis
VVFIIFYSMMYWITSRIYYTMIND

SEQ ID NO: 1750259 - protein, 40 aa, Staphylococcus epidermidis
VYDWITNWFGWLFLIIVFILDVFLIFLAFSRYGRFKLGSD

SEQ ID NO: 1750260 - protein, 34 aa, Staphylococcus epidermidis
WGTTIVTLVTFVILIILLKKFAWGPLKEVMDKRE

SEQ ID NO: 1750261 - protein, 27 aa, Staphylococcus epidermidis
WGVMTQGWWFPVMASAFLIFTIIIMFI

SEQ ID NO: 1750262 - protein, 26 aa, Staphylococcus epidermidis
WIQQWTVFYWAWVISWSPFIGGFVAR

SEQ ID NO: 1750263 - protein, 21 aa, Staphylococcus epidermidis
WLHGLNITAYLFWTVSCVIGA

SEQ ID NO: 1750264 - protein, 25 aa, Staphylococcus epidermidis
WLHGLNITAYLFWTVSCVIGAIFGE

SEQ ID NO: 1750265 - protein, 26 aa, Staphylococcus epidermidis
WLHGLNITAYLFWTVSCVIGAIFGEY

SEQ ID NO: 1750266 - protein, 18 aa, Staphylococcus epidermidis
WLLLLPGSYLLGIHWRLG

SEQ ID NO: 1750267 - protein, 17 aa, Staphylococcus epidermidis
WLLYLQYYVLLARFLRG

SEQ ID NO: 1750268 - protein, 23 aa, Staphylococcus epidermidis
WSSNWLTIVFVTILLILLALIIA

SEQ ID NO: 1750269 - protein, 22 aa, Staphylococcus epidermidis
YAISVLFIFFKAPDLALTQFVV

SEQ ID NO: 1750270 - protein, 26 aa, Staphylococcus epidermidis
YFETSAVLITLILFGKYLEARAKTQT

SEQ ID NO: 1750271 - protein, 18 aa, Staphylococcus epidermidis
YFVPIVVGIAIFTFIIWI

SEQ ID NO: 1750272 - protein, 17 aa, Staphylococcus epidermidis
YHHLPMLLNTFLIGLFL

SEQ ID NO: 1750273 - protein, 17 aa, Staphylococcus epidermidis
YIPWFKTNKEITIKDLM

SEQ ID NO: 1750274 - protein, 24 aa, Staphylococcus epidermidis
YKKTAMIILFTLIIVVIIDYVSSK

SEQ ID NO: 1750275 - protein, 21 aa, Staphylococcus epidermidis
YKYNPFLINQVKNLNQLDGKV

SEQ ID NO: 1750276 - protein, 21 aa, Staphylococcus epidermidis
YLTGNLLLLPRLGAALTVVIT

SEQ ID NO: 1750277 - protein, 18 aa, Staphylococcus epidermidis
YPILKRLVERLPAMVLPS

SEQ ID NO: 1750278 - protein, 27 aa, Staphylococcus epidermidis
YPITSLLIFISLLIFEMIVISIEFLIL

SEQ ID NO: 1750279 - protein, 18 aa, Staphylococcus epidermidis
YSAPNPLGGTLMLQGLKI

SEQ ID NO: 1750280 - protein, 22 aa, Staphylococcus epidermidis
YSIPFVIVSLNFPLFNLVDQFT

SEQ ID NO: 1750281 - protein, 18 aa, Staphylococcus epidermidis
YSYFLNYGLLVVSSIFLV

SEQ ID NO: 1750282 - protein, 20 aa, Staphylococcus epidermidis
YTRILPLIINLLGFLISKIN

SEQ ID NO: 1750283 - protein, 19 aa, Staphylococcus epidermidis
YVPMMLLAGILVSLLTAAF

SEQ ID NO: 1750284 - protein, 17 aa, Staphylococcus epidermidis
YVYFSWLLGLLVGMVIM

SEQ ID NO: 1750285 - protein, 18 aa, Staphylococcus epidermidis
YWQVVWYVAIVTSALVVI

SEQ ID NO: 1750286 - protein, 23 aa, Staphylococcus epidermidis
AAAIIAVSFLYLQGGRLIDIATA

SEQ ID NO: 1750287 - protein, 24 aa, Staphylococcus epidermidis
AACAGFTYGLQLATSLISSGMHRK

SEQ ID NO: 1750288 - protein, 25 aa, Staphylococcus epidermidis
AAFSPLVLYSLYWKGLTRAGAISGM

SEQ ID NO: 1750289 - protein, 22 aa, Staphylococcus epidermidis
AAGILAFIGLILSPAIGAILMS

SEQ ID NO: 1750290 - protein, 23 aa, Staphylococcus epidermidis
AAGVLAFIGLILSPAIGAILMSL

SEQ ID NO: 1750291 - protein, 17 aa, Staphylococcus epidermidis
AAIIASSFLYLQGGRLV

SEQ ID NO: 1750292 - protein, 26 aa, Staphylococcus epidermidis
AAIVIFFMVIVFGFSLFLAGHYTPGG

SEQ ID NO: 1750293 - protein, 17 aa, Staphylococcus epidermidis
AAKELVKQELETAKYRV

SEQ ID NO: 1750294 - protein, 19 aa, Staphylococcus epidermidis
AALYLVCLPALRRGAWSRA

SEQ ID NO: 1750295 - protein, 26 aa, Staphylococcus epidermidis
ADEDHKLQYDYAINLANNVLDKENGT

SEQ ID NO: 1750296 - protein, 17 aa, Staphylococcus epidermidis
ADKLNSIVRKKAKALKE

SEQ ID NO: 1750297 - protein, 22 aa, Staphylococcus epidermidis
ADPEYIFYAYKRYNFVQKDPNF

SEQ ID NO: 1750298 - protein, 23 aa, Staphylococcus epidermidis
AEAKRLLEISKNKTITNINQAQT

SEQ ID NO: 1750299 - protein, 23 aa, Staphylococcus epidermidis
AEDSILNRKVAIKAISIPPSEKE

SEQ ID NO: 1750300 - protein, 23 aa, Staphylococcus epidermidis
AEDTILNRKVAIKAISIPPREKE

SEQ ID NO: 1750301 - protein, 17 aa, Staphylococcus epidermidis
AEKLNQMTTLNPNIVYT

SEQ ID NO: 1750302 - protein, 30 aa, Staphylococcus epidermidis
AEKMRFIPYLIFVGLWVVFIYSPVAHWVWG

SEQ ID NO: 1750303 - protein, 17 aa, Staphylococcus epidermidis
AERKVNEALLTATQNIS

SEQ ID NO: 1750304 - protein, 30 aa, Staphylococcus epidermidis
AEVQEALLNGIRRILAVGFDNSFDSISNQT

SEQ ID NO: 1750305 - protein, 17 aa, Staphylococcus epidermidis
AFAEQLWNIGRNSAFAL

SEQ ID NO: 1750306 - protein, 18 aa, Staphylococcus epidermidis
AFEIPLRYKIMGIVGSVW

SEQ ID NO: 1750307 - protein, 31 aa, Staphylococcus epidermidis
AFFCTILAVILLLIWPPVFNGIVTFGKWIVG

SEQ ID NO: 1750308 - protein, 22 aa, Staphylococcus epidermidis
AFGWLILEYALKKTTSLLGLLS

SEQ ID NO: 1750309 - protein, 25 aa, Staphylococcus epidermidis
AFIAWGFIAAIFIKNGWFPNKDLAQ

SEQ ID NO: 1750310 - protein, 22 aa, Staphylococcus epidermidis
AFILGLLLLIPSLILLLRLFVF

SEQ ID NO: 1750311 - protein, 19 aa, Staphylococcus epidermidis
AFILLVALLFTGMGMTYKN

SEQ ID NO: 1750312 - protein, 22 aa, Staphylococcus epidermidis
AFILLVVLLFAGMGLTYKNVVK

SEQ ID NO: 1750313 - protein, 22 aa, Staphylococcus epidermidis
AFITFIWIMITFIHAIKNYSDN

SEQ ID NO: 1750314 - protein, 17 aa, Staphylococcus epidermidis
AFKFMHVDSPWLSVLLI

SEQ ID NO: 1750315 - protein, 24 aa, Staphylococcus epidermidis
AFKTLLLWLGFVALGYQVSKYFNL

SEQ ID NO: 1750316 - protein, 45 aa, Staphylococcus epidermidis
AFLAIIFDFILRYMERLSYKKLLISLGTIVIVIIIAIAIPMAAQK

SEQ ID NO: 1750317 - protein, 21 aa, Staphylococcus epidermidis
AFMILFLLTVVAVIATWLIPA

SEQ ID NO: 1750318 - protein, 20 aa, Staphylococcus epidermidis
AFNTLTIYYLDPIERLINIQ

SEQ ID NO: 1750319 - protein, 25 aa, Staphylococcus epidermidis
AFTLIEMLLVLLIISLLLILIIPNI

SEQ ID NO: 1750320 - protein, 17 aa, Staphylococcus epidermidis
AGFRIDTGYYNNDPLDK

SEQ ID NO: 1750321 - protein, 28 aa, Staphylococcus epidermidis
AGGTRIRPILMTAIATIGALIPLLFGQD

SEQ ID NO: 1750322 - protein, 34 aa, Staphylococcus epidermidis
AGIAAAILVVMIIISGVLLRQAFLKMDNYVDDLS

SEQ ID NO: 1750323 - protein, 31 aa, Staphylococcus epidermidis
AGIKWQQIIFILPFLLLAIFVTIFMGRQLTI

SEQ ID NO: 1750324 - protein, 27 aa, Staphylococcus epidermidis
AGPMITYLIPLLIAFSGGRLIHGLRGG

SEQ ID NO: 1750325 - protein, 17 aa, Staphylococcus epidermidis
AGQGYRGYGTFVKNDSQ

SEQ ID NO: 1750326 - protein, 25 aa, Staphylococcus epidermidis
AGSLFYLLVLLSFPMPIKAVRRFNK

SEQ ID NO: 1750327 - protein, 25 aa, Staphylococcus epidermidis
AGTVILLIGLFIWNIMQWSTNPAIQ

SEQ ID NO: 1750328 - protein, 18 aa, Staphylococcus epidermidis
AHKRQDAINILTNLAESK

SEQ ID NO: 1750329 - protein, 24 aa, Staphylococcus epidermidis
AIAGILTLWYYWIKRRKNIKKMID

SEQ ID NO: 1750330 - protein, 25 aa, Staphylococcus epidermidis
AIALFLVVFCWQPVHFYALAIKRSD

SEQ ID NO: 1750331 - protein, 28 aa, Staphylococcus epidermidis
AIFISPIWFIFLFFYYKKYKTNAKALAK

SEQ ID NO: 1750332 - protein, 24 aa, Staphylococcus epidermidis
AIFNYWRMFAISFIFFIIAGLLTI

SEQ ID NO: 1750333 - protein, 17 aa, Staphylococcus epidermidis
AIFSILIFISKSGQKIM

SEQ ID NO: 1750334 - protein, 22 aa, Staphylococcus epidermidis
AIGMFIMYFFGHPLSYSTMALA

SEQ ID NO: 1750335 - protein, 49 aa, Staphylococcus epidermidis
AIGTTTTDVSGHYQFKGLENGSYTVEFETPSGYTPTKANSGQDITVDSN

SEQ ID NO: 1750336 - protein, 32 aa, Staphylococcus epidermidis
AIIAEALKKDFSNPDYGVDTPLALNTSQSKNS

SEQ ID NO: 1750337 - protein, 23 aa, Staphylococcus epidermidis
AIILFTLILQIFFYQNLPAEQQI

SEQ ID NO: 1750338 - protein, 22 aa, Staphylococcus epidermidis
AIILVFVIIILSWGGIARLVRG

SEQ ID NO: 1750339 - protein, 25 aa, Staphylococcus epidermidis
AIIYIGMVLVILLLNIDQIVPMIGT

SEQ ID NO: 1750340 - protein, 19 aa, Staphylococcus epidermidis
AIKSLFSFKQPPLAHVKPA

SEQ ID NO: 1750341 - protein, 29 aa, Staphylococcus epidermidis
AILEFASWHWLFYINIPIAILAIILVFMT

SEQ ID NO: 1750342 - protein, 29 aa, Staphylococcus epidermidis
AILEFATWHWLFFINIPIAIIAIILVLIT

SEQ ID NO: 1750343 - protein, 28 aa, Staphylococcus epidermidis
AILSVVLIVIVLIFYIKSLNQNQVINEY

SEQ ID NO: 1750344 - protein, 25 aa, Staphylococcus epidermidis
AILTNHLLRKYPNILKMTQLETDTQ

SEQ ID NO: 1750345 - protein, 17 aa, Staphylococcus epidermidis
AIMMASIFFMYNHSVLA

SEQ ID NO: 1750346 - protein, 18 aa, Staphylococcus epidermidis
AINELDQALKSAINHIHQ

SEQ ID NO: 1750347 - protein, 21 aa, Staphylococcus epidermidis
AINGWILPITLGAILIASRKK

SEQ ID NO: 1750348 - protein, 27 aa, Staphylococcus epidermidis
AINHVKEQLSLVFNAIEKDQKDIQVAQ

SEQ ID NO: 1750349 - protein, 19 aa, Staphylococcus epidermidis
AIPVFIYGFVFITLSERSV

SEQ ID NO: 1750350 - protein, 17 aa, Staphylococcus epidermidis
AIQYVQSLSYINDAQRH

SEQ ID NO: 1750351 - protein, 24 aa, Staphylococcus epidermidis
AISIAILVILLPKSLRKSSLNLLS

SEQ ID NO: 1750352 - protein, 28 aa, Staphylococcus epidermidis
AISLVLFLPFLVLSILLFLLGLNIKNTT

SEQ ID NO: 1750353 - protein, 23 aa, Staphylococcus epidermidis
AITFVLVLLVFWGLSHEAKLYTL

SEQ ID NO: 1750354 - protein, 17 aa, Staphylococcus epidermidis
AIVFFLIALILYILNII

SEQ ID NO: 1750355 - protein, 17 aa, Staphylococcus epidermidis
AIVFFMAFIMNVKILKK

SEQ ID NO: 1750356 - protein, 18 aa, Staphylococcus epidermidis
AIYLSLFKVFGPLITVLP

SEQ ID NO: 1750357 - protein, 19 aa, Staphylococcus epidermidis
AIYLSLFKVFGPLITVLPG

SEQ ID NO: 1750358 - protein, 32 aa, Staphylococcus epidermidis
AKAKADPRNVGGGGAFGAFVSTDRNGMATTEE

SEQ ID NO: 1750359 - protein, 27 aa, Staphylococcus epidermidis
AKGDLLPIIFFAVFFGLGLAAIGEKAE

SEQ ID NO: 1750360 - protein, 17 aa, Staphylococcus epidermidis
AKGYYYISSYFTDKRGS

SEQ ID NO: 1750361 - protein, 21 aa, Staphylococcus epidermidis
AKLFPFGPIFAGVLCVIVIIG

SEQ ID NO: 1750362 - protein, 24 aa, Staphylococcus epidermidis
AKQLSHAKFLNGKMEELKVAVAKA

SEQ ID NO: 1750363 - protein, 29 aa, Staphylococcus epidermidis
ALDDLREDFLYLRAIEREQYRKTLYENIV

SEQ ID NO: 1750364 - protein, 19 aa, Staphylococcus epidermidis
ALDGLMGALKESIKDYTNI

SEQ ID NO: 1750365 - protein, 20 aa, Staphylococcus epidermidis
ALDGLMSALKESIKNNANIV

SEQ ID NO: 1750366 - protein, 17 aa, Staphylococcus epidermidis
ALFFEVGLVLLIPLVFT

SEQ ID NO: 1750367 - protein, 27 aa, Staphylococcus epidermidis
ALFFEVGLVLLIPLVFTVAKRANVSIL

SEQ ID NO: 1750368 - protein, 20 aa, Staphylococcus epidermidis
ALFILLISTSRVYLGVHYPT

SEQ ID NO: 1750369 - protein, 26 aa, Staphylococcus epidermidis
ALFMSGLMYVIIGLFIRLSGTGWLMH

SEQ ID NO: 1750370 - protein, 26 aa, Staphylococcus epidermidis
ALFTSIIWLVGSFLFGWYISNFGNYN

SEQ ID NO: 1750371 - protein, 31 aa, Staphylococcus epidermidis
ALGIYILLFLFYGLFLFLITLLVKSSSLVFS

SEQ ID NO: 1750372 - protein, 19 aa, Staphylococcus epidermidis
ALGWNYWFNWVITVAADVT

SEQ ID NO: 1750373 - protein, 26 aa, Staphylococcus epidermidis
ALIIIANAMFLRRYQWKKEGIRTKNN

SEQ ID NO: 1750374 - protein, 29 aa, Staphylococcus epidermidis
ALILASLGIIIYVSLRFEWRMGLSAVLAL

SEQ ID NO: 1750375 - protein, 18 aa, Staphylococcus epidermidis
ALIMIPFIITIISSIMIG

SEQ ID NO: 1750376 - protein, 20 aa, Staphylococcus epidermidis
ALIMIPFIITIISSIMIGIF

SEQ ID NO: 1750377 - protein, 23 aa, Staphylococcus epidermidis
ALIQIFRPLKHYFKLSWKTIYQV

SEQ ID NO: 1750378 - protein, 25 aa, Staphylococcus epidermidis
ALISIPMYVILIIPISNVMQKLSYK

SEQ ID NO: 1750379 - protein, 21 aa, Staphylococcus epidermidis
ALITLFNILIHLGFASATSLS

SEQ ID NO: 1750380 - protein, 22 aa, Staphylococcus epidermidis
ALITMYVIHLIILSVLGINPVR

SEQ ID NO: 1750381 - protein, 17 aa, Staphylococcus epidermidis
ALIYYGLKFLNPSYLLV

SEQ ID NO: 1750382 - protein, 27 aa, Staphylococcus epidermidis
ALKKDFSNPDYGVDTPLALNTSQSKTS

SEQ ID NO: 1750383 - protein, 18 aa, Staphylococcus epidermidis
ALKKLKAIGFKDIHVEQA

SEQ ID NO: 1750384 - protein, 32 aa, Staphylococcus epidermidis
ALKVSALDYLPYAFFPLLCPIITIILGFTLKN

SEQ ID NO: 1750385 - protein, 46 aa, Staphylococcus epidermidis
ALLAIIFDLILRYMEKLSYKKLLITLGAIVLVILLAIVIPLFAQKG

SEQ ID NO: 1750386 - protein, 21 aa, Staphylococcus epidermidis
ALLHDVFIIVAVFSLFRIEVD

SEQ ID NO: 1750387 - protein, 17 aa, Staphylococcus epidermidis
ALLILLCFLISICFIFA

SEQ ID NO: 1750388 - protein, 60 aa, Staphylococcus epidermidis
ALLIPFIIMVFTAIALVAVWFIFNQLVAGIATAILIVMIIISGVLLRKAFLKMDNYVDDL

SEQ ID NO: 1750389 - protein, 40 aa, Staphylococcus epidermidis
ALLIPFILMVLTAIALVIVWFIFNQIVAGIAAAILVVMII

SEQ ID NO: 1750390 - protein, 24 aa, Staphylococcus epidermidis
ALLITFILVPVLIPTLKRMKFGQS

SEQ ID NO: 1750391 - protein, 20 aa, Staphylococcus epidermidis
ALMMFILIIFTIELIVEFTG

SEQ ID NO: 1750392 - protein, 23 aa, Staphylococcus epidermidis
ALMRKLKIPVFPIVARKAKGTHN

SEQ ID NO: 1750393 - protein, 30 aa, Staphylococcus epidermidis
ALNDAWAFLYPMLPYLFIGVFIGAFIYGFV

SEQ ID NO: 1750394 - protein, 19 aa, Staphylococcus epidermidis
ALRKGVLSVFNALKKGVSV

SEQ ID NO: 1750395 - protein, 18 aa, Staphylococcus epidermidis
ALTKLFGKGSWYIPKWLG

SEQ ID NO: 1750396 - protein, 47 aa, Staphylococcus epidermidis
ALTTPIAFLVLIFLFDWKLSLICLIPVILGFLLLRFMMGDESKSFLD

SEQ ID NO: 1750397 - protein, 31 aa, Staphylococcus epidermidis
ALVLIIFFLLMFLLIMPLYRYKNFRYFIGED

SEQ ID NO: 1750398 - protein, 26 aa, Staphylococcus epidermidis
ALVNFIIFAFYIFLYCFIGMEGTVPN

SEQ ID NO: 1750399 - protein, 18 aa, Staphylococcus epidermidis
ALYLPLLFKIVQLQLNLS

SEQ ID NO: 1750400 - protein, 41 aa, Staphylococcus epidermidis
AMASIMPIIIIPILSSLIVGLIFIFVIGAPISNIFGALTSW

SEQ ID NO: 1750401 - protein, 25 aa, Staphylococcus epidermidis
AMFFIVALVMIAFLALSPLGDWLGV

SEQ ID NO: 1750402 - protein, 24 aa, Staphylococcus epidermidis
AMIVPVLMFAFFGIVLGFATLFKN

SEQ ID NO: 1750403 - protein, 20 aa, Staphylococcus epidermidis
AMLFLYFLGIFVGMLLPIQT

SEQ ID NO: 1750404 - protein, 19 aa, Staphylococcus epidermidis
AMLIVYLLRNQLAVDRDEL

SEQ ID NO: 1750405 - protein, 22 aa, Staphylococcus epidermidis
AMTYAFYPEAPFLLLMVSGFLG

SEQ ID NO: 1750406 - protein, 23 aa, Staphylococcus epidermidis
ANAINGLIHLNVAQRDVMINANT

SEQ ID NO: 1750407 - protein, 26 aa, Staphylococcus epidermidis
ANEGYFFTVYVPYGNDWFAYFMRRLA

SEQ ID NO: 1750408 - protein, 25 aa, Staphylococcus epidermidis
ANEGYLFTVYVPYGNDWFAYFMRRL

SEQ ID NO: 1750409 - protein, 23 aa, Staphylococcus epidermidis
ANEKLYVYNWGEYIDPSLIKKFE

SEQ ID NO: 1750410 - protein, 32 aa, Staphylococcus epidermidis
ANFYYIFFEKIGFLLVLLLGCVLVYVGYVFFH

SEQ ID NO: 1750411 - protein, 24 aa, Staphylococcus epidermidis
ANGKKYIVTQAVRPTGTGNVYTEY

SEQ ID NO: 1750412 - protein, 22 aa, Staphylococcus epidermidis
ANKDYLLYWMQLGQGNLDEALN

SEQ ID NO: 1750413 - protein, 22 aa, Staphylococcus epidermidis
ANLLTFIAWLISGISILRYNKT

SEQ ID NO: 1750414 - protein, 23 aa, Staphylococcus epidermidis
ANSFSMWRLFGISIIAIIGMLIW

SEQ ID NO: 1750415 - protein, 25 aa, Staphylococcus epidermidis
ANTGKDIIPPKTIAGEVDATVNIDK

SEQ ID NO: 1750416 - protein, 25 aa, Staphylococcus epidermidis
ANTGKDIIPPKTIAGEVDGTVNIDK

SEQ ID NO: 1750417 - protein, 31 aa, Staphylococcus epidermidis
ANWQTYVMIIVYFLILLIIGFYGYRQATGNL

SEQ ID NO: 1750418 - protein, 21 aa, Staphylococcus epidermidis
ANYIRIIEKRLLNARNYTSIA

SEQ ID NO: 1750419 - protein, 25 aa, Staphylococcus epidermidis
APGSLFYLLVLLSFPMPIKAVRRFN

SEQ ID NO: 1750420 - protein, 24 aa, Staphylococcus epidermidis
APIHGIPFVFWLLVGISMWFFINQ

SEQ ID NO: 1750421 - protein, 18 aa, Staphylococcus epidermidis
APIMKFIMHILSVAVEFL

SEQ ID NO: 1750422 - protein, 17 aa, Staphylococcus epidermidis
APIVAGFGAAMKKSIDF

SEQ ID NO: 1750423 - protein, 26 aa, Staphylococcus epidermidis
APLAGAALISGLALLAARKSKKDKNA

SEQ ID NO: 1750424 - protein, 25 aa, Staphylococcus epidermidis
APSEAIHFCFTYRHALRLVSPDTLF

SEQ ID NO: 1750425 - protein, 22 aa, Staphylococcus epidermidis
APTIFNFSLALLIGLISGVFSS

SEQ ID NO: 1750426 - protein, 23 aa, Staphylococcus epidermidis
AQATLNALNYLNQAQRGNLETKV

SEQ ID NO: 1750427 - protein, 21 aa, Staphylococcus epidermidis
AQDIAKTLIHWCDKAFVTKLV

SEQ ID NO: 1750428 - protein, 24 aa, Staphylococcus epidermidis
AQGAINFTFLDGKRPTYTNADVGH

SEQ ID NO: 1750429 - protein, 18 aa, Staphylococcus epidermidis
AQGLALIIGIDRLLDMVR

SEQ ID NO: 1750430 - protein, 20 aa, Staphylococcus epidermidis
AQLVILHSVFWFSVQMSIAQ

SEQ ID NO: 1750431 - protein, 23 aa, Staphylococcus epidermidis
AQSLVFYTIINWLPELLTDHGIP

SEQ ID NO: 1750432 - protein, 22 aa, Staphylococcus epidermidis
AQVNPHFFFNAINTISALVRID

SEQ ID NO: 1750433 - protein, 27 aa, Staphylococcus epidermidis
ARETFDSWMEVDYLDSYDSGAPNKRLL

SEQ ID NO: 1750434 - protein, 27 aa, Staphylococcus epidermidis
ARETFDSWMEVDYLDSYDSGTPNKRLL

SEQ ID NO: 1750435 - protein, 32 aa, Staphylococcus epidermidis
ARGQNYSIGPNLRKYFSLSNGSDLPNRDFTSI

SEQ ID NO: 1750436 - protein, 24 aa, Staphylococcus epidermidis
ARIGRSLGIHLILATQKPSGVVDD

SEQ ID NO: 1750437 - protein, 29 aa, Staphylococcus epidermidis
ARLLTGQFTLFFMHLSKILKQGKIKAGEP

SEQ ID NO: 1750438 - protein, 24 aa, Staphylococcus epidermidis
ARMVGIGMILGGMLWALLAPIIAV

SEQ ID NO: 1750439 - protein, 18 aa, Staphylococcus epidermidis
ARSGRPIQFLVGFDVEDS

SEQ ID NO: 1750440 - protein, 25 aa, Staphylococcus epidermidis
ARSQLTLNREPYINHINNESHLNNV

SEQ ID NO: 1750441 - protein, 24 aa, Staphylococcus epidermidis
ARVQFLKMILLILAVMLAGASIAV

SEQ ID NO: 1750442 - protein, 24 aa, Staphylococcus epidermidis
ASAICFFIVPILFIPKTHSTIIEH

SEQ ID NO: 1750443 - protein, 29 aa, Staphylococcus epidermidis
ASFLLLSWLIIIFVLLILAYQRAQVLKRP

SEQ ID NO: 1750444 - protein, 25 aa, Staphylococcus epidermidis
ASFQGLIPIIAGLVPAIMAVANALG

SEQ ID NO: 1750445 - protein, 18 aa, Staphylococcus epidermidis
ASIAIIIVLLVCGVSYKG

SEQ ID NO: 1750446 - protein, 22 aa, Staphylococcus epidermidis
ASILLPFGFLIGYYIGIHPLSR

SEQ ID NO: 1750447 - protein, 32 aa, Staphylococcus epidermidis
ASIVGIALIYLFMLGFYRLPGLVAIIALTAYI

SEQ ID NO: 1750448 - protein, 21 aa, Staphylococcus epidermidis
ASKEYLKDLGLPKTILDSSKI

SEQ ID NO: 1750449 - protein, 17 aa, Staphylococcus epidermidis
ASKILPLIILITVIIHI

SEQ ID NO: 1750450 - protein, 19 aa, Staphylococcus epidermidis
ASLAIIPYKNNTAINIHYI

SEQ ID NO: 1750451 - protein, 32 aa, Staphylococcus epidermidis
ASLGLFQFPWILFLLGIIFNKEKFNYKHILSV

SEQ ID NO: 1750452 - protein, 29 aa, Staphylococcus epidermidis
ASLIGSFWEGTLLILIFSGAHFLEDYAEG

SEQ ID NO: 1750453 - protein, 23 aa, Staphylococcus epidermidis
ASLIIIIMYLFLTISPAFMLAKY

SEQ ID NO: 1750454 - protein, 23 aa, Staphylococcus epidermidis
ASLQYSFLMNIIASFVACGFFLF

SEQ ID NO: 1750455 - protein, 21 aa, Staphylococcus epidermidis
ASVFLIFTIIIMFIAGTGQYG

SEQ ID NO: 1750456 - protein, 24 aa, Staphylococcus epidermidis
ASVLSFFAGVLLLKRQTRKSNKKH

SEQ ID NO: 1750457 - protein, 29 aa, Staphylococcus epidermidis
ASWRVPFIIIVGIALIAFIFGLVSISSYN

SEQ ID NO: 1750458 - protein, 27 aa, Staphylococcus epidermidis
ASYELPILYVTVWLDDQGNIIKDAVED

SEQ ID NO: 1750459 - protein, 22 aa, Staphylococcus epidermidis
ATAGIISSLFYFFKNKNKPPQQ

SEQ ID NO: 1750460 - protein, 22 aa, Staphylococcus epidermidis
ATAGILGSLFYFNKNKSPKEVK

SEQ ID NO: 1750461 - protein, 17 aa, Staphylococcus epidermidis
ATALFIFVIFTLYRELS

SEQ ID NO: 1750462 - protein, 25 aa, Staphylococcus epidermidis
ATAMWTIVVLWVATILNFGGANITG

SEQ ID NO: 1750463 - protein, 19 aa, Staphylococcus epidermidis
ATEEERQIALNKVKAIVED

SEQ ID NO: 1750464 - protein, 20 aa, Staphylococcus epidermidis
ATFKFHGYQFNKGQKYHMNG

SEQ ID NO: 1750465 - protein, 20 aa, Staphylococcus epidermidis
ATFLPQAFLSYAIGGIFHIK

SEQ ID NO: 1750466 - protein, 35 aa, Staphylococcus epidermidis
ATGHTMDFFWELATLILIMLLGHWIEMNAVGNAGD

SEQ ID NO: 1750467 - protein, 27 aa, Staphylococcus epidermidis
ATGIACGFIFYPLTMLISKRHKEVHPI

SEQ ID NO: 1750468 - protein, 25 aa, Staphylococcus epidermidis
ATLVVPFMFMWLTKSKRNKAIGRAS

SEQ ID NO: 1750469 - protein, 23 aa, Staphylococcus epidermidis
ATQYQKQLAISRIKQIQLDTMNA

SEQ ID NO: 1750470 - protein, 17 aa, Staphylococcus epidermidis
ATTAFFLVLAFRTYKEL

SEQ ID NO: 1750471 - protein, 29 aa, Staphylococcus epidermidis
ATVLSYPVYLFIIGLIVLIIVGTYRVATG

SEQ ID NO: 1750472 - protein, 23 aa, Staphylococcus epidermidis
ATWNYLGYLVGAVIPIFYIYKTK

SEQ ID NO: 1750473 - protein, 20 aa, Staphylococcus epidermidis
ATYLPQAFLSYAIGGVFHIK

SEQ ID NO: 1750474 - protein, 17 aa, Staphylococcus epidermidis
AVAGISLFIAGIGVMNV

SEQ ID NO: 1750475 - protein, 19 aa, Staphylococcus epidermidis
AVAILYLIPFFLLVMTIIV

SEQ ID NO: 1750476 - protein, 20 aa, Staphylococcus epidermidis
AVDSILNRKVAIKAISIPPS

SEQ ID NO: 1750477 - protein, 19 aa, Staphylococcus epidermidis
AVEILFATIGLIIGLFISV

SEQ ID NO: 1750478 - protein, 18 aa, Staphylococcus epidermidis
AVELYYYVKGGRVDYGAA

SEQ ID NO: 1750479 - protein, 18 aa, Staphylococcus epidermidis
AVFFSFIFGFPVGTLMGL

SEQ ID NO: 1750480 - protein, 20 aa, Staphylococcus epidermidis
AVGFQLFKKYQIKKSTMSNA

SEQ ID NO: 1750481 - protein, 34 aa, Staphylococcus epidermidis
AVGIGGLNNAFGFKLDTYHNTSPPKSDAKAKADP

SEQ ID NO: 1750482 - protein, 31 aa, Staphylococcus epidermidis
AVGIGGLNNAFGFKLDTYHNTSTPRSDAKAK

SEQ ID NO: 1750483 - protein, 17 aa, Staphylococcus epidermidis
AVGTLLETFFSSSLFKA

SEQ ID NO: 1750484 - protein, 25 aa, Staphylococcus epidermidis
AVIIIMIFPSAPLFVLPLGSFAGAL

SEQ ID NO: 1750485 - protein, 26 aa, Staphylococcus epidermidis
AVIIIMIFPSAPLFVLPLGSFIGALT

SEQ ID NO: 1750486 - protein, 19 aa, Staphylococcus epidermidis
AVITFWLFANSLINVIPTL

SEQ ID NO: 1750487 - protein, 37 aa, Staphylococcus epidermidis
AVITIARGQNYTIGPNLRKYFSLSNGSDLPNRDFTSI

SEQ ID NO: 1750488 - protein, 58 aa, Staphylococcus epidermidis
AVLAAPLLMTMFVHLFGIQIPHIFMNPWFQFVLATPVQFVIGWQFYVGAYKNLRNGSA

SEQ ID NO: 1750489 - protein, 23 aa, Staphylococcus epidermidis
AVLGILFLARRTASSMLPSAIAE

SEQ ID NO: 1750490 - protein, 20 aa, Staphylococcus epidermidis
AVNYPNFMSNGNAPYGVILG

SEQ ID NO: 1750491 - protein, 28 aa, Staphylococcus epidermidis
AWALLPLLLFVLLFLGVGIVSGDFTTMP

SEQ ID NO: 1750492 - protein, 25 aa, Staphylococcus epidermidis
AWIANGLSIMYLLLTGMSLIVMKSS

SEQ ID NO: 1750493 - protein, 26 aa, Staphylococcus epidermidis
AWQMSRNLLWFYLIVLICVMVASEPS

SEQ ID NO: 1750494 - protein, 25 aa, Staphylococcus epidermidis
AYGKVWLFFMYYWIIFGIGCYFGQY

SEQ ID NO: 1750495 - protein, 24 aa, Staphylococcus epidermidis
AYLSLVIYIILSIAKYMTGYVYDS

SEQ ID NO: 1750496 - protein, 18 aa, Staphylococcus epidermidis
AYLSLVVYIILSITKYVV

SEQ ID NO: 1750497 - protein, 19 aa, Staphylococcus epidermidis
AYTAQIAVLAILSQIVAKY

SEQ ID NO: 1750498 - protein, 20 aa, Staphylococcus epidermidis
AYVFNFFSRLLTALIGLVTA

SEQ ID NO: 1750499 - protein, 21 aa, Staphylococcus epidermidis
AYVLWGILPMYWELINHIGAF

SEQ ID NO: 1750500 - protein, 17 aa, Staphylococcus epidermidis
CAGFTYGLNLANGLITS

SEQ ID NO: 1750501 - protein, 19 aa, Staphylococcus epidermidis
CALAAMLIVYLLRNQLAVD

SEQ ID NO: 1750502 - protein, 18 aa, Staphylococcus epidermidis
CFIIYVIWQVALIMYYYQ

SEQ ID NO: 1750503 - protein, 18 aa, Staphylococcus epidermidis
CFLIIPFTHSIVAVMILM

SEQ ID NO: 1750504 - protein, 24 aa, Staphylococcus epidermidis
CGFNFILLLFGYLTFYRPANESRE

SEQ ID NO: 1750505 - protein, 22 aa, Staphylococcus epidermidis
CIGFIVFILLYMFANMITRWMG

SEQ ID NO: 1750506 - protein, 25 aa, Staphylococcus epidermidis
CISVSWIWFIFLALAGKSVGSLDKN

SEQ ID NO: 1750507 - protein, 17 aa, Staphylococcus epidermidis
CITILLLMIYQKDFYKN

SEQ ID NO: 1750508 - protein, 22 aa, Staphylococcus epidermidis
CKPDHPFVYWATLKNAASLLDA

SEQ ID NO: 1750509 - protein, 21 aa, Staphylococcus epidermidis
CKPHPFAQLLHDGIRNAYDYK

SEQ ID NO: 1750510 - protein, 17 aa, Staphylococcus epidermidis
CLCACVLVYLLIKSLMP

SEQ ID NO: 1750511 - protein, 42 aa, Staphylococcus epidermidis
CLIGMGIIGWYMWSLWSLIIALLPISLFFVYAILYTRFSGFS

SEQ ID NO: 1750512 - protein, 18 aa, Staphylococcus epidermidis
CLILTYIFNPTFVVPLSA

SEQ ID NO: 1750513 - protein, 35 aa, Staphylococcus epidermidis; identical to SEQ ID NO: 1595308

SEQ ID NO: 1750514 - protein, 32 aa, Staphylococcus epidermidis
CLLLDILDKTPSIYYSFFTIALGIIIYSIKEC

SEQ ID NO: 1750515 - protein, 22 aa, Staphylococcus epidermidis
CLPLILIILYLIAGIYAFLNMN

SEQ ID NO: 1750516 - protein, 19 aa, Staphylococcus epidermidis
CLPLLLFFLNGYLKISLHY

SEQ ID NO: 1750517 - protein, 19 aa, Staphylococcus epidermidis
CLSFIALILYLFLKRFLKV

SEQ ID NO: 1750518 - protein, 26 aa, Staphylococcus epidermidis
CLSLPFAMFGLFASMFFIIIGSGLMK

SEQ ID NO: 1750519 - protein, 31 aa, Staphylococcus epidermidis
CLVVTQLLYFIPGSVWFLMIVRLLNGLATAV

SEQ ID NO: 1750520 - protein, 21 aa, Staphylococcus epidermidis
CREFIAFMNVNKIYFSNEIFY

SEQ ID NO: 1750521 - protein, 26 aa, Staphylococcus epidermidis
CSWKWTLFALIYPIITAYGLTLAFYQ

SEQ ID NO: 1750522 - protein, 18 aa, Staphylococcus epidermidis
CVGLILLSIFDRGLPKDD

SEQ ID NO: 1750523 - protein, 23 aa, Staphylococcus epidermidis
CVGMIYPFLIRFSDFRTPRYFIL

SEQ ID NO: 1750524 - protein, 19 aa, Staphylococcus epidermidis
CVKVLKLKIRWPFWLSQIG

SEQ ID NO: 1750525 - protein, 26 aa, Staphylococcus epidermidis
CYHKYLPWLILVPIVSMIGLLILLLK

SEQ ID NO: 1750526 - protein, 31 aa, Staphylococcus epidermidis
DADNKTIDSGFYKPTYNLGDYVWEDTNKDGI

SEQ ID NO: 1750527 - protein, 21 aa, Staphylococcus epidermidis
DAHWFGFPVPFRFSGFRFDVS

SEQ ID NO: 1750528 - protein, 28 aa, Staphylococcus epidermidis
DAKPKIEAIVPKVRKKRSALDELQASAD

SEQ ID NO: 1750529 - protein, 19 aa, Staphylococcus epidermidis
DAKQLVDAKLAEEIQNINN

SEQ ID NO: 1750530 - protein, 19 aa, Staphylococcus epidermidis
DALGYVLLAFATRGWMAFP

SEQ ID NO: 1750531 - protein, 44 aa, Staphylococcus epidermidis
DALKAPNYTETSGTPTLKLTNSSQTVIYKFKDVQGPQISVDSQT

SEQ ID NO: 1750532 - protein, 18 aa, Staphylococcus epidermidis
DALQLRFILDWNSQAHRP

SEQ ID NO: 1750533 - protein, 27 aa, Staphylococcus epidermidis
DANTGKDIIPPKTIAGEVDGTVNIDKQ

SEQ ID NO: 1750534 - protein, 20 aa, Staphylococcus epidermidis
DARLMSMLIYLLGLFTSFIA

SEQ ID NO: 1750535 - protein, 40 aa, Staphylococcus epidermidis
DDIKEKISNVTPLVKVKPEALKQILAKLDNQRDLINNNAE

SEQ ID NO: 1750536 - protein, 22 aa, Staphylococcus epidermidis
DDQIWSNSKFKLALKVQDRQDS

SEQ ID NO: 1750537 - protein, 24 aa, Staphylococcus epidermidis
DDQLETIIYRLFTGRSTRNSLGMT

SEQ ID NO: 1750538 - protein, 34 aa, Staphylococcus epidermidis
DDVVYDKSKLHKELPLFVSGHFRNAMNNEETSLY

SEQ ID NO: 1750539 - protein, 24 aa, Staphylococcus epidermidis
DDYKLIIFYFLIALGEEFLFRKVV

SEQ ID NO: 1750540 - protein, 21 aa, Staphylococcus epidermidis
DEAKRLLEISKNKTITNINQA

SEQ ID NO: 1750541 - protein, 23 aa, Staphylococcus epidermidis
DECFYLVMEYIEGPTLAEYIHNH

SEQ ID NO: 1750542 - protein, 24 aa, Staphylococcus epidermidis
DEEDKLEFFKLYDDSYDFQETTKD

SEQ ID NO: 1750543 - protein, 24 aa, Staphylococcus epidermidis
DEISKILPVIESKSAARNEIHQKA

SEQ ID NO: 1750544 - protein, 35 aa, Staphylococcus epidermidis
DEISWVRWILYIVALFLPIFIFYTVARPVDRNNRF

SEQ ID NO: 1750545 - protein, 23 aa, Staphylococcus epidermidis
DEKKIFDYVIPLAEDGFEVDSEL

SEQ ID NO: 1750546 - protein, 28 aa, Staphylococcus epidermidis
DFEEIDQFDPKRFTLNKAKKDIITDVNT

SEQ ID NO: 1750547 - protein, 18 aa, Staphylococcus epidermidis
DFGAIWTLGKFLLASYAA

SEQ ID NO: 1750548 - protein, 17 aa, Staphylococcus epidermidis
DFLTRYKALVITSFNSK

SEQ ID NO: 1750549 - protein, 20 aa, Staphylococcus epidermidis
DFMRYSLISGILIGFIAPLI

SEQ ID NO: 1750550 - protein, 23 aa, Staphylococcus epidermidis
DFNKHLIEIYLTSIIDNLHNAQE

SEQ ID NO: 1750551 - protein, 24 aa, Staphylococcus epidermidis
DFNKNLINIYLTSIIDNLHNAQEN

SEQ ID NO: 1750552 - protein, 24 aa, Staphylococcus epidermidis
DFRTPRYFILLISSLVLAFILSFV

SEQ ID NO: 1750553 - protein, 26 aa, Staphylococcus epidermidis
DFSHFLQTLLALVVGTLISALLYGFL

SEQ ID NO: 1750554 - protein, 23 aa, Staphylococcus epidermidis
DFSKKLIGRPLKAHEFDFVLKDE

SEQ ID NO: 1750555 - protein, 17 aa, Staphylococcus epidermidis
DGFNPMRIILAGAAISA

SEQ ID NO: 1750556 - protein, 25 aa, Staphylococcus epidermidis
DGKQKLQRIVLSTQTKTQAKADIAQ

SEQ ID NO: 1750557 - protein, 23 aa, Staphylococcus epidermidis
DGLAFLTLYLLDVHLGYTFSGGF

SEQ ID NO: 1750558 - protein, 19 aa, Staphylococcus epidermidis
DGSLLKYTEMKWLTPDDHY

SEQ ID NO: 1750559 - protein, 17 aa, Staphylococcus epidermidis
DGSLPQLVFLIAVPNDS

SEQ ID NO: 1750560 - protein, 23 aa, Staphylococcus epidermidis
DGSRLLFYYSPVAILISLLSVTA

SEQ ID NO: 1750561 - protein, 36 aa, Staphylococcus epidermidis
DGTVNIDKQLNNFKNLGYSYVGTDALKAPNYTETSG

SEQ ID NO: 1750562 - protein, 21 aa, Staphylococcus epidermidis
DGYQWDILFNSNHKGHEYMYY

SEQ ID NO: 1750563 - protein, 32 aa, Staphylococcus epidermidis; identical to SEQ ID NO: 1740610

SEQ ID NO: 1750564 - protein, 35 aa, Staphylococcus epidermidis
DHGKMPIISYFIGLVLAIIGLFLSDANLLIQNILF

SEQ ID NO: 1750565 - protein, 24 aa, Staphylococcus epidermidis
DHSNPIILLLFVTIGFGLIGFIDD

SEQ ID NO: 1750566 - protein, 23 aa, Staphylococcus epidermidis
DHTHIVWLSIILFIRGCSVGGIN

SEQ ID NO: 1750567 - protein, 22 aa, Staphylococcus epidermidis
DIAKYFAILPAMFMSAMPAMNH

SEQ ID NO: 1750568 - protein, 17 aa, Staphylococcus epidermidis
DIDLIETYPFKFIELRN

SEQ ID NO: 1750569 - protein, 21 aa, Staphylococcus epidermidis
DIFFLLVQRHRPESFYAAEIA

SEQ ID NO: 1750570 - protein, 18 aa, Staphylococcus epidermidis
DIFIPILPAIVTAGLLMG

SEQ ID NO: 1750571 - protein, 17 aa, Staphylococcus epidermidis
DIIFQIGPGLFGVRDKE

SEQ ID NO: 1750572 - protein, 22 aa, Staphylococcus epidermidis
DIISGYFVPIVVGIAIVTFIVW

SEQ ID NO: 1750573 - protein, 24 aa, Staphylococcus epidermidis
DIISIILSVFGFGGLLYGTSSISH

SEQ ID NO: 1750574 - protein, 22 aa, Staphylococcus epidermidis
DIKMWVLGLVGTIAGSLIVAVL

SEQ ID NO: 1750575 - protein, 17 aa, Staphylococcus epidermidis
DILTTQKLPSLMKYGFS

SEQ ID NO: 1750576 - protein, 17 aa, Staphylococcus epidermidis
DILTTRNLPSLIKYGYS

SEQ ID NO: 1750577 - protein, 25 aa, Staphylococcus epidermidis
DINRVRISFLPVSSTGRVSVQRSSR

SEQ ID NO: 1750578 - protein, 33 aa, Staphylococcus epidermidis
DITERLNIPDIKRPWLPPLPEIVYQSELIETDF

SEQ ID NO: 1750579 - protein, 25 aa, Staphylococcus epidermidis
DITILGGDLLLLPKAIKASKATIRN

SEQ ID NO: 1750580 - protein, 28 aa, Staphylococcus epidermidis
DITRFIVRVLIPFALIISLFLISQGTPQ

SEQ ID NO: 1750581 - protein, 24 aa, Staphylococcus epidermidis
DIVIQWGVLALIVIFQPEIRRALE

SEQ ID NO: 1750582 - protein, 33 aa, Staphylococcus epidermidis
DKAKELALPDIQAVKVLAVVKPQAKNQIQAIFD

SEQ ID NO: 1750583 - protein, 27 aa, Staphylococcus epidermidis
DKARPKIEAIVPQVSKKRDALNAIQEA

SEQ ID NO: 1750584 - protein, 27 aa, Staphylococcus epidermidis
DKFNLFLPWYYLIKFVMPIVIILVFIV

SEQ ID NO: 1750585 - protein, 30 aa, Staphylococcus epidermidis
DKIDIKVDFDQWLTSLRWDDVPKNYDEVRM

SEQ ID NO: 1750586 - protein, 31 aa, Staphylococcus epidermidis
DKITWVRWILYIVALFLPIFIIYTIVKPADK

SEQ ID NO: 1750587 - protein, 27 aa, Staphylococcus epidermidis
DKKGDSKIIIVKRFKNIWKANEQISGV

SEQ ID NO: 1750588 - protein, 25 aa, Staphylococcus epidermidis
DKKKGLLGSLPFINKNKRSSGNKDQ

SEQ ID NO: 1750589 - protein, 22 aa, Staphylococcus epidermidis
DKMEFQMLYGFRTELSQKIANE

SEQ ID NO: 1750590 - protein, 31 aa, Staphylococcus epidermidis
DKMFPILMGFFVFLFVFLISGITLLRERTTG

SEQ ID NO: 1750591 - protein, 24 aa, Staphylococcus epidermidis
DKNRIKRMLFDRPVLLEHTDDFIN

SEQ ID NO: 1750592 - protein, 35 aa, Staphylococcus epidermidis
DKPQQVQPPLDKNALQAFFDASYHNYRMIDRDRAD

SEQ ID NO: 1750593 - protein, 25 aa, Staphylococcus epidermidis
DKQLTALQKEFLAKVDHAHNLVELN

SEQ ID NO: 1750594 - protein, 24 aa, Staphylococcus epidermidis
DKSKLNQLVAQYKAIDLSPKTEES

SEQ ID NO: 1750595 - protein, 25 aa, Staphylococcus epidermidis
DKSNPIILLLFVTIGFGLIGFIDDY

SEQ ID NO: 1750596 - protein, 23 aa, Staphylococcus epidermidis
DKYEVNIIYLISHALVETGNGQS

SEQ ID NO: 1750597 - protein, 18 aa, Staphylococcus epidermidis
DKYPELRLRLVKGAYKED

SEQ ID NO: 1750598 - protein, 25 aa, Staphylococcus epidermidis
DLDGKFHGQKLNNVNLKYNASNQTF

SEQ ID NO: 1750599 - protein, 26 aa, Staphylococcus epidermidis
DLDGKFHGQKLNNVNLKYNASNQTFT

SEQ ID NO: 1750600 - protein, 25 aa, Staphylococcus epidermidis
DLGVIWILGILYFISTILTFFIKMP

SEQ ID NO: 1750601 - protein, 24 aa, Staphylococcus epidermidis
DLGYILFHLLIVLLTFVIFTIWIS

SEQ ID NO: 1750602 - protein, 18 aa, Staphylococcus epidermidis
DLIETYPFKFIELRNISN

SEQ ID NO: 1750603 - protein, 23 aa, Staphylococcus epidermidis
DLIGYSWMYLVCGLLVICAIMMS

SEQ ID NO: 1750604 - protein, 32 aa, Staphylococcus epidermidis; identical to SEQ ID NO: 1589171

SEQ ID NO: 1750605 - protein, 25 aa, Staphylococcus epidermidis
DLKAASREQINEAIIAEALKKDFSN

SEQ ID NO: 1750606 - protein, 21 aa, Staphylococcus epidermidis
DLKFIDWGVLLVLGIFIGSYI

SEQ ID NO: 1750607 - protein, 19 aa, Staphylococcus epidermidis
DLLNQISDLTKGPSLFDRL

SEQ ID NO: 1750608 - protein, 23 aa, Staphylococcus epidermidis
DLNGQISYKTNAPFRGDGSQKTG

SEQ ID NO: 1750609 - protein, 23 aa, Staphylococcus epidermidis
DLRLMVLFWGATLLSLTLLIRVN

SEQ ID NO: 1750610 - protein, 21 aa, Staphylococcus epidermidis
DLSFLIDGVIGIVGFLASYFP

SEQ ID NO: 1750611 - protein, 24 aa, Staphylococcus epidermidis
DMEKIWYWLISIIMIAVISMSGHV

SEQ ID NO: 1750612 - protein, 24 aa, Staphylococcus epidermidis
DMEKIWYWLISIVMIAVISMSGHV

SEQ ID NO: 1750613 - protein, 20 aa, Staphylococcus epidermidis
DMEKVWYWLVSLAMILAIAM

SEQ ID NO: 1750614 - protein, 21 aa, Staphylococcus epidermidis
DMHNVEGMAFAIPINDVRKIA

SEQ ID NO: 1750615 - protein, 19 aa, Staphylococcus epidermidis
DMLLTKITSFIPFLAPFEL

SEQ ID NO: 1750616 - protein, 24 aa, Staphylococcus epidermidis
DMTPYLMIISITAILLVVLQIIYF

SEQ ID NO: 1750617 - protein, 27 aa, Staphylococcus epidermidis
DMTRFIVRVLIPFAFIISLFLISQGTP

SEQ ID NO: 1750618 - protein, 23 aa, Staphylococcus epidermidis
DMTRYFMTIPEASRLVLQAGALA

SEQ ID NO: 1750619 - protein, 17 aa, Staphylococcus epidermidis
DMYIIYKTIVNTLQKKD

SEQ ID NO: 1750620 - protein, 31 aa, Staphylococcus epidermidis
DNFIIMGVTVILLIAILFQFNLAHVATLASV

SEQ ID NO: 1750621 - protein, 23 aa, Staphylococcus epidermidis
DNGDYYTVIFSGEKDNGVGAAKV

SEQ ID NO: 1750622 - protein, 30 aa, Staphylococcus epidermidis
DNGFVLLLLYILLAIQWIYSVILLVMVCLN

SEQ ID NO: 1750623 - protein, 26 aa, Staphylococcus epidermidis
DNHSNNLDLLHQNRLQDKVVKQPTKG

SEQ ID NO: 1750624 - protein, 30 aa, Staphylococcus epidermidis
DNKKVLMFSFIIISLFMLVEIIGGFLANSL

SEQ ID NO: 1750625 - protein, 18 aa, Staphylococcus epidermidis
DNLEQLVYMLKLSKKTVS

SEQ ID NO: 1750626 - protein, 28 aa, Staphylococcus epidermidis
DNMSGTLISAYPVGLRYVDATNSNGGIK

SEQ ID NO: 1750627 - protein, 24 aa, Staphylococcus epidermidis
DNPTYSLGDYVWLDKNKNGVQDDD

SEQ ID NO: 1750628 - protein, 17 aa, Staphylococcus epidermidis
DNSKDVLTTTVTGLPSG

SEQ ID NO: 1750629 - protein, 28 aa, Staphylococcus epidermidis
DPKNPPFFFSVLLPIVFISALIGILQYT

SEQ ID NO: 1750630 - protein, 24 aa, Staphylococcus epidermidis
DPNPEYPMFYTTTAVNYPNFMSNG

SEQ ID NO: 1750631 - protein, 24 aa, Staphylococcus epidermidis
DPTPYIMIIVITAIILIILQLVNM

SEQ ID NO: 1750632 - protein, 24 aa, Staphylococcus epidermidis
DQAHDVTLQLYYDSARKFNDALWN

SEQ ID NO: 1750633 - protein, 20 aa, Staphylococcus epidermidis
DQHVFPPYQGAPLFKEKYLN

SEQ ID NO: 1750634 - protein, 20 aa, Staphylococcus epidermidis
DQIKNLKFYMDEIPELIRET

SEQ ID NO: 1750635 - protein, 19 aa, Staphylococcus epidermidis
DQLETIIYRLFTGRSTRNS

SEQ ID NO: 1750636 - protein, 18 aa, Staphylococcus epidermidis
DQLQLVTDPSSLSNSERE

SEQ ID NO: 1750637 - protein, 23 aa, Staphylococcus epidermidis
DQMEFQMLYGFRSELAQSIANEG

SEQ ID NO: 1750638 - protein, 20 aa, Staphylococcus epidermidis
DQNFLFHILAAVIVIILGIV

SEQ ID NO: 1750639 - protein, 23 aa, Staphylococcus epidermidis
DQRFSLNFHYPTLPEIKDIVETK

SEQ ID NO: 1750640 - protein, 29 aa, Staphylococcus epidermidis
DQVTFHAIHNLIRPFRDVVQVKWSQTGFV

SEQ ID NO: 1750641 - protein, 17 aa, Staphylococcus epidermidis
DRAVELYYYIKGGRVDY

SEQ ID NO: 1750642 - protein, 17 aa, Staphylococcus epidermidis
DRAVELYYYVKGGRVDY

SEQ ID NO: 1750643 - protein, 21 aa, Staphylococcus epidermidis
DRAVELYYYVKGGRVDYGAAH

SEQ ID NO: 1750644 - protein, 21 aa, Staphylococcus epidermidis
DRDGRLIGIVSLKIDMHNVEG

SEQ ID NO: 1750645 - protein, 25 aa, Staphylococcus epidermidis
DREGWMIFIGWLSYFLLGFYIGTYY

SEQ ID NO: 1750646 - protein, 38 aa, Staphylococcus epidermidis
DSAWLSLLLIVIAFFVVPFLVAWILDLILRRFIHLYEN

SEQ ID NO: 1750647 - protein, 29 aa, Staphylococcus epidermidis
DSDGNYHIQIPSETTLKGGQPLQVIAIDK

SEQ ID NO: 1750648 - protein, 40 aa, Staphylococcus epidermidis
DSDGNYHIQIPSETTLKGGQPLQVIAIDKAGNKSEATTTN

SEQ ID NO: 1750649 - protein, 17 aa, Staphylococcus epidermidis
DSFAIPKIKDNSGEIIA

SEQ ID NO: 1750650 - protein, 26 aa, Staphylococcus epidermidis
DSFGYGFFIPIFFIMVGVDLNIPSLI

SEQ ID NO: 1750651 - protein, 17 aa, Staphylococcus epidermidis
DSFTIPKIKDNSGEIIA

SEQ ID NO: 1750652 - protein, 18 aa, Staphylococcus epidermidis
DSFTIPKIKDNSGEIIAT

SEQ ID NO: 1750653 - protein, 25 aa, Staphylococcus epidermidis
DSIALWIVAIVAIVISLIALFKQAR

SEQ ID NO: 1750654 - protein, 38 aa, Staphylococcus epidermidis
DSIKEGDTFTIKYGQYIRPGGLELPAIKTQLRSKDGSI

SEQ ID NO: 1750655 - protein, 40 aa, Staphylococcus epidermidis
DSIKEGDTFTIKYGQYIRPGGLELPAIKTQLRSKDGSIVA

SEQ ID NO: 1750656 - protein, 32 aa, Staphylococcus epidermidis
DSIQDDNEKGISGVKVTLKDEKGNIISTTTTD

SEQ ID NO: 1750657 - protein, 19 aa, Staphylococcus epidermidis
DSKYLNEDSKYQQQYDRVI

SEQ ID NO: 1750658 - protein, 20 aa, Staphylococcus epidermidis
DSLGLGLYLVQLILKQHHSQ

SEQ ID NO: 1750659 - protein, 23 aa, Staphylococcus epidermidis
DSNDTVMFWLVGSLAGIKWSQIM

SEQ ID NO: 1750660 - protein, 25 aa, Staphylococcus epidermidis
DSNGKYEFTGLENGDYTIEFETPEG

SEQ ID NO: 1750661 - protein, 23 aa, Staphylococcus epidermidis
DSNSASTSLSGSLSTSISDSTST

SEQ ID NO: 1750662 - protein, 17 aa, Staphylococcus epidermidis
DSRLNGMGPYPTGKLSA

SEQ ID NO: 1750663 - protein, 44 aa, Staphylococcus epidermidis
DSYDSGTPNKRLLGSYASSYIDMIDRIPPVAPKANSITTEDTSI

SEQ ID NO: 1750664 - protein, 24 aa, Staphylococcus epidermidis
DTCVPNFLFYNIPLMIFGTIAAMV

SEQ ID NO: 1750665 - protein, 27 aa, Staphylococcus epidermidis
DTEFNNTYIPLPAIAKLVFNNVLTGKP

SEQ ID NO: 1750666 - protein, 26 aa, Staphylococcus epidermidis
DTEFNNTYIPLPATAKLEFNNVLLTG

SEQ ID NO: 1750667 - protein, 31 aa, Staphylococcus epidermidis
DTFSPTLLVLLMYLISMMTAYVFYSYERAKG

SEQ ID NO: 1750668 - protein, 25 aa, Staphylococcus epidermidis
DTIGLWAPILLLLARVLQGFSTGGE

SEQ ID NO: 1750669 - protein, 29 aa, Staphylococcus epidermidis
DTKAVARSVLNALAKQLIKTFENTPDVTH

SEQ ID NO: 1750670 - protein, 36 aa, Staphylococcus epidermidis
DTMSPTILVLLMYLIAMMTAYVFYSYERAKGSLNLI

SEQ ID NO: 1750671 - protein, 26 aa, Staphylococcus epidermidis
DTSYTYLIIIYAIRMFAVSLLMMPIN

SEQ ID NO: 1750672 - protein, 25 aa, Staphylococcus epidermidis
DTTPWKYRYIAGTIILLLVVLSYVI

SEQ ID NO: 1750673 - protein, 23 aa, Staphylococcus epidermidis
DTVGFKWMYILCALLVTIAMILS

SEQ ID NO: 1750674 - protein, 23 aa, Staphylococcus epidermidis
DTVGFKWMYILCALLVTIAMTLS

SEQ ID NO: 1750675 - protein, 22 aa, Staphylococcus epidermidis
DTYILKIYMSSTPLLKNIKKNS

SEQ ID NO: 1750676 - protein, 27 aa, Staphylococcus epidermidis
DVGGEFYDFDLFKMEYKDQPLELRTIN

SEQ ID NO: 1750677 - protein, 25 aa, Staphylococcus epidermidis
DVGQTMLILIIFFSIIFYSGIGVQN

SEQ ID NO: 1750678 - protein, 29 aa, Staphylococcus epidermidis
DVKGLTVFYIFIALLMFGLLNQGHISLNT

SEQ ID NO: 1750679 - protein, 17 aa, Staphylococcus epidermidis
DVKWRSMVNYYELTQRQ

SEQ ID NO: 1750680 - protein, 18 aa, Staphylococcus epidermidis
DVLTLLQATAKNSNLRSN

SEQ ID NO: 1750681 - protein, 22 aa, Staphylococcus epidermidis
DVNIIIGMIQNMDDARALLNGI

SEQ ID NO: 1750682 - protein, 31 aa, Staphylococcus epidermidis; identical to SEQ ID NO: 1595436

SEQ ID NO: 1750683 - protein, 17 aa, Staphylococcus epidermidis
DVWITKSGNGYFIADMK

SEQ ID NO: 1750684 - protein, 18 aa, Staphylococcus epidermidis
DWILIIVAIGLVLSFEAI

SEQ ID NO: 1750685 - protein, 17 aa, Staphylococcus epidermidis
DWLVKMTAKFREWSEQV

SEQ ID NO: 1750686 - protein, 24 aa, Staphylococcus epidermidis
DYKHPTWMLVFGIVAVIVTIITGI

SEQ ID NO: 1750687 - protein, 19 aa, Staphylococcus epidermidis
DYLLNLIAMFSIFMCLVLG

SEQ ID NO: 1750688 - protein, 44 aa, Staphylococcus epidermidis
DYNGDTKVMTVTYAGQTFTRNLTDWIKNSGGTTFSLSMTASTGG

SEQ ID NO: 1750689 - protein, 25 aa, Staphylococcus epidermidis
DYPVMMAMTLFFSFLGLLGNLISDI

SEQ ID NO: 1750690 - protein, 23 aa, Staphylococcus epidermidis
DYQHPTWMLVFGIIAVIVTIMTG

SEQ ID NO: 1750691 - protein, 29 aa, Staphylococcus epidermidis
EAAYTTTVFGTISLASALLLFRRQRKSSK

SEQ ID NO: 1750692 - protein, 24 aa, Staphylococcus epidermidis
EAGTYLMNALQNLATPTKEQARGL

SEQ ID NO: 1750693 - protein, 19 aa, Staphylococcus epidermidis
EALWSINENINGISLDSIT

SEQ ID NO: 1750694 - protein, 27 aa, Staphylococcus epidermidis
EARDNGTRLIATDIPNPTKKAEAREAV

SEQ ID NO: 1750695 - protein, 30 aa, Staphylococcus epidermidis
EASDILTSFKLPGLIKYGFNINERYIKSLS

SEQ ID NO: 1750696 - protein, 20 aa, Staphylococcus epidermidis
EAWLWVLVLVAFSITVIATI

SEQ ID NO: 1750697 - protein, 20 aa, Staphylococcus epidermidis
EAYVFNFFSRLLTALIGLVT

SEQ ID NO: 1750698 - protein, 26 aa, Staphylococcus epidermidis
EDEKDTFSWSRWLPHMTLGAQNIRGF

SEQ ID NO: 1750699 - protein, 17 aa, Staphylococcus epidermidis
EDGYYWFQGRVDDVIMT

SEQ ID NO: 1750700 - protein, 24 aa, Staphylococcus epidermidis
EDKQFILEEKKLSNKTLGALIVGA

SEQ ID NO: 1750701 - protein, 23 aa, Staphylococcus epidermidis
EDSKPIIATIFLDNYDEITQNMN

SEQ ID NO: 1750702 - protein, 23 aa, Staphylococcus epidermidis
EDSKPIIATLFLDNYDEITQNMN

SEQ ID NO: 1750703 - protein, 28 aa, Staphylococcus epidermidis
EDTKDALNGIQRLSKAKAKAIQYVQSLS

SEQ ID NO: 1750704 - protein, 35 aa, Staphylococcus epidermidis
EDTKPKTYIKPNNSEYSYLLNDLGYDATTVKENSD

SEQ ID NO: 1750705 - protein, 17 aa, Staphylococcus epidermidis
EDTNKDGIQDDSEKGIS

SEQ ID NO: 1750706 - protein, 44 aa, Staphylococcus epidermidis
EDTNNAITIIILITAIIFIAASTIFAFFLSNKITKPLRQLKTQA

SEQ ID NO: 1750707 - protein, 24 aa, Staphylococcus epidermidis
EEARAYLKYIKAENDLKYVADKVE

SEQ ID NO: 1750708 - protein, 32 aa, Staphylococcus epidermidis
EEDYSSFYEVPILHVTVWLDEDGNILKDAVED

SEQ ID NO: 1750709 - protein, 25 aa, Staphylococcus epidermidis
EEERRLIFNPYYSGDYFKDNKKDSL

SEQ ID NO: 1750710 - protein, 30 aa, Staphylococcus epidermidis
EEGIGLVVIILFILKLLAAILIGFGAAFLF

SEQ ID NO: 1750711 - protein, 25 aa, Staphylococcus epidermidis
EEGKYQFDGLKNGLTYKITFETPEG

SEQ ID NO: 1750712 - protein, 26 aa, Staphylococcus epidermidis
EEKASAIDKLIKTAARIAEAIDKAQT

SEQ ID NO: 1750713 - protein, 25 aa, Staphylococcus epidermidis
EEKASAIDKLIKTAARIAESIDKAQ

SEQ ID NO: 1750714 - protein, 20 aa, Staphylococcus epidermidis
EEKKLGTFPIGNYNLKATKN

SEQ ID NO: 1750715 - protein, 24 aa, Staphylococcus epidermidis
EEKKPTCIALPKDSPELLKHLNQT

SEQ ID NO: 1750716 - protein, 24 aa, Staphylococcus epidermidis
EEKNAAINTLDELLAKANEAIQNA

SEQ ID NO: 1750717 - protein, 27 aa, Staphylococcus epidermidis
EEQFYLFFPAILILLLMTMKKYKNVAL

SEQ ID NO: 1750718 - protein, 26 aa, Staphylococcus epidermidis
EEQFYLFFPAILLLFMAIVKKKKNVI

SEQ ID NO: 1750719 - protein, 18 aa, Staphylococcus epidermidis
EEYRYGFYVTPYLNRING

SEQ ID NO: 1750720 - protein, 18 aa, Staphylococcus epidermidis
EFNMIWKAMLIPSMGYIV

SEQ ID NO: 1750721 - protein, 20 aa, Staphylococcus epidermidis
EFNMYLPFINKCILKMERDE

SEQ ID NO: 1750722 - protein, 23 aa, Staphylococcus epidermidis
EFNNTYTPLPATAKLEFTNVLDG

SEQ ID NO: 1750723 - protein, 24 aa, Staphylococcus epidermidis
EGANPLLYLFFAIGLSLLVTIFSL

SEQ ID NO: 1750724 - protein, 20 aa, Staphylococcus epidermidis
EGDKIGVPGLVRGLHDMHVK

SEQ ID NO: 1750725 - protein, 21 aa, Staphylococcus epidermidis
EGFYIQNTMFPLQATELHIDH

SEQ ID NO: 1750726 - protein, 23 aa, Staphylococcus epidermidis
EGLDLIVVILIAPALVYGLATLI

SEQ ID NO: 1750727 - protein, 24 aa, Staphylococcus epidermidis
EGWVWTITIVGLITLFWASLNATK

SEQ ID NO: 1750728 - protein, 23 aa, Staphylococcus epidermidis
EHDTRTITFPYVEGKKVYQAFVS

SEQ ID NO: 1750729 - protein, 25 aa, Staphylococcus epidermidis
EHIQISFIALLIATIIAVPLGILLT

SEQ ID NO: 1750730 - protein, 28 aa, Staphylococcus epidermidis
EHIQLSFIALFIATLIAVPLAILLTKTK

SEQ ID NO: 1750731 - protein, 27 aa, Staphylococcus epidermidis
EHLGEYIDIPGYPKPFKIQPASEGDAA

SEQ ID NO: 1750732 - protein, 33 aa, Staphylococcus epidermidis
EHSKTWYVTGLWYLAYLITPMFWVGVVTGVAYM

SEQ ID NO: 1750733 - protein, 71 aa, Staphylococcus epidermidis
EIATADIQGGGVWRLFKIPENVNRIKVQFLPNNDIQTNYQRILQLQDGYRYYSFIDTIGVYSGSHLYVKSR

SEQ ID NO: 1750734 - protein, 27 aa, Staphylococcus epidermidis
EIEINTRYYVFITSYINRIQPNGRNGI

SEQ ID NO: 1750735 - protein, 37 aa, Staphylococcus epidermidis
EIFKYLYSEFSFPLLIMVIIIIFYKQIKNILNDLTKL

SEQ ID NO: 1750736 - protein, 19 aa, Staphylococcus epidermidis
EIIFFIYSKTLCLGLAFIM

SEQ ID NO: 1750737 - protein, 26 aa, Staphylococcus epidermidis
EIIKYVLLALITLISFIIAIFTAIHL

SEQ ID NO: 1750738 - protein, 23 aa, Staphylococcus epidermidis
EILAFRIIFSMIFMILVLIVGRN

SEQ ID NO: 1750739 - protein, 23 aa, Staphylococcus epidermidis
EINKISVITIKKPEAIAEIQELA

SEQ ID NO: 1750740 - protein, 17 aa, Staphylococcus epidermidis
EIRSKPTPPRIITTANE

SEQ ID NO: 1750741 - protein, 37 aa, Staphylococcus epidermidis
EISIVVCIFLLFALIFFLFTLPFSAFGLALGIVLLVI

SEQ ID NO: 1750742 - protein, 19 aa, Staphylococcus epidermidis
EKAKLLNHAMKALNKVYKN

SEQ ID NO: 1750743 - protein, 25 aa, Staphylococcus epidermidis
EKARIYSRYLLANHWEILQLTENEY

SEQ ID NO: 1750744 - protein, 23 aa, Staphylococcus epidermidis
EKILLALVLYRFAYYFVPVMIAL

SEQ ID NO: 1750745 - protein, 23 aa, Staphylococcus epidermidis
EKKMYNLFYVRCNELLLGKFSSE

SEQ ID NO: 1750746 - protein, 20 aa, Staphylococcus epidermidis
EKLRYLLNIGKLEELRATRY

SEQ ID NO: 1750747 - protein, 28 aa, Staphylococcus epidermidis
EKQVFTSKVKALLNRIQLQIAEAETNED

SEQ ID NO: 1750748 - protein, 32 aa, Staphylococcus epidermidis
EKRLVTLAIITIIALLFVGCTMEIGGNIKEIN

SEQ ID NO: 1750749 - protein, 38 aa, Staphylococcus epidermidis
EKSSRTKKWLIALVVILLIVVAIFVTRAIMNHNDDKVN

SEQ ID NO: 1750750 - protein, 27 aa, Staphylococcus epidermidis
EKVIFTPHLVFIITDMSLIIDHVILEY

SEQ ID NO: 1750751 - protein, 19 aa, Staphylococcus epidermidis
EKYPDLRLRLVKGAYKENE

SEQ ID NO: 1750752 - protein, 20 aa, Staphylococcus epidermidis
ELCIFTLKEFLKLHKYYQNS

SEQ ID NO: 1750753 - protein, 24 aa, Staphylococcus epidermidis
ELDLPLMDGLYLHMLLWGQEKGYK

SEQ ID NO: 1750754 - protein, 26 aa, Staphylococcus epidermidis
ELEINTRYYVFISSYIDSIQTNGRSG

SEQ ID NO: 1750755 - protein, 22 aa, Staphylococcus epidermidis
ELIPRWFVEYDGNWYAYKDGRL

SEQ ID NO: 1750756 - protein, 28 aa, Staphylococcus epidermidis
ELKIIFRKKLYLVISILLPVVFYLLFTS

SEQ ID NO: 1750757 - protein, 17 aa, Staphylococcus epidermidis
ELKKLIKQYKAINLNDK

SEQ ID NO: 1750758 - protein, 21 aa, Staphylococcus epidermidis
ELKLIMSLGFILGGIIGLFQG

SEQ ID NO: 1750759 - protein, 22 aa, Staphylococcus epidermidis
ELKLIMTLGFILGGIIGFFQGV

SEQ ID NO: 1750760 - protein, 20 aa, Staphylococcus epidermidis
ELQIAKKDAIKTIDVLVKQK

SEQ ID NO: 1750761 - protein, 25 aa, Staphylococcus epidermidis
ELSSGALFYIAYLKGITGNNNITDK

SEQ ID NO: 1750762 - protein, 23 aa, Staphylococcus epidermidis
ELYFTKDGLPLLKTRGLKNIVEP

SEQ ID NO: 1750763 - protein, 22 aa, Staphylococcus epidermidis
ELYFTKDGLPLMKTRGLKNIVE

SEQ ID NO: 1750764 - protein, 27 aa, Staphylococcus epidermidis
EMFRPFALAITFSLLASLLVSITVVPS

SEQ ID NO: 1750765 - protein, 23 aa, Staphylococcus epidermidis
ENDKYLIHMLPIDDITLTNDGKT

SEQ ID NO: 1750766 - protein, 21 aa, Staphylococcus epidermidis
ENFPRLFTHDTHIPNFITIII

SEQ ID NO: 1750767 - protein, 32 aa, Staphylococcus epidermidis
ENGKYQFDNLDSGNYIIHFEKPEGMTQTTANS

SEQ ID NO: 1750768 - protein, 20 aa, Staphylococcus epidermidis
ENKIKSFKFFSQYGNFKDID

SEQ ID NO: 1750769 - protein, 22 aa, Staphylococcus epidermidis
ENNAPQVGAGTPGAENTPQAGG

SEQ ID NO: 1750770 - protein, 25 aa, Staphylococcus epidermidis
ENTMILGWIFYFFLGGYIGYNYEKI

SEQ ID NO: 1750771 - protein, 26 aa, Staphylococcus epidermidis
ENTMILGWIFYFFLGGYIGYNYERVL

SEQ ID NO: 1750772 - protein, 18 aa, Staphylococcus epidermidis
ENVFAWPGLGPLSVKAIT

SEQ ID NO: 1750773 - protein, 27 aa, Staphylococcus epidermidis
EPFGLPALTMPFILATWIMLFAGMKNR

SEQ ID NO: 1750774 - protein, 27 aa, Staphylococcus epidermidis
EPGDWLTFFGTLVGALIGALIAGGIAI

SEQ ID NO: 1750775 - protein, 27 aa, Staphylococcus epidermidis
EPIKDSEWSVTGYPNTLTLQNAVGRTN

SEQ ID NO: 1750776 - protein, 26 aa, Staphylococcus epidermidis
EPLEFTFLFIAPYLFVIHALLAATMD

SEQ ID NO: 1750777 - protein, 38 aa, Staphylococcus epidermidis
EPMMKIEFYQNLLVNLLIILAYILMGVIVIAISRKLVT

SEQ ID NO: 1750778 - protein, 29 aa, Staphylococcus epidermidis
EPTFEKLLHPLFDLLHLPDALTTTISFVI

SEQ ID NO: 1750779 - protein, 22 aa, Staphylococcus epidermidis
EQEYLNHLILDHLSVYSREHVV

SEQ ID NO: 1750780 - protein, 24 aa, Staphylococcus epidermidis
EQGISFVVILLFVLKMIAVVVIGF

SEQ ID NO: 1750781 - protein, 24 aa, Staphylococcus epidermidis
EQKNAALNTIFNTQAMKGINPLIQ

SEQ ID NO: 1750782 - protein, 25 aa, Staphylococcus epidermidis
EQSKYFLWFQLIVLILNLFYILRVI

SEQ ID NO: 1750783 - protein, 24 aa, Staphylococcus epidermidis
EQSPLKMMIYSLYVITAIVLSAFF

SEQ ID NO: 1750784 - protein, 33 aa, Staphylococcus epidermidis
EQVNKEIIPSNYTWASYTKYNKLKETAQTVLDE

SEQ ID NO: 1750785 - protein, 23 aa, Staphylococcus epidermidis
ERDTFNWARWLPHMTLSALNIRG

SEQ ID NO: 1750786 - protein, 17 aa, Staphylococcus epidermidis
ERQIALNKVKAIVDDAN

SEQ ID NO: 1750787 - protein, 18 aa, Staphylococcus epidermidis
ERQIALNKVKAIVEDANE

SEQ ID NO: 1750788 - protein, 31 aa, Staphylococcus epidermidis
ERRFLSLYDYMLNLIAMISIFLSLVIGAQQV

SEQ ID NO: 1750789 - protein, 24 aa, Staphylococcus epidermidis
ESAEFVIAIRFLLGIAGALIMPTT

SEQ ID NO: 1750790 - protein, 23 aa, Staphylococcus epidermidis
ESFGIPFWLSSLILVVLILLTLF

SEQ ID NO: 1750791 - protein, 26 aa, Staphylococcus epidermidis
ESFGLPFWLSSFILVILILITLFLKF

SEQ ID NO: 1750792 - protein, 27 aa, Staphylococcus epidermidis
ESFGLPFWLSSFILVILILITLFLKFD

SEQ ID NO: 1750793 - protein, 26 aa, Staphylococcus epidermidis
ESFGLPFWLSSLILVILILLTLFLKF

SEQ ID NO: 1750794 - protein, 28 aa, Staphylococcus epidermidis
ESNNGVIFSLIALFSSLFFIKRKSNKNI

SEQ ID NO: 1750795 - protein, 36 aa, Staphylococcus epidermidis
ESPFIALFNRYGSPLPLMHLYKLIESFLNEPLEIAN

SEQ ID NO: 1750796 - protein, 76 aa, Staphylococcus epidermidis
ESTAAKLNVQPTDNSFQYFVIDYNGDTKVMTVTYAGQTFTRNLTDWIKNSGGTTFSLSMTASTGGAKNLQQVQFGT

SEQ ID NO: 1750797 - protein, 34 aa, Staphylococcus epidermidis
ESVAYIVFLNLGLSVLFLLFTFVKEVRLSKHFYK

SEQ ID NO: 1750798 - protein, 34 aa, Staphylococcus epidermidis
ESVFYIVILNVGLSILFLLFTFVKEVRLSKHFYE

SEQ ID NO: 1750799 - protein, 31 aa, Staphylococcus epidermidis; identical to SEQ ID NO: 1591111

SEQ ID NO: 1750800 - protein, 34 aa, Staphylococcus epidermidis
ETFSEFRIFLAVLITLLLIISISLVIASTYSIIK

SEQ ID NO: 1750801 - protein, 38 aa, Staphylococcus epidermidis; identical to SEQ ID NO: 1593225

SEQ ID NO: 1750802 - protein, 25 aa, Staphylococcus epidermidis
ETITAQIILIVLILFFVFKQRKKNH

SEQ ID NO: 1750803 - protein, 22 aa, Staphylococcus epidermidis
ETKIFFKLVLPLSKRSILAGIM

SEQ ID NO: 1750804 - protein, 24 aa, Staphylococcus epidermidis
ETLKNPLWAIFYIICIIAVVFHFA

SEQ ID NO: 1750805 - protein, 24 aa, Staphylococcus epidermidis
ETNGKQWDAIKEIKFVVKNHEEDI

SEQ ID NO: 1750806 - protein, 23 aa, Staphylococcus epidermidis
ETPLRHVIPFNEENRYLVMPALS

SEQ ID NO: 1750807 - protein, 17 aa, Staphylococcus epidermidis
ETSLYQRWIIIILLICN

SEQ ID NO: 1750808 - protein, 25 aa, Staphylococcus epidermidis
ETTTNFIIKVVDTTAPPAPAINPIK

SEQ ID NO: 1750809 - protein, 24 aa, Staphylococcus epidermidis
ETVDNINNIRPIVVKKPTANNEID

SEQ ID NO: 1750810 - protein, 21 aa, Staphylococcus epidermidis
EVAAIIGQAKLLDHAMENLEE

SEQ ID NO: 1750811 - protein, 27 aa, Staphylococcus epidermidis
EVAGWNLFLFILFRAISGIVITGLISY

SEQ ID NO: 1750812 - protein, 18 aa, Staphylococcus epidermidis
EVEAFFASKFPLVNFRMN

SEQ ID NO: 1750813 - protein, 27 aa, Staphylococcus epidermidis
EVFQLLMWMGFIILISLIVWILAILII

SEQ ID NO: 1750814 - protein, 25 aa, Staphylococcus epidermidis
EVGMLLSLVLTFFPNLFIQENVSRT

SEQ ID NO: 1750815 - protein, 21 aa, Staphylococcus epidermidis
EVIQWFYKEVDWFEAKLKDET

SEQ ID NO: 1750816 - protein, 17 aa, Staphylococcus epidermidis
EVKQLLQQAKILDEAMK

SEQ ID NO: 1750817 - protein, 17 aa, Staphylococcus epidermidis
EVLKKYWLEIFGGIAIG

SEQ ID NO: 1750818 - protein, 17 aa, Staphylococcus epidermidis
EVRKLSRRGDTNNKKPS

SEQ ID NO: 1750819 - protein, 28 aa, Staphylococcus epidermidis
EVSQKMKTILPRVDTKAVARSVLNALAK

SEQ ID NO: 1750820 - protein, 19 aa, Staphylococcus epidermidis
EWIANNPNEFSGKTLYLVV

SEQ ID NO: 1750821 - protein, 26 aa, Staphylococcus epidermidis
EWRLIVISILLLLFWSTEKVLHPIDS

SEQ ID NO: 1750822 - protein, 26 aa, Staphylococcus epidermidis
EWRLIVISVLLLFFWSTEKVLHPIDS

SEQ ID NO: 1750823 - protein, 30 aa, Staphylococcus epidermidis
EYDASYELPILYVTVWLDDQGNIIKDAVED

SEQ ID NO: 1750824 - protein, 24 aa, Staphylococcus epidermidis
EYKLPTFVLGVGLGGLIILNLLEK

SEQ ID NO: 1750825 - protein, 22 aa, Staphylococcus epidermidis
EYLCKRYWFWQVEKKKFLESKI

SEQ ID NO: 1750826 - protein, 30 aa, Staphylococcus epidermidis
EYMNYWFPSFPNWLPGVIAVLFLMAANLVS

SEQ ID NO: 1750827 - protein, 18 aa, Staphylococcus epidermidis
EYSKDEIFQVYLNKIYYS

SEQ ID NO: 1750828 - protein, 18 aa, Staphylococcus epidermidis
EYTVPPLTLLNQPVKQQS

SEQ ID NO: 1750829 - protein, 28 aa, Staphylococcus epidermidis
EYYSLNWAFLLELFFKHLLMSVYGVLFA

SEQ ID NO: 1750830 - protein, 20 aa, Staphylococcus epidermidis
FAALTTWLKGMQGANIIILA

SEQ ID NO: 1750831 - protein, 30 aa, Staphylococcus epidermidis
FADMAILLGINWLAILLYVEAVVSPFGTGV

SEQ ID NO: 1750832 - protein, 34 aa, Staphylococcus epidermidis
FAGVIVLLAFVLLVFVFRSILVPLKAVLGFVLSL

SEQ ID NO: 1750833 - protein, 21 aa, Staphylococcus epidermidis
FAINFFVYLCMYLLIVVIAGY

SEQ ID NO: 1750834 - protein, 17 aa, Staphylococcus epidermidis
FAIYGLIRFVFGIGKGI

SEQ ID NO: 1750835 - protein, 21 aa, Staphylococcus epidermidis
FALGWNYWFNWVITVAADVTI

SEQ ID NO: 1750836 - protein, 19 aa, Staphylococcus epidermidis
FALYQLIGLTRRNILRMLN

SEQ ID NO: 1750837 - protein, 32 aa, Staphylococcus epidermidis
FASFIGVAIIYLFMLGFYRLPGLVAIIALTTY

SEQ ID NO: 1750838 - protein, 27 aa, Staphylococcus epidermidis
FASVDSWKMVWFVLGIVSLVLGLIVLV

SEQ ID NO: 1750839 - protein, 25 aa, Staphylococcus epidermidis
FATMLLLGILMIFVTAVFLSRGLLN

SEQ ID NO: 1750840 - protein, 26 aa, Staphylococcus epidermidis
FATRGWMAFPIMILLASGGIGMPALQ

SEQ ID NO: 1750841 - protein, 18 aa, Staphylococcus epidermidis
FAVIFITIQVIMLNGLAS

SEQ ID NO: 1750842 - protein, 17 aa, Staphylococcus epidermidis
FAVSLLMMPINTTGINA

SEQ ID NO: 1750843 - protein, 26 aa, Staphylococcus epidermidis
FCIIMVFALLGFLPYNLNPAKVFMGD

SEQ ID NO: 1750844 - protein, 19 aa, Staphylococcus epidermidis
FCSFLLIFIEVFVPLTIFL

SEQ ID NO: 1750845 - protein, 18 aa, Staphylococcus epidermidis
FDAYVLAISIILLLMCVR

SEQ ID NO: 1750846 - protein, 25 aa, Staphylococcus epidermidis
FDIVGLILLVIMMLSLNVIITQSAQ

SEQ ID NO: 1750847 - protein, 24 aa, Staphylococcus epidermidis
FDNFTVIIVGLISGALWAFGQGNQ

SEQ ID NO: 1750848 - protein, 19 aa, Staphylococcus epidermidis
FDNWFNMYIDEVKGHLLLE

SEQ ID NO: 1750849 - protein, 17 aa, Staphylococcus epidermidis
FEILPYIVIASAATILY

SEQ ID NO: 1750850 - protein, 20 aa, Staphylococcus epidermidis
FEVGLVLLIPLVFTVAKRAN

SEQ ID NO: 1750851 - protein, 23 aa, Staphylococcus epidermidis
FFAMQPMMYIIIGIVLMIAYCIY

SEQ ID NO: 1750852 - protein, 17 aa, Staphylococcus epidermidis
FFCIRLISLKISINHSQ

SEQ ID NO: 1750853 - protein, 24 aa, Staphylococcus epidermidis
FFDNYLIVILFITIQGILTFRLYR

SEQ ID NO: 1750854 - protein, 21 aa, Staphylococcus epidermidis
FFDNYLIVVIFLSIQALLTIK

SEQ ID NO: 1750855 - protein, 20 aa, Staphylococcus epidermidis
FFDNYLIVVLFLSIQALLTI

SEQ ID NO: 1750856 - protein, 22 aa, Staphylococcus epidermidis
FFEVGLVLLIPLVFTVAKRANV

SEQ ID NO: 1750857 - protein, 25 aa, Staphylococcus epidermidis
FFFEAIFLSIYLYTWDRFKNKWTHF

SEQ ID NO: 1750858 - protein, 17 aa, Staphylococcus epidermidis
FFFTGLIIGIIPYLLKV

SEQ ID NO: 1750859 - protein, 27 aa, Staphylococcus epidermidis
FFGGQLTLFFWFFKLHYSFGHIINSKI

SEQ ID NO: 1750860 - protein, 23 aa, Staphylococcus epidermidis
FFICEMLFFTYLTKPIFYIISII

SEQ ID NO: 1750861 - protein, 17 aa, Staphylococcus epidermidis
FFIIFALVNSIGSSLLS

SEQ ID NO: 1750862 - protein, 33 aa, Staphylococcus epidermidis
FFIKSRINWILWILFLNIILLGVAYIDYEISVE

SEQ ID NO: 1750863 - protein, 19 aa, Staphylococcus epidermidis
FFISLIILIIIAFICYQFW

SEQ ID NO: 1750864 - protein, 25 aa, Staphylococcus epidermidis
FFKYLAIFLSINLILTLTTIIFVIF

SEQ ID NO: 1750865 - protein, 21 aa, Staphylococcus epidermidis
FFPVMMFGIPAAALAMYHTAK

SEQ ID NO: 1750866 - protein, 36 aa, Staphylococcus epidermidis
FFQSYLPQVFKSMLIPIVIIITMCFVHLPTAIIMIV

SEQ ID NO: 1750867 - protein, 24 aa, Staphylococcus epidermidis
FFSVRLLLSLVFINLTSPVGMHLI

SEQ ID NO: 1750868 - protein, 24 aa, Staphylococcus epidermidis
FFSVRLLLSLVFINLTSPVGMHLV

SEQ ID NO: 1750869 - protein, 28 aa, Staphylococcus epidermidis
FFVIGAYLMFLLFSLLMIGLIFGVENNL

SEQ ID NO: 1750870 - protein, 18 aa, Staphylococcus epidermidis
FFYSAFALPFIFNVRVVS

SEQ ID NO: 1750871 - protein, 21 aa, Staphylococcus epidermidis
FGAFIAFVLYILRIKYLHESP

SEQ ID NO: 1750872 - protein, 18 aa, Staphylococcus epidermidis
FGASWETWVYQGLAVLVV

SEQ ID NO: 1750873 - protein, 27 aa, Staphylococcus epidermidis
FGAVYTPFMFVLAIIMATVPPLFFNQP

SEQ ID NO: 1750874 - protein, 17 aa, Staphylococcus epidermidis
FGEIIILLLIQIGGLGI

SEQ ID NO: 1750875 - protein, 29 aa, Staphylococcus epidermidis
FGFIMLISIILAYIFKWLGLVDDVLLMVI

SEQ ID NO: 1750876 - protein, 20 aa, Staphylococcus epidermidis
FGFQYVNFLILTWTPKYLQD

SEQ ID NO: 1750877 - protein, 23 aa, Staphylococcus epidermidis
FGGFILYTILIFGLSMVTNIYIV

SEQ ID NO: 1750878 - protein, 29 aa, Staphylococcus epidermidis
FGGNAYAFRQCTWWVYNRRLELGLPCDPF

SEQ ID NO: 1750879 - protein, 17 aa, Staphylococcus epidermidis
FGIPPKELNIAQSAYLI

SEQ ID NO: 1750880 - protein, 17 aa, Staphylococcus epidermidis
FGIVLILTSLVGSLFSV

SEQ ID NO: 1750881 - protein, 25 aa, Staphylococcus epidermidis
FGKINRLWLVLLFAGGGLSLILLSL

SEQ ID NO: 1750882 - protein, 32 aa, Staphylococcus epidermidis
FGLERTIFVALLFIFIGIIIRSIVGLSWLYVG

SEQ ID NO: 1750883 - protein, 21 aa, Staphylococcus epidermidis
FGLFSPFILGLIAIFVISLII

SEQ ID NO: 1750884 - protein, 27 aa, Staphylococcus epidermidis
FGLIAIMLIVCIVLVIMMMTGGKKDTY

SEQ ID NO: 1750885 - protein, 34 aa, Staphylococcus epidermidis
FGLIPISINLPILGLIPFILWGAMGWATQAPQQH

SEQ ID NO: 1750886 - protein, 17 aa, Staphylococcus epidermidis
FGQYAMLFLAPTGLVMA

SEQ ID NO: 1750887 - protein, 19 aa, Staphylococcus epidermidis
FGQYAMLFLAPTGLVMATL

SEQ ID NO: 1750888 - protein, 18 aa, Staphylococcus epidermidis
FGRRPVLLASLLGATIDY

SEQ ID NO: 1750889 - protein, 19 aa, Staphylococcus epidermidis
FGSLFAGLGSLFLFGRRRK

SEQ ID NO: 1750890 - protein, 33 aa, Staphylococcus epidermidis
FGVYVKMSCSVLLMSGTLIGYGLTKDTQADSTE

SEQ ID NO: 1750891 - protein, 26 aa, Staphylococcus epidermidis
FHDIFKPTFIPIIPLLGLSVGSLIGG

SEQ ID NO: 1750892 - protein, 26 aa, Staphylococcus epidermidis
FHINRSEWMFVLLAIALVLSLEAINT

SEQ ID NO: 1750893 - protein, 24 aa, Staphylococcus epidermidis
FHKVRGLLSFWIGALLIAFTLLSN

SEQ ID NO: 1750894 - protein, 17 aa, Staphylococcus epidermidis
FIALFLFGHSGGPGTQG

SEQ ID NO: 1750895 - protein, 22 aa, Staphylococcus epidermidis
FIAVPLWGMLKKRQFKKTKNNK

SEQ ID NO: 1750896 - protein, 18 aa, Staphylococcus epidermidis
FIEPTIYIVLLIISVRYL

SEQ ID NO: 1750897 - protein, 19 aa, Staphylococcus epidermidis
FIFGLILGVLLFLSAKSHS

SEQ ID NO: 1750898 - protein, 17 aa, Staphylococcus epidermidis
FIGLLILYYICRLISEE

SEQ ID NO: 1750899 - protein, 18 aa, Staphylococcus epidermidis
FIHLGLNTLLEPFGLPAL

SEQ ID NO: 1750900 - protein, 20 aa, Staphylococcus epidermidis
FIIGSLVYLILATICYFLFL

SEQ ID NO: 1750901 - protein, 27 aa, Staphylococcus epidermidis
FIIIIVAMILLLIKYRYIFKLQTGRFF

SEQ ID NO: 1750902 - protein, 23 aa, Staphylococcus epidermidis
FIILGWVFSVLSLLVLPIVFGIA

SEQ ID NO: 1750903 - protein, 20 aa, Staphylococcus epidermidis
FIILITLRKHLKLGETFFGY

SEQ ID NO: 1750904 - protein, 19 aa, Staphylococcus epidermidis
FIIPIIIILLMVVQAIISK

SEQ ID NO: 1750905 - protein, 19 aa, Staphylococcus epidermidis
FIIPIIIMLLMVVQAIISK

SEQ ID NO: 1750906 - protein, 24 aa, Staphylococcus epidermidis
FIISALIIFGIALIVCLFRLIKGP

SEQ ID NO: 1750907 - protein, 19 aa, Staphylococcus epidermidis
FIISFLYLMVGFITAFFSN

SEQ ID NO: 1750908 - protein, 19 aa, Staphylococcus epidermidis
FIIVFFMAFIMNVKILKKL

SEQ ID NO: 1750909 - protein, 26 aa, Staphylococcus epidermidis
FIIVIVAMILLLIKHRYIFKLQTGRF

SEQ ID NO: 1750910 - protein, 19 aa, Staphylococcus epidermidis
FIKKPLRTLTWLMAIIVYL

SEQ ID NO: 1750911 - protein, 30 aa, Staphylococcus epidermidis
FIKRAIFLILAFAYLYLIPNIIIPILIGNK

SEQ ID NO: 1750912 - protein, 17 aa, Staphylococcus epidermidis
FILGMIIPFLGYRNLYI

SEQ ID NO: 1750913 - protein, 25 aa, Staphylococcus epidermidis
FILTMIIFLLLILFQNIRLYGKIKI

SEQ ID NO: 1750914 - protein, 24 aa, Staphylococcus epidermidis
FIMVAVWCLIGYRLARFRYVSETL

SEQ ID NO: 1750915 - protein, 20 aa, Staphylococcus epidermidis
FINSVFAGLLIGIGSGLVIA

SEQ ID NO: 1750916 - protein, 17 aa, Staphylococcus epidermidis
FIPIVIPPLISLFNDLR

SEQ ID NO: 1750917 - protein, 24 aa, Staphylococcus epidermidis
FIQDFFMLAFFTTIGLGASFKLFK

SEQ ID NO: 1750918 - protein, 25 aa, Staphylococcus epidermidis
FISELSFGLPETWATALYGMAIVVG

SEQ ID NO: 1750919 - protein, 20 aa, Staphylococcus epidermidis
FITFMWIMFTFIHAIKNYSD

SEQ ID NO: 1750920 - protein, 22 aa, Staphylococcus epidermidis
FITMSILGIILFLIPIPVVQDG

SEQ ID NO: 1750921 - protein, 36 aa, Staphylococcus epidermidis
FIVNIIIMIVLLTIMIFGVIWLFKDKGQNQHSVLRN

SEQ ID NO: 1750922 - protein, 31 aa, Staphylococcus epidermidis
FIVNIIIMIVLLTIMILGGIWLFKDKGQNQH

SEQ ID NO: 1750923 - protein, 36 aa, Staphylococcus epidermidis
FIVNIIIMVVLLSVVIIGLIWLFKDKGQDQHSVLRN

SEQ ID NO: 1750924 - protein, 33 aa, Staphylococcus epidermidis
FIVNLFRAIPFIILILLLIPFTSVILGTISGPT

SEQ ID NO: 1750925 - protein, 33 aa, Staphylococcus epidermidis
FIVNLFRAIPFIILILLLIPFTSVLLGTISGPT

SEQ ID NO: 1750926 - protein, 35 aa, Staphylococcus epidermidis
FKDNYRKILFITFISLLINLIGITGALYLKTLTDS

SEQ ID NO: 1750927 - protein, 17 aa, Staphylococcus epidermidis
FKFFIGVLLISLLASII

SEQ ID NO: 1750928 - protein, 23 aa, Staphylococcus epidermidis
FKFVCIVFIVVCIFLFIVKKKGK

SEQ ID NO: 1750929 - protein, 22 aa, Staphylococcus epidermidis
FKIKRIIIAIPTLSASRYKEIN

SEQ ID NO: 1750930 - protein, 25 aa, Staphylococcus epidermidis
FKLFSPWYYLIKFVMPVVIILVFIV

SEQ ID NO: 1750931 - protein, 31 aa, Staphylococcus epidermidis
FKNGTTLTALVGAVLLFVKQVTEAFGIDISS

SEQ ID NO: 1750932 - protein, 25 aa, Staphylococcus epidermidis
FKNGYKNYIFKKSDQYYIVSTKKDI

SEQ ID NO: 1750933 - protein, 33 aa, Staphylococcus epidermidis
FKNNRQLFWIFLIILLTIFVALQIRIFTIKEDN

SEQ ID NO: 1750934 - protein, 51 aa, Staphylococcus epidermidis
FKNTRFIMVIILILLALSFVLIPVSIKLPLLGLLPFVLWGAMGWATQAPQQ

SEQ ID NO: 1750935 - protein, 27 aa, Staphylococcus epidermidis
FKNTRFVMLIILILLALSFGLIPISIN

SEQ ID NO: 1750936 - protein, 24 aa, Staphylococcus epidermidis
FKQKRFNVFVDGGYMLDNVKIYAN

SEQ ID NO: 1750937 - protein, 33 aa, Staphylococcus epidermidis
FKRTRISMFIWLIFLLPLPFLLSNLGVTFVVIA

SEQ ID NO: 1750938 - protein, 19 aa, Staphylococcus epidermidis
FKSHYDIFKDFNLNSDKPT

SEQ ID NO: 1750939 - protein, 19 aa, Staphylococcus epidermidis
FKVSLISFMILFIGLELVD

SEQ ID NO: 1750940 - protein, 23 aa, Staphylococcus epidermidis
FLAICYIFVNFFYFDSWACHSSE

SEQ ID NO: 1750941 - protein, 17 aa, Staphylococcus epidermidis
FLFFVYLIPQMIVVFIK

SEQ ID NO: 1750942 - protein, 17 aa, Staphylococcus epidermidis
FLFGLLPGSLIGSFLSR

SEQ ID NO: 1750943 - protein, 21 aa, Staphylococcus epidermidis
FLFKKLSWPYGLIIAAVIITS

SEQ ID NO: 1750944 - protein, 25 aa, Staphylococcus epidermidis
FLGSMLYLLLKKPFKLKLSYRFNTT

SEQ ID NO: 1750945 - protein, 19 aa, Staphylococcus epidermidis
FLHNVIFDVARHYRPDQAH

SEQ ID NO: 1750946 - protein, 19 aa, Staphylococcus epidermidis
FLIFIVAFCLFIMWELKTN

SEQ ID NO: 1750947 - protein, 26 aa, Staphylococcus epidermidis
FLILVLVIFTLFTYKAPSGMKAMGAL

SEQ ID NO: 1750948 - protein, 25 aa, Staphylococcus epidermidis
FLILVLVVFTLFTYKAPSGMKAMGA

SEQ ID NO: 1750949 - protein, 17 aa, Staphylococcus epidermidis
FLIMLKLMLAIAFFAVS

SEQ ID NO: 1750950 - protein, 19 aa, Staphylococcus epidermidis
FLIYIAVVLVSCMVFLTFF

SEQ ID NO: 1750951 - protein, 22 aa, Staphylococcus epidermidis
FLIYICYFFIMCLISLISTIVL

SEQ ID NO: 1750952 - protein, 25 aa, Staphylococcus epidermidis
FLKLTISLVILWIGSYLVMTDHMTL

SEQ ID NO: 1750953 - protein, 26 aa, Staphylococcus epidermidis
FLKNGGILREKGTPSAAGFRIDTGYY

SEQ ID NO: 1750954 - protein, 17 aa, Staphylococcus epidermidis
FLKPNILDQYYGAGNLY

SEQ ID NO: 1750955 - protein, 17 aa, Staphylococcus epidermidis
FLKYILWIVPPIGDYMS

SEQ ID NO: 1750956 - protein, 18 aa, Staphylococcus epidermidis
FLLLLIMVIFGGKKGLIS

SEQ ID NO: 1750957 - protein, 19 aa, Staphylococcus epidermidis
FLLMIFKIMNPKQSVFIIF

SEQ ID NO: 1750958 - protein, 30 aa, Staphylococcus epidermidis
FLPIIIIRTSWLFILFIFLGGLSYTIGAWF

SEQ ID NO: 1750959 - protein, 19 aa, Staphylococcus epidermidis
FLSSLFYMYRKHIFMAAVG

SEQ ID NO: 1750960 - protein, 21 aa, Staphylococcus epidermidis
FLTTVFCMLLNLTPIFAILTA

SEQ ID NO: 1750961 - protein, 17 aa, Staphylococcus epidermidis
FLTYMTIVIVSCIIFSI

SEQ ID NO: 1750962 - protein, 19 aa, Staphylococcus epidermidis
FLTYMTIVIVSCIIFSTFF

SEQ ID NO: 1750963 - protein, 19 aa, Staphylococcus epidermidis
FLVFVAVLLHKIPDGLTIS

SEQ ID NO: 1750964 - protein, 27 aa, Staphylococcus epidermidis
FLVSYLFIFIYFLILTSRKLSPIIVIL

SEQ ID NO: 1750965 - protein, 18 aa, Staphylococcus epidermidis
FLVVLFFTVKDESDWIYN

SEQ ID NO: 1750966 - protein, 17 aa, Staphylococcus epidermidis
FMAIIGALIGGITNVIA

SEQ ID NO: 1750967 - protein, 17 aa, Staphylococcus epidermidis
FMFFITLVIAILSGLIF

SEQ ID NO: 1750968 - protein, 28 aa, Staphylococcus epidermidis
FMGYAILIFFIFVFALLFVNVDTRRAIY

SEQ ID NO: 1750969 - protein, 18 aa, Staphylococcus epidermidis
FMKSRFWLPLIISSMVFS

SEQ ID NO: 1750970 - protein, 17 aa, Staphylococcus epidermidis
FMSNGNAPYGVILGRTT

SEQ ID NO: 1750971 - protein, 17 aa, Staphylococcus epidermidis
FMVTLIAPLLFVEGVNV

SEQ ID NO: 1750972 - protein, 25 aa, Staphylococcus epidermidis
FNDFNSFISNIPAHSTLTWNEEPNS

SEQ ID NO: 1750973 - protein, 31 aa, Staphylococcus epidermidis; identical to SEQ ID NO: 1595676

SEQ ID NO: 1750974 - protein, 22 aa, Staphylococcus epidermidis
FNIIMLIIGYFVVPFTGAFIVH

SEQ ID NO: 1750975 - protein, 21 aa, Staphylococcus epidermidis
FNILFKHLLPKVFPSILVIMI

SEQ ID NO: 1750976 - protein, 17 aa, Staphylococcus epidermidis
FNMYIDEVKGHLLLELA

SEQ ID NO: 1750977 - protein, 29 aa, Staphylococcus epidermidis
FNNRYEHIINKAHLLGEKHIAEHKLGYVV

SEQ ID NO: 1750978 - protein, 27 aa, Staphylococcus epidermidis
FNNYYVSPVSLSLDFSKKLIGRPLKAH

SEQ ID NO: 1750979 - protein, 26 aa, Staphylococcus epidermidis
FNPVFALWFLLTLFFFHVVLVIVRRY

SEQ ID NO: 1750980 - protein, 25 aa, Staphylococcus epidermidis
FNQILANRFTYFGLGLLLILLSTYI

SEQ ID NO: 1750981 - protein, 20 aa, Staphylococcus epidermidis
FNSFFYIYHLGVLVTVAMQF

SEQ ID NO: 1750982 - protein, 18 aa, Staphylococcus epidermidis
FNVLSLTVIIFILSNIVT

SEQ ID NO: 1750983 - protein, 17 aa, Staphylococcus epidermidis
FPLIVWIVAKRPASTYS

SEQ ID NO: 1750984 - protein, 17 aa, Staphylococcus epidermidis
FPRWASILTIFIGLIAI

SEQ ID NO: 1750985 - protein, 19 aa, Staphylococcus epidermidis
FPVMMFGIPAAALAMYHTA

SEQ ID NO: 1750986 - protein, 19 aa, Staphylococcus epidermidis
FPVPFRFSGFRFDVSSILV

SEQ ID NO: 1750987 - protein, 20 aa, Staphylococcus epidermidis
FPYFMIFLPFFKRNKYWGFL

SEQ ID NO: 1750988 - protein, 24 aa, Staphylococcus epidermidis
FQNILLMLLIIPTWINLLLKTYAF

SEQ ID NO: 1750989 - protein, 39 aa, Staphylococcus epidermidis
FQNILTFIITKLPNFLFLFLMLSMIIYFSFITLLNKLPI

SEQ ID NO: 1750990 - protein, 23 aa, Staphylococcus epidermidis
FQWAMMVFVFFVITMALAVILRD

SEQ ID NO: 1750991 - protein, 22 aa, Staphylococcus epidermidis
FQWAMMVFVFFVITMALSVILR

SEQ ID NO: 1750992 - protein, 18 aa, Staphylococcus epidermidis
FRGLIFIFIFTMLNFFFN

SEQ ID NO: 1750993 - protein, 33 aa, Staphylococcus epidermidis
FRKKLYLFMSIFLPVAFYLLFTSLLDLPEEAKK

SEQ ID NO: 1750994 - protein, 18 aa, Staphylococcus epidermidis
FRYAIFKGLGLGGAMTTG

SEQ ID NO: 1750995 - protein, 24 aa, Staphylococcus epidermidis
FSFFIYLLHPIILDSLFAYTNIFE

SEQ ID NO: 1750996 - protein, 38 aa, Staphylococcus epidermidis
FSFVKFLYQNFSFPVLFLIIIFLFKEQIKKILTDFTVG

SEQ ID NO: 1750997 - protein, 38 aa, Staphylococcus epidermidis
FSFVKFLYQNFSFPVLFLIIIFLFKKQIKKILTDFTVG

SEQ ID NO: 1750998 - protein, 17 aa, Staphylococcus epidermidis
FSFVQKYIQIKFFSEFV

SEQ ID NO: 1750999 - protein, 22 aa, Staphylococcus epidermidis
FSGFILYTILIFGLSTITNIYI

SEQ ID NO: 1751000 - protein, 25 aa, Staphylococcus epidermidis
FSGFSWFIFLLIIQASTIISMEFYH

SEQ ID NO: 1751001 - protein, 46 aa, Staphylococcus epidermidis
FSHSSLIINIILITAFILNLIFAFIIIFMERRSAGSIWAWLLVLVI

SEQ ID NO: 1751002 - protein, 26 aa, Staphylococcus epidermidis
FSICSFIVALLNRLDNLRPQIYVILN

SEQ ID NO: 1751003 - protein, 19 aa, Staphylococcus epidermidis
FSILFLTIVGAFLFFRSSV

SEQ ID NO: 1751004 - protein, 22 aa, Staphylococcus epidermidis
FSILPIMMIVYGVIAKIIVVWF

SEQ ID NO: 1751005 - protein, 35 aa, Staphylococcus epidermidis
FSIRKFSIGTGSVLLGAFLFVGFQDVAHADEIHNN

SEQ ID NO: 1751006 - protein, 21 aa, Staphylococcus epidermidis
FSKELLGRPLKADEFDFVLKN

SEQ ID NO: 1751007 - protein, 23 aa, Staphylococcus epidermidis
FSKTFLFYCLLIIIFTVLNCQQV

SEQ ID NO: 1751008 - protein, 27 aa, Staphylococcus epidermidis
FSKVFDYILVFFLFGIAVTMIAGSGST

SEQ ID NO: 1751009 - protein, 26 aa, Staphylococcus epidermidis
FSLPQRRWVYFLALSSGALIALFIQH

SEQ ID NO: 1751010 - protein, 26 aa, Staphylococcus epidermidis
FSLVASILVLWLYFRKSIPRKFDAVN

SEQ ID NO: 1751011 - protein, 35 aa, Staphylococcus epidermidis
FSLVEMIFTLFIISCLLITTLWSRNLFDIQLIDEE

SEQ ID NO: 1751012 - protein, 24 aa, Staphylococcus epidermidis
FSNSYWVWWLTYGVIALLLVALFY

SEQ ID NO: 1751013 - protein, 19 aa, Staphylococcus epidermidis
FSPLVLYSLYWKDLTRAGA

SEQ ID NO: 1751014 - protein, 19 aa, Staphylococcus epidermidis
FSPLVLYSLYWKDLTRTGA

SEQ ID NO: 1751015 - protein, 18 aa, Staphylococcus epidermidis
FSQNLREMVTESGLAALK

SEQ ID NO: 1751016 - protein, 22 aa, Staphylococcus epidermidis
FSSAFILMFLAFDVKEVLTSLP

SEQ ID NO: 1751017 - protein, 24 aa, Staphylococcus epidermidis
FSSFIILLFPIFFLGQAQSTTTLM

SEQ ID NO: 1751018 - protein, 18 aa, Staphylococcus epidermidis
FSSWFLTFGYVCVVALNA

SEQ ID NO: 1751019 - protein, 17 aa, Staphylococcus epidermidis
FSTVIATLVFMGINTNH

SEQ ID NO: 1751020 - protein, 27 aa, Staphylococcus epidermidis
FSVLFFVDLIIILIFNKVKLSSEFDLS

SEQ ID NO: 1751021 - protein, 25 aa, Staphylococcus epidermidis
FSVVVVFLIFLIISKIFKSDAKASS

SEQ ID NO: 1751022 - protein, 20 aa, Staphylococcus epidermidis
FTCIIFIGFLYQLYSKRINL

SEQ ID NO: 1751023 - protein, 30 aa, Staphylococcus epidermidis
FTFIELLFTLSLVLLSFSLLPTLIHLTSHY

SEQ ID NO: 1751024 - protein, 26 aa, Staphylococcus epidermidis
FTGSWTIIDILIILIGLDVISGVIKA

SEQ ID NO: 1751025 - protein, 23 aa, Staphylococcus epidermidis
FTHGWLIPFLYIDIAILTPFVEE

SEQ ID NO: 1751026 - protein, 31 aa, Staphylococcus epidermidis
FTHTWITPILFIDIVIFTPIIEELLFRHLII

SEQ ID NO: 1751027 - protein, 27 aa, Staphylococcus epidermidis
FTINSLWVLMLIRLIHGIAFGFSSTAT

SEQ ID NO: 1751028 - protein, 20 aa, Staphylococcus epidermidis
FTMGWLYWGMWSLVTSVDVI

SEQ ID NO: 1751029 - protein, 20 aa, Staphylococcus epidermidis
FTNPKVLKKVGLYGGIAAGV

SEQ ID NO: 1751030 - protein, 26 aa, Staphylococcus epidermidis
FTNYVDQYQNITGSFDLIATPKRETA

SEQ ID NO: 1751031 - protein, 21 aa, Staphylococcus epidermidis
FTQIGFPIVDIILATFLGLLI

SEQ ID NO: 1751032 - protein, 25 aa, Staphylococcus epidermidis
FTTHLTLFLIMRFIQGLTSGGAIVI

SEQ ID NO: 1751033 - protein, 23 aa, Staphylococcus epidermidis
FTTRQVFLTGILIFFIGTIVGGF

SEQ ID NO: 1751034 - protein, 20 aa, Staphylococcus epidermidis
FTVALLILSAFLFALSSYKF

SEQ ID NO: 1751035 - protein, 25 aa, Staphylococcus epidermidis
FTVSYLMLVLLHTKLNKNHLYILLL

SEQ ID NO: 1751036 - protein, 21 aa, Staphylococcus epidermidis
FTYLFPPLNWILKKELIEISN

SEQ ID NO: 1751037 - protein, 17 aa, Staphylococcus epidermidis
FTYLIVCTIFIISYVTM

SEQ ID NO: 1751038 - protein, 46 aa, Staphylococcus epidermidis
FTYVRKRKFQIFKWLAIGASILGLLLIAFLVYLYFSVMKNHNQVEK

SEQ ID NO: 1751039 - protein, 28 aa, Staphylococcus epidermidis
FVAAFPHLYHFKVLIACLLVLFILMMNL

SEQ ID NO: 1751040 - protein, 29 aa, Staphylococcus epidermidis
FVAAFPNLYHFKVLIACLLVLFILIMNLR

SEQ ID NO: 1751041 - protein, 23 aa, Staphylococcus epidermidis
FVACGFFLFMFGGTASDFWIACI

SEQ ID NO: 1751042 - protein, 24 aa, Staphylococcus epidermidis
FVAFAVVLLLFTTLADMPFLEHAY

SEQ ID NO: 1751043 - protein, 27 aa, Staphylococcus epidermidis
FVAMFIPLFFIFKYKQPMFGKLSSQPL

SEQ ID NO: 1751044 - protein, 25 aa, Staphylococcus epidermidis
FVAMFVMFIGFLVTCLYFEFAGNPV

SEQ ID NO: 1751045 - protein, 18 aa, Staphylococcus epidermidis
FVAPTIKFHVWRVAIQTE

SEQ ID NO: 1751046 - protein, 18 aa, Staphylococcus epidermidis
FVDSAVQLFPYKVNDHKA

SEQ ID NO: 1751047 - protein, 20 aa, Staphylococcus epidermidis
FVFFDVPIQVLLLISSAYAA

SEQ ID NO: 1751048 - protein, 17 aa, Staphylococcus epidermidis
FVIIAFAGTLPGMAVFE

SEQ ID NO: 1751049 - protein, 19 aa, Staphylococcus epidermidis
FVIIAFVLALFIKEPNHST

SEQ ID NO: 1751050 - protein, 23 aa, Staphylococcus epidermidis
FVITLLFVIWQPKGLDIGITAVI

SEQ ID NO: 1751051 - protein, 26 aa, Staphylococcus epidermidis
FVLAQFLVLFLFYAIHKRYVVDIARR

SEQ ID NO: 1751052 - protein, 17 aa, Staphylococcus epidermidis
FVLVFTTLKIFGYSKDT

SEQ ID NO: 1751053 - protein, 18 aa, Staphylococcus epidermidis
FVPIIFKKMFPIPNEVNR

SEQ ID NO: 1751054 - protein, 19 aa, Staphylococcus epidermidis
FVQEGIRMPQPLFTQYDEA

SEQ ID NO: 1751055 - protein, 20 aa, Staphylococcus epidermidis
FVSLIFTCIIFIGFLYQLYS

SEQ ID NO: 1751056 - protein, 24 aa, Staphylococcus epidermidis
FVVIAFILALFIKEPNRKSQNIRE

SEQ ID NO: 1751057 - protein, 19 aa, Staphylococcus epidermidis
FWFALIKVVTIILMIIAGF

SEQ ID NO: 1751058 - protein, 19 aa, Staphylococcus epidermidis
FWVVGFLFLLICASAHICK

SEQ ID NO: 1751059 - protein, 17 aa, Staphylococcus epidermidis
FYFYITVIISCLIAAMI

SEQ ID NO: 1751060 - protein, 20 aa, Staphylococcus epidermidis
FYIQNTMFPLQATELHIDHT

SEQ ID NO: 1751061 - protein, 19 aa, Staphylococcus epidermidis
FYIQNTMFPLQATELHVDN

SEQ ID NO: 1751062 - protein, 26 aa, Staphylococcus epidermidis
FYLALHHILPIWIWGIIMMIVSLILG

SEQ ID NO: 1751063 - protein, 26 aa, Staphylococcus epidermidis
FYLIFTFIQMIFYLIKYKIVTHHILV

SEQ ID NO: 1751064 - protein, 17 aa, Staphylococcus epidermidis
FYMYRKHIFMAAVGEVL

SEQ ID NO: 1751065 - protein, 23 aa, Staphylococcus epidermidis
FYPIFMSIYWIVGSIYYFFIKEK

SEQ ID NO: 1751066 - protein, 24 aa, Staphylococcus epidermidis
GAAVGWFWLVFTGGLNVLGALYSI

SEQ ID NO: 1751067 - protein, 24 aa, Staphylococcus epidermidis
GACGWMVYILFFDGLEVHTIYSSF

SEQ ID NO: 1751068 - protein, 24 aa, Staphylococcus epidermidis
GAFIALVLYILRIKYLKESPTWII

SEQ ID NO: 1751069 - protein, 18 aa, Staphylococcus epidermidis
GAGYNIVAVPLAAGVLAF

SEQ ID NO: 1751070 - protein, 37 aa, Staphylococcus epidermidis
GAHKSILFFIAFAIYIMVFIALFIWLPNDLNQVNQSY

SEQ ID NO: 1751071 - protein, 18 aa, Staphylococcus epidermidis
GAIFLVNALLSGVGLYLL

SEQ ID NO: 1751072 - protein, 25 aa, Staphylococcus epidermidis
GAIIIYPAILILPPLIGIPAYSAYI

SEQ ID NO: 1751073 - protein, 29 aa, Staphylococcus epidermidis
GAIILQLALLFIAQLYYHFTKGISSEREP

SEQ ID NO: 1751074 - protein, 25 aa, Staphylococcus epidermidis
GAINTFITLAFLGVTTILGYYKNFN

SEQ ID NO: 1751075 - protein, 29 aa, Staphylococcus epidermidis
GAIVLQLALLFITQLYFHFSHNITSQREP

SEQ ID NO: 1751076 - protein, 20 aa, Staphylococcus epidermidis
GAIYLSLFKVFGPLITVLPG

SEQ ID NO: 1751077 - protein, 24 aa, Staphylococcus epidermidis
GALVVIIWIAWIKPLASINEIFGM

SEQ ID NO: 1751078 - protein, 38 aa, Staphylococcus epidermidis
GAPLVLNPVFFIPFILAPIVNVWIFKFFVDVLNMNSFS

SEQ ID NO: 1751079 - protein, 17 aa, Staphylococcus epidermidis
GASALIPLLKLLVVVVF

SEQ ID NO: 1751080 - protein, 18 aa, Staphylococcus epidermidis
GASSIVIGGIIFLSGHED

SEQ ID NO: 1751081 - protein, 20 aa, Staphylococcus epidermidis
GATFLLIGLFWLNGIAKKRG

SEQ ID NO: 1751082 - protein, 17 aa, Staphylococcus epidermidis
GATLTYTPKAVDGDPII

SEQ ID NO: 1751083 - protein, 20 aa, Staphylococcus epidermidis
GDAFKYAAPVAGALGYTVED

SEQ ID NO: 1751084 - protein, 23 aa, Staphylococcus epidermidis
GDGQPILQLISDNPQINATVTEF

SEQ ID NO: 1751085 - protein, 49 aa, Staphylococcus epidermidis
GDHFDHIINVIISFFKKHWPKLLIIIGIILLLLILNAIFTTVNKNDHTN

SEQ ID NO: 1751086 - protein, 26 aa, Staphylococcus epidermidis
GDNPTYSLGDYVWLDKNKNGVQDDDE

SEQ ID NO: 1751087 - protein, 18 aa, Staphylococcus epidermidis
GDPIISTKEIPFNKKREF

SEQ ID NO: 1751088 - protein, 23 aa, Staphylococcus epidermidis
GDPLVHFIHFPLGVTLLYIGVFF

SEQ ID NO: 1751089 - protein, 26 aa, Staphylococcus epidermidis
GDSIALWIVAIVAIVISLIALFKQAH

SEQ ID NO: 1751090 - protein, 24 aa, Staphylococcus epidermidis
GDSNNLVLGESILVVGNPLGVDFK

SEQ ID NO: 1751091 - protein, 26 aa, Staphylococcus epidermidis
GEEFYLKKIWVAIKFLAVYIYQLLTS

SEQ ID NO: 1751092 - protein, 19 aa, Staphylococcus epidermidis
GEFEFWFALIKVVTIILMI

SEQ ID NO: 1751093 - protein, 24 aa, Staphylococcus epidermidis
GERIFYILSFLFNVLILIGVIGGR

SEQ ID NO: 1751094 - protein, 23 aa, Staphylococcus epidermidis
GESKWTFRKLLNYGIDGLISFNN

SEQ ID NO: 1751095 - protein, 22 aa, Staphylococcus epidermidis
GETFFGYLIWYSIGRFFVEGLR

SEQ ID NO: 1751096 - protein, 26 aa, Staphylococcus epidermidis
GFDYLLLTMLLYIPGLIVYSIVQKNN

SEQ ID NO: 1751097 - protein, 20 aa, Staphylococcus epidermidis
GFFLLAPLFVSMVVGIVFLK

SEQ ID NO: 1751098 - protein, 22 aa, Staphylococcus epidermidis
GFGQIFLMPSIIGGLLILIGIF

SEQ ID NO: 1751099 - protein, 31 aa, Staphylococcus epidermidis
GFIIHFANWRWIFFINIFIVIIAVPLMNKYV

SEQ ID NO: 1751100 - protein, 20 aa, Staphylococcus epidermidis
GFLILYFLAPYIAELTLSRN

SEQ ID NO: 1751101 - protein, 28 aa, Staphylococcus epidermidis
GFLLAFVSLFLVIWFPASPFVIIFSSIM

SEQ ID NO: 1751102 - protein, 30 aa, Staphylococcus epidermidis
GFPPGTFFHASNRRWPYNLPRSRNILRASD

SEQ ID NO: 1751103 - protein, 24 aa, Staphylococcus epidermidis
GFQFSFLICFFILMAQPFLKNLTP

SEQ ID NO: 1751104 - protein, 17 aa, Staphylococcus epidermidis
GFVFITLSERSVKWMFV

SEQ ID NO: 1751105 - protein, 27 aa, Staphylococcus epidermidis
GFVGIILFFAIFGFFIKRVTHAFKELE

SEQ ID NO: 1751106 - protein, 26 aa, Staphylococcus epidermidis
GGAFLFMFLIFTIFVGLPLLIMEFTV

SEQ ID NO: 1751107 - protein, 25 aa, Staphylococcus epidermidis
GGAIIIYPAILLLPPLFGNPSYSAY

SEQ ID NO: 1751108 - protein, 25 aa, Staphylococcus epidermidis
GGALVWLMYLPHWKVTEDPAVKLGV

SEQ ID NO: 1751109 - protein, 23 aa, Staphylococcus epidermidis
GGGYLIWLWLREGHSYWLGLLGG

SEQ ID NO: 1751110 - protein, 26 aa, Staphylococcus epidermidis
GGIPTYTYLIPIVSLFALITISVMTF

SEQ ID NO: 1751111 - protein, 27 aa, Staphylococcus epidermidis
GGITNISSIRPVYTKKQQARAQINDKF

SEQ ID NO: 1751112 - protein, 32 aa, Staphylococcus epidermidis
GGLEWSPDHKSLIYKYDATLGRQINTNDVLTL

SEQ ID NO: 1751113 - protein, 26 aa, Staphylococcus epidermidis
GGMLQRMMIALALALKPKLIIADEPT

SEQ ID NO: 1751114 - protein, 29 aa, Staphylococcus epidermidis
GGNGVLLVVPFFSLVILFSLGIDYAIFLL

SEQ ID NO: 1751115 - protein, 26 aa, Staphylococcus epidermidis
GGSIALLSLLLFIASGIYLIAKYSTG

SEQ ID NO: 1751116 - protein, 27 aa, Staphylococcus epidermidis
GGSKALNLNLGFAQWGFKQKPNESYAE

SEQ ID NO: 1751117 - protein, 23 aa, Staphylococcus epidermidis
GGTALAFYLFIDSLKYLSAKETT

SEQ ID NO: 1751118 - protein, 20 aa, Staphylococcus epidermidis
GGTFFYRFRKIIAPLFASGY

SEQ ID NO: 1751119 - protein, 27 aa, Staphylococcus epidermidis
GGYLFGSLFFMLISKVWIGKNASLVDY

SEQ ID NO: 1751120 - protein, 26 aa, Staphylococcus epidermidis
GHDVSWGEWFLYAAPWSILMSIALYF

SEQ ID NO: 1751121 - protein, 22 aa, Staphylococcus epidermidis
GHFLWPAILAFALTGIGLPLLG

SEQ ID NO: 1751122 - protein, 18 aa, Staphylococcus epidermidis
GHLILNEIMLLIVGLGIA

SEQ ID NO: 1751123 - protein, 27 aa, Staphylococcus epidermidis
GHSAWRYFMLIFYLVPYALFGGLIYAI

SEQ ID NO: 1751124 - protein, 25 aa, Staphylococcus epidermidis
GHSNIILMMLIFILAGAFSTTAEKM

SEQ ID NO: 1751125 - protein, 24 aa, Staphylococcus epidermidis
GIACVLIILLFFTNTLRSDLRVNR

SEQ ID NO: 1751126 - protein, 53 aa, Staphylococcus epidermidis
GIAIAIVILIIFAFAFRFIVKLIPVHYIFRVLSILIFIMTFKMLGVSIQKLQL

SEQ ID NO: 1751127 - protein, 38 aa, Staphylococcus epidermidis
GIAKLDAIEITARKKALANTYLQGLSDEKIHEIESDND

SEQ ID NO: 1751128 - protein, 25 aa, Staphylococcus epidermidis
GIDKVLWFFIAVIIGSLVTTLAVLI

SEQ ID NO: 1751129 - protein, 33 aa, Staphylococcus epidermidis
GIDSVFTPIKLRRRVWRRLARDLKPDQLHDIKH

SEQ ID NO: 1751130 - protein, 26 aa, Staphylococcus epidermidis
GIDYLLLTMLLYIPGIIVYIVVQKNN

SEQ ID NO: 1751131 - protein, 26 aa, Staphylococcus epidermidis
GIDYLLLTMLLYIPGIIVYVVVQKNN

SEQ ID NO: 1751132 - protein, 17 aa, Staphylococcus epidermidis
GIFLLLIVPFVQPFIGL

SEQ ID NO: 1751133 - protein, 22 aa, Staphylococcus epidermidis
GIFLMSITFFPVPMYIVSCIFG

SEQ ID NO: 1751134 - protein, 25 aa, Staphylococcus epidermidis
GIFTFFLLTVFTITLKTYFSYYVDF

SEQ ID NO: 1751135 - protein, 20 aa, Staphylococcus epidermidis
GIGTIRDIQPLVVKKPTAKS

SEQ ID NO: 1751136 - protein, 24 aa, Staphylococcus epidermidis
GIGTLIYILITRAKIPAYLGSSFA

SEQ ID NO: 1751137 - protein, 30 aa, Staphylococcus epidermidis
GIHEIYFPYVLMRPLLFLAVILGGMTGVAT

SEQ ID NO: 1751138 - protein, 21 aa, Staphylococcus epidermidis
GIIALILGLIIFIYKKTSTNK

SEQ ID NO: 1751139 - protein, 21 aa, Staphylococcus epidermidis
GIIAWFYSLIWAFIGFIWITH

SEQ ID NO: 1751140 - protein, 19 aa, Staphylococcus epidermidis
GIIFFLALAFLFSSDRKNI

SEQ ID NO: 1751141 - protein, 28 aa, Staphylococcus epidermidis
GIIFIVLLIVLTLIFSIVHHYANVQKHE

SEQ ID NO: 1751142 - protein, 19 aa, Staphylococcus epidermidis
GIIIVVVTILFIASAWSGL

SEQ ID NO: 1751143 - protein, 24 aa, Staphylococcus epidermidis
GIILGVITFWLFAQSLVNLVVPLQ

SEQ ID NO: 1751144 - protein, 17 aa, Staphylococcus epidermidis
GIKYGLFIQSIIDFIIV

SEQ ID NO: 1751145 - protein, 19 aa, Staphylococcus epidermidis
GILCYIFWGIYLKEGMYQY

SEQ ID NO: 1751146 - protein, 27 aa, Staphylococcus epidermidis
GILPNKTSWWLVIPVGLVYAVIYYFVF

SEQ ID NO: 1751147 - protein, 24 aa, Staphylococcus epidermidis
GILSLFIILIPVVIIALLILFCFL

SEQ ID NO: 1751148 - protein, 30 aa, Staphylococcus epidermidis
GILVVIIAPFFSYLVKFFPPVVTGSVVTII

SEQ ID NO: 1751149 - protein, 29 aa, Staphylococcus epidermidis
GILVVLIAPFFSYLVKFFPPVVTGSVVTI

SEQ ID NO: 1751150 - protein, 25 aa, Staphylococcus epidermidis
GIMGPMLIIPLFFQNFKHYTAIEAA

SEQ ID NO: 1751151 - protein, 22 aa, Staphylococcus epidermidis
GIMIFLTFILFQNVILYAQTTI

SEQ ID NO: 1751152 - protein, 19 aa, Staphylococcus epidermidis
GIPAFLMVVLMGVTGLVLN

SEQ ID NO: 1751153 - protein, 18 aa, Staphylococcus epidermidis
GIRMFKRYAVITTSAKIL

SEQ ID NO: 1751154 - protein, 35 aa, Staphylococcus epidermidis
GISFDPFTPLLIAAVLYFILTFALSRIMSLVEGRM

SEQ ID NO: 1751155 - protein, 23 aa, Staphylococcus epidermidis
GISLLTAILPVILMLISTIVQLV

SEQ ID NO: 1751156 - protein, 24 aa, Staphylococcus epidermidis
GISPFLLVPYSIYPILLGVCGLVA

SEQ ID NO: 1751157 - protein, 24 aa, Staphylococcus epidermidis
GISVITLIIIFYRPLMISTFDETF

SEQ ID NO: 1751158 - protein, 33 aa, Staphylococcus epidermidis
GITHSIPFTILWPILITFLIFVIFNHTEPLHVW

SEQ ID NO: 1751159 - protein, 18 aa, Staphylococcus epidermidis
GIVFLIMLKLMLAIAFFA

SEQ ID NO: 1751160 - protein, 24 aa, Staphylococcus epidermidis
GIVILLTLIIFMKLNTFISLIITS

SEQ ID NO: 1751161 - protein, 23 aa, Staphylococcus epidermidis
GIWTLKLFILPNHPIIKSGLYKV

SEQ ID NO: 1751162 - protein, 17 aa, Staphylococcus epidermidis
GIYFVAMNYFNTNHTLN

SEQ ID NO: 1751163 - protein, 26 aa, Staphylococcus epidermidis
GIYILIGFLVLFSFQRILTTHFHFGY

SEQ ID NO: 1751164 - protein, 23 aa, Staphylococcus epidermidis
GKDALTDIAILKIKDTKGIKSIQ

SEQ ID NO: 1751165 - protein, 24 aa, Staphylococcus epidermidis
GKGSWYIPKWLGSVLPKIDIEGKA

SEQ ID NO: 1751166 - protein, 24 aa, Staphylococcus epidermidis
GKIILQPQFLLTNSKIIVSAKKGN

SEQ ID NO: 1751167 - protein, 28 aa, Staphylococcus epidermidis
GKIKKDDLILLVGFGGGLAYASTLIRWT

SEQ ID NO: 1751168 - protein, 19 aa, Staphylococcus epidermidis
GKIKPIYFIGGILGMAFVT

SEQ ID NO: 1751169 - protein, 30 aa, Staphylococcus epidermidis
GKIVLPIFSILFFLAAWFFARKPSKILDYI

SEQ ID NO: 1751170 - protein, 19 aa, Staphylococcus epidermidis
GKLITPDKIAIALGLGADL

SEQ ID NO: 1751171 - protein, 18 aa, Staphylococcus epidermidis
GKLTIYLGYSPGVGKTYE

SEQ ID NO: 1751172 - protein, 20 aa, Staphylococcus epidermidis
GKQMGYVYFSWLLGLLVGMV

SEQ ID NO: 1751173 - protein, 17 aa, Staphylococcus epidermidis
GKSTLISLIPRFYDVTA

SEQ ID NO: 1751174 - protein, 35 aa, Staphylococcus epidermidis
GKTFSEFRIFLAVLITLLLIISISLVIASTYSIIK

SEQ ID NO: 1751175 - protein, 21 aa, Staphylococcus epidermidis
GKVATFRLLLIDTPETKDPRK

SEQ ID NO: 1751176 - protein, 31 aa, Staphylococcus epidermidis
GKVVTHTVTGLPQGLKFDASTNSIVGTPTQI

SEQ ID NO: 1751177 - protein, 19 aa, Staphylococcus epidermidis
GKYQEWFDTVTNGASDAAG

SEQ ID NO: 1751178 - protein, 17 aa, Staphylococcus epidermidis
GLAQMLPGFILRSNWLG

SEQ ID NO: 1751179 - protein, 28 aa, Staphylococcus epidermidis
GLDHSLLGQWWHWFSQLLHLNLGTSYQT

SEQ ID NO: 1751180 - protein, 30 aa, Staphylococcus epidermidis
GLEQNIYRIIWIFALFLSLAIMYYFLNVFI

SEQ ID NO: 1751181 - protein, 19 aa, Staphylococcus epidermidis
GLFSPIILGLIAVFIISLI

SEQ ID NO: 1751182 - protein, 18 aa, Staphylococcus epidermidis
GLGLILGVFAYAASFFGA

SEQ ID NO: 1751183 - protein, 73 aa, Staphylococcus epidermidis
GLIAMNRYQVMPGYKVKFIFMILVTMIVFVLINTYLLRQLKSIGMFIMIVILAVYFIAMNYLNPSGSGSTLNR

SEQ ID NO: 1751184 - protein, 30 aa, Staphylococcus epidermidis
GLIFSGIYFFVFRFLILKFDIPLPGRRAEE

SEQ ID NO: 1751185 - protein, 24 aa, Staphylococcus epidermidis
GLIGGPWVAIIVGIISGLCRLYIG

SEQ ID NO: 1751186 - protein, 18 aa, Staphylococcus epidermidis
GLILFWNNKFNPLPIYNT

SEQ ID NO: 1751187 - protein, 20 aa, Staphylococcus epidermidis
GLLIIYTGFGIFKESIFTLS

SEQ ID NO: 1751188 - protein, 17 aa, Staphylococcus epidermidis
GLLILIGLILVLSIFKP

SEQ ID NO: 1751189 - protein, 21 aa, Staphylococcus epidermidis
GLPLLIALLHALFAALAFMKL

SEQ ID NO: 1751190 - protein, 17 aa, Staphylococcus epidermidis
GLPLLTALPIVSGMLEK

SEQ ID NO: 1751191 - protein, 25 aa, Staphylococcus epidermidis
GLRDVNVNLPQGWTKSFTINPNNNT

SEQ ID NO: 1751192 - protein, 26 aa, Staphylococcus epidermidis
GLSLIPQNLIIVGLFVICMFVSISMG

SEQ ID NO: 1751193 - protein, 26 aa, Staphylococcus epidermidis
GLTGVFAFILLLTQQWLWLNPNHNLN

SEQ ID NO: 1751194 - protein, 20 aa, Staphylococcus epidermidis
GLVNFIILPPKYYHQLEDQL

SEQ ID NO: 1751195 - protein, 25 aa, Staphylococcus epidermidis
GLVQNLILIMNPYSLIALVLSVFLF

SEQ ID NO: 1751196 - protein, 62 aa, Staphylococcus epidermidis
GLVQNLILLMNPYSLIALTLSVLLFFKGKKAFWFIFIGGFLLTFLLYANVVYFRFFSDFLTF

SEQ ID NO: 1751197 - protein, 19 aa, Staphylococcus epidermidis
GLYFSYIYNVPSGATIVLC

SEQ ID NO: 1751198 - protein, 17 aa, Staphylococcus epidermidis
GMHRKILVIGAETLSKI

SEQ ID NO: 1751199 - protein, 19 aa, Staphylococcus epidermidis
GMIMLFCSHLLIGRTYFYL

SEQ ID NO: 1751200 - protein, 20 aa, Staphylococcus epidermidis
GMIVLLCVGLILLSIFDRGL

SEQ ID NO: 1751201 - protein, 23 aa, Staphylococcus epidermidis
GMKNAAIKIWTALKNGVIAIIKA

SEQ ID NO: 1751202 - protein, 27 aa, Staphylococcus epidermidis
GMKSLPIFILLMFFSMQMVTLPKQMLP

SEQ ID NO: 1751203 - protein, 19 aa, Staphylococcus epidermidis
GMMLIGEACLFLLNVPSGV

SEQ ID NO: 1751204 - protein, 24 aa, Staphylococcus epidermidis
GMPLLAFHYPEEIWRGVFAFMSMM

SEQ ID NO: 1751205 - protein, 22 aa, Staphylococcus epidermidis
GMPMLWANFFWVWGHPEVYIVI

SEQ ID NO: 1751206 - protein, 24 aa, Staphylococcus epidermidis
GMVLKFIFDLLYPLTPFEMVEVSG

SEQ ID NO: 1751207 - protein, 27 aa, Staphylococcus epidermidis
GNETITQFIIKVVDTTAPVVTPIKNQT

SEQ ID NO: 1751208 - protein, 27 aa, Staphylococcus epidermidis
GNFRLQNFLARIKPADYYYTTLDPVEV

SEQ ID NO: 1751209 - protein, 24 aa, Staphylococcus epidermidis
GNGLKMFIFIMLLGSVVAAFFAND

SEQ ID NO: 1751210 - protein, 19 aa, Staphylococcus epidermidis
GNIVYIIIFLIIVVFVFKK

SEQ ID NO: 1751211 - protein, 34 aa, Staphylococcus epidermidis
GNMPLYMKIYLIVSLLLWLILYLQEREYIFKNYN

SEQ ID NO: 1751212 - protein, 20 aa, Staphylococcus epidermidis
GNPIAYAYNLDDLYITANVD

SEQ ID NO: 1751213 - protein, 19 aa, Staphylococcus epidermidis
GNPITSTEEIPFDKKRVFN

SEQ ID NO: 1751214 - protein, 20 aa, Staphylococcus epidermidis
GNPITSTEEIPFDKKRVFNP

SEQ ID NO: 1751215 - protein, 24 aa, Staphylococcus epidermidis
GNPKKIELEFQPLTSFSNKRYIYN

SEQ ID NO: 1751216 - protein, 31 aa, Staphylococcus epidermidis
GNSKKILLSYIFFVIFTPLVAFMLMRIMESS

SEQ ID NO: 1751217 - protein, 25 aa, Staphylococcus epidermidis
GNTNYLLIVLLLIMAGIFGGSVNSS

SEQ ID NO: 1751218 - protein, 20 aa, Staphylococcus epidermidis
GPFALDSFGWKETIPPKKDG

SEQ ID NO: 1751219 - protein, 31 aa, Staphylococcus epidermidis
GPLGNEVPNVRQFFLFDLTSRVIGSDENKDR

SEQ ID NO: 1751220 - protein, 31 aa, Staphylococcus epidermidis
GPMTHYFHWLGMGITYLVFLIGIIASTKLEK

SEQ ID NO: 1751221 - protein, 25 aa, Staphylococcus epidermidis
GPNSLNTVLTFDDLGIKTSTNRVRP

SEQ ID NO: 1751222 - protein, 30 aa, Staphylococcus epidermidis
GPSYIALAIWLVIGLVFFFIRYPKLKRMDN

SEQ ID NO: 1751223 - protein, 20 aa, Staphylococcus epidermidis
GQASILIATKEGSTWTLDKQ

SEQ ID NO: 1751224 - protein, 30 aa, Staphylococcus epidermidis
GQDDMTIDSGFYQTPKYSLGNYVWYDTNKD

SEQ ID NO: 1751225 - protein, 31 aa, Staphylococcus epidermidis
GQGWTHIWFDLLILTLFIIVFIALNIIGLKR

SEQ ID NO: 1751226 - protein, 19 aa, Staphylococcus epidermidis
GQITAQPIEKQAARDAINQ

SEQ ID NO: 1751227 - protein, 31 aa, Staphylococcus epidermidis
GQLFTVQFLIVILTFLFIDFFDTAGTLVAVA

SEQ ID NO: 1751228 - protein, 21 aa, Staphylococcus epidermidis
GQNWSAPINGSTVRSGLIGSV

SEQ ID NO: 1751229 - protein, 23 aa, Staphylococcus epidermidis
GQRTGDNIVDLQSIALLMNKDVL

SEQ ID NO: 1751230 - protein, 24 aa, Staphylococcus epidermidis
GQTIRLMEHFLRNGNQEEIDYQRE

SEQ ID NO: 1751231 - protein, 24 aa, Staphylococcus epidermidis
GQWYGYFIIIIMQFFILSYVIYKI

SEQ ID NO: 1751232 - protein, 21 aa, Staphylococcus epidermidis
GRLLTLYLIIREIAGVASIRV

SEQ ID NO: 1751233 - protein, 24 aa, Staphylococcus epidermidis
GRYEVLYLTIPLLILAFVFANHFT

SEQ ID NO: 1751234 - protein, 23 aa, Staphylococcus epidermidis
GSFLPELLDQLYNLDYATFEKYV

SEQ ID NO: 1751235 - protein, 24 aa, Staphylococcus epidermidis
GSGAPLPQFWRSAGAINSSVANDF

SEQ ID NO: 1751236 - protein, 31 aa, Staphylococcus epidermidis
GSKEAQLTEALLAEPTIKKGKKKTNVPNLVT

SEQ ID NO: 1751237 - protein, 22 aa, Staphylococcus epidermidis
GSKNKMIIPKDKYLVLGDNRTN

SEQ ID NO: 1751238 - protein, 29 aa, Staphylococcus epidermidis
GSLAAFYYAVVAPYKRHPMIKLMNAMQYD

SEQ ID NO: 1751239 - protein, 29 aa, Staphylococcus epidermidis
GSLAGIIILFLWLYITSFIIIIGAEINAI

SEQ ID NO: 1751240 - protein, 24 aa, Staphylococcus epidermidis
GSLWIYYIRFIKGNLRWSILIVSL

SEQ ID NO: 1751241 - protein, 36 aa, Staphylococcus epidermidis
GSNTREARFLPNKILNIRYKLRPVNIETPREVTFNE

SEQ ID NO: 1751242 - protein, 22 aa, Staphylococcus epidermidis
GSSFTKFPITTGYYPNGGAPGY

SEQ ID NO: 1751243 - protein, 19 aa, Staphylococcus epidermidis
GSTALWIGAGLMSLAVLFS

SEQ ID NO: 1751244 - protein, 27 aa, Staphylococcus epidermidis
GSTILFIIIIIFLMYANHLFIKRRTKE

SEQ ID NO: 1751245 - protein, 20 aa, Staphylococcus epidermidis
GSVESLKWSYEKYGDLAVAY

SEQ ID NO: 1751246 - protein, 22 aa, Staphylococcus epidermidis
GTFDNWFNMYLKEVKGSLLLEL

SEQ ID NO: 1751247 - protein, 23 aa, Staphylococcus epidermidis
GTFDNWFNMYLKEVKGSLLLELA

SEQ ID NO: 1751248 - protein, 17 aa, Staphylococcus epidermidis
GTFPIGNYNLKATKNMD

SEQ ID NO: 1751249 - protein, 17 aa, Staphylococcus epidermidis
GTFSTVIATLVFMGINT

SEQ ID NO: 1751250 - protein, 26 aa, Staphylococcus epidermidis
GTIIDYLIVFFLFGLTVVMIAGGGSA

SEQ ID NO: 1751251 - protein, 24 aa, Staphylococcus epidermidis
GTILSIIALLLIASFFITSADSAT

SEQ ID NO: 1751252 - protein, 22 aa, Staphylococcus epidermidis
GTLVGMRLRRVSPRKVIAPLIK

SEQ ID NO: 1751253 - protein, 26 aa, Staphylococcus epidermidis
GTLVGSLLAIVGSLFIFGRRKKGNEK

SEQ ID NO: 1751254 - protein, 32 aa, Staphylococcus epidermidis
GTQTLFDKRLDAMQNFPTGWLKAMVNIPDNMN

SEQ ID NO: 1751255 - protein, 19 aa, Staphylococcus epidermidis
GTVFIIFFILRELRMKAPM

SEQ ID NO: 1751256 - protein, 26 aa, Staphylococcus epidermidis
GTVLGIYPSYLPYNQERWQGANAMNA

SEQ ID NO: 1751257 - protein, 34 aa, Staphylococcus epidermidis
GTVNIDKQLNNFKNLGYSYVGTDALKAPNYTETS

SEQ ID NO: 1751258 - protein, 23 aa, Staphylococcus epidermidis
GTVRDEAWLNKKLNYISKKTYQG

SEQ ID NO: 1751259 - protein, 26 aa, Staphylococcus epidermidis
GTYAWLFLFLILFIKLARIPFWFLIK

SEQ ID NO: 1751260 - protein, 19 aa, Staphylococcus epidermidis
GVASITLGTALFLSSSHDA

SEQ ID NO: 1751261 - protein, 17 aa, Staphylococcus epidermidis
GVAYYFLRKLDIKNKDK

SEQ ID NO: 1751262 - protein, 18 aa, Staphylococcus epidermidis
GVENIIIAFILTRWAWFC

SEQ ID NO: 1751263 - protein, 20 aa, Staphylococcus epidermidis
GVFLFMLVLLNFPISMISGH

SEQ ID NO: 1751264 - protein, 24 aa, Staphylococcus epidermidis
GVGLIILVVFLVPGTIYGVLSGEI

SEQ ID NO: 1751265 - protein, 24 aa, Staphylococcus epidermidis
GVGLPLFTALPIVSSMLEKYGIRD

SEQ ID NO: 1751266 - protein, 34 aa, Staphylococcus epidermidis
GVICLMLVIYTLLPLIMSLLGEKIFWPSKKSTSH

SEQ ID NO: 1751267 - protein, 25 aa, Staphylococcus epidermidis
GVMTQGWWFPVMASAFLIFTIVIMF

SEQ ID NO: 1751268 - protein, 19 aa, Staphylococcus epidermidis
GVMYLICAVLMFVRGGIDA

SEQ ID NO: 1751269 - protein, 22 aa, Staphylococcus epidermidis
GVNKITNLRPVVAKKQSAIDEI

SEQ ID NO: 1751270 - protein, 17 aa, Staphylococcus epidermidis
GVPGLVRGLHDMHVKEG

SEQ ID NO: 1751271 - protein, 19 aa, Staphylococcus epidermidis
GVRHIILDLRNNPGGLLDE

SEQ ID NO: 1751272 - protein, 20 aa, Staphylococcus epidermidis
GVSFIIISLIIRAIVYKNDE

SEQ ID NO: 1751273 - protein, 20 aa, Staphylococcus epidermidis
GVSFIILSLIIRAIVYKTTK

SEQ ID NO: 1751274 - protein, 28 aa, Staphylococcus epidermidis
GVSIIRVIWYVFSWILIKTVFTIRKLSD

SEQ ID NO: 1751275 - protein, 42 aa, Staphylococcus epidermidis
GVSKFGSMAQKVGGFAPLLSNPYVLGFGAIVAASAGVGYLVY

SEQ ID NO: 1751276 - protein, 25 aa, Staphylococcus epidermidis
GVSNHIHTWNKFKYQVLFTGVYESE

SEQ ID NO: 1751277 - protein, 25 aa, Staphylococcus epidermidis
GVSTLIGIVFGWIPARAASKKELID

SEQ ID NO: 1751278 - protein, 21 aa, Staphylococcus epidermidis
GVVILIFTLTLHLPLYVLLIG

SEQ ID NO: 1751279 - protein, 23 aa, Staphylococcus epidermidis
GVVLNFVLVFTTLKIFGYSKDTI

SEQ ID NO: 1751280 - protein, 19 aa, Staphylococcus epidermidis
GVWFMSYFIFVKPMKKLQQ

SEQ ID NO: 1751281 - protein, 17 aa, Staphylococcus epidermidis
GVYAFVTNTPKNAYLLS

SEQ ID NO: 1751282 - protein, 25 aa, Staphylococcus epidermidis
GVYFYIYILLWCLPLLLFFLNGYLK

SEQ ID NO: 1751283 - protein, 21 aa, Staphylococcus epidermidis
GVYSMPVLVLILVAFFSKQTS

SEQ ID NO: 1751284 - protein, 28 aa, Staphylococcus epidermidis
GWDFMARYWWIVFPIGGFLSWLIPELTG

SEQ ID NO: 1751285 - protein, 20 aa, Staphylococcus epidermidis
GWDHLDLVGMDAFDLTHTGR

SEQ ID NO: 1751286 - protein, 22 aa, Staphylococcus epidermidis
GWIGWLVTILLWGTTLWGILYK

SEQ ID NO: 1751287 - protein, 27 aa, Staphylococcus epidermidis
GWMSLFVLIIFIFFTFSLAFQKYKKGR

SEQ ID NO: 1751288 - protein, 18 aa, Staphylococcus epidermidis
GWVIVFIAGLTVFFSGPG

SEQ ID NO: 1751289 - protein, 25 aa, Staphylococcus epidermidis
GYEKRIEKTKYFSFGITIETTKHIE

SEQ ID NO: 1751290 - protein, 21 aa, Staphylococcus epidermidis
GYHFTVYVPYGDDWFAYFMRR

SEQ ID NO: 1751291 - protein, 18 aa, Staphylococcus epidermidis
GYIDLSVGASFIPYGGSS

SEQ ID NO: 1751292 - protein, 26 aa, Staphylococcus epidermidis
GYITHQNYLPLWYELSKTKSKDNKEV

SEQ ID NO: 1751293 - protein, 25 aa, Staphylococcus epidermidis
GYIVSIFMGLVKFAPIAQAKWLDFP

SEQ ID NO: 1751294 - protein, 18 aa, Staphylococcus epidermidis
GYLIVYSIIFLSIALFMN

SEQ ID NO: 1751295 - protein, 18 aa, Staphylococcus epidermidis
GYLVVYCIIFVSIALFMN

SEQ ID NO: 1751296 - protein, 34 aa, Staphylococcus epidermidis
GYSKSIIRDDGERSYLLNSNPIQVLDLVEPENGY

SEQ ID NO: 1751297 - protein, 19 aa, Staphylococcus epidermidis
GYTPTLKHSGTNPALDSEG

SEQ ID NO: 1751298 - protein, 38 aa, Staphylococcus epidermidis
HAFNTLAHIVIWDTDQQPLVFELPELSLQNALVTSEVV

SEQ ID NO: 1751299 - protein, 25 aa, Staphylococcus epidermidis
HAIQAAKDLINAHPPIMDKNQIDQA

SEQ ID NO: 1751300 - protein, 24 aa, Staphylococcus epidermidis
HAIQAAKDLITAHPTIMDKNQIDQ

SEQ ID NO: 1751301 - protein, 17 aa, Staphylococcus epidermidis
HAKALNEAMRQLENEVA

SEQ ID NO: 1751302 - protein, 17 aa, Staphylococcus epidermidis
HAKETINYFKKLGIHTT

SEQ ID NO: 1751303 - protein, 18 aa, Staphylococcus epidermidis
HALFITFLFGMIAYFILL

SEQ ID NO: 1751304 - protein, 32 aa, Staphylococcus epidermidis
HALLIAVSMILTLWIVPWLSAKRARTLKQQVA

SEQ ID NO: 1751305 - protein, 29 aa, Staphylococcus epidermidis
HDLQTYHLIIYYLVILFGLEPIRAINNLI

SEQ ID NO: 1751306 - protein, 29 aa, Staphylococcus epidermidis
HDLQTYHLIIYYLVILFGLEPMRAINNLI

SEQ ID NO: 1751307 - protein, 24 aa, Staphylococcus epidermidis
HDQVYMMIIYYVVILMIMFGNFQV

SEQ ID NO: 1751308 - protein, 29 aa, Staphylococcus epidermidis
HEAKLYTLIWFFIGIVIYLLYGLKHSKKN

SEQ ID NO: 1751309 - protein, 23 aa, Staphylococcus epidermidis
HELNTYIHYLLNSLQKIPNTDAY

SEQ ID NO: 1751310 - protein, 26 aa, Staphylococcus epidermidis
HEVEEPDFLIVIYHGGLNKISKQNKR

SEQ ID NO: 1751311 - protein, 19 aa, Staphylococcus epidermidis
HFGIFSIPITIIWIVAITN

SEQ ID NO: 1751312 - protein, 18 aa, Staphylococcus epidermidis
HFPIGVWLLYIGVFFTIL

SEQ ID NO: 1751313 - protein, 18 aa, Staphylococcus epidermidis
HFVIIDKNGKLASTTNTL

SEQ ID NO: 1751314 - protein, 17 aa, Staphylococcus epidermidis
HFVLFLTTFLFLLTMSL

SEQ ID NO: 1751315 - protein, 35 aa, Staphylococcus epidermidis
HGDYIKPFIALFLLSMGFYILYQFLFKRAHEHHHV

SEQ ID NO: 1751316 - protein, 36 aa, Staphylococcus epidermidis
HGDYIKPFIALFLLSMGFYILYQFLFKRTHEHHTHV

SEQ ID NO: 1751317 - protein, 18 aa, Staphylococcus epidermidis
HGEWYRLITSMFLHFNFE

SEQ ID NO: 1751318 - protein, 19 aa, Staphylococcus epidermidis
HGGFWVKGVRKRKLKDYEP

SEQ ID NO: 1751319 - protein, 38 aa, Staphylococcus epidermidis
HGKNKQVKLKLWQLILLLLAVIILTAGITVAATILISH

SEQ ID NO: 1751320 - protein, 37 aa, Staphylococcus epidermidis
HGLKNRLTLVVIAIFIIFLILLFMFVNLSDEDTGQIT

SEQ ID NO: 1751321 - protein, 25 aa, Staphylococcus epidermidis
HHELFFFAVLFFIVGWLTIRNAIKK

SEQ ID NO: 1751322 - protein, 24 aa, Staphylococcus epidermidis
HHELFFFAVLFFIVGWLTIRNTIK

SEQ ID NO: 1751323 - protein, 20 aa, Staphylococcus epidermidis
HHFKLEIVPIHYIHSDKPTN

SEQ ID NO: 1751324 - protein, 24 aa, Staphylococcus epidermidis
HHHDYLHYKLGVANIKKSFKIDYH

SEQ ID NO: 1751325 - protein, 17 aa, Staphylococcus epidermidis
HHKDIRLSDTDKIDPIV

SEQ ID NO: 1751326 - protein, 20 aa, Staphylococcus epidermidis
HHVFWISFVAIFVGTALPLA

SEQ ID NO: 1751327 - protein, 18 aa, Staphylococcus epidermidis
HIDSKLILQVLFNLVDNA

SEQ ID NO: 1751328 - protein, 26 aa, Staphylococcus epidermidis
HIGTLWSSLFWVILGAILALALNRDK

SEQ ID NO: 1751329 - protein, 20 aa, Staphylococcus epidermidis
HIHKSHGINYLIITEPIHSK

SEQ ID NO: 1751330 - protein, 18 aa, Staphylococcus epidermidis
HILFPIEDIYWTELVASY

SEQ ID NO: 1751331 - protein, 20 aa, Staphylococcus epidermidis
HILLLILIMLICALNGYYPT

SEQ ID NO: 1751332 - protein, 21 aa, Staphylococcus epidermidis
HILRNSLIPIITFLGADIVSI

SEQ ID NO: 1751333 - protein, 19 aa, Staphylococcus epidermidis
HILTPNQSLILPINQPTKS

SEQ ID NO: 1751334 - protein, 21 aa, Staphylococcus epidermidis
HINIILFIGIMLVAANLRAPI

SEQ ID NO: 1751335 - protein, 27 aa, Staphylococcus epidermidis
HKAKNDLDYILSPIKDRPSLLDRIHGN

SEQ ID NO: 1751336 - protein, 22 aa, Staphylococcus epidermidis
HKASEQQSYHNKSEKIKNVNKP

SEQ ID NO: 1751337 - protein, 25 aa, Staphylococcus epidermidis
HKKVMLWAAIFALTFFIIYASRTIF

SEQ ID NO: 1751338 - protein, 21 aa, Staphylococcus epidermidis
HKRIIFTMFVLFIYIFGSNIS

SEQ ID NO: 1751339 - protein, 36 aa, Staphylococcus epidermidis
HKRRNTLYTAIVLLIALVLLVFAIKAIHVNPVKSDA

SEQ ID NO: 1751340 - protein, 18 aa, Staphylococcus epidermidis
HKSASPRMNLMSLAAEPN

SEQ ID NO: 1751341 - protein, 18 aa, Staphylococcus epidermidis
HKTQQELNLKLKIVEVNA

SEQ ID NO: 1751342 - protein, 30 aa, Staphylococcus epidermidis
HLGVAIGIALFIFLIVRPPIEYIRQYLAQW

SEQ ID NO: 1751343 - protein, 23 aa, Staphylococcus epidermidis
HLKNIIFCLLGTLIIALGVNMFV

SEQ ID NO: 1751344 - protein, 18 aa, Staphylococcus epidermidis
HLLTYYSFVFQDVILFND

SEQ ID NO: 1751345 - protein, 22 aa, Staphylococcus epidermidis
HLNFWLLAIGFIILVAPVTGVA

SEQ ID NO: 1751346 - protein, 18 aa, Staphylococcus epidermidis
HLRLIILIELFIQFIISA

SEQ ID NO: 1751347 - protein, 17 aa, Staphylococcus epidermidis
HLVLFPGILLQGAAIAA

SEQ ID NO: 1751348 - protein, 30 aa, Staphylococcus epidermidis
HMSGPLFIIVLLVIFFFLGFIVPSSSGLAV

SEQ ID NO: 1751349 - protein, 23 aa, Staphylococcus epidermidis
HNDFKFIPMYFGMGMIFSIAYVY

SEQ ID NO: 1751350 - protein, 37 aa, Staphylococcus epidermidis
HNISNFFSVLPWFIITVPLVLLLGYQLDILNLGDNVA

SEQ ID NO: 1751351 - protein, 17 aa, Staphylococcus epidermidis
HNKYSLPYFFGTVGILY

SEQ ID NO: 1751352 - protein, 26 aa, Staphylococcus epidermidis
HNPETLLPVNLYVKPELKHTIELYHD

SEQ ID NO: 1751353 - protein, 23 aa, Staphylococcus epidermidis
HNYLAIIFILILVGLFFILKMKS

SEQ ID NO: 1751354 - protein, 31 aa, Staphylococcus epidermidis
HPVGMALFIMSVIVIIGFVLNMFIKHFKKER

SEQ ID NO: 1751355 - protein, 18 aa, Staphylococcus epidermidis
HQHRIREQWQNAIKTKEM

SEQ ID NO: 1751356 - protein, 17 aa, Staphylococcus epidermidis
HQISMFSLFIFYKILIL

SEQ ID NO: 1751357 - protein, 18 aa, Staphylococcus epidermidis
HQKAEVIRGLINNNEEAT

SEQ ID NO: 1751358 - protein, 19 aa, Staphylococcus epidermidis
HQLRRSLFASTIFPVFMVM

SEQ ID NO: 1751359 - protein, 24 aa, Staphylococcus epidermidis
HQQGYAPLRFRSALVPLANIGSSL

SEQ ID NO: 1751360 - protein, 22 aa, Staphylococcus epidermidis
HQSIPTLMHLNQAQQNALNEKI

SEQ ID NO: 1751361 - protein, 17 aa, Staphylococcus epidermidis
HRRLLYGSVFLMATSAI

SEQ ID NO: 1751362 - protein, 31 aa, Staphylococcus epidermidis
HSAWRYFMLVFYLVPYILFGVLIYAILKAYE

SEQ ID NO: 1751363 - protein, 46 aa, Staphylococcus epidermidis
HSDDKKKGGFMKILLPLIAAILILGAIAIFGGMALNNHNDSKSDDQ

SEQ ID NO: 1751364 - protein, 21 aa, Staphylococcus epidermidis
HSLFIPMMLMLLLGAFTKSAQ

SEQ ID NO: 1751365 - protein, 37 aa, Staphylococcus epidermidis
HSNGSWDFLIHFFVDIGWFLTNWLYKFVNFVEDVLDK

SEQ ID NO: 1751366 - protein, 20 aa, Staphylococcus epidermidis
HSSKKWYRPLGYDAEDINLN

SEQ ID NO: 1751367 - protein, 29 aa, Staphylococcus epidermidis
HTGSFYVAAFFRFALVMIGVLSSSIVNLV

SEQ ID NO: 1751368 - protein, 29 aa, Staphylococcus epidermidis
HTGSFYVAAFFRFVLVMIGVLSSSIVNLI

SEQ ID NO: 1751369 - protein, 26 aa, Staphylococcus epidermidis
HTVEQTIYINPLRYSAKETNVNISGN

SEQ ID NO: 1751370 - protein, 29 aa, Staphylococcus epidermidis
HTVNGQENLYRIAIQYYGSGTQENVDKIK

SEQ ID NO: 1751371 - protein, 21 aa, Staphylococcus epidermidis
HVAGFIITSFIICIILFVKWM

SEQ ID NO: 1751372 - protein, 38 aa, Staphylococcus epidermidis
HVCVGIFLVILSISILLLMGFILYFHHLTSEASSISNS

SEQ ID NO: 1751373 - protein, 44 aa, Staphylococcus epidermidis
HVDSPWLSVLLIVVAFFVVPFLVAWILDLLLRKVIRLYSNDIFK

SEQ ID NO: 1751374 - protein, 27 aa, Staphylococcus epidermidis
HVFSFKLLLSLLVIGFIVLAILLASVI

SEQ ID NO: 1751375 - protein, 18 aa, Staphylococcus epidermidis
HVIIFKTIDPIPWKQHNV

SEQ ID NO: 1751376 - protein, 23 aa, Staphylococcus epidermidis
HVPLALFMLFQMMFCTIAVSILS

SEQ ID NO: 1751377 - protein, 23 aa, Staphylococcus epidermidis
HVQKAMLLHYISGKYVLDLKDDD

SEQ ID NO: 1751378 - protein, 19 aa, Staphylococcus epidermidis
HVWHVFVFALAFSLAINVH

SEQ ID NO: 1751379 - protein, 19 aa, Staphylococcus epidermidis
HVWLWAQLAVFLHVFVDIF

SEQ ID NO: 1751380 - protein, 32 aa, Staphylococcus epidermidis
HWHSLSKDPNPEYPILFTPAAKDYANFMSDNT

SEQ ID NO: 1751381 - protein, 19 aa, Staphylococcus epidermidis
HWISPFFITGVLGGLTTFS

SEQ ID NO: 1751382 - protein, 24 aa, Staphylococcus epidermidis
HWLTVLFIVLILISFNLLGARLFG

SEQ ID NO: 1751383 - protein, 23 aa, Staphylococcus epidermidis
HWVGLPLPFRFSGFGFDLSSTLV

SEQ ID NO: 1751384 - protein, 25 aa, Staphylococcus epidermidis
HYFKTVFNFIIVLITLLFRNGRIIF

SEQ ID NO: 1751385 - protein, 17 aa, Staphylococcus epidermidis
HYNTYYQPVGKPPKKKK

SEQ ID NO: 1751386 - protein, 25 aa, Staphylococcus epidermidis
HYQGFTKIIIVLIISPIIAFCVGFI

SEQ ID NO: 1751387 - protein, 17 aa, Staphylococcus epidermidis
IAAIFYVSNWWYIAKDV

SEQ ID NO: 1751388 - protein, 24 aa, Staphylococcus epidermidis
IAAIIWNLVTWLYGIPSSSSHALI

SEQ ID NO: 1751389 - protein, 23 aa, Staphylococcus epidermidis
IAGIITLWYYWIKRRRNIKQMVE

SEQ ID NO: 1751390 - protein, 23 aa, Staphylococcus epidermidis
IAGIITWLLTALGAAAVFVFKKV

SEQ ID NO: 1751391 - protein, 23 aa, Staphylococcus epidermidis
IAGILTLWYYWIKRRNNIKKMVD

SEQ ID NO: 1751392 - protein, 25 aa, Staphylococcus epidermidis
IAGVFAIFFFAFQLNLFPFQGSVDI

SEQ ID NO: 1751393 - protein, 29 aa, Staphylococcus epidermidis
IAHYAIYLLSLIISVILYFSFVTLKYAHH

SEQ ID NO: 1751394 - protein, 21 aa, Staphylococcus epidermidis
IAIIGMLIWIMMSHNLWESIK

SEQ ID NO: 1751395 - protein, 26 aa, Staphylococcus epidermidis
IAILGFSIMMGMKISLSKLAINVILA

SEQ ID NO: 1751396 - protein, 30 aa, Staphylococcus epidermidis
IAIVTFIVWIVFVHTGQFEPALLAAISVLV

SEQ ID NO: 1751397 - protein, 34 aa, Staphylococcus epidermidis
IAIYAITVILFSALMSFLFTNIYYHFHLKASNDA

SEQ ID NO: 1751398 - protein, 30 aa, Staphylococcus epidermidis
IAKNKWVSIVAWLIVLGVIITPLMINSPKF

SEQ ID NO: 1751399 - protein, 20 aa, Staphylococcus epidermidis
IAKYFAILPAMFMAAMPAMN

SEQ ID NO: 1751400 - protein, 28 aa, Staphylococcus epidermidis
IALFFEVGLVLLIPLVFTVAKRANVSIL

SEQ ID NO: 1751401 - protein, 18 aa, Staphylococcus epidermidis
IALIIAIVFFLIALILYI

SEQ ID NO: 1751402 - protein, 17 aa, Staphylococcus epidermidis
IALILYLFLKRFLKVKT

SEQ ID NO: 1751403 - protein, 17 aa, Staphylococcus epidermidis
IALIVVGIVMILFAFKT

SEQ ID NO: 1751404 - protein, 18 aa, Staphylococcus epidermidis
IALLIFLPILLKGGMVLM

SEQ ID NO: 1751405 - protein, 26 aa, Staphylococcus epidermidis
IALTTYIYLTLVAFNFISGVLTLPGL

SEQ ID NO: 1751406 - protein, 18 aa, Staphylococcus epidermidis
IALVVYALLPILRNTYTG

SEQ ID NO: 1751407 - protein, 17 aa, Staphylococcus epidermidis
IALYDSMPKPNRNKRIV

SEQ ID NO: 1751408 - protein, 47 aa, Staphylococcus epidermidis
IAMVAAIIIVYLILVITFKGGLAPFTILFSLPFTVIGVVLALVITGE

SEQ ID NO: 1751409 - protein, 29 aa, Staphylococcus epidermidis
IANTILRWLSIFVIPLFGIIISKLVDRNN

SEQ ID NO: 1751410 - protein, 35 aa, Staphylococcus epidermidis
IARMIGIGMILGGMLWALLAPIIAVGTLLETFFSS

SEQ ID NO: 1751411 - protein, 26 aa, Staphylococcus epidermidis
IASFQGLIPIIAGLVPAIMAVANALG

SEQ ID NO: 1751412 - protein, 25 aa, Staphylococcus epidermidis
IASLIIMAVLIWTIGIASSAWIIIL

SEQ ID NO: 1751413 - protein, 27 aa, Staphylococcus epidermidis
IASLLIMAILIWTIGIASSAWIIIVCL

SEQ ID NO: 1751414 - protein, 35 aa, Staphylococcus epidermidis
IATYIYVIITLLIVYVIPRFYKAIPAPLIAIIVLT

SEQ ID NO: 1751415 - protein, 27 aa, Staphylococcus epidermidis
IAVALIIVGLVQKFLFTSYTVSGESMH

SEQ ID NO: 1751416 - protein, 17 aa, Staphylococcus epidermidis
IAVILVYATLRGILSAV

SEQ ID NO: 1751417 - protein, 23 aa, Staphylococcus epidermidis
IAVITYFKLWKYLYREWFTSVDH

SEQ ID NO: 1751418 - protein, 20 aa, Staphylococcus epidermidis
IAVIVVLVVIIFIGGEESDG

SEQ ID NO: 1751419 - protein, 17 aa, Staphylococcus epidermidis
ICTVIWIVLVIILSFKF

SEQ ID NO: 1751420 - protein, 31 aa, Staphylococcus epidermidis
IDFILRWKRYFILGVVGIIIAILTLTNKDES

SEQ ID NO: 1751421 - protein, 37 aa, Staphylococcus epidermidis
IDGKTYFEITILNRKWWQSFHFYQKNKELKITTTDED

SEQ ID NO: 1751422 - protein, 24 aa, Staphylococcus epidermidis
IDKATIEGALLDLQNARESLHGEQ

SEQ ID NO: 1751423 - protein, 37 aa, Staphylococcus epidermidis
IDKLLINKYLGIPIFLGIMWLIFQTTFTWIGTPLSDQ

SEQ ID NO: 1751424 - protein, 29 aa, Staphylococcus epidermidis
IDPIPWKQHNVKLVFFLAIAKKDAQMMKK

SEQ ID NO: 1751425 - protein, 17 aa, Staphylococcus epidermidis
IDRIDWILIIVAIGLVL

SEQ ID NO: 1751426 - protein, 18 aa, Staphylococcus epidermidis
IDTALFVIIAFAGTLPGM

SEQ ID NO: 1751427 - protein, 32 aa, Staphylococcus epidermidis
IDTFKDDIFKTKDALNGIERLTAAKSKAEKLI

SEQ ID NO: 1751428 - protein, 24 aa, Staphylococcus epidermidis
IDTTKKLIIAKAEAKQVIKELSQK

SEQ ID NO: 1751429 - protein, 29 aa, Staphylococcus epidermidis
IDVAGSIWWVLLINILIALSALAMGIFVS

SEQ ID NO: 1751430 - protein, 19 aa, Staphylococcus epidermidis
IEEKLFREYLWKKVLMKHI

SEQ ID NO: 1751431 - protein, 20 aa, Staphylococcus epidermidis
IEFILFRLVPTLLLNFILLL

SEQ ID NO: 1751432 - protein, 19 aa, Staphylococcus epidermidis
IEGWRWMLGLAVVPSVILL

SEQ ID NO: 1751433 - protein, 25 aa, Staphylococcus epidermidis
IEKGKVNKLLKRNPTVEQVKESVAN

SEQ ID NO: 1751434 - protein, 27 aa, Staphylococcus epidermidis
IEKTLLSAKRWIRYIHEVEEPDFLIVI

SEQ ID NO: 1751435 - protein, 18 aa, Staphylococcus epidermidis
IELLLIVLLYTKQSFTLN

SEQ ID NO: 1751436 - protein, 17 aa, Staphylococcus epidermidis
IENILPATTVKDKAKAD

SEQ ID NO: 1751437 - protein, 48 aa, Staphylococcus epidermidis
IERYNHAKPPKFLVRFWTLFVSFLMGLVLMTVLFFNNLGMVKLGNINT

SEQ ID NO: 1751438 - protein, 24 aa, Staphylococcus epidermidis
IETTKKLIIAKAEAKQMIKELSQK

SEQ ID NO: 1751439 - protein, 23 aa, Staphylococcus epidermidis
IEWVLLVKIFKRKIPFLDKVILK

SEQ ID NO: 1751440 - protein, 18 aa, Staphylococcus epidermidis
IEYLFLRDKNSVVKFTDS

SEQ ID NO: 1751441 - protein, 26 aa, Staphylococcus epidermidis
IFCEIAFWFVILLGLVTRYILYQQTL

SEQ ID NO: 1751442 - protein, 19 aa, Staphylococcus epidermidis
IFCNFFINIGIFISLQFKE

SEQ ID NO: 1751443 - protein, 24 aa, Staphylococcus epidermidis
IFDVFFTLTWIIITISLVLNLIKV

SEQ ID NO: 1751444 - protein, 22 aa, Staphylococcus epidermidis
IFFIVVLVVLIVLVGLIGFRWS

SEQ ID NO: 1751445 - protein, 24 aa, Staphylococcus epidermidis
IFGALFQVFFFDKFMKYLSELNFI

SEQ ID NO: 1751446 - protein, 26 aa, Staphylococcus epidermidis
IFGSKILLMIVLRLLGINISVSIIFS

SEQ ID NO: 1751447 - protein, 17 aa, Staphylococcus epidermidis
IFHLPVFNMLFTSGAFL

SEQ ID NO: 1751448 - protein, 18 aa, Staphylococcus epidermidis
IFIFLIAMFYFEVMFDVE

SEQ ID NO: 1751449 - protein, 24 aa, Staphylococcus epidermidis
IFKERKLLITIAYKLLMDDHTYTL

SEQ ID NO: 1751450 - protein, 23 aa, Staphylococcus epidermidis
IFLVILVIFCGVAYYFLRKLDIK

SEQ ID NO: 1751451 - protein, 17 aa, Staphylococcus epidermidis
IFMGIICLIYWIGSILI

SEQ ID NO: 1751452 - protein, 20 aa, Staphylococcus epidermidis
IFNIIILAVMLFITMYFSYI

SEQ ID NO: 1751453 - protein, 31 aa, Staphylococcus epidermidis
IFNLFLIIISFFIFLLLLPFVLAYFIAVPIM

SEQ ID NO: 1751454 - protein, 20 aa, Staphylococcus epidermidis
IFNMFVFFEVFLMSSYCLLV

SEQ ID NO: 1751455 - protein, 17 aa, Staphylococcus epidermidis
IFPLMKKLENTGEIQQN

SEQ ID NO: 1751456 - protein, 24 aa, Staphylococcus epidermidis
IFPLNFFFFIVVFTFIIWGIFAII

SEQ ID NO: 1751457 - protein, 22 aa, Staphylococcus epidermidis
IFPYLLWMVIFIIIPVILLVYF

SEQ ID NO: 1751458 - protein, 26 aa, Staphylococcus epidermidis
IFQSINPLFILLFAPVVSAVWQKLGR

SEQ ID NO: 1751459 - protein, 20 aa, Staphylococcus epidermidis
IFRFILFLVQVYYIGMIVYF

SEQ ID NO: 1751460 - protein, 28 aa, Staphylococcus epidermidis
IFSFFASVLVLWIYFRRSLPRSVDINHL

SEQ ID NO: 1751461 - protein, 27 aa, Staphylococcus epidermidis
IFSGFIIGAFFLPLVMLGLHHIFTPIH

SEQ ID NO: 1751462 - protein, 29 aa, Staphylococcus epidermidis
IFTAIHLYFINWKYAIFIKYNLGYSVWNN

SEQ ID NO: 1751463 - protein, 24 aa, Staphylococcus epidermidis
IFVLTLIFVIWQPKGLDIGITALI

SEQ ID NO: 1751464 - protein, 25 aa, Staphylococcus epidermidis
IFVPLAIILLIAGAWYGLKLNKEKE

SEQ ID NO: 1751465 - protein, 25 aa, Staphylococcus epidermidis
IFVSFLILTIFIGGCGFINKEDSKE

SEQ ID NO: 1751466 - protein, 17 aa, Staphylococcus epidermidis
IFYFLAMISFLLVISFA

SEQ ID NO: 1751467 - protein, 19 aa, Staphylococcus epidermidis
IFYILIGLQFLYTAYRSLR

SEQ ID NO: 1751468 - protein, 20 aa, Staphylococcus epidermidis
IGALIAMKFNLTPLAIAVVA

SEQ ID NO: 1751469 - protein, 22 aa, Staphylococcus epidermidis
IGALLVLGIGKVLNHTVLNKDG

SEQ ID NO: 1751470 - protein, 17 aa, Staphylococcus epidermidis
IGATFHIVSLPDSGTRI

SEQ ID NO: 1751471 - protein, 24 aa, Staphylococcus epidermidis
IGDHVFIDGIWFEVQEEGLSILSH

SEQ ID NO: 1751472 - protein, 24 aa, Staphylococcus epidermidis
IGDHVFINGIWFEVQSDGLKMMSH

SEQ ID NO: 1751473 - protein, 36 aa, Staphylococcus epidermidis
IGETFSEFRIFLAVLLSLLLVISISLVIASTYSIIK

SEQ ID NO: 1751474 - protein, 17 aa, Staphylococcus epidermidis
IGGVPPFSGFPGKVLIF

SEQ ID NO: 1751475 - protein, 31 aa, Staphylococcus epidermidis
IGIFTSFIAGILWLIAGIMLLARKPKDDIYN

SEQ ID NO: 1751476 - protein, 18 aa, Staphylococcus epidermidis
IGILCLMISHWFKSKDNT

SEQ ID NO: 1751477 - protein, 27 aa, Staphylococcus epidermidis
IGILIAILYIPILFLMVYSFNSARNMI

SEQ ID NO: 1751478 - protein, 27 aa, Staphylococcus epidermidis
IGILVLISYLLFLLSGLANGLINMNTE

SEQ ID NO: 1751479 - protein, 19 aa, Staphylococcus epidermidis
IGIMYFIITLLLMTQVYGF

SEQ ID NO: 1751480 - protein, 23 aa, Staphylococcus epidermidis
IGIPFYAVLKVLVSHIFLLFKRR

SEQ ID NO: 1751481 - protein, 17 aa, Staphylococcus epidermidis
IGIWSGIVVIIIASIIL

SEQ ID NO: 1751482 - protein, 24 aa, Staphylococcus epidermidis
IGKALMLPVAILPAAGLLLAIGTA

SEQ ID NO: 1751483 - protein, 19 aa, Staphylococcus epidermidis
IGLCALFILLISTSRVYLG

SEQ ID NO: 1751484 - protein, 32 aa, Staphylococcus epidermidis
IGLIAVMVIVCIVLVIMMFVGGKKDSYYGIMK

SEQ ID NO: 1751485 - protein, 32 aa, Staphylococcus epidermidis
IGLITIMVIVCIVLVIMMFVGGKKDSYYGIMK

SEQ ID NO: 1751486 - protein, 33 aa, Staphylococcus epidermidis
IGLIVAIVVAILFFILFLVAISSKKKIKNQTEA

SEQ ID NO: 1751487 - protein, 23 aa, Staphylococcus epidermidis
IGLLVAGLIHLWKTNSSFRDAVI

SEQ ID NO: 1751488 - protein, 19 aa, Staphylococcus epidermidis
IGLPYIQITFISGGIIILG

SEQ ID NO: 1751489 - protein, 18 aa, Staphylococcus epidermidis
IGLWFNTMMAFTAYFIVW

SEQ ID NO: 1751490 - protein, 23 aa, Staphylococcus epidermidis
IGNDNLWYFYPDENNLNKVMKKY

SEQ ID NO: 1751491 - protein, 26 aa, Staphylococcus epidermidis
IGPMIHYFHWLGIGITYLVFLIGIIA

SEQ ID NO: 1751492 - protein, 27 aa, Staphylococcus epidermidis
IGPRNFYFIYVLWMILVLCFAKQYGES

SEQ ID NO: 1751493 - protein, 22 aa, Staphylococcus epidermidis
IGRVPAIIALVVYALLPILRNT

SEQ ID NO: 1751494 - protein, 30 aa, Staphylococcus epidermidis
IGSVLLILLFLFLIFHLIRLASKIDNQFNK

SEQ ID NO: 1751495 - protein, 27 aa, Staphylococcus epidermidis
IGSVTNHEILITLKNSQTLSSLGYSNN

SEQ ID NO: 1751496 - protein, 21 aa, Staphylococcus epidermidis
IGTIVLIYLFSALYGYAMEFL

SEQ ID NO: 1751497 - protein, 18 aa, Staphylococcus epidermidis
IGVFHSKYLLAWSKHKND

SEQ ID NO: 1751498 - protein, 23 aa, Staphylococcus epidermidis
IGVFILIILFIYNIYTYFSKLIR

SEQ ID NO: 1751499 - protein, 25 aa, Staphylococcus epidermidis
IGVLLIACLAYLYFFVMKNEEQVEK

SEQ ID NO: 1751500 - protein, 17 aa, Staphylococcus epidermidis
IGVWLLYIGVFFTILSG

SEQ ID NO: 1751501 - protein, 24 aa, Staphylococcus epidermidis
IHEAYYFNFFSRLLTALIGLVTAG

SEQ ID NO: 1751502 - protein, 25 aa, Staphylococcus epidermidis
IHFNLLTMLIYGIVLIIISLLDSLF

SEQ ID NO: 1751503 - protein, 24 aa, Staphylococcus epidermidis
IHTPPRTRINTNSQPKHLPHGSYF

SEQ ID NO: 1751504 - protein, 19 aa, Staphylococcus epidermidis
IHWILFFLMIFFVFIVLVA

SEQ ID NO: 1751505 - protein, 17 aa, Staphylococcus epidermidis
IIAIAVALIIVGLVQKF

SEQ ID NO: 1751506 - protein, 18 aa, Staphylococcus epidermidis
IIALIIFGPTKLPQFGRA

SEQ ID NO: 1751507 - protein, 26 aa, Staphylococcus epidermidis
IIALLLLILLFLSICLLFSPIILIVY

SEQ ID NO: 1751508 - protein, 20 aa, Staphylococcus epidermidis
IIASSFLYLQGGRLVDIITA

SEQ ID NO: 1751509 - protein, 25 aa, Staphylococcus epidermidis
IIATFLGWKWIFIFSIVVSVISLIL

SEQ ID NO: 1751510 - protein, 23 aa, Staphylococcus epidermidis
IIATVLLLIFMFVAIRGASVSGS

SEQ ID NO: 1751511 - protein, 19 aa, Staphylococcus epidermidis
IIAYIMLFIVIKTLGRIWT

SEQ ID NO: 1751512 - protein, 41 aa, Staphylococcus epidermidis
IIDDFGKAVGFITLTGLLYGFWLVFAKRRKNEEEEEKLRDN

SEQ ID NO: 1751513 - protein, 23 aa, Staphylococcus epidermidis
IIEIFFGIMLLIKRPASWLKKGI

SEQ ID NO: 1751514 - protein, 18 aa, Staphylococcus epidermidis
IIFAMISIILIVAATIYT

SEQ ID NO: 1751515 - protein, 25 aa, Staphylococcus epidermidis
IIFGIILFLVVIVGAIFGLTRLVVR

SEQ ID NO: 1751516 - protein, 19 aa, Staphylococcus epidermidis
IIFIMLFVVALFKCITNYK

SEQ ID NO: 1751517 - protein, 17 aa, Staphylococcus epidermidis
IIFLPIIIIRTSWLFIL

SEQ ID NO: 1751518 - protein, 28 aa, Staphylococcus epidermidis
IIFTLLCIGVLLWIVGVHPYLAFFPIVA

SEQ ID NO: 1751519 - protein, 25 aa, Staphylococcus epidermidis
IIGAIFVISYLFWYCKKIKKDPKSS

SEQ ID NO: 1751520 - protein, 22 aa, Staphylococcus epidermidis
IIGALLVLGIGKLLNKTGFNNE

SEQ ID NO: 1751521 - protein, 24 aa, Staphylococcus epidermidis
IIGGFILFFLMKFSHVMTPEMTDS

SEQ ID NO: 1751522 - protein, 28 aa, Staphylococcus epidermidis
IIGIAIILLLIIAAFIVKQVNGSGKKDS

SEQ ID NO: 1751523 - protein, 29 aa, Staphylococcus epidermidis
IIGIVIIVVLIIAAFILKQVNGSGSKDSK

SEQ ID NO: 1751524 - protein, 26 aa, Staphylococcus epidermidis
IIGLFLSFMAGVLWLIAGIMLLVRKP

SEQ ID NO: 1751525 - protein, 23 aa, Staphylococcus epidermidis
IIGLILGIIIATLIDAVTPEMVK

SEQ ID NO: 1751526 - protein, 54 aa, Staphylococcus epidermidis
IIGLLISFIFVISPLYFRFTIYWPFFSDTFIWLPLLLLGIERLLRDFKVGLFIL

SEQ ID NO: 1751527 - protein, 22 aa, Staphylococcus epidermidis
IIGVWFMSYFIFVKPMKRLQQT

SEQ ID NO: 1751528 - protein, 25 aa, Staphylococcus epidermidis
IIHWILFFLMIFFVFIVLSAPTYLP

SEQ ID NO: 1751529 - protein, 17 aa, Staphylococcus epidermidis
IIIAIVLFSLHGWSVYQ

SEQ ID NO: 1751530 - protein, 18 aa, Staphylococcus epidermidis
IIIAMCFVHLPTALIMMV

SEQ ID NO: 1751531 - protein, 20 aa, Staphylococcus epidermidis
IIIIGFILKFDTIAIILIAA

SEQ ID NO: 1751532 - protein, 21 aa, Staphylococcus epidermidis
IIIIILIITMVLNQNFMKDRV

SEQ ID NO: 1751533 - protein, 29 aa, Staphylococcus epidermidis
IIIITIIVLIFIVLFYKELFILSFDEEYS

SEQ ID NO: 1751534 - protein, 28 aa, Staphylococcus epidermidis
IIILCLSLFIVFFGISWGPVLWVMLPEL

SEQ ID NO: 1751535 - protein, 17 aa, Staphylococcus epidermidis
IIIPILLVLFKLPMNTV

SEQ ID NO: 1751536 - protein, 18 aa, Staphylococcus epidermidis
IIIWLFYSNHFINLINIL

SEQ ID NO: 1751537 - protein, 19 aa, Staphylococcus epidermidis
IIIWLFYSNHFINLINILF

SEQ ID NO: 1751538 - protein, 44 aa, Staphylococcus epidermidis
IIKANITFAIAIKFIALLLVIPGWLTLWIAILSDMGATLLVALN

SEQ ID NO: 1751539 - protein, 24 aa, Staphylococcus epidermidis
IIKNWIIVIVVAAIIIWAFAGIPG

SEQ ID NO: 1751540 - protein, 25 aa, Staphylococcus epidermidis
IIKYVLLALITLISFIIAIFTAIHL

SEQ ID NO: 1751541 - protein, 19 aa, Staphylococcus epidermidis
IILAVIIIVTIAVILILTV

SEQ ID NO: 1751542 - protein, 17 aa, Staphylococcus epidermidis
IILFLVVIVGAIFGLTR

SEQ ID NO: 1751543 - protein, 22 aa, Staphylococcus epidermidis
IILGVITFWLFAQSLVNLVVPL

SEQ ID NO: 1751544 - protein, 25 aa, Staphylococcus epidermidis
IILIILITILTFILICGYLSHKNKI

SEQ ID NO: 1751545 - protein, 20 aa, Staphylococcus epidermidis
IILLAFTYLPNMIYYIVACI

SEQ ID NO: 1751546 - protein, 19 aa, Staphylococcus epidermidis
IILMFILAFVGLVKPIIPS

SEQ ID NO: 1751547 - protein, 22 aa, Staphylococcus epidermidis
IILPPFFMATGALMYIIPYFRL

SEQ ID NO: 1751548 - protein, 20 aa, Staphylococcus epidermidis
IILSKILILAIYSFIYFAIT

SEQ ID NO: 1751549 - protein, 17 aa, Staphylococcus epidermidis
IIMFIADMLLAIPSFII

SEQ ID NO: 1751550 - protein, 28 aa, Staphylococcus epidermidis
IIMGVTVILLIAILFQFNLAHVATLASV

SEQ ID NO: 1751551 - protein, 22 aa, Staphylococcus epidermidis
IIMIIISIVVYLLIPKSLDITK

SEQ ID NO: 1751552 - protein, 17 aa, Staphylococcus epidermidis
IINLKSFWIRRIKRLLP

SEQ ID NO: 1751553 - protein, 36 aa, Staphylococcus epidermidis
IINLQREMWKYLSIIGVIVLFTVYLASRSINRTYIR

SEQ ID NO: 1751554 - protein, 22 aa, Staphylococcus epidermidis
IINNIFLHFIYNTSLVTLALFL

SEQ ID NO: 1751555 - protein, 37 aa, Staphylococcus epidermidis
IIPSFFPSIIVLFGSIFFLFMLDWETALIALISIPMY

SEQ ID NO: 1751556 - protein, 18 aa, Staphylococcus epidermidis
IIQMSGVVILIFTLTLHL

SEQ ID NO: 1751557 - protein, 22 aa, Staphylococcus epidermidis
IIRRIQIHIETWDRTALEEQEA

SEQ ID NO: 1751558 - protein, 33 aa, Staphylococcus epidermidis
IISIIGLLIVFVVAAFIFFSMISDQIFFKHVKS

SEQ ID NO: 1751559 - protein, 28 aa, Staphylococcus epidermidis
IISISIFIIMMIILNLLLPGTGLLLVGL

SEQ ID NO: 1751560 - protein, 17 aa, Staphylococcus epidermidis
IISIVVGFILWAIFFND

SEQ ID NO: 1751561 - protein, 17 aa, Staphylococcus epidermidis
IISIYIFIKITLIIYLF

SEQ ID NO: 1751562 - protein, 19 aa, Staphylococcus epidermidis
IISLIFLVAFSSKAALVIF

SEQ ID NO: 1751563 - protein, 19 aa, Staphylococcus epidermidis
IITFPILRKFKVATPIFKP

SEQ ID NO: 1751564 - protein, 24 aa, Staphylococcus epidermidis
IITKYWITYFIVNLIFHNDKLLYL

SEQ ID NO: 1751565 - protein, 21 aa, Staphylococcus epidermidis
IITLFIYSIIIFAIFLGITIV

SEQ ID NO: 1751566 - protein, 18 aa, Staphylococcus epidermidis
IITLLAIIWLIYEEYLIK

SEQ ID NO: 1751567 - protein, 18 aa, Staphylococcus epidermidis
IIVAVFSLFRIEVDLTFI

SEQ ID NO: 1751568 - protein, 24 aa, Staphylococcus epidermidis
IIVFYAIYLLKIDVAGSIWWVLLI

SEQ ID NO: 1751569 - protein, 24 aa, Staphylococcus epidermidis
IIVKTLLFFIIGSLVYISGYRNYQ

SEQ ID NO: 1751570 - protein, 17 aa, Staphylococcus epidermidis
IIVLLIINLIIAVLVIL

SEQ ID NO: 1751571 - protein, 18 aa, Staphylococcus epidermidis
IIVLLVILLAMNAIAILL

SEQ ID NO: 1751572 - protein, 18 aa, Staphylococcus epidermidis
IIVTVILYAMKVPGSIFV

SEQ ID NO: 1751573 - protein, 20 aa, Staphylococcus epidermidis
IIWIFSIPVIVAMIHTLVAS

SEQ ID NO: 1751574 - protein, 19 aa, Staphylococcus epidermidis
IIYAFISIILIASATIYTY

SEQ ID NO: 1751575 - protein, 23 aa, Staphylococcus epidermidis
IIYFILIHFFQHSFLLNTYINML

SEQ ID NO: 1751576 - protein, 18 aa, Staphylococcus epidermidis
IIYFILIHIFQHSFLLNT

SEQ ID NO: 1751577 - protein, 19 aa, Staphylococcus epidermidis
IIYLFLSFIVIVASASFIT

SEQ ID NO: 1751578 - protein, 20 aa, Staphylococcus epidermidis
IIYQFVIGLIYFIVRYLISK

SEQ ID NO: 1751579 - protein, 24 aa, Staphylococcus epidermidis
IIYTIVNFLFFDKWAFYSCEKQLN

SEQ ID NO: 1751580 - protein, 21 aa, Staphylococcus epidermidis
IKDLITFHIPKVINGLVMIVG

SEQ ID NO: 1751581 - protein, 20 aa, Staphylococcus epidermidis
IKFEALLFNIKKAKSLAFRD

SEQ ID NO: 1751582 - protein, 20 aa, Staphylococcus epidermidis
IKFHIYLLILPIITGLSGLI

SEQ ID NO: 1751583 - protein, 20 aa, Staphylococcus epidermidis
IKFHIYLLVLPIIAGLSGLI

SEQ ID NO: 1751584 - protein, 26 aa, Staphylococcus epidermidis
IKGLTLIFFFLVFTFSMHVLFTNGGI

SEQ ID NO: 1751585 - protein, 29 aa, Staphylococcus epidermidis
IKHYGMFLFSLLLSIVLYFSFTTLKYSHS

SEQ ID NO: 1751586 - protein, 17 aa, Staphylococcus epidermidis
IKINPLTGKVIISYVAV

SEQ ID NO: 1751587 - protein, 31 aa, Staphylococcus epidermidis
IKITAWPTGIFLLLLIIVSCTVWQIGWIDII

SEQ ID NO: 1751588 - protein, 25 aa, Staphylococcus epidermidis
IKKKILLALLTSLSSGVFLLIGGIA

SEQ ID NO: 1751589 - protein, 26 aa, Staphylococcus epidermidis
IKKQWLQYVFLISTILIALGTLWLGQ

SEQ ID NO: 1751590 - protein, 25 aa, Staphylococcus epidermidis
IKLARIPFWFLIKGLTLIFFFLVFT

SEQ ID NO: 1751591 - protein, 40 aa, Staphylococcus epidermidis
IKLWLTIILIVATVLILLSVSLITFIQYYFTQETEYAIKE

SEQ ID NO: 1751592 - protein, 29 aa, Staphylococcus epidermidis
IKLYKHFYYKLFALLLLATIIFAFLPFVD

SEQ ID NO: 1751593 - protein, 17 aa, Staphylococcus epidermidis
IKSLFSFTKPPLAEVKP

SEQ ID NO: 1751594 - protein, 24 aa, Staphylococcus epidermidis
IKTIQYPIVLISIFLVMLIVLNMT

SEQ ID NO: 1751595 - protein, 19 aa, Staphylococcus epidermidis
IKYINLLYVVFSHVPIIIV

SEQ ID NO: 1751596 - protein, 17 aa, Staphylococcus epidermidis
ILAFAVIMWVTEAVSYP

SEQ ID NO: 1751597 - protein, 35 aa, Staphylococcus epidermidis
ILAHLFKHLLIRLRYSYLYLSKRYYIIISFVLAIA

SEQ ID NO: 1751598 - protein, 19 aa, Staphylococcus epidermidis
ILCYIFWGIYLKEGMYQYN

SEQ ID NO: 1751599 - protein, 24 aa, Staphylococcus epidermidis
ILDKRFLFFFFASVILHCIWDTDI

SEQ ID NO: 1751600 - protein, 17 aa, Staphylococcus epidermidis
ILEIFYILIGLQFLYTA

SEQ ID NO: 1751601 - protein, 23 aa, Staphylococcus epidermidis
ILETPFGYLISLDKVLKSIQFNQ

SEQ ID NO: 1751602 - protein, 18 aa, Staphylococcus epidermidis
ILFIVILGALTAIGPLSI

SEQ ID NO: 1751603 - protein, 20 aa, Staphylococcus epidermidis
ILFSSIFILVAYVPNVFGFT

SEQ ID NO: 1751604 - protein, 26 aa, Staphylococcus epidermidis
ILGAVLLIFILVFGDLKFILESYTLA

SEQ ID NO: 1751605 - protein, 18 aa, Staphylococcus epidermidis
ILGFLITIFWGALNPLLS

SEQ ID NO: 1751606 - protein, 22 aa, Staphylococcus epidermidis
ILGMLLIMLLILILSLKKQPEG

SEQ ID NO: 1751607 - protein, 21 aa, Staphylococcus epidermidis
ILGVFLILLSFIALIYISFIS

SEQ ID NO: 1751608 - protein, 18 aa, Staphylococcus epidermidis
ILIDFRLPRMLITILAGA

SEQ ID NO: 1751609 - protein, 26 aa, Staphylococcus epidermidis
ILIGPLIHYLSWWGLGIDYIIILIGI

SEQ ID NO: 1751610 - protein, 17 aa, Staphylococcus epidermidis
ILIIIIGFILKFDTIAI

SEQ ID NO: 1751611 - protein, 18 aa, Staphylococcus epidermidis
ILIIYRRIKYQPSTFKNA

SEQ ID NO: 1751612 - protein, 26 aa, Staphylococcus epidermidis
ILILVIDLIYLLFIPGKLIIPHYSTS

SEQ ID NO: 1751613 - protein, 18 aa, Staphylococcus epidermidis
ILIPAYILLQSIVPIIVV

SEQ ID NO: 1751614 - protein, 29 aa, Staphylococcus epidermidis
ILISGVIFIIFVLLPASWFTGLVTNKTLA

SEQ ID NO: 1751615 - protein, 22 aa, Staphylococcus epidermidis
ILIVISIILIIYRRIKYQPSTF

SEQ ID NO: 1751616 - protein, 17 aa, Staphylococcus epidermidis
ILIVSLIMIIFLFFINR

SEQ ID NO: 1751617 - protein, 19 aa, Staphylococcus epidermidis
ILIYLTLIQISGVILLVIT

SEQ ID NO: 1751618 - protein, 17 aa, Staphylococcus epidermidis
ILKALLFALLSFAVCFF

SEQ ID NO: 1751619 - protein, 18 aa, Staphylococcus epidermidis
ILKIPILNSYYKIYRTYQ

SEQ ID NO: 1751620 - protein, 17 aa, Staphylococcus epidermidis
ILLIALGYFLKRINYLK

SEQ ID NO: 1751621 - protein, 29 aa, Staphylococcus epidermidis
ILLIILSLYLKWWILFGVSIALLIIVAIA

SEQ ID NO: 1751622 - protein, 22 aa, Staphylococcus epidermidis
ILLLILLLVVVFILLALLIMSF

SEQ ID NO: 1751623 - protein, 20 aa, Staphylococcus epidermidis
ILLLNLIIRIFFNSSCPTPS

SEQ ID NO: 1751624 - protein, 20 aa, Staphylococcus epidermidis
ILLVLFIVGTIAVILILTVG

SEQ ID NO: 1751625 - protein, 19 aa, Staphylococcus epidermidis
ILLVLFKLPMNTVVVNSII

SEQ ID NO: 1751626 - protein, 28 aa, Staphylococcus epidermidis
ILMGFTEQYLIWSIFRLISGITSGTVFV

SEQ ID NO: 1751627 - protein, 19 aa, Staphylococcus epidermidis
ILMYVFWELTSVSSFLLIS

SEQ ID NO: 1751628 - protein, 33 aa, Staphylococcus epidermidis
ILNHFIPIIITIILCYLGFQFGLKKRDEMLMFL

SEQ ID NO: 1751629 - protein, 17 aa, Staphylococcus epidermidis
ILNHIFSAPTRSQVGEK

SEQ ID NO: 1751630 - protein, 31 aa, Staphylococcus epidermidis
ILNNQSASYLIKKWALDRIKQIQLETMNSIR

SEQ ID NO: 1751631 - protein, 24 aa, Staphylococcus epidermidis
ILPPLAAMLFIKIGYHPIAGLAMA

SEQ ID NO: 1751632 - protein, 19 aa, Staphylococcus epidermidis
ILREKGTPSAAGFRIDTGY

SEQ ID NO: 1751633 - protein, 28 aa, Staphylococcus epidermidis
ILSCIGTFIFLILSLSRLNKLKLKRIVY

SEQ ID NO: 1751634 - protein, 29 aa, Staphylococcus epidermidis
ILSGKMLFFYIITIIILIVLVIFYIKEAQ

SEQ ID NO: 1751635 - protein, 24 aa, Staphylococcus epidermidis
ILSIFIILIPVVIIALLLLILLFL

SEQ ID NO: 1751636 - protein, 28 aa, Staphylococcus epidermidis
ILVIILIAIGILFYMRSNKRNSVGKVEE

SEQ ID NO: 1751637 - protein, 24 aa, Staphylococcus epidermidis
ILVILILLTLFLKFDRLIAVLGGV

SEQ ID NO: 1751638 - protein, 18 aa, Staphylococcus epidermidis
ILYAWSPFIILTVIVMIW

SEQ ID NO: 1751639 - protein, 22 aa, Staphylococcus epidermidis
ILYSIFCVLLIGLLILPETSIT

SEQ ID NO: 1751640 - protein, 25 aa, Staphylococcus epidermidis
IMATTPVLWILYAGRIVAGITGATG

SEQ ID NO: 1751641 - protein, 20 aa, Staphylococcus epidermidis
IMFVVEVGMLLSLVLTFFPN

SEQ ID NO: 1751642 - protein, 23 aa, Staphylococcus epidermidis
IMIIIMALLCVYAFDLKSLFKEF

SEQ ID NO: 1751643 - protein, 20 aa, Staphylococcus epidermidis
IMIIISIVVYLLIPKSLDIT

SEQ ID NO: 1751644 - protein, 17 aa, Staphylococcus epidermidis
IMISVIFVIYRRVKYQP

SEQ ID NO: 1751645 - protein, 26 aa, Staphylococcus epidermidis
IMKTLTLFTVLLTLPTLVFSFFGMNV

SEQ ID NO: 1751646 - protein, 19 aa, Staphylococcus epidermidis
IMLKLMLAIAFFAVSLAIS

SEQ ID NO: 1751647 - protein, 17 aa, Staphylococcus epidermidis
IMLPLDKVKVGDTLLIK

SEQ ID NO: 1751648 - protein, 21 aa, Staphylococcus epidermidis
IMQILTLVSVIFSPLTFIAGV

SEQ ID NO: 1751649 - protein, 20 aa, Staphylococcus epidermidis
IMSFFTTLIIYFPDSLNLGS

SEQ ID NO: 1751650 - protein, 34 aa, Staphylococcus epidermidis
IMTAFFCTFLAIILLFVWPPVFNAIVTFGKWIVG

SEQ ID NO: 1751651 - protein, 27 aa, Staphylococcus epidermidis
IMVTVFFMIIIYFIFYILAVIIAAHYD

SEQ ID NO: 1751652 - protein, 18 aa, Staphylococcus epidermidis
IMYIVYPGYIYNIGFQFS

SEQ ID NO: 1751653 - protein, 25 aa, Staphylococcus epidermidis
INEKYIRSLSYALQLMRDRLPLSEL

SEQ ID NO: 1751654 - protein, 26 aa, Staphylococcus epidermidis
INEREFNINLPFINKFILKMERDEAD

SEQ ID NO: 1751655 - protein, 25 aa, Staphylococcus epidermidis
INFGNIDSPYIIKVISKYDPNKDDY

SEQ ID NO: 1751656 - protein, 18 aa, Staphylococcus epidermidis
INFMILIITKYWITYFIV

SEQ ID NO: 1751657 - protein, 32 aa, Staphylococcus epidermidis
INGADNLTIDSGFYKTPKYSVGDYVWKDTNKD

SEQ ID NO: 1751658 - protein, 17 aa, Staphylococcus epidermidis
INGTIATAGILGSLFYF

SEQ ID NO: 1751659 - protein, 20 aa, Staphylococcus epidermidis
INGWILPITLGAILIASRKK

SEQ ID NO: 1751660 - protein, 26 aa, Staphylococcus epidermidis
INIDSKLILQVLFNLIDNALKHAESH

SEQ ID NO: 1751661 - protein, 17 aa, Staphylococcus epidermidis
INILTNLAESKKSDIRA

SEQ ID NO: 1751662 - protein, 23 aa, Staphylococcus epidermidis
INIPGYFTTIAAILLLGGIQLIS

SEQ ID NO: 1751663 - protein, 19 aa, Staphylococcus epidermidis
INIYLLMTGIIILGFFSLA

SEQ ID NO: 1751664 - protein, 24 aa, Staphylococcus epidermidis
INKVEALLLDAKKQIAHAENNKQV

SEQ ID NO: 1751665 - protein, 18 aa, Staphylococcus epidermidis
INLLAATEDTKPKTYIKP

SEQ ID NO: 1751666 - protein, 17 aa, Staphylococcus epidermidis
INLMLFDVSWIDTKLNP

SEQ ID NO: 1751667 - protein, 17 aa, Staphylococcus epidermidis
INNNAQPVLDKLAIERL

SEQ ID NO: 1751668 - protein, 23 aa, Staphylococcus epidermidis
INQPYIYHLFIKLILKGKNSQEV

SEQ ID NO: 1751669 - protein, 18 aa, Staphylococcus epidermidis
INQYTPDFSKKKNATLKL

SEQ ID NO: 1751670 - protein, 48 aa, Staphylococcus epidermidis
INTFDPIIFIILSIGVLLWILGIHPYIVFFPIILILIGYYIVRFKMQA

SEQ ID NO: 1751671 - protein, 28 aa, Staphylococcus epidermidis
INTFLMLFFELLVLFIVVSFIVSIIQQI

SEQ ID NO: 1751672 - protein, 17 aa, Staphylococcus epidermidis
INTILDPIKVEATDNSG

SEQ ID NO: 1751673 - protein, 17 aa, Staphylococcus epidermidis
INYLIITEPIHSKDFSG

SEQ ID NO: 1751674 - protein, 29 aa, Staphylococcus epidermidis
IPAIILSLLILFFYLFSDGLRDAFDPKMR

SEQ ID NO: 1751675 - protein, 23 aa, Staphylococcus epidermidis
IPAPLIAIIVLTALYMYTGSDVR

SEQ ID NO: 1751676 - protein, 25 aa, Staphylococcus epidermidis
IPASIIGLIVWFFAGLHSGGNANPK

SEQ ID NO: 1751677 - protein, 19 aa, Staphylococcus epidermidis
IPFLGPWLSFAPAAILGII

SEQ ID NO: 1751678 - protein, 26 aa, Staphylococcus epidermidis
IPFTWMMIIFSCLFLGTLIFTFFNDR

SEQ ID NO: 1751679 - protein, 17 aa, Staphylococcus epidermidis
IPILTAILLIFIGKRPI

SEQ ID NO: 1751680 - protein, 17 aa, Staphylococcus epidermidis
IPITLVTFILGLIIALF

SEQ ID NO: 1751681 - protein, 17 aa, Staphylococcus epidermidis
IPLAWFMNFDNFLVRPL

SEQ ID NO: 1751682 - protein, 19 aa, Staphylococcus epidermidis
IPLLKLLVVVVFAMIFFVV

SEQ ID NO: 1751683 - protein, 24 aa, Staphylococcus epidermidis
IPLSFAYVLFIVFWQVGFSNAVNL

SEQ ID NO: 1751684 - protein, 21 aa, Staphylococcus epidermidis
IPLSIWGIPFFIGGLCLAIAA

SEQ ID NO: 1751685 - protein, 24 aa, Staphylococcus epidermidis
IPNWLRRLITRSLAVIPVIICLIV

SEQ ID NO: 1751686 - protein, 19 aa, Staphylococcus epidermidis
IPQWILVTLLTVITIFLVV

SEQ ID NO: 1751687 - protein, 21 aa, Staphylococcus epidermidis
IPVLILAFIVSKLIPVFFIKR

SEQ ID NO: 1751688 - protein, 25 aa, Staphylococcus epidermidis
IQKEYWLVYGIVTLAAVIIPFFVTI

SEQ ID NO: 1751689 - protein, 43 aa, Staphylococcus epidermidis
IQKKGLRKYNNKLIAVTISSLALAAPLAFGNASAHAAQTNDNS

SEQ ID NO: 1751690 - protein, 18 aa, Staphylococcus epidermidis
IQQKANEIIQIIEANNNA

SEQ ID NO: 1751691 - protein, 17 aa, Staphylococcus epidermidis
IQSFMIMTCVLIGFIVC

SEQ ID NO: 1751692 - protein, 18 aa, Staphylococcus epidermidis
IQTICVLLGIWVYNLDKS

SEQ ID NO: 1751693 - protein, 17 aa, Staphylococcus epidermidis
IRKFAVGASSIVIGGII

SEQ ID NO: 1751694 - protein, 18 aa, Staphylococcus epidermidis
IRPLILKYRIQFIEQKTQ

SEQ ID NO: 1751695 - protein, 20 aa, Staphylococcus epidermidis
IRVGLIIIAIVLFSLHGWSV

SEQ ID NO: 1751696 - protein, 17 aa, Staphylococcus epidermidis
ISAFLFLATTFDSGSYI

SEQ ID NO: 1751697 - protein, 27 aa, Staphylococcus epidermidis
ISAFSFFIYLLHPIILDSLFAYTNIFE

SEQ ID NO: 1751698 - protein, 20 aa, Staphylococcus epidermidis
ISAMVIGILCLMISHWFKSK

SEQ ID NO: 1751699 - protein, 31 aa, Staphylococcus epidermidis
ISEANANIRSYLLQNNPILAGVNGDVTFYYR

SEQ ID NO: 1751700 - protein, 49 aa, Staphylococcus epidermidis
ISFIFVMSPLYFRFTIYWPFFSDTFIWLPLLLLGIERLLRDFKVGLFIL

SEQ ID NO: 1751701 - protein, 17 aa, Staphylococcus epidermidis
ISFLFYIASMILSNQTG

SEQ ID NO: 1751702 - protein, 22 aa, Staphylococcus epidermidis
ISGFFFAFAALTYLISAQPNMN

SEQ ID NO: 1751703 - protein, 17 aa, Staphylococcus epidermidis
ISGLPDGVSFDSATNTI

SEQ ID NO: 1751704 - protein, 22 aa, Staphylococcus epidermidis
ISIFTYLYLFISASVIVLILSS

SEQ ID NO: 1751705 - protein, 22 aa, Staphylococcus epidermidis
ISIIANFWWIQAIGAIYLIYMS

SEQ ID NO: 1751706 - protein, 27 aa, Staphylococcus epidermidis
ISKDGKKYLFFDNYQFDVPHYSINLLA

SEQ ID NO: 1751707 - protein, 23 aa, Staphylococcus epidermidis
ISKKTYQGIFSFNVLGLQDIHRN

SEQ ID NO: 1751708 - protein, 25 aa, Staphylococcus epidermidis
ISKLIPVFYIRRWFDTKTTIASAFL

SEQ ID NO: 1751709 - protein, 25 aa, Staphylococcus epidermidis
ISLDPDIFYPLIKKLKENNDYVVVN

SEQ ID NO: 1751710 - protein, 32 aa, Staphylococcus epidermidis
ISLFLGLSFLWFPIFSIIFSLITLLLVLSVSA

SEQ ID NO: 1751711 - protein, 17 aa, Staphylococcus epidermidis
ISLFYCIVIFPITIILY

SEQ ID NO: 1751712 - protein, 26 aa, Staphylococcus epidermidis
ISLGDALAPMLYKAAKWITSLANKFS

SEQ ID NO: 1751713 - protein, 27 aa, Staphylococcus epidermidis
ISLIFAIIIVLFIQSFIIIGAVIPDQS

SEQ ID NO: 1751714 - protein, 19 aa, Staphylococcus epidermidis
ISLKQQLPYIPKQRLYTLT

SEQ ID NO: 1751715 - protein, 17 aa, Staphylococcus epidermidis
ISLLNMAPIIFGGLALG

SEQ ID NO: 1751716 - protein, 26 aa, Staphylococcus epidermidis
ISLPFILLIVFFPLFYKLSHSDYGFY

SEQ ID NO: 1751717 - protein, 17 aa, Staphylococcus epidermidis
ISLVFLVAFSSKAALVI

SEQ ID NO: 1751718 - protein, 18 aa, Staphylococcus epidermidis
ISLYIIFIGKFLIYICYF

SEQ ID NO: 1751719 - protein, 32 aa, Staphylococcus epidermidis
ISMFSLFIFYKILILWTLPTLIFTIAMGFFVT

SEQ ID NO: 1751720 - protein, 21 aa, Staphylococcus epidermidis
ISNWRRIFAFLTFIAVIVLVG

SEQ ID NO: 1751721 - protein, 30 aa, Staphylococcus epidermidis
ISPITLVPVLFLLLFAWKKVPAIPTLLVGS

SEQ ID NO: 1751722 - protein, 26 aa, Staphylococcus epidermidis
ISPSIVVGPNFYMGIGTPGGNKIPTI

SEQ ID NO: 1751723 - protein, 38 aa, Staphylococcus epidermidis
ISRGYRQILKWSLNHKWIVIIVSIVILIGSIGLGATSL

SEQ ID NO: 1751724 - protein, 25 aa, Staphylococcus epidermidis
ISRIVSCLLILFLGAAIFSLLGQHA

SEQ ID NO: 1751725 - protein, 17 aa, Staphylococcus epidermidis
ISRIWIAIMFLIGFIAV

SEQ ID NO: 1751726 - protein, 23 aa, Staphylococcus epidermidis
ISSDIFVWFKLVLNDTSEFHNIK

SEQ ID NO: 1751727 - protein, 17 aa, Staphylococcus epidermidis
ISSIFAALTTWLKGMQG

SEQ ID NO: 1751728 - protein, 22 aa, Staphylococcus epidermidis
ISSIMIGIFYRKFDARYPKLGE

SEQ ID NO: 1751729 - protein, 30 aa, Staphylococcus epidermidis
ISSIVAIIYFIFFLKYKFLDKTSTIKVNIH

SEQ ID NO: 1751730 - protein, 25 aa, Staphylococcus epidermidis
ISSLYGILILLFVLSIIILVFGQNI

SEQ ID NO: 1751731 - protein, 29 aa, Staphylococcus epidermidis
ISTLADIFMVIFSILVFSKTLKLREGHIF

SEQ ID NO: 1751732 - protein, 37 aa, Staphylococcus epidermidis; identical to SEQ ID NO: 1596246

SEQ ID NO: 1751733 - protein, 18 aa, Staphylococcus epidermidis
ISVDSQTREVGKTINPIT

SEQ ID NO: 1751734 - protein, 19 aa, Staphylococcus epidermidis
ISVLLIYFLLTVLAQGVII

SEQ ID NO: 1751735 - protein, 19 aa, Staphylococcus epidermidis
ISYILLIVLKRRGLLDKFN

SEQ ID NO: 1751736 - protein, 17 aa, Staphylococcus epidermidis
ITAIVLSAFFYVMTIQK

SEQ ID NO: 1751737 - protein, 19 aa, Staphylococcus epidermidis
ITASKINHQWSLNKQVQGI

SEQ ID NO: 1751738 - protein, 48 aa, Staphylococcus epidermidis
ITDLKRVAKTPGVWIILIGLAILPSFYAWFNLWAMWDPYGNTGHIKVA

SEQ ID NO: 1751739 - protein, 25 aa, Staphylococcus epidermidis
ITDQQFFKFSFIHREPVMKENESYI

SEQ ID NO: 1751740 - protein, 28 aa, Staphylococcus epidermidis
ITEIYGFRFSFISLFFLCILSTIVVIIG

SEQ ID NO: 1751741 - protein, 21 aa, Staphylococcus epidermidis
ITFIFIWIGIILYSISQYMNI

SEQ ID NO: 1751742 - protein, 19 aa, Staphylococcus epidermidis
ITGIFILVTALFALLSSLF

SEQ ID NO: 1751743 - protein, 24 aa, Staphylococcus epidermidis
ITGIIGLFLSFIAGALWLIAGIML

SEQ ID NO: 1751744 - protein, 29 aa, Staphylococcus epidermidis
ITHSLPFTILWPILITFFIFVIFSHTNPL

SEQ ID NO: 1751745 - protein, 21 aa, Staphylococcus epidermidis
ITIGYERFMWKWKLFRIFNKQ

SEQ ID NO: 1751746 - protein, 25 aa, Staphylococcus epidermidis
ITIILNRTLLKIFNIIILAVMLFIT

SEQ ID NO: 1751747 - protein, 25 aa, Staphylococcus epidermidis
ITISLLLLIYGIGGGFFLPSNTSAI

SEQ ID NO: 1751748 - protein, 17 aa, Staphylococcus epidermidis
ITIVLFISFILLYMVSQ

SEQ ID NO: 1751749 - protein, 18 aa, Staphylococcus epidermidis
ITIVLFISFILLYMVSQT

SEQ ID NO: 1751750 - protein, 25 aa, Staphylococcus epidermidis
ITIYLFIFIYYLFITSRKLSPLIVI

SEQ ID NO: 1751751 - protein, 25 aa, Staphylococcus epidermidis
ITKYVLLALITLISFIIAIFTAIHL

SEQ ID NO: 1751752 - protein, 25 aa, Staphylococcus epidermidis
ITLIGGILVWLGWYGFNVGSAFTLD

SEQ ID NO: 1751753 - protein, 26 aa, Staphylococcus epidermidis
ITLITFLILIFILVFTAQKLANIPGL

SEQ ID NO: 1751754 - protein, 20 aa, Staphylococcus epidermidis
ITLPLLRPGIFSGWILIFCI

SEQ ID NO: 1751755 - protein, 29 aa, Staphylococcus epidermidis
ITLVTILFGILYFVLMVTAAYVLIRMYRN

SEQ ID NO: 1751756 - protein, 38 aa, Staphylococcus epidermidis
ITNVIAIRMLFHPFKPYYIFKMRIPFTPGLIPKRRDEI

SEQ ID NO: 1751757 - protein, 20 aa, Staphylococcus epidermidis
ITPMMPYLPLLLSYAQKYDK

SEQ ID NO: 1751758 - protein, 18 aa, Staphylococcus epidermidis
ITSFIPFLAPFELLVRSQ

SEQ ID NO: 1751759 - protein, 25 aa, Staphylococcus epidermidis
ITSIFYWFFLIFMINYTVAFAEDPT

SEQ ID NO: 1751760 - protein, 30 aa, Staphylococcus epidermidis
ITSVLDLLIVWYVLYLLITVFKGTKAIQLL

SEQ ID NO: 1751761 - protein, 27 aa, Staphylococcus epidermidis
ITVFDVFLLLFIMRFGFRKIEAIVGTL

SEQ ID NO: 1751762 - protein, 18 aa, Staphylococcus epidermidis
ITVLFIITTGLIGSILGS

SEQ ID NO: 1751763 - protein, 26 aa, Staphylococcus epidermidis
ITVLVILLIIIFYRPLMISTFDSTFS

SEQ ID NO: 1751764 - protein, 25 aa, Staphylococcus epidermidis
ITVPVKHVLLEVVPTTRTTVRGQQF

SEQ ID NO: 1751765 - protein, 20 aa, Staphylococcus epidermidis
ITVTLILAVPLYCSLLVPEL

SEQ ID NO: 1751766 - protein, 17 aa, Staphylococcus epidermidis
ITWMNWFIAAIVPGLIS

SEQ ID NO: 1751767 - protein, 27 aa, Staphylococcus epidermidis
ITYLKKRWFIIIIVFLIALGLSNLYDY

SEQ ID NO: 1751768 - protein, 25 aa, Staphylococcus epidermidis
IVAALLIWGFNFTVADPIASILVSL

SEQ ID NO: 1751769 - protein, 23 aa, Staphylococcus epidermidis
IVAQLIMIFVFQLPPGSAPVTAV

SEQ ID NO: 1751770 - protein, 25 aa, Staphylococcus epidermidis
IVASLLIWGFNFTLADPLASILVSL

SEQ ID NO: 1751771 - protein, 24 aa, Staphylococcus epidermidis
IVDETLFTFWQGFNYTVDMNKEPY

SEQ ID NO: 1751772 - protein, 19 aa, Staphylococcus epidermidis
IVDIVVAQYFYKKSLENKK

SEQ ID NO: 1751773 - protein, 18 aa, Staphylococcus epidermidis
IVENKSYIGFLDDSIEKL

SEQ ID NO: 1751774 - protein, 17 aa, Staphylococcus epidermidis
IVFSLAGLTIICLLIGF

SEQ ID NO: 1751775 - protein, 24 aa, Staphylococcus epidermidis
IVFVLMLLIEWLVQFLPLSLNYNA

SEQ ID NO: 1751776 - protein, 39 aa, Staphylococcus epidermidis
IVGAILLYMQSPLLLLITIVFIPLFIICSHSLRKPFEKY

SEQ ID NO: 1751777 - protein, 26 aa, Staphylococcus epidermidis
IVGLILFFFLLQFKIIPESWIDVGAN

SEQ ID NO: 1751778 - protein, 26 aa, Staphylococcus epidermidis
IVGLMLFFLLLQFKIIPESWINVGAD

SEQ ID NO: 1751779 - protein, 40 aa, Staphylococcus epidermidis
IVGRMIDSFFNYLFGMSRFLTYILVILATGFITYSKKIPK

SEQ ID NO: 1751780 - protein, 24 aa, Staphylococcus epidermidis
IVGSWRMLIIYFISGLFGNFVSLS

SEQ ID NO: 1751781 - protein, 18 aa, Staphylococcus epidermidis
IVGWFYFSGSSFATSWNP

SEQ ID NO: 1751782 - protein, 17 aa, Staphylococcus epidermidis
IVGYILVIVFSLTYWKW

SEQ ID NO: 1751783 - protein, 23 aa, Staphylococcus epidermidis
IVHLFLHVICICIAYWALNSIRL

SEQ ID NO: 1751784 - protein, 21 aa, Staphylococcus epidermidis
IVIILIFIRRQITIANPLLNL

SEQ ID NO: 1751785 - protein, 26 aa, Staphylococcus epidermidis
IVIKAAFIHLMLIINCAKKKALSEVC

SEQ ID NO: 1751786 - protein, 26 aa, Staphylococcus epidermidis
IVISTLIFLFIGKPVSLLIIAGAING

SEQ ID NO: 1751787 - protein, 17 aa, Staphylococcus epidermidis
IVIVFFAAQLLAFLEWS

SEQ ID NO: 1751788 - protein, 25 aa, Staphylococcus epidermidis
IVIVLIVRFILLPLMLIQVKNMHMM

SEQ ID NO: 1751789 - protein, 19 aa, Staphylococcus epidermidis
IVLILMLLNKLYNLALSPL

SEQ ID NO: 1751790 - protein, 41 aa, Staphylococcus epidermidis
IVLIVLSFYNWQMSLTLFLIMPIALFFIILSKFVTTPTNKK

SEQ ID NO: 1751791 - protein, 18 aa, Staphylococcus epidermidis
IVLTVFIHLGLNTLLEPF

SEQ ID NO: 1751792 - protein, 18 aa, Staphylococcus epidermidis
IVLYYAFHLSPAITNFVV

SEQ ID NO: 1751793 - protein, 18 aa, Staphylococcus epidermidis
IVMLIALTVCLIPTTIGG

SEQ ID NO: 1751794 - protein, 23 aa, Staphylococcus epidermidis
IVMLLARYIPIVLQILIVSSLVN

SEQ ID NO: 1751795 - protein, 26 aa, Staphylococcus epidermidis
IVMLVIAFVLILIQNFLFLKRRSILT

SEQ ID NO: 1751796 - protein, 20 aa, Staphylococcus epidermidis
IVNLVFLPPKFETKIYYNSM

SEQ ID NO: 1751797 - protein, 26 aa, Staphylococcus epidermidis
IVPWPTLFFGMFFNNLFFWCANQMIV

SEQ ID NO: 1751798 - protein, 18 aa, Staphylococcus epidermidis
IVQFFMYLSAAINLLLIK

SEQ ID NO: 1751799 - protein, 17 aa, Staphylococcus epidermidis
IVRFFLDPLGDLGVIWI

SEQ ID NO: 1751800 - protein, 21 aa, Staphylococcus epidermidis
IVSCIVFLTFFLSVNQGAQSE

SEQ ID NO: 1751801 - protein, 26 aa, Staphylococcus epidermidis
IVSIITFIFFTPMHALLIAVSMILTL

SEQ ID NO: 1751802 - protein, 18 aa, Staphylococcus epidermidis
IVTFAWMIIGFSISFDQG

SEQ ID NO: 1751803 - protein, 21 aa, Staphylococcus epidermidis
IVTFILGLIIALFTALMRIST

SEQ ID NO: 1751804 - protein, 19 aa, Staphylococcus epidermidis
IVTFILMVLMYRCFGKHGL

SEQ ID NO: 1751805 - protein, 17 aa, Staphylococcus epidermidis
IVTLLMRIIPFILISRV

SEQ ID NO: 1751806 - protein, 26 aa, Staphylococcus epidermidis
IVTPFLIIMVILIAVFYLFTGSISLG

SEQ ID NO: 1751807 - protein, 27 aa, Staphylococcus epidermidis
IVTPFLIVMVILIAVYYLFTGNISIAE

SEQ ID NO: 1751808 - protein, 32 aa, Staphylococcus epidermidis
IVTPTISLLIIGLLTIFIIMPLAGFISDGLVH

SEQ ID NO: 1751809 - protein, 21 aa, Staphylococcus epidermidis
IVTTPFVLFFMLKDGHRFKDY

SEQ ID NO: 1751810 - protein, 28 aa, Staphylococcus epidermidis
IVTVILILIILFAVFRSVVTPFIPLFIV

SEQ ID NO: 1751811 - protein, 24 aa, Staphylococcus epidermidis
IVVALILTFFIKKLPVLGNTTENE

SEQ ID NO: 1751812 - protein, 19 aa, Staphylococcus epidermidis
IVVDVIIYYPFVKVYDEQI

SEQ ID NO: 1751813 - protein, 30 aa, Staphylococcus epidermidis
IVVKIIAPIIKFLVLIKWNFNSLSNIKIDN

SEQ ID NO: 1751814 - protein, 20 aa, Staphylococcus epidermidis
IVVLWLVITAWKNIGYIKEI

SEQ ID NO: 1751815 - protein, 17 aa, Staphylococcus epidermidis
IVVWFFRKYDNHMRGSV

SEQ ID NO: 1751816 - protein, 17 aa, Staphylococcus epidermidis
IVYSIIFLSIALFMNKK

SEQ ID NO: 1751817 - protein, 21 aa, Staphylococcus epidermidis
IWIYICWLGIFFAFTFMNIAA

SEQ ID NO: 1751818 - protein, 24 aa, Staphylococcus epidermidis
IWPGVMTLIFLVSFIHNIIKVYNT

SEQ ID NO: 1751819 - protein, 27 aa, Staphylococcus epidermidis
IYAIRSLLWEHIIQLKMPFFDKNESGQ

SEQ ID NO: 1751820 - protein, 19 aa, Staphylococcus epidermidis
IYDLIEILVLIPISLIITI

SEQ ID NO: 1751821 - protein, 33 aa, Staphylococcus epidermidis
IYHSFLLKKWYLFLYLILILLTLIVTLTTIQHI

SEQ ID NO: 1751822 - protein, 19 aa, Staphylococcus epidermidis
IYIFGMMAILACILFQNVL

SEQ ID NO: 1751823 - protein, 25 aa, Staphylococcus epidermidis
IYLAISLFLWLILYLQEKGKILADF

SEQ ID NO: 1751824 - protein, 17 aa, Staphylococcus epidermidis
IYMINDYGQLQPINKDL

SEQ ID NO: 1751825 - protein, 19 aa, Staphylococcus epidermidis
IYNGGFYLISAMSLLIIAS

SEQ ID NO: 1751826 - protein, 19 aa, Staphylococcus epidermidis
IYNGGFYLISTMTLLIIAS

SEQ ID NO: 1751827 - protein, 17 aa, Staphylococcus epidermidis
IYPIGMMLLIIGGGGTF

SEQ ID NO: 1751828 - protein, 17 aa, Staphylococcus epidermidis
IYPYLCLTIFIIGHLAR

SEQ ID NO: 1751829 - protein, 25 aa, Staphylococcus epidermidis
IYSTLGFGLMLYAFSSAGNLGFSNP

SEQ ID NO: 1751830 - protein, 19 aa, Staphylococcus epidermidis
IYVIFLGLAFILSFSTLKF

SEQ ID NO: 1751831 - protein, 21 aa, Staphylococcus epidermidis
IYYTIFLVFHINLATIGGVLG

SEQ ID NO: 1751832 - protein, 25 aa, Staphylococcus epidermidis
KAFIPLFILGMLFWAIQEQGSNVLN

SEQ ID NO: 1751833 - protein, 20 aa, Staphylococcus epidermidis
KAILYFEIITTIAIGLGLII

SEQ ID NO: 1751834 - protein, 29 aa, Staphylococcus epidermidis
KAKIRAVIPWSILYEILVGIFISISYNVL

SEQ ID NO: 1751835 - protein, 19 aa, Staphylococcus epidermidis
KALLIPPRKYIFKSIGIFC

SEQ ID NO: 1751836 - protein, 28 aa, Staphylococcus epidermidis
KALLQGIEQILKVNVSIINQSFNDSLHN

SEQ ID NO: 1751837 - protein, 42 aa, Staphylococcus epidermidis
KAMAPIMPIIIIPIISSLIVGLIFIFVIGAPISSIFAALTTW

SEQ ID NO: 1751838 - protein, 19 aa, Staphylococcus epidermidis
KAMEALQQVVAHKNNILND

SEQ ID NO: 1751839 - protein, 19 aa, Staphylococcus epidermidis
KANEIIRKKAAEQTTLINQ

SEQ ID NO: 1751840 - protein, 21 aa, Staphylococcus epidermidis
KATIITVIDTTAPPAPTINPI

SEQ ID NO: 1751841 - protein, 31 aa, Staphylococcus epidermidis
KATIKNIRQNLFWAFGYNVAGIPIAACGLLA

SEQ ID NO: 1751842 - protein, 30 aa, Staphylococcus epidermidis
KATIRNIRQNLFWAFGYNVAGIPIAALGLL

SEQ ID NO: 1751843 - protein, 23 aa, Staphylococcus epidermidis
KATLGIGIFATLLTSLILGIKRH

SEQ ID NO: 1751844 - protein, 17 aa, Staphylococcus epidermidis
KAYWVPLSAHTIMLGNV

SEQ ID NO: 1751845 - protein, 33 aa, Staphylococcus epidermidis
KDADNKTIDSGFYKPIYNLGDYVWEDTNKDGIQ

SEQ ID NO: 1751846 - protein, 22 aa, Staphylococcus epidermidis
KDAIKTIDVLVKQKIKDIDSNN

SEQ ID NO: 1751847 - protein, 22 aa, Staphylococcus epidermidis
KDEIFQVYLNKIYYSDGVTGVK

SEQ ID NO: 1751848 - protein, 22 aa, Staphylococcus epidermidis
KDETLYTIRLLPVGGYVRMAGD

SEQ ID NO: 1751849 - protein, 26 aa, Staphylococcus epidermidis
KDGIQDDNEKGISGVKVTLKNKNGDT

SEQ ID NO: 1751850 - protein, 30 aa, Staphylococcus epidermidis
KDGIQDDSEKGISGVKVTLKDKNGNAIGTT

SEQ ID NO: 1751851 - protein, 25 aa, Staphylococcus epidermidis
KDGKYQVMIVIPKNFSKLAMQLDEK

SEQ ID NO: 1751852 - protein, 24 aa, Staphylococcus epidermidis
KDILQDFIYLLKKPAFVIPMLLQG

SEQ ID NO: 1751853 - protein, 27 aa, Staphylococcus epidermidis
KDIQNPALIMLLTGLGLLGLFRNKIRE

SEQ ID NO: 1751854 - protein, 24 aa, Staphylococcus epidermidis
KDISYTVEFEAMRPKLVDLNGQIS

SEQ ID NO: 1751855 - protein, 29 aa, Staphylococcus epidermidis
KDKKLFNISWIVLIVLLFGYLVSEFIKVP

SEQ ID NO: 1751856 - protein, 24 aa, Staphylococcus epidermidis
KDKMIFKKLPNIFKFGKKKMDIKD

SEQ ID NO: 1751857 - protein, 29 aa, Staphylococcus epidermidis
KDKTIEAIHKIKPISTIKPQTLNEITIQL

SEQ ID NO: 1751858 - protein, 29 aa, Staphylococcus epidermidis
KDLPKPAFKLPLYPVLPAITFVLVLLVFW

SEQ ID NO: 1751859 - protein, 21 aa, Staphylococcus epidermidis
KDLQILAIYREMNAGSTLDPQ

SEQ ID NO: 1751860 - protein, 21 aa, Staphylococcus epidermidis
KDLVFILCLLVIIGLSFLLSS

SEQ ID NO: 1751861 - protein, 17 aa, Staphylococcus epidermidis
KDTNKDSIQDDNEKGIS

SEQ ID NO: 1751862 - protein, 36 aa, Staphylococcus epidermidis
KDTQGAILKIAAFAGAIGPLSLGLGSIVRSIGGTVK

SEQ ID NO: 1751863 - protein, 17 aa, Staphylococcus epidermidis
KDTTYKLSQSIPKQIYE

SEQ ID NO: 1751864 - protein, 26 aa, Staphylococcus epidermidis
KDVLTTTVTGLPSGLSFDQTTNTIIG

SEQ ID NO: 1751865 - protein, 26 aa, Staphylococcus epidermidis
KDVLTTTVTGLPSGLSFDQTTNTITG

SEQ ID NO: 1751866 - protein, 19 aa, Staphylococcus epidermidis
KDYVFINDGWAKNGTYCII

SEQ ID NO: 1751867 - protein, 18 aa, Staphylococcus epidermidis
KEDGMWKLDWDHSVIIPG

SEQ ID NO: 1751868 - protein, 21 aa, Staphylococcus epidermidis
KEEALKQVDTLVNKSFITINN

SEQ ID NO: 1751869 - protein, 23 aa, Staphylococcus epidermidis
KEEKIRLRLLNGSNARDLNLKLS

SEQ ID NO: 1751870 - protein, 39 aa, Staphylococcus epidermidis
KEEKKPTVWIVLLSIIFVLLIAAVLYGGYYAYNHYVKND

SEQ ID NO: 1751871 - protein, 37 aa, Staphylococcus epidermidis
KEFSSNLNNMNFLRWVNIRDDYTISWTSSKIQGRNTD

SEQ ID NO: 1751872 - protein, 25 aa, Staphylococcus epidermidis
KEIDQFDPKRFTLNKAKKDIITDVN

SEQ ID NO: 1751873 - protein, 17 aa, Staphylococcus epidermidis
KEINTILDPIKVEATDN

SEQ ID NO: 1751874 - protein, 18 aa, Staphylococcus epidermidis
KESILFHYLFSENKQENN

SEQ ID NO: 1751875 - protein, 18 aa, Staphylococcus epidermidis
KETINYFKKLGIHTTLIT

SEQ ID NO: 1751876 - protein, 37 aa, Staphylococcus epidermidis
KETQLTESLLKEPSIAKAQTKLKRIPTLITESKQNSN

SEQ ID NO: 1751877 - protein, 23 aa, Staphylococcus epidermidis
KEVKTIPEFFSGQAPYLFAHRGG

SEQ ID NO: 1751878 - protein, 25 aa, Staphylococcus epidermidis
KFILPIVVGLFIWALTPFKPDALND

SEQ ID NO: 1751879 - protein, 20 aa, Staphylococcus epidermidis
KFIMHIFFGKYKPDSLPKSA

SEQ ID NO: 1751880 - protein, 24 aa, Staphylococcus epidermidis
KFITMSLLGIILFLIPIPVVQDGQ

SEQ ID NO: 1751881 - protein, 17 aa, Staphylococcus epidermidis
KFKEMVHMLLYNNAAFL

SEQ ID NO: 1751882 - protein, 29 aa, Staphylococcus epidermidis
KFLNNIWFYLIFFLFFGLFLLLLTLIIEK

SEQ ID NO: 1751883 - protein, 24 aa, Staphylococcus epidermidis
KFLNPVFLILLGIVVLLAFIHPMG

SEQ ID NO: 1751884 - protein, 20 aa, Staphylococcus epidermidis
KFSIRKYAIGTFSTVIATLV

SEQ ID NO: 1751885 - protein, 33 aa, Staphylococcus epidermidis
KFSIRKYAIGTFSTVIATLVFMGINPNHASADE

SEQ ID NO: 1751886 - protein, 21 aa, Staphylococcus epidermidis
KFSLFLAMLVACLLIQAATNM

SEQ ID NO: 1751887 - protein, 33 aa, Staphylococcus epidermidis
KFYKFRFILIMLIVFLMAIMVLFISGLAQGLAR

SEQ ID NO: 1751888 - protein, 21 aa, Staphylococcus epidermidis
KGAIYLSLFKVFGPLFTVLPG

SEQ ID NO: 1751889 - protein, 33 aa, Staphylococcus epidermidis
KGAQKRLEFYRLYLLMVHLLKFGGMYAASVNRS

SEQ ID NO: 1751890 - protein, 39 aa, Staphylococcus epidermidis
KGDRVFIFMSRTPELYFAFLGILKIGAIVGPLFEAFMEK

SEQ ID NO: 1751891 - protein, 37 aa, Staphylococcus epidermidis
KGEDGVVSNGFIVAVAIVLAIFGLAKKSRKDDDDQDG

SEQ ID NO: 1751892 - protein, 17 aa, Staphylococcus epidermidis
KGELKMATPSKPIVNAN

SEQ ID NO: 1751893 - protein, 23 aa, Staphylococcus epidermidis
KGFTFNQVTGAMPSILKATVASG

SEQ ID NO: 1751894 - protein, 24 aa, Staphylococcus epidermidis
KGHLLLELAVIFGISALVTSFLKH

SEQ ID NO: 1751895 - protein, 24 aa, Staphylococcus epidermidis
KGIELFIMLLITLIAFVLANSLAV

SEQ ID NO: 1751896 - protein, 22 aa, Staphylococcus epidermidis
KGILVIVAVLLIVDFINHFDQI

SEQ ID NO: 1751897 - protein, 30 aa, Staphylococcus epidermidis
KGIMRDWEPGKKIHFIGHSMGGQTIRQMEE

SEQ ID NO: 1751898 - protein, 39 aa, Staphylococcus epidermidis
KGIRQEFLMILPALIGYLLGFPMFGILISTGTLAHVYVF

SEQ ID NO: 1751899 - protein, 22 aa, Staphylococcus epidermidis
KGKILYAYIGIILCYHNAYHTY

SEQ ID NO: 1751900 - protein, 25 aa, Staphylococcus epidermidis
KGKKLTFIISPQWFTNHGLTNQNFD

SEQ ID NO: 1751901 - protein, 23 aa, Staphylococcus epidermidis
KGKVNKLLKRNPTVAQVKESVAN

SEQ ID NO: 1751902 - protein, 26 aa, Staphylococcus epidermidis
KGLISLPNGLWIDLWQDFIAHDHENL

SEQ ID NO: 1751903 - protein, 24 aa, Staphylococcus epidermidis
KGMNWIHYPWDFLVIAIVALIFYQ

SEQ ID NO: 1751904 - protein, 26 aa, Staphylococcus epidermidis
KGNQLVVLTLNNDSYWKEFKVEGTRA

SEQ ID NO: 1751905 - protein, 24 aa, Staphylococcus epidermidis
KGQTYTIEQLLKQAALNSSNAATL

SEQ ID NO: 1751906 - protein, 24 aa, Staphylococcus epidermidis
KGTFKGWWEMYLKQVKGNLLLELA

SEQ ID NO: 1751907 - protein, 27 aa, Staphylococcus epidermidis
KGVRKKLWLSIALIGSLQYGGLIISIV

SEQ ID NO: 1751908 - protein, 23 aa, Staphylococcus epidermidis
KGWPSMMYEIWNNPEKYYSYFIG

SEQ ID NO: 1751909 - protein, 31 aa, Staphylococcus epidermidis
KGYELYIVLAIFIILDIILALITAYFVSKRL

SEQ ID NO: 1751910 - protein, 40 aa, Staphylococcus epidermidis
KHEHLRPILTKRQIYLGKAGFFFMLGVIQALIVSIGDLVI

SEQ ID NO: 1751911 - protein, 17 aa, Staphylococcus epidermidis
KHFLLFNGLMGGLSFVL

SEQ ID NO: 1751912 - protein, 23 aa, Staphylococcus epidermidis
KHKASEQQSYHNKSEKIKNVNKP

SEQ ID NO: 1751913 - protein, 25 aa, Staphylococcus epidermidis
KIALGIGGAITVVALSRKESRDKLK

SEQ ID NO: 1751914 - protein, 26 aa, Staphylococcus epidermidis
KIATRYWRLIALLPITISSIVVGFTP

SEQ ID NO: 1751915 - protein, 17 aa, Staphylococcus epidermidis
KIGVMYLICAVLMFVRG

SEQ ID NO: 1751916 - protein, 18 aa, Staphylococcus epidermidis
KIHDWIVHLFLNLNHFKW

SEQ ID NO: 1751917 - protein, 17 aa, Staphylococcus epidermidis
KIIVVWFFRKYDNHMRG

SEQ ID NO: 1751918 - protein, 34 aa, Staphylococcus epidermidis
KIKFSLVIGILVLISYLLFLLSGLANGLIKMNTE

SEQ ID NO: 1751919 - protein, 17 aa, Staphylococcus epidermidis
KIKNFKFFVQYGDFKDL

SEQ ID NO: 1751920 - protein, 19 aa, Staphylococcus epidermidis
KIKYYFLVLVISKLISITI

SEQ ID NO: 1751921 - protein, 19 aa, Staphylococcus epidermidis
KILKKLTLGIGIFATLLTS

SEQ ID NO: 1751922 - protein, 17 aa, Staphylococcus epidermidis
KILKKVTLGIGIFATLL

SEQ ID NO: 1751923 - protein, 48 aa, Staphylococcus epidermidis
KINEFKQLVIAFFKEHWPKMLIIIGIIVLLLILNAIFTTVNKNDHTND

SEQ ID NO: 1751924 - protein, 22 aa, Staphylococcus epidermidis
KINRVWLVLLFAGGGASLILLS

SEQ ID NO: 1751925 - protein, 29 aa, Staphylococcus epidermidis
KIRQNIIISLTIVAFLIVNALTGLMGLTT

SEQ ID NO: 1751926 - protein, 32 aa, Staphylococcus epidermidis
KKAAQAQYKNQYPVIFVHGFVGLVGEDSFDLY

SEQ ID NO: 1751927 - protein, 34 aa, Staphylococcus epidermidis
KKAYKPLWIIISFALLIGILLLPTPAGLPIMAKA

SEQ ID NO: 1751928 - protein, 25 aa, Staphylococcus epidermidis
KKEHYHLMYLLEQKATYFIDAELTE

SEQ ID NO: 1751929 - protein, 28 aa, Staphylococcus epidermidis
KKELNFWTWMMIIPFLTSAILIGPLIHY

SEQ ID NO: 1751930 - protein, 31 aa, Staphylococcus epidermidis
KKELNNIYTLPIKIPSFIPKEPIKKSGETAL

SEQ ID NO: 1751931 - protein, 21 aa, Staphylococcus epidermidis
KKFNRTLITLSSVIVVIFAGV

SEQ ID NO: 1751932 - protein, 23 aa, Staphylococcus epidermidis
KKHLRLIILIELLIQFIISAILS

SEQ ID NO: 1751933 - protein, 24 aa, Staphylococcus epidermidis
KKIELEPMFNVPVLVSLNKKRIQF

SEQ ID NO: 1751934 - protein, 36 aa, Staphylococcus epidermidis
KKKRKKGWLFGCGGCLVLLILIIVGVTACTGTFVNE

SEQ ID NO: 1751935 - protein, 25 aa, Staphylococcus epidermidis
KKLEAKAYIDGYSDDKINDISSRAT

SEQ ID NO: 1751936 - protein, 22 aa, Staphylococcus epidermidis
KKLNKLFTSLRSKYYLFVSDPV

SEQ ID NO: 1751937 - protein, 32 aa, Staphylococcus epidermidis
KKLTNLVFKYKIYPVLMCIVSIFLSITVVIQN

SEQ ID NO: 1751938 - protein, 18 aa, Staphylococcus epidermidis
KKNILGYILWVGVLFIFT

SEQ ID NO: 1751939 - protein, 42 aa, Staphylococcus epidermidis
KKPLPKFLTLFAGPLFNFILALVLFIGLAYYQGTPTNTIGEV

SEQ ID NO: 1751940 - protein, 28 aa, Staphylococcus epidermidis
KKQIHEPWLFSLPAVILMVLIPIVFVIP

SEQ ID NO: 1751941 - protein, 32 aa, Staphylococcus epidermidis
KKQSIDEVSKILPVIEIKLAARNEIHQKAEVI

SEQ ID NO: 1751942 - protein, 33 aa, Staphylococcus epidermidis
KKRMRKLPFIILIILIILISIIVYITHQYNSGM

SEQ ID NO: 1751943 - protein, 43 aa, Staphylococcus epidermidis
KKRSKVKIIVLSLIFVLLLASLIGFIGMGLFGNKYQEMPDLSG

SEQ ID NO: 1751944 - protein, 25 aa, Staphylococcus epidermidis
KKSAVIIWNAIKFAVQHPIQALKNV

SEQ ID NO: 1751945 - protein, 38 aa, Staphylococcus epidermidis
KKSKKIFLKVIITILILLIIFFGVMYFISSRANVDDLK

SEQ ID NO: 1751946 - protein, 39 aa, Staphylococcus epidermidis
KKTNKIILKILFVIIIVFVLFVGLMYFLSSRANVDDLKS

SEQ ID NO: 1751947 - protein, 22 aa, Staphylococcus epidermidis
KKVVWIFIFCFIGNIIGGFILF

SEQ ID NO: 1751948 - protein, 21 aa, Staphylococcus epidermidis
KKYKWLLIALIILVSILRPFL

SEQ ID NO: 1751949 - protein, 36 aa, Staphylococcus epidermidis
KLARIPFWFLIKGLTPIFFFLIFTFSMHVLFTNGGI

SEQ ID NO: 1751950 - protein, 17 aa, Staphylococcus epidermidis
KLDLCILIILLAIIFCF

SEQ ID NO: 1751951 - protein, 17 aa, Staphylococcus epidermidis
KLEIHYTNKDGQASAII

SEQ ID NO: 1751952 - protein, 23 aa, Staphylococcus epidermidis
KLEIKWPFWLSQTGLIFLGIQIG

SEQ ID NO: 1751953 - protein, 22 aa, Staphylococcus epidermidis
KLFNSFFYIYHVGVLVTVAMQF

SEQ ID NO: 1751954 - protein, 54 aa, Staphylococcus epidermidis
KLHKNDNDSLFKHLVDNFGKTVGVITLTGLLSSFWLVLAKRRKKEEEEKQSIKN

SEQ ID NO: 1751955 - protein, 18 aa, Staphylococcus epidermidis
KLIFVFVFIIFIFFCHSF

SEQ ID NO: 1751956 - protein, 21 aa, Staphylococcus epidermidis
KLITFSFIFVFLGLFGIFVGE

SEQ ID NO: 1751957 - protein, 24 aa, Staphylococcus epidermidis
KLKIRWPFWLSQIGLILLGVQIGS

SEQ ID NO: 1751958 - protein, 39 aa, Staphylococcus epidermidis
KLKQLSSKKYLGYGTASALTLALYLFSGNASAHAEQNNS

SEQ ID NO: 1751959 - protein, 20 aa, Staphylococcus epidermidis
KLLKLIHYFKTVFNFIIVLI

SEQ ID NO: 1751960 - protein, 21 aa, Staphylococcus epidermidis
KLLVVVVFAMIFFVVVVLGIV

SEQ ID NO: 1751961 - protein, 24 aa, Staphylococcus epidermidis
KLNQLAPYFKGFDGSFVLYNEREQ

SEQ ID NO: 1751962 - protein, 20 aa, Staphylococcus epidermidis
KLNSIVRKKAKALKEIELEA

SEQ ID NO: 1751963 - protein, 26 aa, Staphylococcus epidermidis
KLNYYIMITLFIFVAIVVYGYLTVGF

SEQ ID NO: 1751964 - protein, 24 aa, Staphylococcus epidermidis
KLSPLIVIILISSLLYLVFRQDHQ

SEQ ID NO: 1751965 - protein, 33 aa, Staphylococcus epidermidis
KLTKNLYLTFLLLFLTIVLFVTVIQNSILALII

SEQ ID NO: 1751966 - protein, 34 aa, Staphylococcus epidermidis
KLTKNLYLTFLLLFVTIILFVTVVHYAVLALIIC

SEQ ID NO: 1751967 - protein, 23 aa, Staphylococcus epidermidis
KLTLGIGIFATLLTSFILGIQRY

SEQ ID NO: 1751968 - protein, 17 aa, Staphylococcus epidermidis
KLVLFGFGGGLAYSGLV

SEQ ID NO: 1751969 - protein, 28 aa, Staphylococcus epidermidis
KLYQHYYYKLFAIATWILLIGSLSQWFD

SEQ ID NO: 1751970 - protein, 31 aa, Staphylococcus epidermidis
KMFPILIGFFVFFFVFLISGIALLRERTKGT

SEQ ID NO: 1751971 - protein, 32 aa, Staphylococcus epidermidis
KMHHNSLIETIWFVVPILIVIALAVPTVKTLY

SEQ ID NO: 1751972 - protein, 20 aa, Staphylococcus epidermidis
KMMIPVYLKHLIIAIPLTVN

SEQ ID NO: 1751973 - protein, 20 aa, Staphylococcus epidermidis
KMPNLVGLPKEKALSKLKDL

SEQ ID NO: 1751974 - protein, 40 aa, Staphylococcus epidermidis
KMRNTMNKRINFIFGFIVFIFAIVVLRLGYLQIAQGSHYK

SEQ ID NO: 1751975 - protein, 20 aa, Staphylococcus epidermidis
KMYRMVFNTISVERMNSILF

SEQ ID NO: 1751976 - protein, 22 aa, Staphylococcus epidermidis
KNATLKLYDVVDAQEAIINAFP

SEQ ID NO: 1751977 - protein, 19 aa, Staphylococcus epidermidis
KNCWLWYIWDIIFDVIYYS

SEQ ID NO: 1751978 - protein, 25 aa, Staphylococcus epidermidis
KNDAIKIIDVLVKQKIKDIDSNNEL

SEQ ID NO: 1751979 - protein, 20 aa, Staphylococcus epidermidis
KNDIDTALNKQIETINAHNT

SEQ ID NO: 1751980 - protein, 19 aa, Staphylococcus epidermidis
KNEDKLVLFGFGGGLAYSG

SEQ ID NO: 1751981 - protein, 61 aa, Staphylococcus epidermidis
KNESSAIILLIFFIGIIVLSIWTQSYLIGFFASILNVFVFNYFFTVPRFTLEMYRFEYPIT

SEQ ID NO: 1751982 - protein, 17 aa, Staphylococcus epidermidis
KNFKFFVQYGDFKDLKT

SEQ ID NO: 1751983 - protein, 24 aa, Staphylococcus epidermidis
KNFKIELNKLDLKAHKKLAAKQRI

SEQ ID NO: 1751984 - protein, 23 aa, Staphylococcus epidermidis
KNFKLPLIILMFASSILSYFIIY

SEQ ID NO: 1751985 - protein, 25 aa, Staphylococcus epidermidis
KNGKYQVMIVIPKDFTKLAMQLDKK

SEQ ID NO: 1751986 - protein, 89 aa, Staphylococcus epidermidis
KNIAGVQNLIALVNYPGISTPLEVPVKVWVYNFDFTQPIYKIQVGDTFPKGTWAGYYKHLENGEGLPIDGWKFYWNQQSTGTTSDQWQS

SEQ ID NO: 1751987 - protein, 28 aa, Staphylococcus epidermidis
KNIFTYFFPFINYLFPRYLREIDQTTAE

SEQ ID NO: 1751988 - protein, 31 aa, Staphylococcus epidermidis
KNIIAVIAIILIIYIALQHAPFLKNQEWNPL

SEQ ID NO: 1751989 - protein, 38 aa, Staphylococcus epidermidis
KNIQWKSIFILVILNLFLAWFFIYFPWGRTGVKGAANG

SEQ ID NO: 1751990 - protein, 36 aa, Staphylococcus epidermidis
KNIRWKYVGLLLVIQLIFAFILLKTHIGISVIGSIS

SEQ ID NO: 1751991 - protein, 35 aa, Staphylococcus epidermidis
KNIVAVLAIIAIIYIALKYAPFLRDQEWNPLSDTS

SEQ ID NO: 1751992 - protein, 28 aa, Staphylococcus epidermidis
KNIVGLIFLSWYPTLYWVINAAVVIMAF

SEQ ID NO: 1751993 - protein, 27 aa, Staphylococcus epidermidis
KNIVGLIFVSWYPTVYWIINAAVVIFA

SEQ ID NO: 1751994 - protein, 36 aa, Staphylococcus epidermidis
KNKRLRKLPFIILIFLIILIALIVYIVHQYNSGMKY

SEQ ID NO: 1751995 - protein, 26 aa, Staphylococcus epidermidis
KNKVNKWLFFLCTLIGLVVLVALLAQ

SEQ ID NO: 1751996 - protein, 31 aa, Staphylococcus epidermidis
KNKVSVFIICYLILFLILRSVMESINEYLIA

SEQ ID NO: 1751997 - protein, 23 aa, Staphylococcus epidermidis
KNKWTHFFISIPVILGGSFSAFF

SEQ ID NO: 1751998 - protein, 30 aa, Staphylococcus epidermidis
KNMFSEWLKNLLQPLATLSLGFFVYKYTDN

SEQ ID NO: 1751999 - protein, 29 aa, Staphylococcus epidermidis
KNNSLTAIANVQPILVKKPAANDVINKKV

SEQ ID NO: 1752000 - protein, 24 aa, Staphylococcus epidermidis
KNNTNITIALIGGGATVISAAFGL

SEQ ID NO: 1752001 - protein, 34 aa, Staphylococcus epidermidis
KNRLTLVVVIAFILFLILLFMFLNHSDEDSGQIT

SEQ ID NO: 1752002 - protein, 41 aa, Staphylococcus epidermidis
KNSKQIKIKLWHFILIILGIILLTSIITVVSTILISHQKSG

SEQ ID NO: 1752003 - protein, 26 aa, Staphylococcus epidermidis
KNYKKKNMYIIPNTAQYIINNKVVKS

SEQ ID NO: 1752004 - protein, 17 aa, Staphylococcus epidermidis
KPLLHVTVWVDENGNIL

SEQ ID NO: 1752005 - protein, 21 aa, Staphylococcus epidermidis
KPLLIAMIIFTLASLGIIFVT

SEQ ID NO: 1752006 - protein, 24 aa, Staphylococcus epidermidis
KPLSNVLVTLTYPDGTSKSVRTDE

SEQ ID NO: 1752007 - protein, 24 aa, Staphylococcus epidermidis
KPNVNLIIYLYILLAIVMGVFLTT

SEQ ID NO: 1752008 - protein, 17 aa, Staphylococcus epidermidis
KPTARKAISDKASQLNN

SEQ ID NO: 1752009 - protein, 17 aa, Staphylococcus epidermidis
KPTARKAVNKKAEEINA

SEQ ID NO: 1752010 - protein, 28 aa, Staphylococcus epidermidis
KPVIAIVISLLILIAAALPISGMRLGIP

SEQ ID NO: 1752011 - protein, 44 aa, Staphylococcus epidermidis
KQALQQLIYAETSLNGFERLNHARPRALEYIKSLEKINNAQKSA

SEQ ID NO: 1752012 - protein, 33 aa, Staphylococcus epidermidis
KQEKNVVPYILLSIGAFLTVGFVIFSIRRGRRQ

SEQ ID NO: 1752013 - protein, 20 aa, Staphylococcus epidermidis
KQELIHYMTYMKLKDPRSLL

SEQ ID NO: 1752014 - protein, 36 aa, Staphylococcus epidermidis
KQIHEPWLFSLPAVILMLLIPVIFFVPNVFGNFIIL

SEQ ID NO: 1752015 - protein, 25 aa, Staphylococcus epidermidis
KQIISGFFFAFAALTYLISAQPNMN

SEQ ID NO: 1752016 - protein, 22 aa, Staphylococcus epidermidis
KQIITFIIFAVLLFAACTWSIA

SEQ ID NO: 1752017 - protein, 23 aa, Staphylococcus epidermidis
KQKALDELLSAIKSINNSIQNAH

SEQ ID NO: 1752018 - protein, 17 aa, Staphylococcus epidermidis
KQKLTVYVILGSVLIKL

SEQ ID NO: 1752019 - protein, 31 aa, Staphylococcus epidermidis
KQLNQRLTDTINLLQPLANKESLKESRNRLE

SEQ ID NO: 1752020 - protein, 24 aa, Staphylococcus epidermidis
KQNARTLINEIVSNALSQLNKVTT

SEQ ID NO: 1752021 - protein, 17 aa, Staphylococcus epidermidis
KQNLMMIWMIITVLLGL

SEQ ID NO: 1752022 - protein, 23 aa, Staphylococcus epidermidis
KQQARAQINDKFNAKEAEINNTP

SEQ ID NO: 1752023 - protein, 19 aa, Staphylococcus epidermidis
KQTLNIGFKLDEEPINIVI

SEQ ID NO: 1752024 - protein, 31 aa, Staphylococcus epidermidis
KREWMSTWTLYYWGWWLSWSPFVGVFIARVS

SEQ ID NO: 1752025 - protein, 20 aa, Staphylococcus epidermidis
KRFEVAVPAFITIIMMPLSY

SEQ ID NO: 1752026 - protein, 25 aa, Staphylococcus epidermidis
KRGNLFTYLIVCTIFIISYVTMILF

SEQ ID NO: 1752027 - protein, 32 aa, Staphylococcus epidermidis
KRIHLGWFVLPVPIVLFIYFISLISITMSGNT

SEQ ID NO: 1752028 - protein, 22 aa, Staphylococcus epidermidis
KRLLKFAIILYGLKLNMGDILG

SEQ ID NO: 1752029 - protein, 24 aa, Staphylococcus epidermidis
KRLTKPLFFYTDWIKNLSNGKLFK

SEQ ID NO: 1752030 - protein, 66 aa, Staphylococcus epidermidis
KRTKLIISAILSAPLLLMMFVHLLPLHLPAIVMNPWFQFILATPVQFIIGWQFYVGAYKNLRNGSA

SEQ ID NO: 1752031 - protein, 32 aa, Staphylococcus epidermidis; identical to SEQ ID NO: 1590732

SEQ ID NO: 1752032 - protein, 20 aa, Staphylococcus epidermidis
KRYLFIITIVLFISFILLYM

SEQ ID NO: 1752033 - protein, 29 aa, Staphylococcus epidermidis
KSALFFIAFVIFTLVLFALYIWIPNDQSH

SEQ ID NO: 1752034 - protein, 17 aa, Staphylococcus epidermidis
KSDFYGHTYHMKIKVRI

SEQ ID NO: 1752035 - protein, 62 aa, Staphylococcus epidermidis; identical to SEQ ID NO: 1591154

SEQ ID NO: 1752036 - protein, 19 aa, Staphylococcus epidermidis
KSFWIRRIKRLLPAVLALL

SEQ ID NO: 1752037 - protein, 21 aa, Staphylococcus epidermidis
KSIRKKLWLATGIVGIIQYTG

SEQ ID NO: 1752038 - protein, 24 aa, Staphylococcus epidermidis
KSKAFIIFMSIIVILMIALSNIDK

SEQ ID NO: 1752039 - protein, 32 aa, Staphylococcus epidermidis
KSKKIYLAVIIIISLIFTLASLYFPLIIKNII

SEQ ID NO: 1752040 - protein, 53 aa, Staphylococcus epidermidis
KSLEQQKTRVKLYKSGKSWVKASINEIELLKTMGLPFLSKNEIQENVTEKTEG

SEQ ID NO: 1752041 - protein, 26 aa, Staphylococcus epidermidis
KSLMGNYVYLYYLAIFVSIISSVISL

SEQ ID NO: 1752042 - protein, 23 aa, Staphylococcus epidermidis
KSLPLIIIGVFILGFFLSTYEAT

SEQ ID NO: 1752043 - protein, 34 aa, Staphylococcus epidermidis
KSQHTFSFKLLFSLLIIGLILIALLIGAMIPSEV

SEQ ID NO: 1752044 - protein, 20 aa, Staphylococcus epidermidis
KSRLRIYILLIICVVVLMLT

SEQ ID NO: 1752045 - protein, 20 aa, Staphylococcus epidermidis
KSSKKWYLPFGYDAEDINLN

SEQ ID NO: 1752046 - protein, 28 aa, Staphylococcus epidermidis
KSYFNGAPWLFFFPGVLLGDFALLCQMI

SEQ ID NO: 1752047 - protein, 20 aa, Staphylococcus epidermidis
KSYPIYNQLIDSLSPNREIS

SEQ ID NO: 1752048 - protein, 32 aa, Staphylococcus epidermidis
KSYQDYFLQFNWFQPLLIGLAGLLILIGLILV

SEQ ID NO: 1752049 - protein, 21 aa, Staphylococcus epidermidis
KTAMIILFTLVIVVIIDFVSS

SEQ ID NO: 1752050 - protein, 28 aa, Staphylococcus epidermidis
KTATKRLPWLIVLTFLGMITATILGSFE

SEQ ID NO: 1752051 - protein, 46 aa, Staphylococcus epidermidis
KTEGHKFKKSAAKTTALVGGAFTFNMLNNHQAFAASETPITSEISS

SEQ ID NO: 1752052 - protein, 31 aa, Staphylococcus epidermidis
KTHSIATIKSILPNVIKKPTAINDLTQEANN

SEQ ID NO: 1752053 - protein, 18 aa, Staphylococcus epidermidis
KTLYYWIRYLNYDVISRD

SEQ ID NO: 1752054 - protein, 25 aa, Staphylococcus epidermidis
KTQPQIMLAIVMWLMGSITSTLTLL

SEQ ID NO: 1752055 - protein, 17 aa, Staphylococcus epidermidis
KTQQELNLKLKIVDVNA

SEQ ID NO: 1752056 - protein, 21 aa, Staphylococcus epidermidis
KTTTKINYEVTRNSASDSTST

SEQ ID NO: 1752057 - protein, 25 aa, Staphylococcus epidermidis
KTVTKIVVFILLTFGFYVFFAGHNN

SEQ ID NO: 1752058 - protein, 29 aa, Staphylococcus epidermidis
KVADHLTAIVKVMLADGSYITVNVPVKVV

SEQ ID NO: 1752059 - protein, 26 aa, Staphylococcus epidermidis
KVAGYLFYFAVSVGVISFIVWMLIQN

SEQ ID NO: 1752060 - protein, 26 aa, Staphylococcus epidermidis
KVDSNGNFSIAIPSDYVLTGKETIKI

SEQ ID NO: 1752061 - protein, 34 aa, Staphylococcus epidermidis
KVDSNGNFSIAIPSYYVLTGKETIKITSIDKGDN

SEQ ID NO: 1752062 - protein, 36 aa, Staphylococcus epidermidis
KVFEKVGFNLDFMKNAPLPFDLMTAMIKKLKNGIKD

SEQ ID NO: 1752063 - protein, 17 aa, Staphylococcus epidermidis
KVGRLMKFIPHSVMIGF

SEQ ID NO: 1752064 - protein, 29 aa, Staphylococcus epidermidis
KVIERLLLALILPLIILMIGLFSFNTYAD

SEQ ID NO: 1752065 - protein, 20 aa, Staphylococcus epidermidis
KVIIVKRFKDIWKANQQISG

SEQ ID NO: 1752066 - protein, 24 aa, Staphylococcus epidermidis
KVITIIVFIIFGILMIFGILGGHS

SEQ ID NO: 1752067 - protein, 28 aa, Staphylococcus epidermidis
KVITSTSVALLLSNLVMNSVVRAESNTS

SEQ ID NO: 1752068 - protein, 17 aa, Staphylococcus epidermidis
KVLSKLNFWYEKNKYRK

SEQ ID NO: 1752069 - protein, 31 aa, Staphylococcus epidermidis
KVLSPLTWSLIFLTFIFLINIFSVKAFGETE

SEQ ID NO: 1752070 - protein, 23 aa, Staphylococcus epidermidis
KVMEQLNHLINGKNQMINSSKFI

SEQ ID NO: 1752071 - protein, 28 aa, Staphylococcus epidermidis
KVTDSDIYSLFRKQSFRGNEYLNSLQKG

SEQ ID NO: 1752072 - protein, 23 aa, Staphylococcus epidermidis
KVTLFTHIILYAIISFVFTEINY

SEQ ID NO: 1752073 - protein, 25 aa, Staphylococcus epidermidis
KVVITNKALLPRIPKDKLPNLETII

SEQ ID NO: 1752074 - protein, 21 aa, Staphylococcus epidermidis
KVVLFLILGTIFLDAYDITIL

SEQ ID NO: 1752075 - protein, 24 aa, Staphylococcus epidermidis
KVYELISFISWFALPLLMSQVYVG

SEQ ID NO: 1752076 - protein, 29 aa, Staphylococcus epidermidis
KVYKKTDELRDKERDLRNKVLDYKEQAEN

SEQ ID NO: 1752077 - protein, 24 aa, Staphylococcus epidermidis
KVYQAFVSVEVPKIGYKGNYKIRI

SEQ ID NO: 1752078 - protein, 17 aa, Staphylococcus epidermidis
KVYYTIFLVFHIILATV

SEQ ID NO: 1752079 - protein, 19 aa, Staphylococcus epidermidis
KWIGTLLTLILIGTSIYKG

SEQ ID NO: 1752080 - protein, 19 aa, Staphylococcus epidermidis
KWIGTLVTLIIIGASVYKG

SEQ ID NO: 1752081 - protein, 20 aa, Staphylococcus epidermidis
KWILKSIIMIVLAIISAFIT

SEQ ID NO: 1752082 - protein, 24 aa, Staphylococcus epidermidis
KWLDFPHIYLPFKDYTPSFHLGLV

SEQ ID NO: 1752083 - protein, 22 aa, Staphylococcus epidermidis
KWLLMICVLVIIINASWNTISR

SEQ ID NO: 1752084 - protein, 18 aa, Staphylococcus epidermidis
KWLSFIPITLFTALIIDG

SEQ ID NO: 1752085 - protein, 20 aa, Staphylococcus epidermidis
KWLSFIPITLFTALIIDGVI

SEQ ID NO: 1752086 - protein, 24 aa, Staphylococcus epidermidis
KWPISILVIIVIALSLIFSPNLSQ

SEQ ID NO: 1752087 - protein, 27 aa, Staphylococcus epidermidis
KYEPPFLKIMIFISFISIIFSMIYVRK

SEQ ID NO: 1752088 - protein, 23 aa, Staphylococcus epidermidis
KYGRWIIPIVFIGLGIYIMVENE

SEQ ID NO: 1752089 - protein, 30 aa, Staphylococcus epidermidis
KYIFQNIFLYTFFIYMFIVSVAGVLTLKHT

SEQ ID NO: 1752090 - protein, 23 aa, Staphylococcus epidermidis
KYINIHLYLVFLPIIIGIIGLLT

SEQ ID NO: 1752091 - protein, 17 aa, Staphylococcus epidermidis
KYKVIIGDLDIPVRSGF

SEQ ID NO: 1752092 - protein, 20 aa, Staphylococcus epidermidis
KYPHFLWFNLTEPNLIMTII

SEQ ID NO: 1752093 - protein, 27 aa, Staphylococcus epidermidis
KYQFDNLDSGNYIIHFEKPEGMTQTTA

SEQ ID NO: 1752094 - protein, 25 aa, Staphylococcus epidermidis
KYQWLDLIIMIPFMTPPYIGSMGWM

SEQ ID NO: 1752095 - protein, 24 aa, Staphylococcus epidermidis
KYSFSIFFFSSFTMTFINIIQFTV

SEQ ID NO: 1752096 - protein, 25 aa, Staphylococcus epidermidis
LAAGVLAFIGLILSPAIGAILMSLS

SEQ ID NO: 1752097 - protein, 23 aa, Staphylococcus epidermidis
LAEKFMIAIFIIALALWVTGSFI

SEQ ID NO: 1752098 - protein, 24 aa, Staphylococcus epidermidis
LAFIQIVLGMLLYLTPIPVQFNFD

SEQ ID NO: 1752099 - protein, 19 aa, Staphylococcus epidermidis
LAFVTLYYFIRYNKKDQHA

SEQ ID NO: 1752100 - protein, 23 aa, Staphylococcus epidermidis
LAGDPYYSGMPLPNDIATAGQKL

SEQ ID NO: 1752101 - protein, 22 aa, Staphylococcus epidermidis
LAGLIPFIPIKFSLFKFNNVNN

SEQ ID NO: 1752102 - protein, 25 aa, Staphylococcus epidermidis
LAGVNGDVTFYYRDGSVDVIDAENV

SEQ ID NO: 1752103 - protein, 23 aa, Staphylococcus epidermidis
LAHIPFYLLGFLAAFIVGLIAIK

SEQ ID NO: 1752104 - protein, 20 aa, Staphylococcus epidermidis
LAIAFLLRPIGGIVFGIIGD

SEQ ID NO: 1752105 - protein, 17 aa, Staphylococcus epidermidis
LAIIIVVFIICSIIGLN

SEQ ID NO: 1752106 - protein, 19 aa, Staphylococcus epidermidis
LAIILIILALIIGLIGGFF

SEQ ID NO: 1752107 - protein, 22 aa, Staphylococcus epidermidis
LAILILLLTVLKVAPVHAEDAS

SEQ ID NO: 1752108 - protein, 30 aa, Staphylococcus epidermidis
LAISIILLLMCVRWWIKYLNFKKNEHLKDK

SEQ ID NO: 1752109 - protein, 22 aa, Staphylococcus epidermidis
LAIWILLVVLIIFYTIKLSART

SEQ ID NO: 1752110 - protein, 29 aa, Staphylococcus epidermidis
LALFFGLSFLWLPFFSITLSLITLILVLG

SEQ ID NO: 1752111 - protein, 19 aa, Staphylococcus epidermidis
LALITAYFVSKRLTKPLFF

SEQ ID NO: 1752112 - protein, 22 aa, Staphylococcus epidermidis
LAMFAFFIYKYSYNKNAESGKM

SEQ ID NO: 1752113 - protein, 17 aa, Staphylococcus epidermidis
LAPAYYLTAISLIGFLV

SEQ ID NO: 1752114 - protein, 24 aa, Staphylococcus epidermidis
LAPNLFILLTCRFIMGFAIGMDSP

SEQ ID NO: 1752115 - protein, 27 aa, Staphylococcus epidermidis
LATEDNRFYHHGALDYKRLFGAVGKNL

SEQ ID NO: 1752116 - protein, 26 aa, Staphylococcus epidermidis
LATGFFWIIIFTVGLAMIFILFPYFM

SEQ ID NO: 1752117 - protein, 18 aa, Staphylococcus epidermidis
LATIIFAFLPFVDQLFNG

SEQ ID NO: 1752118 - protein, 21 aa, Staphylococcus epidermidis
LATVYAIRMIGIALGLMPVMT

SEQ ID NO: 1752119 - protein, 17 aa, Staphylococcus epidermidis
LAVLAIMIPIFGVGKTP

SEQ ID NO: 1752120 - protein, 20 aa, Staphylococcus epidermidis
LAVMLLLSIFILYLNHILIS

SEQ ID NO: 1752121 - protein, 29 aa, Staphylococcus epidermidis
LAWIANILSLLFLIFGILSIFVINNASNQ

SEQ ID NO: 1752122 - protein, 18 aa, Staphylococcus epidermidis
LCWPYVLLPYGFGQIFQQ

SEQ ID NO: 1752123 - protein, 20 aa, Staphylococcus epidermidis
LDFWTCMMIIPIVLGSVLIG

SEQ ID NO: 1752124 - protein, 23 aa, Staphylococcus epidermidis
LDFWTWMMIIPMVLGSVLIGPMI

SEQ ID NO: 1752125 - protein, 23 aa, Staphylococcus epidermidis
LDGGRILFVLYEAIFRKPINKKA

SEQ ID NO: 1752126 - protein, 23 aa, Staphylococcus epidermidis
LDIPVRSGFSMDAKIPLNTKKLP

SEQ ID NO: 1752127 - protein, 17 aa, Staphylococcus epidermidis
LDNIIDLIRFLFNYEHL

SEQ ID NO: 1752128 - protein, 19 aa, Staphylococcus epidermidis
LDNLRPQIYVILNTKKDQE

SEQ ID NO: 1752129 - protein, 18 aa, Staphylococcus epidermidis
LDPLGDLGVIWILGILYF

SEQ ID NO: 1752130 - protein, 25 aa, Staphylococcus epidermidis
LDQYTLALIFLLSLLIFIVYCHYLQ

SEQ ID NO: 1752131 - protein, 26 aa, Staphylococcus epidermidis
LDTHPAFYLSFITLLILFIIVLVWRY

SEQ ID NO: 1752132 - protein, 24 aa, Staphylococcus epidermidis
LEANYFFYLFPMLNWILKKELIEI

SEQ ID NO: 1752133 - protein, 18 aa, Staphylococcus epidermidis
LEEAAMLVVIFSLGELME

SEQ ID NO: 1752134 - protein, 17 aa, Staphylococcus epidermidis
LEISKNKTITNINQAQT

SEQ ID NO: 1752135 - protein, 24 aa, Staphylococcus epidermidis
LEIVRTIFVIELVGGLLLAFYFYR

SEQ ID NO: 1752136 - protein, 18 aa, Staphylococcus epidermidis
LEKQLDAFRLSLEKNKDT

SEQ ID NO: 1752137 - protein, 19 aa, Staphylococcus epidermidis
LENIMFLRKQNIKSVNLIN

SEQ ID NO: 1752138 - protein, 22 aa, Staphylococcus epidermidis
LENKIKNFKFFSQYANFKNLDK

SEQ ID NO: 1752139 - protein, 28 aa, Staphylococcus epidermidis
LEQNWCSYLFPMLNWFIPIKYTKLTYQE

SEQ ID NO: 1752140 - protein, 21 aa, Staphylococcus epidermidis
LETIRNVEPIVVVKPKANEII

SEQ ID NO: 1752141 - protein, 28 aa, Staphylococcus epidermidis
LFALSFFIILTLIIGGFYILHENKRDYY

SEQ ID NO: 1752142 - protein, 26 aa, Staphylococcus epidermidis
LFALSFFIILTLITGGFYILHENKRD

SEQ ID NO: 1752143 - protein, 17 aa, Staphylococcus epidermidis
LFCVLILMSFNLLSAKL

SEQ ID NO: 1752144 - protein, 23 aa, Staphylococcus epidermidis
LFDAFIVRMTLIPALTKLFGKGS

SEQ ID NO: 1752145 - protein, 30 aa, Staphylococcus epidermidis
LFFANISFVVLIVLLIICAIPEHSFLRNAK

SEQ ID NO: 1752146 - protein, 18 aa, Staphylococcus epidermidis
LFFFAIVFFIVGWLTIRS

SEQ ID NO: 1752147 - protein, 18 aa, Staphylococcus epidermidis
LFFLMIFFVFIVLVAPTY

SEQ ID NO: 1752148 - protein, 27 aa, Staphylococcus epidermidis
LFFSSVLIIFIILLSGLTFLPDLMLGP

SEQ ID NO: 1752149 - protein, 51 aa, Staphylococcus epidermidis
LFIDKVFVNIIYFQGMFYTQIFGIPVFLFLNILIILLCIIVGSVLAYKINQ

SEQ ID NO: 1752150 - protein, 31 aa, Staphylococcus epidermidis
LFIFVFILVNILLVMIYIDKVNKAQINDAES

SEQ ID NO: 1752151 - protein, 27 aa, Staphylococcus epidermidis
LFIINVLVILFLKLFISLDTHQIMFWM

SEQ ID NO: 1752152 - protein, 24 aa, Staphylococcus epidermidis
LFIISIMIIIEAIRRFFAPPEVQS

SEQ ID NO: 1752153 - protein, 17 aa, Staphylococcus epidermidis
LFIQFESKLKYLFGKLL

SEQ ID NO: 1752154 - protein, 20 aa, Staphylococcus epidermidis
LFIVSLYWHFLDVVWIFIFT

SEQ ID NO: 1752155 - protein, 31 aa, Staphylococcus epidermidis
LFKHLLIRFRYSYLYLSKRYYIIISFVLAIA

SEQ ID NO: 1752156 - protein, 17 aa, Staphylococcus epidermidis
LFLVVIVGAIFGLTRLV

SEQ ID NO: 1752157 - protein, 21 aa, Staphylococcus epidermidis
LFLYPFIAYFIGLVRDRYFGK

SEQ ID NO: 1752158 - protein, 18 aa, Staphylococcus epidermidis
LFREYLWKKVLMKHIKNI

SEQ ID NO: 1752159 - protein, 21 aa, Staphylococcus epidermidis
LFSILKFIFATALFIFVIFTL

SEQ ID NO: 1752160 - protein, 26 aa, Staphylococcus epidermidis
LFSRFKYIFIPYILVGLFYSYSESLL

SEQ ID NO: 1752161 - protein, 18 aa, Staphylococcus epidermidis
LFTIGLYLVIGPFFALPR

SEQ ID NO: 1752162 - protein, 17 aa, Staphylococcus epidermidis
LFTLIFIVIGFYDGFLG

SEQ ID NO: 1752163 - protein, 17 aa, Staphylococcus epidermidis
LFTLLTETITFFTRVPF

SEQ ID NO: 1752164 - protein, 24 aa, Staphylococcus epidermidis
LFTQIGFPIIDIILANILGLLIVF

SEQ ID NO: 1752165 - protein, 32 aa, Staphylococcus epidermidis
LFVRSRINWIMWIIFLNLVMLGISYIDYDISV

SEQ ID NO: 1752166 - protein, 17 aa, Staphylococcus epidermidis
LFVYLAVAILYLIPFFL

SEQ ID NO: 1752167 - protein, 35 aa, Staphylococcus epidermidis
LGALIALMKLSKFKPLSWLASIYIEFLRGTPMLVQ

SEQ ID NO: 1752168 - protein, 22 aa, Staphylococcus epidermidis
LGALYLPLLFKIVQLQLNLSKG

SEQ ID NO: 1752169 - protein, 24 aa, Staphylococcus epidermidis
LGAMFLLFGSFLYFIGTEGYVNMQ

SEQ ID NO: 1752170 - protein, 48 aa, Staphylococcus epidermidis
LGDATWGFVLSWLPLYSKYLIVSVYLAITMLLVWLSLLSITYHSDENK

SEQ ID NO: 1752171 - protein, 26 aa, Staphylococcus epidermidis
LGELIRWLLVFGFIFQLPILFMGLAH

SEQ ID NO: 1752172 - protein, 22 aa, Staphylococcus epidermidis
LGETFFGYLIWYSVGRFFVEAM

SEQ ID NO: 1752173 - protein, 32 aa, Staphylococcus epidermidis
LGGFSWPIVLILLILFFFYSHYLFASATAHVS

SEQ ID NO: 1752174 - protein, 18 aa, Staphylococcus epidermidis
LGGLLIKFKIISTLIIKI

SEQ ID NO: 1752175 - protein, 25 aa, Staphylococcus epidermidis
LGGMLWALLAPIIAVSTVLSNVFGV

SEQ ID NO: 1752176 - protein, 26 aa, Staphylococcus epidermidis
LGGVTLVIILILQRFTKGFLKSIAIL

SEQ ID NO: 1752177 - protein, 19 aa, Staphylococcus epidermidis
LGHIALIFGLGAILGKLLA

SEQ ID NO: 1752178 - protein, 24 aa, Staphylococcus epidermidis
LGILSLFIILIPVVIIALLILLCF

SEQ ID NO: 1752179 - protein, 17 aa, Staphylococcus epidermidis
LGIMVWLGMKSLPIFIL

SEQ ID NO: 1752180 - protein, 18 aa, Staphylococcus epidermidis
LGIVFATLITVTFAFVFN

SEQ ID NO: 1752181 - protein, 27 aa, Staphylococcus epidermidis
LGIVLLVISIHWWIKYLGFKKDERLKE

SEQ ID NO: 1752182 - protein, 18 aa, Staphylococcus epidermidis
LGIWIYKMDKNESSAIIL

SEQ ID NO: 1752183 - protein, 17 aa, Staphylococcus epidermidis
LGKGTTFIIKLPQPHIK

SEQ ID NO: 1752184 - protein, 22 aa, Staphylococcus epidermidis
LGLFKSPYVLLVTFISMVFLRP

SEQ ID NO: 1752185 - protein, 21 aa, Staphylococcus epidermidis
LGLLIVAIVGFLLFMYIKDSR

SEQ ID NO: 1752186 - protein, 26 aa, Staphylococcus epidermidis
LGLPTLTWPFIFATWIMLFAGIKNQT

SEQ ID NO: 1752187 - protein, 19 aa, Staphylococcus epidermidis
LGRIHGNDPNDHGGFNGIE

SEQ ID NO: 1752188 - protein, 19 aa, Staphylococcus epidermidis
LGSFAYIYFMKGVLGFHFD

SEQ ID NO: 1752189 - protein, 23 aa, Staphylococcus epidermidis
LGSMLYLVLTRPFSLKLKHNTVH

SEQ ID NO: 1752190 - protein, 28 aa, Staphylococcus epidermidis
LGTIVAIIVILLFLRNIRTTAISVVSIP

SEQ ID NO: 1752191 - protein, 21 aa, Staphylococcus epidermidis
LGVVILIFTLTLHLPLYVLLI

SEQ ID NO: 1752192 - protein, 17 aa, Staphylococcus epidermidis
LGYFGYGYMFGSLLGGI

SEQ ID NO: 1752193 - protein, 19 aa, Staphylococcus epidermidis
LHGLNLTAYLFWTISCVAG

SEQ ID NO: 1752194 - protein, 68 aa, Staphylococcus epidermidis
LHHSNIIMNVILIGAFLLNLIFAFIIIFMERRTANSIWAWLLVLVFLPLIGFILYLLLGRQIQRDQIF

SEQ ID NO: 1752195 - protein, 39 aa, Staphylococcus epidermidis
LHIISFGILVLYIINAFINYLRYQLILRLSLKIDVNLMK

SEQ ID NO: 1752196 - protein, 24 aa, Staphylococcus epidermidis
LHKDTLIDIIFYSAIFGFIVARLY

SEQ ID NO: 1752197 - protein, 29 aa, Staphylococcus epidermidis
LHNNDWYTFFMMITTIQLIIYVACYEPKK

SEQ ID NO: 1752198 - protein, 33 aa, Staphylococcus epidermidis
LHSKYLVVSVYLAITMLLVWLSLISITYRSDER

SEQ ID NO: 1752199 - protein, 29 aa, Staphylococcus epidermidis
LIAIIIAVLLLFLVNTFLIKSYTVSGLSM

SEQ ID NO: 1752200 - protein, 31 aa, Staphylococcus epidermidis
LIAIIVAILLLFLVNNFLFKPYTVSGLSMYP

SEQ ID NO: 1752201 - protein, 26 aa, Staphylococcus epidermidis
LIAIKTFLHLISKVKLIPFAIYRIVL

SEQ ID NO: 1752202 - protein, 17 aa, Staphylococcus epidermidis
LIAMFSIFMCLMLGAQQ

SEQ ID NO: 1752203 - protein, 64 aa, Staphylococcus epidermidis
LIAMNQYHIMPGYKVKFMFMIIMTMMLFVLINTYLFRQLKSIGMFIMMTTLGIYFVAMNYFNTN

SEQ ID NO: 1752204 - protein, 19 aa, Staphylococcus epidermidis
LIARYPLQLFGSNAIIGVV

SEQ ID NO: 1752205 - protein, 18 aa, Staphylococcus epidermidis
LIASIVCILVFKYKKEQL

SEQ ID NO: 1752206 - protein, 17 aa, Staphylococcus epidermidis
LIATKEGSTWTLDKQES

SEQ ID NO: 1752207 - protein, 18 aa, Staphylococcus epidermidis
LIFALLHKYFYSNNSKIR

SEQ ID NO: 1752208 - protein, 19 aa, Staphylococcus epidermidis
LIFGAPTIFNFSLALLIGL

SEQ ID NO: 1752209 - protein, 38 aa, Staphylococcus epidermidis
LIFGLICLIITQLLYFIPDSVWFLMIVRLLNGIATAIA

SEQ ID NO: 1752210 - protein, 18 aa, Staphylococcus epidermidis
LIFTIIIMFIAGMGKYGL

SEQ ID NO: 1752211 - protein, 20 aa, Staphylococcus epidermidis
LIFVTSFLGLAFLIAAGCII

SEQ ID NO: 1752212 - protein, 25 aa, Staphylococcus epidermidis
LIGFFVFFFTFLISGIGLLKERTSG

SEQ ID NO: 1752213 - protein, 19 aa, Staphylococcus epidermidis
LIIALFTALMRISTSKILR

SEQ ID NO: 1752214 - protein, 22 aa, Staphylococcus epidermidis
LIIFIVFFIGGTVTWFAFDKAI

SEQ ID NO: 1752215 - protein, 17 aa, Staphylococcus epidermidis
LIIIAFVISFVALADLI

SEQ ID NO: 1752216 - protein, 21 aa, Staphylococcus epidermidis
LIIIFSIIIIASNDTFAESKN

SEQ ID NO: 1752217 - protein, 17 aa, Staphylococcus epidermidis
LIIIGAFIADYVRLRKE

SEQ ID NO: 1752218 - protein, 26 aa, Staphylococcus epidermidis
LIILGFLLHYIFKINEKWLLMICVLV

SEQ ID NO: 1752219 - protein, 22 aa, Staphylococcus epidermidis
LIILIFILLVAIVNIVVSIIER

SEQ ID NO: 1752220 - protein, 26 aa, Staphylococcus epidermidis
LIKGYPILGWTFFIASLSLAGIPPFS

SEQ ID NO: 1752221 - protein, 21 aa, Staphylococcus epidermidis
LIKMIIIPIVFCALALSISNL

SEQ ID NO: 1752222 - protein, 18 aa, Staphylococcus epidermidis
LILGIALPIVYFTTMIRS

SEQ ID NO: 1752223 - protein, 21 aa, Staphylococcus epidermidis
LILIGAIPAAFLAIIFDFILR

SEQ ID NO: 1752224 - protein, 25 aa, Staphylococcus epidermidis
LILIGLILVLSIFKPTYRKPGLYKD

SEQ ID NO: 1752225 - protein, 19 aa, Staphylococcus epidermidis
LILKFSHILLPFMFGPMIA

SEQ ID NO: 1752226 - protein, 20 aa, Staphylococcus epidermidis
LILLACSIALLFISLFFRNR

SEQ ID NO: 1752227 - protein, 19 aa, Staphylococcus epidermidis
LILQVLFNLVDNALKHAES

SEQ ID NO: 1752228 - protein, 25 aa, Staphylococcus epidermidis
LILVFNIFFVLCLISMFITVITIIL

SEQ ID NO: 1752229 - protein, 63 aa, Staphylococcus epidermidis
LILVYSMLIAFLFIDKVFVNIIFFQGMFYTQIFGIPVFLFLNLLIVFLCIIVGSVLAYKINQQ

SEQ ID NO: 1752230 - protein, 21 aa, Staphylococcus epidermidis
LILVYSMLTAFLFIDKVFVNI

SEQ ID NO: 1752231 - protein, 17 aa, Staphylococcus epidermidis
LIMGFIIHIPISKAFIL

SEQ ID NO: 1752232 - protein, 18 aa, Staphylococcus epidermidis
LIMISVIFVIYRRVKYQP

SEQ ID NO: 1752233 - protein, 18 aa, Staphylococcus epidermidis
LIMLMQLSQLFSVSTDYL

SEQ ID NO: 1752234 - protein, 18 aa, Staphylococcus epidermidis
LINAVYAEKLIQYGNRYR

SEQ ID NO: 1752235 - protein, 19 aa, Staphylococcus epidermidis
LINLLPLMNRVFFKNNALT

SEQ ID NO: 1752236 - protein, 24 aa, Staphylococcus epidermidis
LINNFYFAYYFLIIGIGYTLIRII

SEQ ID NO: 1752237 - protein, 29 aa, Staphylococcus epidermidis
LINNKWTGLFVLIGLLIANWQVGLSALIA

SEQ ID NO: 1752238 - protein, 23 aa, Staphylococcus epidermidis
LIPAFIIFQSIIPIIIVFGTLGV

SEQ ID NO: 1752239 - protein, 20 aa, Staphylococcus epidermidis
LIPLFILLCFPFTPNTLINI

SEQ ID NO: 1752240 - protein, 20 aa, Staphylococcus epidermidis
LIPLFILLCFPFTPNTLINL

SEQ ID NO: 1752241 - protein, 18 aa, Staphylococcus epidermidis
LIPLYVQNALGLSALLSG

SEQ ID NO: 1752242 - protein, 26 aa, Staphylococcus epidermidis
LIQGYPILGWTFFIAALSLAGIPPLS

SEQ ID NO: 1752243 - protein, 21 aa, Staphylococcus epidermidis
LIQWIISFFLLVTGFLVSYVL

SEQ ID NO: 1752244 - protein, 17 aa, Staphylococcus epidermidis
LIRMLLMKQDAFLTENN

SEQ ID NO: 1752245 - protein, 17 aa, Staphylococcus epidermidis
LISFIIAIFTAIHLYFV

SEQ ID NO: 1752246 - protein, 29 aa, Staphylococcus epidermidis
LISIGNWRWIFWINIPIILIGLIGCLLLK

SEQ ID NO: 1752247 - protein, 21 aa, Staphylococcus epidermidis
LISLFIILTKSYISGLKPLKC

SEQ ID NO: 1752248 - protein, 20 aa, Staphylococcus epidermidis
LISVLLIYFLLTVLAQGIVI

SEQ ID NO: 1752249 - protein, 22 aa, Staphylococcus epidermidis
LITALLIIKPKLSFTLYDSDRL

SEQ ID NO: 1752250 - protein, 18 aa, Staphylococcus epidermidis
LITLIRFFIPLHPDFDTL

SEQ ID NO: 1752251 - protein, 24 aa, Staphylococcus epidermidis
LITRSWVNFLLKLLLSFVIVIFSG

SEQ ID NO: 1752252 - protein, 19 aa, Staphylococcus epidermidis
LITTNYYKLLKPNPTDREI

SEQ ID NO: 1752253 - protein, 24 aa, Staphylococcus epidermidis
LIVFTLIFGIIAFFHESRLGKWID

SEQ ID NO: 1752254 - protein, 32 aa, Staphylococcus epidermidis
LIVIIFIVISTFIFLFIGKPVSLLIIAGAING

SEQ ID NO: 1752255 - protein, 19 aa, Staphylococcus epidermidis
LIVILGIGYLIINGIRKKS

SEQ ID NO: 1752256 - protein, 30 aa, Staphylococcus epidermidis
LIVLALIAIIVIMFQLINHSGPFSKIGTNQ

SEQ ID NO: 1752257 - protein, 19 aa, Staphylococcus epidermidis
LIVSLLILVFGTKAGSQTT

SEQ ID NO: 1752258 - protein, 17 aa, Staphylococcus epidermidis
LIWAFIGFIWITHALNA

SEQ ID NO: 1752259 - protein, 18 aa, Staphylococcus epidermidis
LIYLIFPILAIFVDKRGN

SEQ ID NO: 1752260 - protein, 19 aa, Staphylococcus epidermidis
LKDKIINLMLFDVSWIDTK

SEQ ID NO: 1752261 - protein, 22 aa, Staphylococcus epidermidis
LKDKIYMYLIIGSSILIMGELS

SEQ ID NO: 1752262 - protein, 31 aa, Staphylococcus epidermidis
LKETKVFPMWLRWSLFIILVGADTYIAITCL

SEQ ID NO: 1752263 - protein, 26 aa, Staphylococcus epidermidis
LKEVSLGFVNAPYIGLDGINKFAYAK

SEQ ID NO: 1752264 - protein, 23 aa, Staphylococcus epidermidis
LKFSLFLAMLIACLLIQAATNMF

SEQ ID NO: 1752265 - protein, 17 aa, Staphylococcus epidermidis
LKGMQGANIIILALIIG

SEQ ID NO: 1752266 - protein, 25 aa, Staphylococcus epidermidis
LKIHPLTIIFILLCAGNLMGVVGVI

SEQ ID NO: 1752267 - protein, 25 aa, Staphylococcus epidermidis
LKLKIRWPFWLSQIGLILLGVQIGS

SEQ ID NO: 1752268 - protein, 18 aa, Staphylococcus epidermidis
LKLLNILLAGVGLFLEYS

SEQ ID NO: 1752269 - protein, 26 aa, Staphylococcus epidermidis
LKQSPILIILLIIISTLLLLICTGFS

SEQ ID NO: 1752270 - protein, 19 aa, Staphylococcus epidermidis
LKRFSIFAMGIMPYITASI

SEQ ID NO: 1752271 - protein, 17 aa, Staphylococcus epidermidis
LKTLVNPVKASLNYRNA

SEQ ID NO: 1752272 - protein, 20 aa, Staphylococcus epidermidis
LKVGRLMKFIPRPVMIGFVN

SEQ ID NO: 1752273 - protein, 27 aa, Staphylococcus epidermidis
LKVIFNFGLPLIVALLHGYFASLAYMH

SEQ ID NO: 1752274 - protein, 23 aa, Staphylococcus epidermidis
LKVRFIYTMQLIVAFIAILIPVI

SEQ ID NO: 1752275 - protein, 25 aa, Staphylococcus epidermidis
LKYTKFDWLIPYIDPFLVLIAGIIL

SEQ ID NO: 1752276 - protein, 42 aa, Staphylococcus epidermidis
LLAAVVTIPLVFLVVTLIIPILFFIIAIMMFARRNKVETVPA

SEQ ID NO: 1752277 - protein, 18 aa, Staphylococcus epidermidis
LLCYGISLTLLIIFISMY

SEQ ID NO: 1752278 - protein, 25 aa, Staphylococcus epidermidis
LLDGLLAFFIIGIITLIFVPSLSSF

SEQ ID NO: 1752279 - protein, 18 aa, Staphylococcus epidermidis
LLDLAKKNKIPQSLFVAI

SEQ ID NO: 1752280 - protein, 19 aa, Staphylococcus epidermidis
LLFLSIFCLLISLTSWSYH

SEQ ID NO: 1752281 - protein, 23 aa, Staphylococcus epidermidis
LLFTPLHHIKYGDSIYLTDSVNI

SEQ ID NO: 1752282 - protein, 18 aa, Staphylococcus epidermidis
LLGVLIFYSFLIYRRERN

SEQ ID NO: 1752283 - protein, 19 aa, Staphylococcus epidermidis
LLIIFAVSTVVLIILLIIS

SEQ ID NO: 1752284 - protein, 19 aa, Staphylococcus epidermidis
LLILLLFNTLVLYITPIGV

SEQ ID NO: 1752285 - protein, 32 aa, Staphylococcus epidermidis
LLISIGNWRWIFWINIPFIFIGLIGCLLLKKY

SEQ ID NO: 1752286 - protein, 24 aa, Staphylococcus epidermidis
LLISVIIILFIYISHEIKREHYIK

SEQ ID NO: 1752287 - protein, 21 aa, Staphylococcus epidermidis
LLIVPAVIAAILWFFVKPDKP

SEQ ID NO: 1752288 - protein, 19 aa, Staphylococcus epidermidis
LLLIMLFPIIIKFTKKIKN

SEQ ID NO: 1752289 - protein, 28 aa, Staphylococcus epidermidis
LLLLAPQLFFYIPLLSFVGGMLPFLMLF

SEQ ID NO: 1752290 - protein, 20 aa, Staphylococcus epidermidis
LLLLIPIFISYKEGLHIIKD

SEQ ID NO: 1752291 - protein, 17 aa, Staphylococcus epidermidis
LLLLVLMIIFGGKKGLV

SEQ ID NO: 1752292 - protein, 23 aa, Staphylococcus epidermidis
LLLNFILLLILFPIIIKFTKKVQ

SEQ ID NO: 1752293 - protein, 18 aa, Staphylococcus epidermidis
LLLTLCSVVISVQKYVTR

SEQ ID NO: 1752294 - protein, 24 aa, Staphylococcus epidermidis
LLLVALFYVFFIPQSFLAFGPYIN

SEQ ID NO: 1752295 - protein, 21 aa, Staphylococcus epidermidis
LLMGLLILILYILREYEINLL

SEQ ID NO: 1752296 - protein, 18 aa, Staphylococcus epidermidis
LLMSILICVTFSLLMVTP

SEQ ID NO: 1752297 - protein, 19 aa, Staphylococcus epidermidis
LLMSILICVTFSLLMVTPI

SEQ ID NO: 1752298 - protein, 23 aa, Staphylococcus epidermidis
LLNIFILIYMIIFWDNMSIAQRY

SEQ ID NO: 1752299 - protein, 18 aa, Staphylococcus epidermidis
LLNQTTNPTLEPYKVDIV

SEQ ID NO: 1752300 - protein, 17 aa, Staphylococcus epidermidis
LLPILIGMLIAIGLLSQ

SEQ ID NO: 1752301 - protein, 24 aa, Staphylococcus epidermidis
LLPLIFALIIPILYRFVKRIHLGW

SEQ ID NO: 1752302 - protein, 26 aa, Staphylococcus epidermidis
LLQLKRASLQFSFLTNLIAAFVACGF

SEQ ID NO: 1752303 - protein, 23 aa, Staphylococcus epidermidis
LLRFEFDMKTLMTVAVIGGAIIG

SEQ ID NO: 1752304 - protein, 21 aa, Staphylococcus epidermidis
LLSFLKLIFATALFIFVIFTL

SEQ ID NO: 1752305 - protein, 34 aa, Staphylococcus epidermidis
LLSHHVFAYLFNLYHRAWEYASVNELFLIVESVT

SEQ ID NO: 1752306 - protein, 20 aa, Staphylococcus epidermidis
LLSLIFIIMYIVYPGYIYNI

SEQ ID NO: 1752307 - protein, 21 aa, Staphylococcus epidermidis
LLSYFIILLILIVYVDDYKLI

SEQ ID NO: 1752308 - protein, 23 aa, Staphylococcus epidermidis
LLTIPVLFLFPFVQKHFVKGINI

SEQ ID NO: 1752309 - protein, 19 aa, Staphylococcus epidermidis
LLVAALLNFIFPDAIKLFI

SEQ ID NO: 1752310 - protein, 19 aa, Staphylococcus epidermidis
LLVCSLMIIFGLKLPLLIA

SEQ ID NO: 1752311 - protein, 17 aa, Staphylococcus epidermidis
LLVILVKLILYLIIVTF

SEQ ID NO: 1752312 - protein, 24 aa, Staphylococcus epidermidis
LLVKLTHRFASRSVLLWALIIFIF

SEQ ID NO: 1752313 - protein, 24 aa, Staphylococcus epidermidis
LLVPYVIFFAFFSIYYYLTGKEDA

SEQ ID NO: 1752314 - protein, 30 aa, Staphylococcus epidermidis
LLVVAMIGIIVIIFQFVNHSGPFSGSESQH

SEQ ID NO: 1752315 - protein, 28 aa, Staphylococcus epidermidis
LLVVAMIGILVIIFQFVNHSGPFSDSES

SEQ ID NO: 1752316 - protein, 21 aa, Staphylococcus epidermidis
LLYPYLVLLIKWQWVKLNKNV

SEQ ID NO: 1752317 - protein, 24 aa, Staphylococcus epidermidis
LMAYVVVIFVFYFLHIHTFSERFK

SEQ ID NO: 1752318 - protein, 17 aa, Staphylococcus epidermidis
LMGLIQLILGLLKVGRL

SEQ ID NO: 1752319 - protein, 18 aa, Staphylococcus epidermidis
LMGLIQLILGLLKVGRLM

SEQ ID NO: 1752320 - protein, 18 aa, Staphylococcus epidermidis
LMGVIVIAISRKLVTKFF

SEQ ID NO: 1752321 - protein, 25 aa, Staphylococcus epidermidis
LMHSSNVFMFKTALKLAGDPYYSGM

SEQ ID NO: 1752322 - protein, 19 aa, Staphylococcus epidermidis
LMIAFTFLLIVIAPKSYLI

SEQ ID NO: 1752323 - protein, 20 aa, Staphylococcus epidermidis
LMILFYFIFFDPQFPVILCF

SEQ ID NO: 1752324 - protein, 21 aa, Staphylococcus epidermidis
LMILLTIVLYYISKKIQDKYK

SEQ ID NO: 1752325 - protein, 22 aa, Staphylococcus epidermidis
LMILLTVVLYYGSKRLQDKYKN

SEQ ID NO: 1752326 - protein, 23 aa, Staphylococcus epidermidis
LMISLLIILLLLNLKKRYKYPMI

SEQ ID NO: 1752327 - protein, 18 aa, Staphylococcus epidermidis
LMITFLVLVANSVTFVFI

SEQ ID NO: 1752328 - protein, 23 aa, Staphylococcus epidermidis
LMKDYFYHVLHLPMSFFDTRKSG

SEQ ID NO: 1752329 - protein, 19 aa, Staphylococcus epidermidis
LMLFFKIIGVSIIPMALIL

SEQ ID NO: 1752330 - protein, 18 aa, Staphylococcus epidermidis
LMLLKLAVVWTLVQFFEG

SEQ ID NO: 1752331 - protein, 28 aa, Staphylococcus epidermidis
LMNPLMIFMLWALLGWKVAIVYFIVLTI

SEQ ID NO: 1752332 - protein, 29 aa, Staphylococcus epidermidis
LMNPLMIFMLWSLLSWKVAVIYFVVLAIF

SEQ ID NO: 1752333 - protein, 29 aa, Staphylococcus epidermidis
LMNPLMVFMLWALLGWKVAIVYFIVLAIF

SEQ ID NO: 1752334 - protein, 25 aa, Staphylococcus epidermidis
LMPPIQFVFILLTFSICDEILSESG

SEQ ID NO: 1752335 - protein, 18 aa, Staphylococcus epidermidis
LMQFGKINRVWLVLLFAG

SEQ ID NO: 1752336 - protein, 18 aa, Staphylococcus epidermidis
LMTFAIIVSTTFTLLLVT

SEQ ID NO: 1752337 - protein, 17 aa, Staphylococcus epidermidis
LMVLMYRCFGKHGLIAW

SEQ ID NO: 1752338 - protein, 17 aa, Staphylococcus epidermidis
LNAILIIVGYKYLSKRS

SEQ ID NO: 1752339 - protein, 18 aa, Staphylococcus epidermidis
LNALLYLLVLINPKKMNP

SEQ ID NO: 1752340 - protein, 25 aa, Staphylococcus epidermidis
LNATNLTRYNYGQPPGTTTAGAVQF

SEQ ID NO: 1752341 - protein, 29 aa, Staphylococcus epidermidis
LNDAWAFLYPMLPYLFIGVFIGAFIYGFV

SEQ ID NO: 1752342 - protein, 27 aa, Staphylococcus epidermidis
LNDLNSIVINVIQKPTARKAVNKKAEE

SEQ ID NO: 1752343 - protein, 20 aa, Staphylococcus epidermidis
LNFFIPLILIVMYVSLIKKI

SEQ ID NO: 1752344 - protein, 17 aa, Staphylococcus epidermidis
LNFSVFFLNLIGLILMA

SEQ ID NO: 1752345 - protein, 17 aa, Staphylococcus epidermidis
LNFVLVFTTLKIFGYSK

SEQ ID NO: 1752346 - protein, 17 aa, Staphylococcus epidermidis
LNHAKALNEAMRQLENE

SEQ ID NO: 1752347 - protein, 20 aa, Staphylococcus epidermidis
LNIMWLFVYTPHKNSKALES

SEQ ID NO: 1752348 - protein, 38 aa, Staphylococcus epidermidis
LNLVKIAFRLLMSPISTIMRILPMLSGAFQALGVAIGA

SEQ ID NO: 1752349 - protein, 38 aa, Staphylococcus epidermidis
LNLVKIAFRLLMSPISTIMRILPMLSGAFQTLGVAIGA

SEQ ID NO: 1752350 - protein, 22 aa, Staphylococcus epidermidis
LNMILDPIFIFGLDLNVVGAAL

SEQ ID NO: 1752351 - protein, 25 aa, Staphylococcus epidermidis
LNMNSFSIFLPWTTPGPLGIVMGTG

SEQ ID NO: 1752352 - protein, 22 aa, Staphylococcus epidermidis
LNNISLHIYQGESLGIIGEPGS

SEQ ID NO: 1752353 - protein, 35 aa, Staphylococcus epidermidis
LNQYSLLILIILTLIFLYILVYRGIVTSVLSFLIV

SEQ ID NO: 1752354 - protein, 18 aa, Staphylococcus epidermidis
LNRKVAIKAISIPPSEKE

SEQ ID NO: 1752355 - protein, 27 aa, Staphylococcus epidermidis
LNRNELTYTVTLPENFEYVENSTEASF

SEQ ID NO: 1752356 - protein, 21 aa, Staphylococcus epidermidis
LNSGNYIVHFDKPSGMTQTTT

SEQ ID NO: 1752357 - protein, 25 aa, Staphylococcus epidermidis
LNVISIIILLILALVSPIYDLIEIL

SEQ ID NO: 1752358 - protein, 28 aa, Staphylococcus epidermidis
LNYYIIITLLIFIVIVGYGYISVGFPKV

SEQ ID NO: 1752359 - protein, 27 aa, Staphylococcus epidermidis
LPFSTITIILFLISAFLFLATTFDSGS

SEQ ID NO: 1752360 - protein, 26 aa, Staphylococcus epidermidis
LPGMIPWFMILFSHLRFRKLHPEEVK

SEQ ID NO: 1752361 - protein, 24 aa, Staphylococcus epidermidis
LPGMIPWFMILFSHLRFRRLHPEK

SEQ ID NO: 1752362 - protein, 20 aa, Staphylococcus epidermidis
LPIAMPVIMAGIRTAMVLII

SEQ ID NO: 1752363 - protein, 27 aa, Staphylococcus epidermidis
LPILLLAVMWFFLIRPQQKRAKAHREM

SEQ ID NO: 1752364 - protein, 22 aa, Staphylococcus epidermidis
LPIYIIIFIVLWLIINIISILQ

SEQ ID NO: 1752365 - protein, 19 aa, Staphylococcus epidermidis
LPLIPFIFLSFVVTSSVYH

SEQ ID NO: 1752366 - protein, 17 aa, Staphylococcus epidermidis
LPLLFKIVQLQLNLSKG

SEQ ID NO: 1752367 - protein, 19 aa, Staphylococcus epidermidis
LPLLIALLHALFAALAFMK

SEQ ID NO: 1752368 - protein, 21 aa, Staphylococcus epidermidis
LPLMDGLYLHMLLWSKEKGYK

SEQ ID NO: 1752369 - protein, 19 aa, Staphylococcus epidermidis
LPLVLIMTFSLLLSSYTCG

SEQ ID NO: 1752370 - protein, 21 aa, Staphylococcus epidermidis
LPMLLNTFLIGLFLFGHSGGP

SEQ ID NO: 1752371 - protein, 48 aa, Staphylococcus epidermidis
LPSKRNILLMFCPLLPFIGFAFIFLIPSKGILICLTFMILNAILSFKL

SEQ ID NO: 1752372 - protein, 17 aa, Staphylococcus epidermidis
LPVYLKDLGLKGSDLGL

SEQ ID NO: 1752373 - protein, 18 aa, Staphylococcus epidermidis
LPYFFGTVGILYNKEKYP

SEQ ID NO: 1752374 - protein, 23 aa, Staphylococcus epidermidis
LQAWTIFMILKVIGTLIMMILGF

SEQ ID NO: 1752375 - protein, 24 aa, Staphylococcus epidermidis
LQFTIMPSLAFLIAKAFNLPSEIA

SEQ ID NO: 1752376 - protein, 20 aa, Staphylococcus epidermidis
LQGGFNWVDQTWQYVDHETG

SEQ ID NO: 1752377 - protein, 26 aa, Staphylococcus epidermidis
LQKGSNYFRFQYFNPLNASKYYENLD

SEQ ID NO: 1752378 - protein, 42 aa, Staphylococcus epidermidis
LQKIKQLMINLFTNYGLIALIFILLKVFVILSNTTFKSDIPL

SEQ ID NO: 1752379 - protein, 18 aa, Staphylococcus epidermidis
LQLFMGSILFFKFLTEFI

SEQ ID NO: 1752380 - protein, 33 aa, Staphylococcus epidermidis
LQMLNMRYSHWLRFVWPVVAFVLIFGGGLLITQ

SEQ ID NO: 1752381 - protein, 32 aa, Staphylococcus epidermidis
LQMLNMRYSHWLRFVWPVVAFVLVFGGGLLIA

SEQ ID NO: 1752382 - protein, 26 aa, Staphylococcus epidermidis
LQNGTYTVEFAIPDNYTPSPANNSTN

SEQ ID NO: 1752383 - protein, 31 aa, Staphylococcus epidermidis
LQTLLLGVLLAFMWPPFKLKANPPRALKATI

SEQ ID NO: 1752384 - protein, 39 aa, Staphylococcus epidermidis
LQYTVIMAVAIFIALAFNIQKAYWVPLSAHTIMLGNVTT

SEQ ID NO: 1752385 - protein, 31 aa, Staphylococcus epidermidis
LQYTVIMGIAIFIALAFNIQKAYWVPLTAHT

SEQ ID NO: 1752386 - protein, 26 aa, Staphylococcus epidermidis
LRENPKWLVKLLILIVLALITAFVSY

SEQ ID NO: 1752387 - protein, 20 aa, Staphylococcus epidermidis
LRFKKLAVMLLLSIFILYLN

SEQ ID NO: 1752388 - protein, 25 aa, Staphylococcus epidermidis
LRFKKLAVMLLLSIFILYLNHILIS

SEQ ID NO: 1752389 - protein, 22 aa, Staphylococcus epidermidis
LRKKVLLRRKVLKKLTLNRQII

SEQ ID NO: 1752390 - protein, 19 aa, Staphylococcus epidermidis
LRNFMQAFFVVFFVYMAMY

SEQ ID NO: 1752391 - protein, 19 aa, Staphylococcus epidermidis
LRNFPVLGRIRYISEKVGP

SEQ ID NO: 1752392 - protein, 44 aa, Staphylococcus epidermidis
LRRQRHKRIQYTIITLLVLLIVIFLLYMFTPLSKISNVNVKGNN

SEQ ID NO: 1752393 - protein, 33 aa, Staphylococcus epidermidis
LRRWTLLIYGLLLLFFPFYHLIDKHHLVFSVIS

SEQ ID NO: 1752394 - protein, 20 aa, Staphylococcus epidermidis
LRYSIGLLIFVCLWTFVLSL

SEQ ID NO: 1752395 - protein, 24 aa, Staphylococcus epidermidis
LSAHPHFLWFNLTKPDIWITIIAG

SEQ ID NO: 1752396 - protein, 29 aa, Staphylococcus epidermidis
LSALIFNALIIVLLIPIAMKGVKFKGAST

SEQ ID NO: 1752397 - protein, 28 aa, Staphylococcus epidermidis
LSCILSLILYLPFIYEYITKGVIFSGNG

SEQ ID NO: 1752398 - protein, 25 aa, Staphylococcus epidermidis
LSDTDKIDPMVITKRKIDKEEQIQN

SEQ ID NO: 1752399 - protein, 23 aa, Staphylococcus epidermidis
LSEHPHFLWFNLTKPDIWITVIA

SEQ ID NO: 1752400 - protein, 28 aa, Staphylococcus epidermidis
LSEKQLLLFILSIFIVYYLFVHQKVFIS

SEQ ID NO: 1752401 - protein, 20 aa, Staphylococcus epidermidis
LSFGRYVSFFSSWFLTFGYV

SEQ ID NO: 1752402 - protein, 27 aa, Staphylococcus epidermidis
LSFKFLNSLLYLKYLKKQLLYLNEKEK

SEQ ID NO: 1752403 - protein, 26 aa, Staphylococcus epidermidis
LSFLVHPLLILVFSALAFIVPGASDA

SEQ ID NO: 1752404 - protein, 26 aa, Staphylococcus epidermidis
LSGILAFHIDPIFAIIIMGFSAMMTE

SEQ ID NO: 1752405 - protein, 35 aa, Staphylococcus epidermidis
LSGLICAIVLFLIIVVIYRQPLLALIVGGSLTCAM

SEQ ID NO: 1752406 - protein, 38 aa, Staphylococcus epidermidis
LSHVKSHDLIFNQLYVVFKMIFWFNPALYISKTMMDND

SEQ ID NO: 1752407 - protein, 31 aa, Staphylococcus epidermidis
LSIFIAFIFVVSPLYFRFSAYWPFFSDVFIW

SEQ ID NO: 1752408 - protein, 25 aa, Staphylococcus epidermidis
LSIFILYLNHILISGTLYALDVYHI

SEQ ID NO: 1752409 - protein, 19 aa, Staphylococcus epidermidis
LSIKGFPLALGALYLPLLF

SEQ ID NO: 1752410 - protein, 27 aa, Staphylococcus epidermidis
LSIYDYLLNLIAMFSIFMCLVLGAQQI

SEQ ID NO: 1752411 - protein, 32 aa, Staphylococcus epidermidis
LSKNYKLYYLSLWYFITFGAFVAFGLFLPNYL

SEQ ID NO: 1752412 - protein, 21 aa, Staphylococcus epidermidis
LSLLLFVIILQVAVLKYYHFN

SEQ ID NO: 1752413 - protein, 30 aa, Staphylococcus epidermidis
LSMKMMPIAFTLMAVIIAILGFSIMMGMKI

SEQ ID NO: 1752414 - protein, 30 aa, Staphylococcus epidermidis
LSNDFVVLDFTYDLPLTTYLSQVLNIDAKV

SEQ ID NO: 1752415 - protein, 27 aa, Staphylococcus epidermidis
LSNFKLQFIVIFIISFIALVFSIFLPK

SEQ ID NO: 1752416 - protein, 40 aa, Staphylococcus epidermidis
LSNKVNKYSIRKFTVGTASILVGATLMFGAADNEAKAAED

SEQ ID NO: 1752417 - protein, 18 aa, Staphylococcus epidermidis
LSQVALLAAFIPIISGMS

SEQ ID NO: 1752418 - protein, 19 aa, Staphylococcus epidermidis
LSRILIFFHLGYFEYNKGF

SEQ ID NO: 1752419 - protein, 24 aa, Staphylococcus epidermidis
LSSFIINAILIVVGWKFLSRTTAI

SEQ ID NO: 1752420 - protein, 25 aa, Staphylococcus epidermidis
LSSKPWIWMPPALMITLTILSINFV

SEQ ID NO: 1752421 - protein, 30 aa, Staphylococcus epidermidis
LSSMGTGFIIFLIALLILAIIGTILISKKP

SEQ ID NO: 1752422 - protein, 26 aa, Staphylococcus epidermidis
LSSMSFLCFPLISKYIFFIIFALVNS

SEQ ID NO: 1752423 - protein, 19 aa, Staphylococcus epidermidis
LSSPIILGASILIAKKLGK

SEQ ID NO: 1752424 - protein, 26 aa, Staphylococcus epidermidis
LSSSIVNLIFLPPKFETKIYYNSMNI

SEQ ID NO: 1752425 - protein, 24 aa, Staphylococcus epidermidis
LSSVILIIIVAIVGMIAFVHFKYG

SEQ ID NO: 1752426 - protein, 24 aa, Staphylococcus epidermidis
LSTLGFIFLMFLSGLEIDFKAFKK

SEQ ID NO: 1752427 - protein, 19 aa, Staphylococcus epidermidis
LSVILPVVLFIMLTDEMLK

SEQ ID NO: 1752428 - protein, 31 aa, Staphylococcus epidermidis
LSVILVITIVISFLFYFITTEKKVDKDTLYE

SEQ ID NO: 1752429 - protein, 25 aa, Staphylococcus epidermidis
LSVNFDRQNRTLTFTSNGLTSKGSN

SEQ ID NO: 1752430 - protein, 25 aa, Staphylococcus epidermidis
LSVTFVNFFMYLIHYMLIVTITEYT

SEQ ID NO: 1752431 - protein, 25 aa, Staphylococcus epidermidis
LSYIFKTIYLLVTAIVFFVLIASYI

SEQ ID NO: 1752432 - protein, 17 aa, Staphylococcus epidermidis
LSYKLYPALMLIMSVFL

SEQ ID NO: 1752433 - protein, 21 aa, Staphylococcus epidermidis
LSYQFLNRALITSILVGIVCG

SEQ ID NO: 1752434 - protein, 18 aa, Staphylococcus epidermidis
LTAFLFIDKVFVNIIYFQ

SEQ ID NO: 1752435 - protein, 24 aa, Staphylococcus epidermidis
LTAYIYLTLVAFNFISGVLTLPGL

SEQ ID NO: 1752436 - protein, 18 aa, Staphylococcus epidermidis
LTDDLKVKIISLPNTDKV

SEQ ID NO: 1752437 - protein, 33 aa, Staphylococcus epidermidis
LTEKVLGWFSWVFLLILTIITMFIALVSFSNDT

SEQ ID NO: 1752438 - protein, 28 aa, Staphylococcus epidermidis
LTFISKAFIPLLWLLDVPTQLAPGILFS

SEQ ID NO: 1752439 - protein, 28 aa, Staphylococcus epidermidis
LTFISNAFIPLLWLLDVPTQLAPGILFS

SEQ ID NO: 1752440 - protein, 21 aa, Staphylococcus epidermidis
LTFLILIAIISIIAPLIAPLP

SEQ ID NO: 1752441 - protein, 17 aa, Staphylococcus epidermidis
LTFSFVQKYIQIKFFSE

SEQ ID NO: 1752442 - protein, 20 aa, Staphylococcus epidermidis
LTFVPLLFLGRYTNMIYTLA

SEQ ID NO: 1752443 - protein, 21 aa, Staphylococcus epidermidis
LTIIGVLIYFIVNTGFFSVRL

SEQ ID NO: 1752444 - protein, 35 aa, Staphylococcus epidermidis
LTIILVLGFIINLVLAFVIIFLEKDRRSASSTWAW

SEQ ID NO: 1752445 - protein, 24 aa, Staphylococcus epidermidis
LTIIVIVVVIIVLLVGSLLMYKHK

SEQ ID NO: 1752446 - protein, 24 aa, Staphylococcus epidermidis
LTKLNDVKVFYPLSNYFIVEIKNL

SEQ ID NO: 1752447 - protein, 23 aa, Staphylococcus epidermidis
LTKPIFYIISIICLFLTLGLCTF

SEQ ID NO: 1752448 - protein, 31 aa, Staphylococcus epidermidis
LTLAFINFFIPFLLIFIIDGFKGIKETLPSI

SEQ ID NO: 1752449 - protein, 21 aa, Staphylococcus epidermidis
LTLMIPLLIVVTFMTFMMTYL

SEQ ID NO: 1752450 - protein, 25 aa, Staphylococcus epidermidis
LTLSTLIAFIIYSFQLMSPISSISS

SEQ ID NO: 1752451 - protein, 20 aa, Staphylococcus epidermidis
LTLTFGVSKSFLKKIGMSDK

SEQ ID NO: 1752452 - protein, 20 aa, Staphylococcus epidermidis
LTMNFMITFLFVISATVIGV

SEQ ID NO: 1752453 - protein, 32 aa, Staphylococcus epidermidis
LTNRFSVRPVLLWTLFVFIIGNGMIAIAPNFP

SEQ ID NO: 1752454 - protein, 26 aa, Staphylococcus epidermidis
LTPKFKLGHFIGYSLLQFLIGFIACY

SEQ ID NO: 1752455 - protein, 25 aa, Staphylococcus epidermidis
LTRMIYGIRPSLLYVFIALFVSVVI

SEQ ID NO: 1752456 - protein, 29 aa, Staphylococcus epidermidis
LTSEIKQLYPFIFNTLYNAIAQLSKDTDI

SEQ ID NO: 1752457 - protein, 25 aa, Staphylococcus epidermidis
LTSKRFIDWLNLNNIVPGFYGINSI

SEQ ID NO: 1752458 - protein, 50 aa, Staphylococcus epidermidis
LTTILIVPIFSGHPPFLRLYLITWMMHLILIGGSRIFWRVSRKYVTGGNK

SEQ ID NO: 1752459 - protein, 26 aa, Staphylococcus epidermidis
LTTKEKYFLLIFISNAIFGVIQDWVN

SEQ ID NO: 1752460 - protein, 25 aa, Staphylococcus epidermidis
LTTTISFVVSFIVVTYLHVVLGELA

SEQ ID NO: 1752461 - protein, 17 aa, Staphylococcus epidermidis
LTVLFYGLAQILPGLVL

SEQ ID NO: 1752462 - protein, 36 aa, Staphylococcus epidermidis
LTVLGLILLSLTFLPDFWYITASVVGYLLFGAGLGI

SEQ ID NO: 1752463 - protein, 28 aa, Staphylococcus epidermidis
LTYTPPHFYLLIILSIIGILLSIIFARI

SEQ ID NO: 1752464 - protein, 17 aa, Staphylococcus epidermidis
LVAFSSKAALVIFMWLP

SEQ ID NO: 1752465 - protein, 18 aa, Staphylococcus epidermidis
LVALFIWRQSHLETPLLN

SEQ ID NO: 1752466 - protein, 18 aa, Staphylococcus epidermidis
LVALGISVAYIYSLYAFY

SEQ ID NO: 1752467 - protein, 22 aa, Staphylococcus epidermidis
LVAYLMLKRFKIEALFFVIVMS

SEQ ID NO: 1752468 - protein, 26 aa, Staphylococcus epidermidis
LVERLPAMVLPSWAYNKIAPVAIDDV

SEQ ID NO: 1752469 - protein, 24 aa, Staphylococcus epidermidis
LVEYFNWRSLFHVVAPIAAITFII

SEQ ID NO: 1752470 - protein, 23 aa, Staphylococcus epidermidis
LVFLLCVMGILTFGIFPHLMPEF

SEQ ID NO: 1752471 - protein, 27 aa, Staphylococcus epidermidis
LVFVPQIVVLFFFISLLEDSGYMARIA

SEQ ID NO: 1752472 - protein, 26 aa, Staphylococcus epidermidis
LVGEDSFDLYPNYWGGKKYNVKEKLT

SEQ ID NO: 1752473 - protein, 19 aa, Staphylococcus epidermidis
LVGLFMWNLMQWSTNPAIQ

SEQ ID NO: 1752474 - protein, 19 aa, Staphylococcus epidermidis
LVIAFTFLFIVIAPKSYLI

SEQ ID NO: 1752475 - protein, 23 aa, Staphylococcus epidermidis
LVIAIIGVIIFGVFSFLNGNGNM

SEQ ID NO: 1752476 - protein, 27 aa, Staphylococcus epidermidis
LVIAIPLAIVVIVVGGWYGLKLNKEKE

SEQ ID NO: 1752477 - protein, 18 aa, Staphylococcus epidermidis
LVIFPLSVAWITLNFNLA

SEQ ID NO: 1752478 - protein, 25 aa, Staphylococcus epidermidis
LVILAVFIPLIYFTPNKITYDNTNE

SEQ ID NO: 1752479 - protein, 17 aa, Staphylococcus epidermidis
LVILILITLFLKFDRLI

SEQ ID NO: 1752480 - protein, 23 aa, Staphylococcus epidermidis
LVILIVVTIILRPYLDVLLLGRA

SEQ ID NO: 1752481 - protein, 30 aa, Staphylococcus epidermidis
LVITLSMLLTLWIVPWLSAKKARKLKQQVT

SEQ ID NO: 1752482 - protein, 17 aa, Staphylococcus epidermidis
LVITLYFSYIIHTIAQK

SEQ ID NO: 1752483 - protein, 19 aa, Staphylococcus epidermidis
LVIYIIIGAALGIIIIPEV

SEQ ID NO: 1752484 - protein, 17 aa, Staphylococcus epidermidis
LVLAFRTYKELGTDNVE

SEQ ID NO: 1752485 - protein, 20 aa, Staphylococcus epidermidis
LVLCLLLIDLITRSWVNFLL

SEQ ID NO: 1752486 - protein, 21 aa, Staphylococcus epidermidis
LVLFIIIVLILMLLNKLYNLA

SEQ ID NO: 1752487 - protein, 21 aa, Staphylococcus epidermidis
LVLMLPLLIVVSFMTFMMTYL

SEQ ID NO: 1752488 - protein, 26 aa, Staphylococcus epidermidis
LVLVVIMIIIFFYSKVRWYSIVIVLM

SEQ ID NO: 1752489 - protein, 26 aa, Staphylococcus epidermidis
LVLVVLIIIIFFYSKVRWYSIVIVLM

SEQ ID NO: 1752490 - protein, 25 aa, Staphylococcus epidermidis
LVNNFYFAYYFFIIGTVYSFIRIIF

SEQ ID NO: 1752491 - protein, 17 aa, Staphylococcus epidermidis
LVPFIAFILLHIGQWMY

SEQ ID NO: 1752492 - protein, 17 aa, Staphylococcus epidermidis
LVPLKAVLGFVLSLLAT

SEQ ID NO: 1752493 - protein, 20 aa, Staphylococcus epidermidis
LVPMIIIMLYRFLYNNQMLF

SEQ ID NO: 1752494 - protein, 22 aa, Staphylococcus epidermidis
LVPYLLWMVIFIIIPAILLVYF

SEQ ID NO: 1752495 - protein, 19 aa, Staphylococcus epidermidis
LVQIFLISMLFTDSAYQFA

SEQ ID NO: 1752496 - protein, 25 aa, Staphylococcus epidermidis
LVRGVLGLLAFLNVALELSGHNPIP

SEQ ID NO: 1752497 - protein, 19 aa, Staphylococcus epidermidis
LVTLIVLTIFIISGAIFLT

SEQ ID NO: 1752498 - protein, 18 aa, Staphylococcus epidermidis
LVTLKGELKMATPSKPIV

SEQ ID NO: 1752499 - protein, 18 aa, Staphylococcus epidermidis
LVVIAIIALIIFGPTKLP

SEQ ID NO: 1752500 - protein, 29 aa, Staphylococcus epidermidis
LVVYAVSAGYKWFFAYPDQHIETVNTLTI

SEQ ID NO: 1752501 - protein, 28 aa, Staphylococcus epidermidis
LVYAVIYYFVFRFLITKFNFKTPGREDK

SEQ ID NO: 1752502 - protein, 18 aa, Staphylococcus epidermidis
LWELFVNHLLMSVYGVLL

SEQ ID NO: 1752503 - protein, 32 aa, Staphylococcus epidermidis
LWFAPIAAIVILVIFSLAFYPAFNPKPKDLPI

SEQ ID NO: 1752504 - protein, 24 aa, Staphylococcus epidermidis
LYAIPFYFRFLHVRSFRKNKKSGQ

SEQ ID NO: 1752505 - protein, 20 aa, Staphylococcus epidermidis
LYALIPYLFTIIPSLMIGFF

SEQ ID NO: 1752506 - protein, 19 aa, Staphylococcus epidermidis
LYALMVLVVSVKMFGFLRA

SEQ ID NO: 1752507 - protein, 17 aa, Staphylococcus epidermidis
LYILMFEQIISITWVYI

SEQ ID NO: 1752508 - protein, 30 aa, Staphylococcus epidermidis
LYNHKQPLIYLFIVILVVLIARATFNMLNQ

SEQ ID NO: 1752509 - protein, 18 aa, Staphylococcus epidermidis
LYPALMLIMSVFLSFAVV

SEQ ID NO: 1752510 - protein, 25 aa, Staphylococcus epidermidis
LYWYIGIIVFYFIMAILTPLSFVDW

SEQ ID NO: 1752511 - protein, 17 aa, Staphylococcus epidermidis
MAIFYLFVGLDFNIFEY

SEQ ID NO: 1752512 - protein, 17 aa, Staphylococcus epidermidis
MAIGDMVFAPIAPGLAA

SEQ ID NO: 1752513 - protein, 17 aa, Staphylococcus epidermidis
MAILFQNLVLYAQTTIH

SEQ ID NO: 1752514 - protein, 17 aa, Staphylococcus epidermidis
MALRLFMLLTLISGFWE

SEQ ID NO: 1752515 - protein, 18 aa, Staphylococcus epidermidis
MALRLFMLLTLISGFWEL

SEQ ID NO: 1752516 - protein, 33 aa, Staphylococcus epidermidis
MASSIFLESFLFFSGFYYPLYLAGQGKMVHSGE

SEQ ID NO: 1752517 - protein, 40 aa, Staphylococcus epidermidis
MATVPPLFFNQPFDEWFYRALVVLVVSCSCALVLSVPVAV

SEQ ID NO: 1752518 - protein, 35 aa, Staphylococcus epidermidis
MAVSALFPILLIVPLFDILMYFNILPKIIGGIGWV

SEQ ID NO: 1752519 - protein, 35 aa, Staphylococcus epidermidis
MAVSALFPILLVVPLFDILMYFNILPKIIGGIGWV

SEQ ID NO: 1752520 - protein, 30 aa, Staphylococcus epidermidis
MAYGILVFFAFIFVILLINSSTRLAVLSIP

SEQ ID NO: 1752521 - protein, 21 aa, Staphylococcus epidermidis
MCIPLAWFLGLQDFFIKPLML

SEQ ID NO: 1752522 - protein, 17 aa, Staphylococcus epidermidis
MCQFLIAIIIIFSVAHF

SEQ ID NO: 1752523 - protein, 25 aa, Staphylococcus epidermidis
MEIADKWQNRYYRRGSANYKTNTVA

SEQ ID NO: 1752524 - protein, 20 aa, Staphylococcus epidermidis
MENHFECLWDLFRSIPSLEQ

SEQ ID NO: 1752525 - protein, 19 aa, Staphylococcus epidermidis
MENVEGMAFAIPINDVRKI

SEQ ID NO: 1752526 - protein, 28 aa, Staphylococcus epidermidis
MEWAKLGILISLLFFPNGHILIKLLFAV

SEQ ID NO: 1752527 - protein, 20 aa, Staphylococcus epidermidis
MFIADMLLAIPSFIIALVIL

SEQ ID NO: 1752528 - protein, 30 aa, Staphylococcus epidermidis
MFIIVIVAMILLLIKYRYIFKLQTGRFFIL

SEQ ID NO: 1752529 - protein, 18 aa, Staphylococcus epidermidis
MFIMYFFGHPLSYSTMAL

SEQ ID NO: 1752530 - protein, 19 aa, Staphylococcus epidermidis
MFIMYFFSHPLSYSTMALA

SEQ ID NO: 1752531 - protein, 22 aa, Staphylococcus epidermidis
MFLAPMLILTLMYFVFNGNEED

SEQ ID NO: 1752532 - protein, 17 aa, Staphylococcus epidermidis
MFLIFALLHKYFYSNNS

SEQ ID NO: 1752533 - protein, 21 aa, Staphylococcus epidermidis
MFLVLLMFIYIIAMIVMGVFA

SEQ ID NO: 1752534 - protein, 27 aa, Staphylococcus epidermidis
MFTAIALYFMFLLQSIFMISLIFGVKN

SEQ ID NO: 1752535 - protein, 26 aa, Staphylococcus epidermidis
MGFIGMIFWIIILGLLFYGVYILIAK

SEQ ID NO: 1752536 - protein, 25 aa, Staphylococcus epidermidis
MGGLSFVLLLIQQWLFLNPNHNLNQ

SEQ ID NO: 1752537 - protein, 17 aa, Staphylococcus epidermidis
MGIPWKVGLTGVLFSGI

SEQ ID NO: 1752538 - protein, 21 aa, Staphylococcus epidermidis
MGKYYAGIYIPSKFTHEITGT

SEQ ID NO: 1752539 - protein, 28 aa, Staphylococcus epidermidis
MHFGAIFYFIFLVLFLFAALTSSISLLE

SEQ ID NO: 1752540 - protein, 19 aa, Staphylococcus epidermidis
MIAASFWSLLQPAIESSKG

SEQ ID NO: 1752541 - protein, 32 aa, Staphylococcus epidermidis; identical to SEQ ID NO: 1588916

SEQ ID NO: 1752542 - protein, 26 aa, Staphylococcus epidermidis
MIAVVVAIIIIWAFAGMPALELKSKS

SEQ ID NO: 1752543 - protein, 29 aa, Staphylococcus epidermidis
MIFIAMFTLFIAFLLVCLHFEFAGNPVLH

SEQ ID NO: 1752544 - protein, 26 aa, Staphylococcus epidermidis
MIGIVFMTMLLFIFLIYANHFVMNRR

SEQ ID NO: 1752545 - protein, 30 aa, Staphylococcus epidermidis
MIGVEIVFFILKLFLEPTRFGYLIIIAVSV

SEQ ID NO: 1752546 - protein, 19 aa, Staphylococcus epidermidis
MIIISIVVYLLIPKSLDIT

SEQ ID NO: 1752547 - protein, 25 aa, Staphylococcus epidermidis
MIILLSFALLFLSFYDKVLPKNLKN

SEQ ID NO: 1752548 - protein, 18 aa, Staphylococcus epidermidis
MIILVRPISVLLSTLGTE

SEQ ID NO: 1752549 - protein, 19 aa, Staphylococcus epidermidis
MIIMYFIIVPVAIGVVLHM

SEQ ID NO: 1752550 - protein, 20 aa, Staphylococcus epidermidis
MILQLSTFHSYHELEFLLVI

SEQ ID NO: 1752551 - protein, 23 aa, Staphylococcus epidermidis
MILREFYIFRFVIGKQPYKLQFN

SEQ ID NO: 1752552 - protein, 17 aa, Staphylococcus epidermidis
MIMTCVLIGFIVCGRWI

SEQ ID NO: 1752553 - protein, 25 aa, Staphylococcus epidermidis
MIPLLILISMVVFSLAIIQPGDPFS

SEQ ID NO: 1752554 - protein, 17 aa, Staphylococcus epidermidis
MITIVGLVLILIAASVT

SEQ ID NO: 1752555 - protein, 18 aa, Staphylococcus epidermidis
MIVLVRPISVLFSTFRTE

SEQ ID NO: 1752556 - protein, 24 aa, Staphylococcus epidermidis
MIYICWLGIFLAFLFMNIASISDR

SEQ ID NO: 1752557 - protein, 20 aa, Staphylococcus epidermidis
MIYIGSPLIFFMFSLTNLIT

SEQ ID NO: 1752558 - protein, 28 aa, Staphylococcus epidermidis
MKGLTPIFFFLIFTFLMHILFTNGGKTL

SEQ ID NO: 1752559 - protein, 19 aa, Staphylococcus epidermidis
MLFSLMIILFVINNFKISF

SEQ ID NO: 1752560 - protein, 27 aa, Staphylococcus epidermidis
MLGGITLLIILILQRFTKGFLKSIAIL

SEQ ID NO: 1752561 - protein, 28 aa, Staphylococcus epidermidis
MLGLAKEDVIGYYMLGLLNLENEFSLDE

SEQ ID NO: 1752562 - protein, 18 aa, Staphylococcus epidermidis
MLGLLNLENEFSLDEIQE

SEQ ID NO: 1752563 - protein, 18 aa, Staphylococcus epidermidis
MLIAWIFYMFSIVLNISF

SEQ ID NO: 1752564 - protein, 23 aa, Staphylococcus epidermidis
MLIIQSLCVLLGIWIYKMDKNES

SEQ ID NO: 1752565 - protein, 19 aa, Staphylococcus epidermidis
MLKLKLKWRVAVSSLLYGI

SEQ ID NO: 1752566 - protein, 19 aa, Staphylococcus epidermidis
MLLPFVCALILVFAKNKNQ

SEQ ID NO: 1752567 - protein, 17 aa, Staphylococcus epidermidis
MLTSPFVMMTWITVLIP

SEQ ID NO: 1752568 - protein, 21 aa, Staphylococcus epidermidis
MLWHLIFMIPAIIGYAFGFIF

SEQ ID NO: 1752569 - protein, 18 aa, Staphylococcus epidermidis
MLYLRAIVPVLPLTLYVV

SEQ ID NO: 1752570 - protein, 20 aa, Staphylococcus epidermidis
MMASIFFMYNHSVLASTRNH

SEQ ID NO: 1752571 - protein, 21 aa, Staphylococcus epidermidis
MMIGIFILLLLTLVIGKNING

SEQ ID NO: 1752572 - protein, 22 aa, Staphylococcus epidermidis
MMIGIFLLLLLTLVIGKNINGS

SEQ ID NO: 1752573 - protein, 23 aa, Staphylococcus epidermidis
MMLREFYIFRFVIGKQPYKLQFD

SEQ ID NO: 1752574 - protein, 24 aa, Staphylococcus epidermidis
MMSPFIILFLTIVGAYLFFRSSVS

SEQ ID NO: 1752575 - protein, 21 aa, Staphylococcus epidermidis
MNEIATIIPATTIKTDAKTAI

SEQ ID NO: 1752576 - protein, 19 aa, Staphylococcus epidermidis
MNSLFFFYSAFALPFIFNV

SEQ ID NO: 1752577 - protein, 29 aa, Staphylococcus epidermidis
MNVWEFLSEKWWLVIIVVVIICGSLSQMF

SEQ ID NO: 1752578 - protein, 24 aa, Staphylococcus epidermidis
MNWFSHDPAFDYFKNMDSTTVATV

SEQ ID NO: 1752579 - protein, 18 aa, Staphylococcus epidermidis
MNYMALAGWDTKDMLKGV

SEQ ID NO: 1752580 - protein, 19 aa, Staphylococcus epidermidis
MPKKELAPHSPSLIYDNRN

SEQ ID NO: 1752581 - protein, 23 aa, Staphylococcus epidermidis
MPLTLLAMIAFYIAIFSIMKPDM

SEQ ID NO: 1752582 - protein, 17 aa, Staphylococcus epidermidis
MPPIMFLIGLVAAHYQH

SEQ ID NO: 1752583 - protein, 24 aa, Staphylococcus epidermidis
MQALMRILFYMSPILWVPKNHGVS

SEQ ID NO: 1752584 - protein, 26 aa, Staphylococcus epidermidis
MQAWGWRIPFILGLFLGLFGLYLRRK

SEQ ID NO: 1752585 - protein, 17 aa, Staphylococcus epidermidis
MQFFVLSYIIYKINFRL

SEQ ID NO: 1752586 - protein, 25 aa, Staphylococcus epidermidis
MQGEFPVMMFGLPAAALAIYHTAKP

SEQ ID NO: 1752587 - protein, 31 aa, Staphylococcus epidermidis
MQGMPAWVWSCIFLVIIFALNSLSVRVYGES

SEQ ID NO: 1752588 - protein, 18 aa, Staphylococcus epidermidis
MRIIFFISSILYLPTNAL

SEQ ID NO: 1752589 - protein, 25 aa, Staphylococcus epidermidis
MRKVFPLDFKILIGVGLLFCVGTPI

SEQ ID NO: 1752590 - protein, 22 aa, Staphylococcus epidermidis
MRRIELSRLLLLKPDIVIFDEP

SEQ ID NO: 1752591 - protein, 34 aa, Staphylococcus epidermidis
MSKGLLLKILFNFGLPLIVALLHALFASLAFMKI

SEQ ID NO: 1752592 - protein, 27 aa, Staphylococcus epidermidis
MSLITFIVLVIFKRSIIMPLYMMFSIL

SEQ ID NO: 1752593 - protein, 18 aa, Staphylococcus epidermidis
MSNLLLLLLAVTGGIRSF

SEQ ID NO: 1752594 - protein, 21 aa, Staphylococcus epidermidis
MTIIIYLTLLLDFNKIVRALG

SEQ ID NO: 1752595 - protein, 28 aa, Staphylococcus epidermidis
MTLVALGISVAYIYSLYAFYMNNFSSAT

SEQ ID NO: 1752596 - protein, 33 aa, Staphylococcus epidermidis
MTSLLIIAILVIFVVLFLIFDTNLFKNDIKYTF

SEQ ID NO: 1752597 - protein, 32 aa, Staphylococcus epidermidis
MTTLFIISILAILAILFLIFDTNLFKNDVKHT

SEQ ID NO: 1752598 - protein, 31 aa, Staphylococcus epidermidis
MTTRVTTPIVAGLGYAARAYVKFDDQMNQMK

SEQ ID NO: 1752599 - protein, 25 aa, Staphylococcus epidermidis
MVKAGIFLLFRFTPLLGLSDAYIYT

SEQ ID NO: 1752600 - protein, 25 aa, Staphylococcus epidermidis
MVLAYAFLLGLFILGLVTSLAIVHA

SEQ ID NO: 1752601 - protein, 19 aa, Staphylococcus epidermidis
MVLFLILGTIFLDAYDITI

SEQ ID NO: 1752602 - protein, 26 aa, Staphylococcus epidermidis
MVLVVSVKMFGFLRAITRYIERLLSH

SEQ ID NO: 1752603 - protein, 17 aa, Staphylococcus epidermidis
MVLYINRNTRTAKGYFL

SEQ ID NO: 1752604 - protein, 34 aa, Staphylococcus epidermidis
MVSMGIFCFIISGLYMLFLFVKKLRKYVTSNVML

SEQ ID NO: 1752605 - protein, 34 aa, Staphylococcus epidermidis
MVSMGIFCFIISGLYMLFLIVKKLRKYVISNMML

SEQ ID NO: 1752606 - protein, 33 aa, Staphylococcus epidermidis
MVSMGIFCFIISGLYMLFLIVKKLRKYVTSSVM

SEQ ID NO: 1752607 - protein, 39 aa, Staphylococcus epidermidis
MWITNKLGWYYLILTTIIVFFCIFLIFSPIGKLKLGKPH

SEQ ID NO: 1752608 - protein, 18 aa, Staphylococcus epidermidis
MWLYMYAYSFYLFFDFAG

SEQ ID NO: 1752609 - protein, 18 aa, Staphylococcus epidermidis
MYLTIVATILISIFLDLT

SEQ ID NO: 1752610 - protein, 32 aa, Staphylococcus epidermidis
MYSTPVLMFIYPLAITLILLTLASPLFNHSKV

SEQ ID NO: 1752611 - protein, 21 aa, Staphylococcus epidermidis
MYTFFSLFVTVLIFIGKKGQE

SEQ ID NO: 1752612 - protein, 18 aa, Staphylococcus epidermidis
NACALILYGFTGLEGYFV

SEQ ID NO: 1752613 - protein, 30 aa, Staphylococcus epidermidis
NADNMTVDTGFYLTPKYNVGDYVWEDTNKD

SEQ ID NO: 1752614 - protein, 31 aa, Staphylococcus epidermidis
NADNMTVDTGFYLTPKYNVGDYVWEDTNKDG

SEQ ID NO: 1752615 - protein, 20 aa, Staphylococcus epidermidis
NAEEFLEKFKFTAAQTEIDD

SEQ ID NO: 1752616 - protein, 31 aa, Staphylococcus epidermidis
NAEHPVGLALLVLSLLAIVGFVLNMFIKHFK

SEQ ID NO: 1752617 - protein, 21 aa, Staphylococcus epidermidis
NAFFIIMWLLGQMSIWNFLFL

SEQ ID NO: 1752618 - protein, 39 aa, Staphylococcus epidermidis
NARTSLDRNVFFGPLGQSRSYTISYKLKDGYTLESIASK

SEQ ID NO: 1752619 - protein, 39 aa, Staphylococcus epidermidis
NARTSLDRNVFFGTLGQSRSYTISYKLKDGYTLESVASK

SEQ ID NO: 1752620 - protein, 26 aa, Staphylococcus epidermidis
NASQKSWLFLPYLCMIFIGGIIHNKL

SEQ ID NO: 1752621 - protein, 26 aa, Staphylococcus epidermidis
NAVFNYWWMFALSFVFFLIAGALTIF

SEQ ID NO: 1752622 - protein, 24 aa, Staphylococcus epidermidis
NCGALLFFMILGQVNYFYGIIMAF

SEQ ID NO: 1752623 - protein, 17 aa, Staphylococcus epidermidis
NDFKFIPVYFGMGVIFS

SEQ ID NO: 1752624 - protein, 27 aa, Staphylococcus epidermidis
NDIQNPALIMLLAGLGLLGLFRNKIRE

SEQ ID NO: 1752625 - protein, 23 aa, Staphylococcus epidermidis
NDKKIVIATLTRKAYEIDGTKIT

SEQ ID NO: 1752626 - protein, 47 aa, Staphylococcus epidermidis
NDNATNLKLRRIVPLGIIFFILILIVILFFLLKNFNSPEAQTKILVN

SEQ ID NO: 1752627 - protein, 24 aa, Staphylococcus epidermidis
NDPKLSFSIVYTNQPVPPPWLNGG

SEQ ID NO: 1752628 - protein, 17 aa, Staphylococcus epidermidis
NDRWLHGLNITAYLFWT

SEQ ID NO: 1752629 - protein, 24 aa, Staphylococcus epidermidis
NDSTQFFESPLFKKKYSVKNSELL

SEQ ID NO: 1752630 - protein, 18 aa, Staphylococcus epidermidis
NDVLINAVYAEKLIQYGN

SEQ ID NO: 1752631 - protein, 21 aa, Staphylococcus epidermidis
NEAISIFKYLTNNAYTMINYS

SEQ ID NO: 1752632 - protein, 17 aa, Staphylococcus epidermidis
NEDKTIYMINDYGQLQP

SEQ ID NO: 1752633 - protein, 17 aa, Staphylococcus epidermidis
NEDLENAGLSWKATREY

SEQ ID NO: 1752634 - protein, 27 aa, Staphylococcus epidermidis
NEENRYLVMPALSDELKIVGLKTVSFV

SEQ ID NO: 1752635 - protein, 35 aa, Staphylococcus epidermidis
NEFKFGLSFLTRSVALARFPWLSANIEYTVTREPY

SEQ ID NO: 1752636 - protein, 26 aa, Staphylococcus epidermidis
NEGSFANRLATAAKTKKSKLTKGSKE

SEQ ID NO: 1752637 - protein, 30 aa, Staphylococcus epidermidis
NEHDYTTTVFGSIALISSLLLLRRQRKESK

SEQ ID NO: 1752638 - protein, 21 aa, Staphylococcus epidermidis
NEIEKLPFDDNLRKLHDLNLK

SEQ ID NO: 1752639 - protein, 27 aa, Staphylococcus epidermidis
NEKIVFTPHLVFVITDMSLIIDHVILE

SEQ ID NO: 1752640 - protein, 27 aa, Staphylococcus epidermidis
NEKPLSNVLVTLTYPDGTSKSVRTDEE

SEQ ID NO: 1752641 - protein, 26 aa, Staphylococcus epidermidis
NELPNSSEILLLNLTSRIIGKDVNKE

SEQ ID NO: 1752642 - protein, 24 aa, Staphylococcus epidermidis
NELSYLAIFILIVAGGPFGEVQNY

SEQ ID NO: 1752643 - protein, 30 aa, Staphylococcus epidermidis
NEPIKDSEWSITGYPNTLTLQNAVGRTNNA

SEQ ID NO: 1752644 - protein, 27 aa, Staphylococcus epidermidis
NESFGLPFWLSSFILVILILITLFLKF

SEQ ID NO: 1752645 - protein, 31 aa, Staphylococcus epidermidis
NESPLRYLIAISIVILVVLGAFQLGIVGRMI

SEQ ID NO: 1752646 - protein, 25 aa, Staphylococcus epidermidis
NETLNKWCFWLFMIGFNVCFLPQFI

SEQ ID NO: 1752647 - protein, 29 aa, Staphylococcus epidermidis
NETNRTLISSILLIGLILIRKSRKKKDTI

SEQ ID NO: 1752648 - protein, 21 aa, Staphylococcus epidermidis
NFANYLLNPLNDFPELFTDTL

SEQ ID NO: 1752649 - protein, 22 aa, Staphylococcus epidermidis
NFANYLLNPLNDFPELFTDTLV

SEQ ID NO: 1752650 - protein, 26 aa, Staphylococcus epidermidis
NFHPHEVAFLLIDYKGGGMANLFKDL

SEQ ID NO: 1752651 - protein, 27 aa, Staphylococcus epidermidis
NFHPHEVAFLLIDYKGGGMANLFKDLK

SEQ ID NO: 1752652 - protein, 31 aa, Staphylococcus epidermidis
NFLKVMFLSSPFVIVFFILEQFARAVGKPII

SEQ ID NO: 1752653 - protein, 21 aa, Staphylococcus epidermidis
NFNAFVYAFFILKLDLKNKNN

SEQ ID NO: 1752654 - protein, 18 aa, Staphylococcus epidermidis
NFNIILGAVLLIFILVFG

SEQ ID NO: 1752655 - protein, 22 aa, Staphylococcus epidermidis
NFNTTYHTKYYYRLSKPYDDSD

SEQ ID NO: 1752656 - protein, 22 aa, Staphylococcus epidermidis
NFSCFIGLIVLIFTLILGVILN

SEQ ID NO: 1752657 - protein, 22 aa, Staphylococcus epidermidis
NFSILHYFILLLGIAVIVVFAL

SEQ ID NO: 1752658 - protein, 19 aa, Staphylococcus epidermidis
NFTIKIVDTTKPTVTSIAN

SEQ ID NO: 1752659 - protein, 26 aa, Staphylococcus epidermidis
NFYGNKLYFERLFMNLIDNSIQHNKF

SEQ ID NO: 1752660 - protein, 39 aa, Staphylococcus epidermidis
NGDENIVTTLLFVASMLIGGLSLFKVGFQNLLRFEFDMK

SEQ ID NO: 1752661 - protein, 23 aa, Staphylococcus epidermidis
NGDYTIEFETPEGYTPTKQNSGS

SEQ ID NO: 1752662 - protein, 23 aa, Staphylococcus epidermidis
NGEVIFNIYFKNNLTSYAYPSSK

SEQ ID NO: 1752663 - protein, 22 aa, Staphylococcus epidermidis
NGFLMKMVLAQTFILALIGTLI

SEQ ID NO: 1752664 - protein, 17 aa, Staphylococcus epidermidis
NGGFYLISTMTLLIIAS

SEQ ID NO: 1752665 - protein, 30 aa, Staphylococcus epidermidis
NGGKVNLSFAQSDFYTQIESITLNDVKMDT

SEQ ID NO: 1752666 - protein, 33 aa, Staphylococcus epidermidis
NGGKVNLSFAQSDFYTQIESITLRGVKMDTTNN

SEQ ID NO: 1752667 - protein, 19 aa, Staphylococcus epidermidis
NGHLILNEIMLLIVGLGIA

SEQ ID NO: 1752668 - protein, 18 aa, Staphylococcus epidermidis
NGKFIPGEVKVYEVTDTN

SEQ ID NO: 1752669 - protein, 21 aa, Staphylococcus epidermidis
NGKLTYQRFLNGYPTFNTQNL

SEQ ID NO: 1752670 - protein, 30 aa, Staphylococcus epidermidis
NGKSPVAPITAATMTPAMTHAHGYGQGYGQ

SEQ ID NO: 1752671 - protein, 21 aa, Staphylococcus epidermidis
NGLTYKITFETPEGYTPTLKH

SEQ ID NO: 1752672 - protein, 17 aa, Staphylococcus epidermidis
NGMNEIATIIPATTIKT

SEQ ID NO: 1752673 - protein, 24 aa, Staphylococcus epidermidis
NGNTSITQILPSTAVKTNALAALA

SEQ ID NO: 1752674 - protein, 21 aa, Staphylococcus epidermidis
NGQQILVRNVPQNAQVTLYQS

SEQ ID NO: 1752675 - protein, 22 aa, Staphylococcus epidermidis
NGRFFIGICMLFVGAIILIKSI

SEQ ID NO: 1752676 - protein, 25 aa, Staphylococcus epidermidis
NGSDLPNRDFTSISAIGSLPSSSEI

SEQ ID NO: 1752677 - protein, 24 aa, Staphylococcus epidermidis
NGTRYLFFDNMSFTAPTKQPIIKP

SEQ ID NO: 1752678 - protein, 24 aa, Staphylococcus epidermidis
NGVIWRILIFYLGAIFVIVSVYPW

SEQ ID NO: 1752679 - protein, 24 aa, Staphylococcus epidermidis
NGVSFMVPFIVVGGLLMAIALTIG

SEQ ID NO: 1752680 - protein, 46 aa, Staphylococcus epidermidis
NHDGKKKGGLMKILLPLIAAVLILGAIAIFGGMALNNHNDSKNDDN

SEQ ID NO: 1752681 - protein, 22 aa, Staphylococcus epidermidis
NHQIIWINLKYEFNQSRPTMDE

SEQ ID NO: 1752682 - protein, 18 aa, Staphylococcus epidermidis
NHTLNKFSPLSYVDTMIY

SEQ ID NO: 1752683 - protein, 24 aa, Staphylococcus epidermidis
NIALIFATVLLILGLISTIFSYKQ

SEQ ID NO: 1752684 - protein, 36 aa, Staphylococcus epidermidis
NIASFYSLLPWFIITVPIVLLLGYQLDILNLGDHVA

SEQ ID NO: 1752685 - protein, 29 aa, Staphylococcus epidermidis
NIDSILQPFIILFLTVLGSYFFFRSTVSL

SEQ ID NO: 1752686 - protein, 24 aa, Staphylococcus epidermidis
NIERISHLVLTRTGLYIIDSQLLK

SEQ ID NO: 1752687 - protein, 25 aa, Staphylococcus epidermidis
NIGMIVYIVLIIAFAYFYAFVQVNP

SEQ ID NO: 1752688 - protein, 20 aa, Staphylococcus epidermidis
NIHFILFLTTFLFLLTMCLY

SEQ ID NO: 1752689 - protein, 18 aa, Staphylococcus epidermidis
NIIDLIRFLFNYEHLVMV

SEQ ID NO: 1752690 - protein, 33 aa, Staphylococcus epidermidis
NIIIGMIQNMDDARALLNGIERLKDAQTKAHND

SEQ ID NO: 1752691 - protein, 18 aa, Staphylococcus epidermidis
NIKDIKMWVLGLVGTIAG

SEQ ID NO: 1752692 - protein, 24 aa, Staphylococcus epidermidis
NIKQALPHFLIPNVPFNLETLQII

SEQ ID NO: 1752693 - protein, 25 aa, Staphylococcus epidermidis
NIKQTLPHFLIPNIPFNLETLQIIF

SEQ ID NO: 1752694 - protein, 18 aa, Staphylococcus epidermidis
NILDVMNIGWSKLVRKEF

SEQ ID NO: 1752695 - protein, 23 aa, Staphylococcus epidermidis
NILINIMFVLIAIIPIVLIKSIV

SEQ ID NO: 1752696 - protein, 18 aa, Staphylococcus epidermidis
NILTMKGLFGAKSLIEMY

SEQ ID NO: 1752697 - protein, 21 aa, Staphylococcus epidermidis
NINMFTFIQLLTPFVTYIIAE

SEQ ID NO: 1752698 - protein, 20 aa, Staphylococcus epidermidis
NINMFTFIQLLTPFVTYLIA

SEQ ID NO: 1752699 - protein, 18 aa, Staphylococcus epidermidis
NINPVVAILIMSISALMT

SEQ ID NO: 1752700 - protein, 29 aa, Staphylococcus epidermidis
NIPDNMNQVRISFLPISINNALTTRESNS

SEQ ID NO: 1752701 - protein, 17 aa, Staphylococcus epidermidis
NIQKAYWVPLSAHTIML

SEQ ID NO: 1752702 - protein, 20 aa, Staphylococcus epidermidis
NIQKAYWVPLSAHTIMLGNM

SEQ ID NO: 1752703 - protein, 36 aa, Staphylococcus epidermidis
NIQWKSILILVILNLFLAWFFIYFDWGRNGVKGAAN

SEQ ID NO: 1752704 - protein, 24 aa, Staphylococcus epidermidis
NIVSFTVNIKPLNEKYRITTSSSN

SEQ ID NO: 1752705 - protein, 20 aa, Staphylococcus epidermidis
NIYLILVIGLLYVIIHYYRN

SEQ ID NO: 1752706 - protein, 24 aa, Staphylococcus epidermidis
NKAVLFIFRCLVVLLVFIGAVAKT

SEQ ID NO: 1752707 - protein, 24 aa, Staphylococcus epidermidis
NKGDKVQFLIKSKVLNNEPITSIK

SEQ ID NO: 1752708 - protein, 28 aa, Staphylococcus epidermidis
NKIKTSRFLLGLTIPSVLSLITLILQFL

SEQ ID NO: 1752709 - protein, 19 aa, Staphylococcus epidermidis
NKINAITPATTVKTDARKA

SEQ ID NO: 1752710 - protein, 34 aa, Staphylococcus epidermidis
NKKDNFYIISIEIVFFYLSWDFMSHTLFTLNLSL

SEQ ID NO: 1752711 - protein, 20 aa, Staphylococcus epidermidis
NKKFVIFFSIAYFFEGAGYI

SEQ ID NO: 1752712 - protein, 17 aa, Staphylococcus epidermidis
NKKKFYFHALITGTNNY

SEQ ID NO: 1752713 - protein, 27 aa, Staphylococcus epidermidis
NKKLFKKLNILLGKSYSLKELDYLVNL

SEQ ID NO: 1752714 - protein, 28 aa, Staphylococcus epidermidis
NKKVLLISFIIIGLFMIVEIIGGFVANS

SEQ ID NO: 1752715 - protein, 24 aa, Staphylococcus epidermidis
NKLSYIFPLLNYFAPHKLIEVSLN

SEQ ID NO: 1752716 - protein, 26 aa, Staphylococcus epidermidis
NKNHLYILLLIHYVCIMYFVYAYEPL

SEQ ID NO: 1752717 - protein, 59 aa, Staphylococcus epidermidis
NKRQKFLRIGFIVLTILAAALSIFSFFTANLIFGIIFALLTVIFVVGIIFSKSKAVDYS

SEQ ID NO: 1752718 - protein, 21 aa, Staphylococcus epidermidis
NKRVDFLSNKVNKYSIRKFTV

SEQ ID NO: 1752719 - protein, 21 aa, Staphylococcus epidermidis
NKSYIGFLDDSIEKLIIESFR

SEQ ID NO: 1752720 - protein, 22 aa, Staphylococcus epidermidis
NKWTHFFISIPVIIGGSFSAFF

SEQ ID NO: 1752721 - protein, 27 aa, Staphylococcus epidermidis
NLAVKHPLFEYARSFDFIIITDVGLIN

SEQ ID NO: 1752722 - protein, 18 aa, Staphylococcus epidermidis
NLIAMFSIFMCLVLGAQQ

SEQ ID NO: 1752723 - protein, 27 aa, Staphylococcus epidermidis
NLIFYVFSIYIFIIIALQLFVSNDAAF

SEQ ID NO: 1752724 - protein, 29 aa, Staphylococcus epidermidis
NLILTLTTIIFVIFFSFKYIYGDFRNLDP

SEQ ID NO: 1752725 - protein, 17 aa, Staphylococcus epidermidis
NLILYLITPLQTFIYFI

SEQ ID NO: 1752726 - protein, 24 aa, Staphylococcus epidermidis
NLIVVILFVLIFEPSIWTIILAMS

SEQ ID NO: 1752727 - protein, 18 aa, Staphylococcus epidermidis
NLKPITLNISRDKAKKIT

SEQ ID NO: 1752728 - protein, 21 aa, Staphylococcus epidermidis
NLKYMYILTLLEYILIYVCFF

SEQ ID NO: 1752729 - protein, 19 aa, Staphylococcus epidermidis
NLLEKWGFPRWASILTIFI

SEQ ID NO: 1752730 - protein, 28 aa, Staphylococcus epidermidis
NLLITLFVFLILIFFLVFTAQKLANIPG

SEQ ID NO: 1752731 - protein, 29 aa, Staphylococcus epidermidis
NLLITLFVFLILIFFLVFTAQKLANIPGV

SEQ ID NO: 1752732 - protein, 26 aa, Staphylococcus epidermidis
NLLITLFVFLILTFFLVFTAQKLANI

SEQ ID NO: 1752733 - protein, 18 aa, Staphylococcus epidermidis
NLLPLMNIVFFKSNHLTL

SEQ ID NO: 1752734 - protein, 17 aa, Staphylococcus epidermidis
NLLPSVLTLIGSLIMLF

SEQ ID NO: 1752735 - protein, 18 aa, Staphylococcus epidermidis
NLLSLKDIYKNKGIDVLN

SEQ ID NO: 1752736 - protein, 20 aa, Staphylococcus epidermidis
NLMMIWMIITVLLGLVFVGF

SEQ ID NO: 1752737 - protein, 25 aa, Staphylococcus epidermidis
NLNDNYFRVTKLYYDLLTEKDKDSQ

SEQ ID NO: 1752738 - protein, 19 aa, Staphylococcus epidermidis
NLPKEKLLTSIQYYGNTSS

SEQ ID NO: 1752739 - protein, 19 aa, Staphylococcus epidermidis
NLTRYNYGQPPGTTTAGAV

SEQ ID NO: 1752740 - protein, 23 aa, Staphylococcus epidermidis
NLVIMFICITLIGLFSQWARTTN

SEQ ID NO: 1752741 - protein, 29 aa, Staphylococcus epidermidis
NLVSKIIMILIYIIVALIVIAILNKVIEQ

SEQ ID NO: 1752742 - protein, 22 aa, Staphylococcus epidermidis
NMCINAYQLALFLIACFYISTV

SEQ ID NO: 1752743 - protein, 19 aa, Staphylococcus epidermidis
NMSFAYYMKNYGGDKQLPR

SEQ ID NO: 1752744 - protein, 19 aa, Staphylococcus epidermidis
NMVFILANWLFLFAGLLFI

SEQ ID NO: 1752745 - protein, 24 aa, Staphylococcus epidermidis
NMYINVFILLLTILPTLAFKNIFD

SEQ ID NO: 1752746 - protein, 25 aa, Staphylococcus epidermidis
NNADSKFTQFYQKQLEKLKNANNAQ

SEQ ID NO: 1752747 - protein, 17 aa, Staphylococcus epidermidis
NNAQPVLDKLAIERLTQ

SEQ ID NO: 1752748 - protein, 24 aa, Staphylococcus epidermidis
NNDKDTIYVAKNKSPLLVGVGEGF

SEQ ID NO: 1752749 - protein, 37 aa, Staphylococcus epidermidis
NNEIKYNKPYFYKGILLILLVCLIIASITGYGIKSFI

SEQ ID NO: 1752750 - protein, 32 aa, Staphylococcus epidermidis
NNFIIMGVTVILLIAILFKFNLAHVATLASVT

SEQ ID NO: 1752751 - protein, 18 aa, Staphylococcus epidermidis
NNHQAFAASETPITSEIS

SEQ ID NO: 1752752 - protein, 35 aa, Staphylococcus epidermidis
NNINEYRPEYNKKKNAILKLYDVSDTQEAIINGYP

SEQ ID NO: 1752753 - protein, 24 aa, Staphylococcus epidermidis
NNIWFDLSILLVFIIGFTVLNIIG

SEQ ID NO: 1752754 - protein, 17 aa, Staphylococcus epidermidis
NNKLNYYIMITLFIFVA

SEQ ID NO: 1752755 - protein, 18 aa, Staphylococcus epidermidis
NNKPNYVEFNQDNGKVVF

SEQ ID NO: 1752756 - protein, 38 aa, Staphylococcus epidermidis
NNKSSTYILIIVVIVLFYVFIACQSYFKDPTRIYSDDV

SEQ ID NO: 1752757 - protein, 26 aa, Staphylococcus epidermidis
NNRYEHILNQAHLLGEKHIAEHKLGY

SEQ ID NO: 1752758 - protein, 29 aa, Staphylococcus epidermidis
NNRYEHILNQAHLLGEKHIAEHKLGYVVV

SEQ ID NO: 1752759 - protein, 27 aa, Staphylococcus epidermidis
NNTMRKMVQNLWWGAGYNIVAVPLAAG

SEQ ID NO: 1752760 - protein, 28 aa, Staphylococcus epidermidis
NNTYLLYFIFCILLIGLLILPETAITPV

SEQ ID NO: 1752761 - protein, 18 aa, Staphylococcus epidermidis
NNVIWPTSNEQFNLKANY

SEQ ID NO: 1752762 - protein, 24 aa, Staphylococcus epidermidis
NNVPFRILIFYIGSLAVIMSVVPW

SEQ ID NO: 1752763 - protein, 32 aa, Staphylococcus epidermidis
NNYTPEKSWDTGLYYFGFIGEKPVRTEVLRPT

SEQ ID NO: 1752764 - protein, 23 aa, Staphylococcus epidermidis
NPDNGLYVLKYKATSTANKTVVV

SEQ ID NO: 1752765 - protein, 27 aa, Staphylococcus epidermidis
NPGKAVAIILLVLQIAGGGGTFPIQTA

SEQ ID NO: 1752766 - protein, 25 aa, Staphylococcus epidermidis
NPILLLILAIIFFSVLKIFKYVSLS

SEQ ID NO: 1752767 - protein, 23 aa, Staphylococcus epidermidis
NPILLLVLAIIFFSVLKIFKYVS

SEQ ID NO: 1752768 - protein, 26 aa, Staphylococcus epidermidis
NPIRALIMLLLLVALWFISKKVEKHF

SEQ ID NO: 1752769 - protein, 27 aa, Staphylococcus epidermidis
NPISNHPWMLLLQGVVFFIIYYVIFRV

SEQ ID NO: 1752770 - protein, 22 aa, Staphylococcus epidermidis
NPKKIELEFQPLTSFSNKRYIY

SEQ ID NO: 1752771 - protein, 17 aa, Staphylococcus epidermidis
NPLHVWLWAQLAVFLHV

SEQ ID NO: 1752772 - protein, 18 aa, Staphylococcus epidermidis
NPLLNPALIASIAIIIVL

SEQ ID NO: 1752773 - protein, 20 aa, Staphylococcus epidermidis
NPLVICYTNDVVKNFTANGL

SEQ ID NO: 1752774 - protein, 20 aa, Staphylococcus epidermidis
NQAIALLQPKENNSELVQAK

SEQ ID NO: 1752775 - protein, 20 aa, Staphylococcus epidermidis
NQAIALLQPKENNSVLVQAK

SEQ ID NO: 1752776 - protein, 25 aa, Staphylococcus epidermidis
NQIKAILPDVITKSNARDVLKSLAN

SEQ ID NO: 1752777 - protein, 24 aa, Staphylococcus epidermidis
NQILGVFMYPFALLLGLPFNEGWD

SEQ ID NO: 1752778 - protein, 18 aa, Staphylococcus epidermidis
NQLNIAMQALRNSVNDVN

SEQ ID NO: 1752779 - protein, 31 aa, Staphylococcus epidermidis
NQLNQRLTDTINLLQPLANKESLKEARNRLE

SEQ ID NO: 1752780 - protein, 23 aa, Staphylococcus epidermidis
NQLPIFIVMAVYTGIYAVFAVIG

SEQ ID NO: 1752781 - protein, 27 aa, Staphylococcus epidermidis
NQNPKYAKYFSTVKNGKFIPGEVKVYE

SEQ ID NO: 1752782 - protein, 21 aa, Staphylococcus epidermidis
NQNVPFDQRYSQSRIDNLLHE

SEQ ID NO: 1752783 - protein, 23 aa, Staphylococcus epidermidis
NQPTLYIELIIGIALIFAGVMMS

SEQ ID NO: 1752784 - protein, 58 aa, Staphylococcus epidermidis
NQRQKLLRISFIVLALIGAALTVFSFVTANMIFGIIFAILTVIFIVGIFLSKTKDVDY

SEQ ID NO: 1752785 - protein, 23 aa, Staphylococcus epidermidis
NQSFLFIVILGSLTAFGPLAIDM

SEQ ID NO: 1752786 - protein, 27 aa, Staphylococcus epidermidis
NQSIEEIAMILPEVSKKPQAKLELKQK

SEQ ID NO: 1752787 - protein, 24 aa, Staphylococcus epidermidis
NQTIKRFFIWLALTVLFAFLSFIN

SEQ ID NO: 1752788 - protein, 27 aa, Staphylococcus epidermidis
NRHPYLWWFMFAVYISNALFTLVNLYL

SEQ ID NO: 1752789 - protein, 26 aa, Staphylococcus epidermidis
NRHPYLWWFMFAVYVSNALFTLVNLY

SEQ ID NO: 1752790 - protein, 21 aa, Staphylococcus epidermidis
NRIYFILSFVFMVTVPNTIYS

SEQ ID NO: 1752791 - protein, 19 aa, Staphylococcus epidermidis
NRLFAKFGALIFIFLIAMF

SEQ ID NO: 1752792 - protein, 17 aa, Staphylococcus epidermidis
NRNHDISHLSLNKSIQM

SEQ ID NO: 1752793 - protein, 20 aa, Staphylococcus epidermidis
NRVALFIALAIMGFVGLILG

SEQ ID NO: 1752794 - protein, 24 aa, Staphylococcus epidermidis
NRYALIFELLIGIILIFAGIMMSQ

SEQ ID NO: 1752795 - protein, 22 aa, Staphylococcus epidermidis
NSFTLLLLLRAFQGVFAASFSP

SEQ ID NO: 1752796 - protein, 23 aa, Staphylococcus epidermidis
NSKFIDWGVLLVLGIFVGSYIAA

SEQ ID NO: 1752797 - protein, 24 aa, Staphylococcus epidermidis
NSLDQINNFRPDFSKKRNAVAEIV

SEQ ID NO: 1752798 - protein, 29 aa, Staphylococcus epidermidis
NSLISRFRQLATGAYKYNPFLINQVKNLN

SEQ ID NO: 1752799 - protein, 18 aa, Staphylococcus epidermidis
NSNQIGRDLTLHAEIFFD

SEQ ID NO: 1752800 - protein, 31 aa, Staphylococcus epidermidis
NSNQIGRDLTLHAEIFFDGETTPIRKDTTYK

SEQ ID NO: 1752801 - protein, 18 aa, Staphylococcus epidermidis
NSTIAIWNAIKKSAVIIW

SEQ ID NO: 1752802 - protein, 57 aa, Staphylococcus epidermidis
NTGRDLYNRTSRYSSRAPKRKDFVVSFIASAIVGSALGLYYKNKVYKKTDELRDKER

SEQ ID NO: 1752803 - protein, 19 aa, Staphylococcus epidermidis
NTIAQIQPATKIKDDAKAD

SEQ ID NO: 1752804 - protein, 19 aa, Staphylococcus epidermidis
NTKYTPTSILYFNPKDEGD

SEQ ID NO: 1752805 - protein, 20 aa, Staphylococcus epidermidis
NTLFIMSWIQLVAGLTRANQ

SEQ ID NO: 1752806 - protein, 25 aa, Staphylococcus epidermidis
NTNILLLVLVLLTGTLLLVWLADQN

SEQ ID NO: 1752807 - protein, 24 aa, Staphylococcus epidermidis
NTNNILIIFFVGNAIDFIEYLNKS

SEQ ID NO: 1752808 - protein, 39 aa, Staphylococcus epidermidis
NTNSLISRFRQLATGAYKYNPFLINQVKNLNQLDGKVTD

SEQ ID NO: 1752809 - protein, 26 aa, Staphylococcus epidermidis
NTPQGSIFYFYLTVNPIEMEGAMDEN

SEQ ID NO: 1752810 - protein, 22 aa, Staphylococcus epidermidis
NTRFSIRKYQGYGATSVAIIGF

SEQ ID NO: 1752811 - protein, 21 aa, Staphylococcus epidermidis
NTSMDWDRKYPYGDTLRGIFG

SEQ ID NO: 1752812 - protein, 18 aa, Staphylococcus epidermidis
NTSTTHFVIIDKNGKLAS

SEQ ID NO: 1752813 - protein, 24 aa, Staphylococcus epidermidis
NTTIIHYFVMLLLALVTVASIQTV

SEQ ID NO: 1752814 - protein, 21 aa, Staphylococcus epidermidis
NTTITPLSVNFDRQNRTLTFT

SEQ ID NO: 1752815 - protein, 22 aa, Staphylococcus epidermidis
NTVRFIILASIIVLLIVQMVRN

SEQ ID NO: 1752816 - protein, 18 aa, Staphylococcus epidermidis
NVALGRMKPFLAGISKGM

SEQ ID NO: 1752817 - protein, 18 aa, Staphylococcus epidermidis
NVALGRMKPFLAGVSKGM

SEQ ID NO: 1752818 - protein, 23 aa, Staphylococcus epidermidis
NVDDIFVLMLLFSQARSQAKTGN

SEQ ID NO: 1752819 - protein, 30 aa, Staphylococcus epidermidis
NVEDKSNQQFPPRNAQRRKRRRDVATNHNK

SEQ ID NO: 1752820 - protein, 18 aa, Staphylococcus epidermidis
NVERVSHLVLTRTGLYII

SEQ ID NO: 1752821 - protein, 47 aa, Staphylococcus epidermidis
NVKRTIIKIIGFMIIAFFVLLLLGILLFAYYAWKAPAFTESKLEDPI

SEQ ID NO: 1752822 - protein, 21 aa, Staphylococcus epidermidis
NVKTMKIGLKALGYQIDNETN

SEQ ID NO: 1752823 - protein, 20 aa, Staphylococcus epidermidis
NVKTMKIGLTALGYKVDNES

SEQ ID NO: 1752824 - protein, 41 aa, Staphylococcus epidermidis
NVLDKRLPMLDLPIIPIIISRYWVQLISNVPKEMVYPLMNS

SEQ ID NO: 1752825 - protein, 18 aa, Staphylococcus epidermidis
NVSILTYLFLLVSSGIIV

SEQ ID NO: 1752826 - protein, 22 aa, Staphylococcus epidermidis
NVSMVIMPRKTATPKPPIIKVD

SEQ ID NO: 1752827 - protein, 30 aa, Staphylococcus epidermidis
NVSRTYVLSIFIILLLTLIFANFSEALAEG

SEQ ID NO: 1752828 - protein, 31 aa, Staphylococcus epidermidis
NVTPSQASEVFTPINPITITATDNSGKVVTH

SEQ ID NO: 1752829 - protein, 32 aa, Staphylococcus epidermidis
NVTPSQASEVFTPINPITITATDNSGKVVTHT

SEQ ID NO: 1752830 - protein, 30 aa, Staphylococcus epidermidis
NVTSKQFTITIQDTISPVVNVTPSQASEVF

SEQ ID NO: 1752831 - protein, 24 aa, Staphylococcus epidermidis
NVVIWLCMILYLNRFSDVKLLDVG

SEQ ID NO: 1752832 - protein, 27 aa, Staphylococcus epidermidis
NVVKYIVWFIVLTTILSKFGISVEGVI

SEQ ID NO: 1752833 - protein, 21 aa, Staphylococcus epidermidis
NVVYFRFFSDFLTFSTLNQAG

SEQ ID NO: 1752834 - protein, 17 aa, Staphylococcus epidermidis
NVYNGIPHLLIPVVTNP

SEQ ID NO: 1752835 - protein, 26 aa, Staphylococcus epidermidis
NWAGWLMFFGIVFFSGSLYILALTQI

SEQ ID NO: 1752836 - protein, 29 aa, Staphylococcus epidermidis
NWQTYIMIAVYFIILLIIGFYGYKQATGN

SEQ ID NO: 1752837 - protein, 29 aa, Staphylococcus epidermidis
NWQTYVMIIVYFIILLIIGFYGYRQATGN

SEQ ID NO: 1752838 - protein, 18 aa, Staphylococcus epidermidis
NWSAPINGSTVNSGLIGS

SEQ ID NO: 1752839 - protein, 25 aa, Staphylococcus epidermidis
NYAHSIPFYKGGYFVFIYKNKSHTS

SEQ ID NO: 1752840 - protein, 31 aa, Staphylococcus epidermidis
NYDYNLFKVIPYLLVLILALIGVNVIIVLIG

SEQ ID NO: 1752841 - protein, 39 aa, Staphylococcus epidermidis
NYHWNIMFYGMFFIGLVAIVIGMFWFKLYQRTTNPKADI

SEQ ID NO: 1752842 - protein, 20 aa, Staphylococcus epidermidis
NYIKPFGDIFLNLIKMIIIP

SEQ ID NO: 1752843 - protein, 17 aa, Staphylococcus epidermidis
NYIVHFDKPSGMTQTTT

SEQ ID NO: 1752844 - protein, 32 aa, Staphylococcus epidermidis
NYKPVWIIISFIILITILLLPTPAGLPVMAKA

SEQ ID NO: 1752845 - protein, 17 aa, Staphylococcus epidermidis
NYNFNDFNSFISNIPAH

SEQ ID NO: 1752846 - protein, 38 aa, Staphylococcus epidermidis
NYSETSGTPTLKLTNSSQTVIYKFKDVQGPQISVDSQT

SEQ ID NO: 1752847 - protein, 20 aa, Staphylococcus epidermidis
NYWQVVWYVAIVVSALVVIA

SEQ ID NO: 1752848 - protein, 28 aa, Staphylococcus epidermidis
NYYNKHQCTWWAYKRRVQLGKPVSNRWG

SEQ ID NO: 1752849 - protein, 25 aa, Staphylococcus epidermidis
PAGPDLYLSIPWFAASISTVAGAIG

SEQ ID NO: 1752850 - protein, 27 aa, Staphylococcus epidermidis
PASITKLMTLYLTFDALNNGKISKDQK

SEQ ID NO: 1752851 - protein, 23 aa, Staphylococcus epidermidis
PATYLLIIINVVIWLCMILYLNR

SEQ ID NO: 1752852 - protein, 26 aa, Staphylococcus epidermidis
PAVALFLVVFCWQPIHFYALAIKRSD

SEQ ID NO: 1752853 - protein, 23 aa, Staphylococcus epidermidis
PAVLFFLMCVGLAIITWIVSLFN

SEQ ID NO: 1752854 - protein, 23 aa, Staphylococcus epidermidis
PDGTWMADIALQIPKNIAASTYK

SEQ ID NO: 1752855 - protein, 23 aa, Staphylococcus epidermidis
PDKLLPYKAPFYPVGPIIVLFTL

SEQ ID NO: 1752856 - protein, 24 aa, Staphylococcus epidermidis
PEAPFLLLMVSGFLGALLGGFIVL

SEQ ID NO: 1752857 - protein, 24 aa, Staphylococcus epidermidis
PEGLDLIVVILLAPAITFGLANLI

SEQ ID NO: 1752858 - protein, 46 aa, Staphylococcus epidermidis
PEILITKVVVLTLFGLGFIIFGVCMKPVMDPLMRKIAKRAAESKVT

SEQ ID NO: 1752859 - protein, 24 aa, Staphylococcus epidermidis
PEKYYSYFIGDWYVSGDSAYKDED

SEQ ID NO: 1752860 - protein, 47 aa, Staphylococcus epidermidis
PENIKFLITITLLIALAIYVFRFIWVFLWYKDFYFPKNIQYYMNESE

SEQ ID NO: 1752861 - protein, 39 aa, Staphylococcus epidermidis
PFIALFNRYGSPLPLMHLYKLIEPFLNEPLEIANNFLMS

SEQ ID NO: 1752862 - protein, 19 aa, Staphylococcus epidermidis
PFIILTVIVMIWSSPSFKG

SEQ ID NO: 1752863 - protein, 21 aa, Staphylococcus epidermidis
PFILGIIIPFIGYRHLYMAMG

SEQ ID NO: 1752864 - protein, 31 aa, Staphylococcus epidermidis
PFKNKTWINIISWLLIIVLSGLNVYLIIQTF

SEQ ID NO: 1752865 - protein, 26 aa, Staphylococcus epidermidis
PFLHYLHFPIGVWLLYIGVFFTILSG

SEQ ID NO: 1752866 - protein, 20 aa, Staphylococcus epidermidis
PFLIVMEFILIYIPLLYHGL

SEQ ID NO: 1752867 - protein, 23 aa, Staphylococcus epidermidis
PFNKKREFDPNLAPGTEKVVQKG

SEQ ID NO: 1752868 - protein, 24 aa, Staphylococcus epidermidis
PFNKKREFDPNLAPGTEKVVQKGE

SEQ ID NO: 1752869 - protein, 26 aa, Staphylococcus epidermidis
PFRRIISFFLVFTMLFSAGVVPLYIL

SEQ ID NO: 1752870 - protein, 18 aa, Staphylococcus epidermidis
PFRRIISFFLVFTMLFSV

SEQ ID NO: 1752871 - protein, 24 aa, Staphylococcus epidermidis
PFSILFLTIIGAFLFFRSSVSLIF

SEQ ID NO: 1752872 - protein, 18 aa, Staphylococcus epidermidis
PGESITLTVIRDGKTKDI

SEQ ID NO: 1752873 - protein, 41 aa, Staphylococcus epidermidis
PGKVIKKNDKYYFQITLENASWWKSFQFFDESETELPTTVV

SEQ ID NO: 1752874 - protein, 24 aa, Staphylococcus epidermidis
PGLGILLAYMIFGKGTAKATSYGA

SEQ ID NO: 1752875 - protein, 32 aa, Staphylococcus epidermidis
PGMNNIISKVHIVIPALKYDHEYTTHIELESV

SEQ ID NO: 1752876 - protein, 23 aa, Staphylococcus epidermidis
PGQFYLVRIYRIVMLIITFLTEL

SEQ ID NO: 1752877 - protein, 23 aa, Staphylococcus epidermidis
PGVTLFLLLKAFSSGASSLTGVE

SEQ ID NO: 1752878 - protein, 18 aa, Staphylococcus epidermidis
PHGSYFRAVDTAANTVAS

SEQ ID NO: 1752879 - protein, 18 aa, Staphylococcus epidermidis
PHHFKLEIVPIHKIYSDK

SEQ ID NO: 1752880 - protein, 24 aa, Staphylococcus epidermidis
PHKSASPRMNLMSLAAEPNSGKNV

SEQ ID NO: 1752881 - protein, 25 aa, Staphylococcus epidermidis
PHWLTVLFIVLILISFNLLGARLFG

SEQ ID NO: 1752882 - protein, 19 aa, Staphylococcus epidermidis
PIAIITLVLVWIKNILLDR

SEQ ID NO: 1752883 - protein, 18 aa, Staphylococcus epidermidis
PIDWAILGGIAAGTLITA

SEQ ID NO: 1752884 - protein, 19 aa, Staphylococcus epidermidis
PIESLIQIPTKTFNKYMGN

SEQ ID NO: 1752885 - protein, 18 aa, Staphylococcus epidermidis
PIIFYQLWSFVAPGLHAY

SEQ ID NO: 1752886 - protein, 23 aa, Staphylococcus epidermidis
PIIIFVIVLLITGIGYISHVNKK

SEQ ID NO: 1752887 - protein, 30 aa, Staphylococcus epidermidis
PIINILRSIPFIILLIAIVPFTKLLVGTSI

SEQ ID NO: 1752888 - protein, 25 aa, Staphylococcus epidermidis
PIISFLTMIVTIISLIYTNKRFDKT

SEQ ID NO: 1752889 - protein, 23 aa, Staphylococcus epidermidis
PIIVIITLLFLLLGNSFGSIISG

SEQ ID NO: 1752890 - protein, 21 aa, Staphylococcus epidermidis
PIKDRPSLLDRIHGNKHHNGQ

SEQ ID NO: 1752891 - protein, 18 aa, Staphylococcus epidermidis
PIKQFCSILILSCILSLI

SEQ ID NO: 1752892 - protein, 17 aa, Staphylococcus epidermidis
PILKRLVERLPAMVLPS

SEQ ID NO: 1752893 - protein, 34 aa, Staphylococcus epidermidis
PIQTAPQFFQTISPYLPFTYAIDALRETVGGIVP

SEQ ID NO: 1752894 - protein, 17 aa, Staphylococcus epidermidis
PISIIILVAFFIGYVIH

SEQ ID NO: 1752895 - protein, 39 aa, Staphylococcus epidermidis
PISRNNLLMFCPLLPIVTLPIMFISPGSGLFLFIGALIL

SEQ ID NO: 1752896 - protein, 25 aa, Staphylococcus epidermidis
PITISLLLLLYGIGGGFFLPSNTSA

SEQ ID NO: 1752897 - protein, 26 aa, Staphylococcus epidermidis
PITSLLIFISLLIFEMIVISIEFLIL

SEQ ID NO: 1752898 - protein, 27 aa, Staphylococcus epidermidis
PIVIITLIFILLISKQLTILNLGESLA

SEQ ID NO: 1752899 - protein, 33 aa, Staphylococcus epidermidis
PIVVSIAVITFIIWIVFVHPGQLEPALVSAISV

SEQ ID NO: 1752900 - protein, 33 aa, Staphylococcus epidermidis
PKAIKQVFWRILLFYILAIFIIGMLIPYDSEAL

SEQ ID NO: 1752901 - protein, 27 aa, Staphylococcus epidermidis
PKFSLIFLIIIYLTIGPLFAIPRTAST

SEQ ID NO: 1752902 - protein, 25 aa, Staphylococcus epidermidis
PKLINLNAHLLYKTNATFRGNDGQR

SEQ ID NO: 1752903 - protein, 19 aa, Staphylococcus epidermidis
PLELIQLDQLLVTILQTYE

SEQ ID NO: 1752904 - protein, 19 aa, Staphylococcus epidermidis
PLFAFVATLFIGVLTGLFG

SEQ ID NO: 1752905 - protein, 19 aa, Staphylococcus epidermidis
PLFIIFGLVFLLLVPNTFY

SEQ ID NO: 1752906 - protein, 27 aa, Staphylococcus epidermidis
PLGLPPLTWPFIFATWIMLFAGIKNQS

SEQ ID NO: 1752907 - protein, 20 aa, Staphylococcus epidermidis
PLGRLYLVPYSQLKLYLTYI

SEQ ID NO: 1752908 - protein, 21 aa, Staphylococcus epidermidis
PLHVWLWAQLAVFLHVFVDIL

SEQ ID NO: 1752909 - protein, 20 aa, Staphylococcus epidermidis
PLIFFMFSLTNLITYDNEEI

SEQ ID NO: 1752910 - protein, 19 aa, Staphylococcus epidermidis
PLIPFIFISFVVTSLVYRH

SEQ ID NO: 1752911 - protein, 20 aa, Staphylococcus epidermidis
PLIQGIVVFIIVLIMFINYL

SEQ ID NO: 1752912 - protein, 19 aa, Staphylococcus epidermidis
PLIVCYTNDVVKNFTANGL

SEQ ID NO: 1752913 - protein, 19 aa, Staphylococcus epidermidis
PLKAVLGFVLSLLATLGFT

SEQ ID NO: 1752914 - protein, 19 aa, Staphylococcus epidermidis
PLKRLLLYVIILLTMCAFL

SEQ ID NO: 1752915 - protein, 20 aa, Staphylococcus epidermidis
PLLMNKFKIDPAVASGPFIT

SEQ ID NO: 1752916 - protein, 22 aa, Staphylococcus epidermidis
PLQRLIKLLGDIFIPILPAIVT

SEQ ID NO: 1752917 - protein, 26 aa, Staphylococcus epidermidis
PLRFKKLAVMLLLSIFILYLNHILIS

SEQ ID NO: 1752918 - protein, 25 aa, Staphylococcus epidermidis
PLSAYAFMIFILLYVPCISTVATIR

SEQ ID NO: 1752919 - protein, 26 aa, Staphylococcus epidermidis
PLSEDDFLLRYKSLIITAFNQKVNFD

SEQ ID NO: 1752920 - protein, 20 aa, Staphylococcus epidermidis
PLWIVILILVLTVGTAVLLE

SEQ ID NO: 1752921 - protein, 31 aa, Staphylococcus epidermidis
PLYALMILVVSVKLFGFLRAITRYIERLLSH

SEQ ID NO: 1752922 - protein, 22 aa, Staphylococcus epidermidis
PMIINTFFIALFLFGHSGGPGT

SEQ ID NO: 1752923 - protein, 21 aa, Staphylococcus epidermidis
PMLLPFLCALILVFTKNKNQT

SEQ ID NO: 1752924 - protein, 25 aa, Staphylococcus epidermidis
PMNSLFFFYSAFALPFIFNVRVVSK

SEQ ID NO: 1752925 - protein, 21 aa, Staphylococcus epidermidis
PNELLPYKAPFYPVGPIIVII

SEQ ID NO: 1752926 - protein, 21 aa, Staphylococcus epidermidis
PNFTILLFARIIQALGSGIMM

SEQ ID NO: 1752927 - protein, 19 aa, Staphylococcus epidermidis
PNGHILIKLLFAVALSIIG

SEQ ID NO: 1752928 - protein, 29 aa, Staphylococcus epidermidis
PNKAKYALLDFTFLHTLNQFKQTVPAIKV

SEQ ID NO: 1752929 - protein, 21 aa, Staphylococcus epidermidis
PNLTTFPLKKGQTYTIEQLLK

SEQ ID NO: 1752930 - protein, 24 aa, Staphylococcus epidermidis
PNQSAQLGATVKPGSAPTQDTEVK

SEQ ID NO: 1752931 - protein, 21 aa, Staphylococcus epidermidis
PNQSGQLGATVKPGSAPNQDT

SEQ ID NO: 1752932 - protein, 25 aa, Staphylococcus epidermidis
PNSEVIFEFNTMTARNYKGGTNLVV

SEQ ID NO: 1752933 - protein, 27 aa, Staphylococcus epidermidis
PNVAKQLSYAKFLNGKMEELKAAVAKA

SEQ ID NO: 1752934 - protein, 18 aa, Staphylococcus epidermidis
PPLDKNALQAFFDASYHN

SEQ ID NO: 1752935 - protein, 32 aa, Staphylococcus epidermidis
PPTINEPAGLVHKYYRGDHVEITLPVTDNAGG

SEQ ID NO: 1752936 - protein, 26 aa, Staphylococcus epidermidis
PQAKNQIQAIFDRKQSKFETNKEATK

SEQ ID NO: 1752937 - protein, 21 aa, Staphylococcus epidermidis
PQNILIDKNKTLKIFDFGIAK

SEQ ID NO: 1752938 - protein, 36 aa, Staphylococcus epidermidis
PQPPRHRRPRFPWFKTILVALIAGIIGALLVLGIGK

SEQ ID NO: 1752939 - protein, 32 aa, Staphylococcus epidermidis
PQQGIVLYYLFAIVVAFLLLNLPYVHKPGVNV

SEQ ID NO: 1752940 - protein, 23 aa, Staphylococcus epidermidis
PQQGMIQMRLFKEASNIIFTIEN

SEQ ID NO: 1752941 - protein, 24 aa, Staphylococcus epidermidis
PQQLKSIPPFFSGQAPYILAHRGG

SEQ ID NO: 1752942 - protein, 23 aa, Staphylococcus epidermidis
PQTLNEITIQLDAQRDLIKNNKE

SEQ ID NO: 1752943 - protein, 20 aa, Staphylococcus epidermidis
PQVFKSMMIPVAIIIAMCFV

SEQ ID NO: 1752944 - protein, 19 aa, Staphylococcus epidermidis
PQWYVEYDGNWYVYKDGRL

SEQ ID NO: 1752945 - protein, 25 aa, Staphylococcus epidermidis
PRAKLIFVFFFIILIFFCHSLGTYA

SEQ ID NO: 1752946 - protein, 22 aa, Staphylococcus epidermidis
PRHQLFLPIAILVGAFLLVFSD

SEQ ID NO: 1752947 - protein, 23 aa, Staphylococcus epidermidis
PRKMITIALVWWSAFTILTGMIK

SEQ ID NO: 1752948 - protein, 29 aa, Staphylococcus epidermidis
PRTVLLIISAMITAFTFISELSFGLPETW

SEQ ID NO: 1752949 - protein, 25 aa, Staphylococcus epidermidis
PSDGWWLLNFISTIGALLMAIGFLF

SEQ ID NO: 1752950 - protein, 24 aa, Staphylococcus epidermidis
PSDGWWLLNFISTIGALLMGIGFL

SEQ ID NO: 1752951 - protein, 17 aa, Staphylococcus epidermidis
PSDLTDSFAIPKIKDNS

SEQ ID NO: 1752952 - protein, 21 aa, Staphylococcus epidermidis
PSMNIILLAIGYFVIPFVGAF

SEQ ID NO: 1752953 - protein, 17 aa, Staphylococcus epidermidis
PSPLTTTISFVVSFIVV

SEQ ID NO: 1752954 - protein, 49 aa, Staphylococcus epidermidis
PSVLTLIGSLIMLFIMDWKLTLLTFITIPVFVFIMIPLGRVMQRISTNT

SEQ ID NO: 1752955 - protein, 22 aa, Staphylococcus epidermidis
PSYWIASMLIIYISVKLNLLPT

SEQ ID NO: 1752956 - protein, 31 aa, Staphylococcus epidermidis
PTAIIMIVTAPFIPLFYVIFGLKTRDESKDQ

SEQ ID NO: 1752957 - protein, 22 aa, Staphylococcus epidermidis
PTALLLMALMFIGGAPLSAAGG

SEQ ID NO: 1752958 - protein, 19 aa, Staphylococcus epidermidis
PTARLYYAAGARSGEYKQA

SEQ ID NO: 1752959 - protein, 17 aa, Staphylococcus epidermidis
PTDIKPFIKTRLISPIG

SEQ ID NO: 1752960 - protein, 26 aa, Staphylococcus epidermidis
PTGSSLKPFLAYGPAIENMQWATNHA

SEQ ID NO: 1752961 - protein, 27 aa, Staphylococcus epidermidis
PTGTGNVYTEYWLTRDGTTNTNDFYRG

SEQ ID NO: 1752962 - protein, 24 aa, Staphylococcus epidermidis
PTIFNFSLALLIGLLSGVFSSIFI

SEQ ID NO: 1752963 - protein, 20 aa, Staphylococcus epidermidis
PTIYIVLLIISVRYLVRNYR

SEQ ID NO: 1752964 - protein, 21 aa, Staphylococcus epidermidis
PTKEKLLPNTGMTDNITYVMV

SEQ ID NO: 1752965 - protein, 41 aa, Staphylococcus epidermidis
PTLIYPVLSVTITGLLMVYIFNPPASWLNHLLLHGLNSLSG

SEQ ID NO: 1752966 - protein, 32 aa, Staphylococcus epidermidis
PTLQLVIYIFGLIFLFYIAWTLWNEKTQNVKQ

SEQ ID NO: 1752967 - protein, 23 aa, Staphylococcus epidermidis
PTLVFSFFGMNVPLPIDAHSYAS

SEQ ID NO: 1752968 - protein, 25 aa, Staphylococcus epidermidis
PTNQAFKKVGLMNPATDKGIWQVRP

SEQ ID NO: 1752969 - protein, 30 aa, Staphylococcus epidermidis
PTTAEVIFIIILGLPIYFFYEYKMNWKNTK

SEQ ID NO: 1752970 - protein, 21 aa, Staphylococcus epidermidis
PTYRFPSFKTLWRSTWEKAKG

SEQ ID NO: 1752971 - protein, 19 aa, Staphylococcus epidermidis
PVDYIMFDLKTIEKVLTGE

SEQ ID NO: 1752972 - protein, 23 aa, Staphylococcus epidermidis
PVFIFVGMIIIVIWLIMDLYRKK

SEQ ID NO: 1752973 - protein, 17 aa, Staphylococcus epidermidis
PVHIAFIPIVIPPLVSL

SEQ ID NO: 1752974 - protein, 18 aa, Staphylococcus epidermidis
PVKTPTPNKVPLPKPQKT

SEQ ID NO: 1752975 - protein, 19 aa, Staphylococcus epidermidis
PVLMFAFFGIVLGFATLFK

SEQ ID NO: 1752976 - protein, 32 aa, Staphylococcus epidermidis
PVNIETPREVTFNESLKYKTYAEIYVNTNDNT

SEQ ID NO: 1752977 - protein, 22 aa, Staphylococcus epidermidis
PVRWPKPKLLLKAAWKSIQMFI

SEQ ID NO: 1752978 - protein, 30 aa, Staphylococcus epidermidis
PVSIGKLFMIFLIRTLITLPIIALLAHLFI

SEQ ID NO: 1752979 - protein, 26 aa, Staphylococcus epidermidis
PVSNKPWMLLIQGVVFFVLYYVIFRV

SEQ ID NO: 1752980 - protein, 23 aa, Staphylococcus epidermidis
PYFHMIWHIFIVLASLLHMIGIF

SEQ ID NO: 1752981 - protein, 24 aa, Staphylococcus epidermidis
PYQQEIRIKLTSNEPIKDSEWSIT

SEQ ID NO: 1752982 - protein, 52 aa, Staphylococcus epidermidis
QAIEGLKPTLIYPLFSVSITGLLMVYVFNPPAAWLNHLLLNGLNSLSGSNIM

SEQ ID NO: 1752983 - protein, 19 aa, Staphylococcus epidermidis
QAILTTKNALDGEDQLRRA

SEQ ID NO: 1752984 - protein, 19 aa, Staphylococcus epidermidis
QAITAIKLINANAHKRQDA

SEQ ID NO: 1752985 - protein, 30 aa, Staphylococcus epidermidis
QAKKQLRGKQKLYQTIDLADKELSKLDDLT

SEQ ID NO: 1752986 - protein, 17 aa, Staphylococcus epidermidis
QARQALIAKVNEKQSAI

SEQ ID NO: 1752987 - protein, 18 aa, Staphylococcus epidermidis
QASADKIVINKNGNKLTT

SEQ ID NO: 1752988 - protein, 23 aa, Staphylococcus epidermidis
QASAIIVTKEGTSWILDTEVPGI

SEQ ID NO: 1752989 - protein, 26 aa, Staphylococcus epidermidis
QAVIYVSLAFMFYGLALLLSHIVAFN

SEQ ID NO: 1752990 - protein, 23 aa, Staphylococcus epidermidis
QCLLAIFIMTLINGLTPLIGLIP

SEQ ID NO: 1752991 - protein, 20 aa, Staphylococcus epidermidis
QDKAFEQIELIKATPDATNE

SEQ ID NO: 1752992 - protein, 24 aa, Staphylococcus epidermidis
QDKYEVNIIYLISHALVETGNGKS

SEQ ID NO: 1752993 - protein, 23 aa, Staphylococcus epidermidis
QDSATLWYHPHPSPNTAKQVYNG

SEQ ID NO: 1752994 - protein, 24 aa, Staphylococcus epidermidis
QEASAKLQEVLKKAIAKIDKGQTN

SEQ ID NO: 1752995 - protein, 26 aa, Staphylococcus epidermidis
QESGFTAGRVINKIKYDSSQKSIKSV

SEQ ID NO: 1752996 - protein, 26 aa, Staphylococcus epidermidis
QFDLSFQRLFIQGYIQRLIQLMEDTV

SEQ ID NO: 1752997 - protein, 23 aa, Staphylococcus epidermidis
QFDVPHYSINLLASNSGKVTYQF

SEQ ID NO: 1752998 - protein, 25 aa, Staphylococcus epidermidis
QFEPALLAAISVLVIACPCALGLAT

SEQ ID NO: 1752999 - protein, 19 aa, Staphylococcus epidermidis
QFERIYKKIKHVCVGIFLV

SEQ ID NO: 1753000 - protein, 19 aa, Staphylococcus epidermidis
QFEVAVPAFITIIMMPLSY

SEQ ID NO: 1753001 - protein, 35 aa, Staphylococcus epidermidis
QFLNSKLIWLILPLLLIQLAFNNWYWIVYVIKDIK

SEQ ID NO: 1753002 - protein, 17 aa, Staphylococcus epidermidis
QFNFVAHSMGNMSFAYY

SEQ ID NO: 1753003 - protein, 21 aa, Staphylococcus epidermidis
QGIIIVVVTILFIASAWSGLS

SEQ ID NO: 1753004 - protein, 17 aa, Staphylococcus epidermidis
QGLALIIGVDRLLDMVR

SEQ ID NO: 1753005 - protein, 25 aa, Staphylococcus epidermidis
QGVVFFIIYYVIFRVVIQVFNLNTI

SEQ ID NO: 1753006 - protein, 23 aa, Staphylococcus epidermidis
QGVVFFVLYYVIFRVVIQVFNLN

SEQ ID NO: 1753007 - protein, 35 aa, Staphylococcus epidermidis
QIATVLIIGLLIYNLLILPLFIPSMVATFGKGNWW

SEQ ID NO: 1753008 - protein, 25 aa, Staphylococcus epidermidis
QIILIVVIIIFSYQLVKTYLEDKAS

SEQ ID NO: 1753009 - protein, 33 aa, Staphylococcus epidermidis
QIISITWVYIILLYLAFLLMTANFLDYTYLKYS

SEQ ID NO: 1753010 - protein, 18 aa, Staphylococcus epidermidis
QILFHPLVGGFLLAAILA

SEQ ID NO: 1753011 - protein, 19 aa, Staphylococcus epidermidis
QINDIVLGLIFLVGSFFFF

SEQ ID NO: 1753012 - protein, 27 aa, Staphylococcus epidermidis
QISDLTKGPSLFDRLNSKGSLLDGVNN

SEQ ID NO: 1753013 - protein, 19 aa, Staphylococcus epidermidis
QISFGYLLSRFLINTKRKS

SEQ ID NO: 1753014 - protein, 19 aa, Staphylococcus epidermidis
QITKLIQDIDRTITKPAVT

SEQ ID NO: 1753015 - protein, 25 aa, Staphylococcus epidermidis
QIVGKVILRFWPFNNMKYNFRPDIF

SEQ ID NO: 1753016 - protein, 44 aa, Staphylococcus epidermidis
QKFEPKYVNIVLIAIPLVMLLAPFLFDWTWSQSVYRGLVLLVAA

SEQ ID NO: 1753017 - protein, 27 aa, Staphylococcus epidermidis
QKFSILEIILLCLIIYAGAAQFIVCAL

SEQ ID NO: 1753018 - protein, 53 aa, Staphylococcus epidermidis
QKNNTAIWRSIVPPLVMIALTVVIFLVRPIGVYIIMMIGMSIVTVIFGITTYF

SEQ ID NO: 1753019 - protein, 32 aa, Staphylococcus epidermidis
QKTIAVVGLLAAAIGPLLMVFGVMASTIGTAI

SEQ ID NO: 1753020 - protein, 21 aa, Staphylococcus epidermidis
QKWLISFILVCNIFGTIYGYH

SEQ ID NO: 1753021 - protein, 37 aa, Staphylococcus epidermidis
QLALLYSRPLYYFGNIMKPLIWLMNGSARVIVRMFGF

SEQ ID NO: 1753022 - protein, 19 aa, Staphylococcus epidermidis
QLEMRALLLHLRPIGLKDK

SEQ ID NO: 1753023 - protein, 22 aa, Staphylococcus epidermidis
QLGKIHIFPALIGSIILIFIVS

SEQ ID NO: 1753024 - protein, 19 aa, Staphylococcus epidermidis
QLIVILWQVVDSFTIIRLL

SEQ ID NO: 1753025 - protein, 17 aa, Staphylococcus epidermidis
QLLLIFLDNAMKYDTDN

SEQ ID NO: 1753026 - protein, 24 aa, Staphylococcus epidermidis
QLNIYLILVIGLLYLIIHYYRYKG

SEQ ID NO: 1753027 - protein, 17 aa, Staphylococcus epidermidis
QLNIYLILVIGLLYVII

SEQ ID NO: 1753028 - protein, 29 aa, Staphylococcus epidermidis
QLPFPTLTIILFLISAFLFLATTFDSGSY

SEQ ID NO: 1753029 - protein, 31 aa, Staphylococcus epidermidis
QLPSYLIIVIFLLILINLIITFPILRKFKVA

SEQ ID NO: 1753030 - protein, 19 aa, Staphylococcus epidermidis
QLQDYNQLNIAMQALRNSV

SEQ ID NO: 1753031 - protein, 35 aa, Staphylococcus epidermidis
QLQQEFNNRYKHILNQAHLLGEKHIAEHKLGYVVV

SEQ ID NO: 1753032 - protein, 24 aa, Staphylococcus epidermidis
QLTVIGFILFVYVAVRIYDPLTNS

SEQ ID NO: 1753033 - protein, 18 aa, Staphylococcus epidermidis
QLTYIYMISIIALSMMVS

SEQ ID NO: 1753034 - protein, 18 aa, Staphylococcus epidermidis
QMGSRIPKGVLLVGPPGT

SEQ ID NO: 1753035 - protein, 21 aa, Staphylococcus epidermidis
QMTTLNPNIVYTSYTGAATHT

SEQ ID NO: 1753036 - protein, 23 aa, Staphylococcus epidermidis
QNGTYTVEFAIPDNYTPSPANNS

SEQ ID NO: 1753037 - protein, 19 aa, Staphylococcus epidermidis
QNHTLTFSSNGLNLGRSAQ

SEQ ID NO: 1753038 - protein, 33 aa, Staphylococcus epidermidis
QNLLTLIITLLPKLTFIFIFMSGIAFFITYKFY

SEQ ID NO: 1753039 - protein, 27 aa, Staphylococcus epidermidis
QNLTLNFMIVFLFIISATVIGVFLYVI

SEQ ID NO: 1753040 - protein, 25 aa, Staphylococcus epidermidis
QNMDDARALLNGIARLKDAQAKAHN

SEQ ID NO: 1753041 - protein, 29 aa, Staphylococcus epidermidis
QNNQNPKYAKYFSTVKNGKFIPGEVKVYE

SEQ ID NO: 1753042 - protein, 18 aa, Staphylococcus epidermidis
QNTDVQETLKTGWDGYEK

SEQ ID NO: 1753043 - protein, 28 aa, Staphylococcus epidermidis
QNYDNLVRSLYIVALAFGLIATIITAGI

SEQ ID NO: 1753044 - protein, 29 aa, Staphylococcus epidermidis
QPFTWMIVAFCFIFLSLFIFTCFNDKFYN

SEQ ID NO: 1753045 - protein, 17 aa, Staphylococcus epidermidis
QPLLFNALLYFIITIIL

SEQ ID NO: 1753046 - protein, 27 aa, Staphylococcus epidermidis
QQEVNRFYYKFLNSAGKLRNKTTMDSN

SEQ ID NO: 1753047 - protein, 25 aa, Staphylococcus epidermidis
QQHVDAFYHKFLNSAGKLRKKETVS

SEQ ID NO: 1753048 - protein, 23 aa, Staphylococcus epidermidis
QQKIDIPYFLIGFIIMACINTFV

SEQ ID NO: 1753049 - protein, 20 aa, Staphylococcus epidermidis
QQLEKALELARTLPQRSTTE

SEQ ID NO: 1753050 - protein, 17 aa, Staphylococcus epidermidis
QQPLWIVILILVLTVGT

SEQ ID NO: 1753051 - protein, 32 aa, Staphylococcus epidermidis
QQSHTVYGQENLYRIAIQYYGEGTQANVDKIK

SEQ ID NO: 1753052 - protein, 29 aa, Staphylococcus epidermidis
QQSLLLLLSVIFISLILRATFNMLIQVLG

SEQ ID NO: 1753053 - protein, 25 aa, Staphylococcus epidermidis
QRLSAFQLLLLVFFSSTFTTCSVTM

SEQ ID NO: 1753054 - protein, 19 aa, Staphylococcus epidermidis
QRLSLARLLLRDDARIWIL

SEQ ID NO: 1753055 - protein, 24 aa, Staphylococcus epidermidis
QRLSLARLLLRPSADFWILDEPTT

SEQ ID NO: 1753056 - protein, 24 aa, Staphylococcus epidermidis
QSHFTYFNKMSFFHDVKQWLKNAE

SEQ ID NO: 1753057 - protein, 25 aa, Staphylococcus epidermidis
QSKDTYYEVILPQNSRLISTRGGSG

SEQ ID NO: 1753058 - protein, 27 aa, Staphylococcus epidermidis
QSKETTYKVVLPPNSKFISATGANGNY

SEQ ID NO: 1753059 - protein, 23 aa, Staphylococcus epidermidis
QSKFWFGLLRYVTEGATFLLIGL

SEQ ID NO: 1753060 - protein, 25 aa, Staphylococcus epidermidis
QSLGIILFIILFTYNSLGYLLKVSN

SEQ ID NO: 1753061 - protein, 28 aa, Staphylococcus epidermidis
QSLMPPIQLIFILLTFSICDEILSESGL

SEQ ID NO: 1753062 - protein, 19 aa, Staphylococcus epidermidis
QSLNYTWFLGGLLGVIFLT

SEQ ID NO: 1753063 - protein, 25 aa, Staphylococcus epidermidis
QSNIFGWIFIAFALLIIISQPSVLG

SEQ ID NO: 1753064 - protein, 17 aa, Staphylococcus epidermidis
QSPYFIPDQAFLDSIKI

SEQ ID NO: 1753065 - protein, 27 aa, Staphylococcus epidermidis
QSTLELNDKMKLLRDQLKTLVNPVKAS

SEQ ID NO: 1753066 - protein, 21 aa, Staphylococcus epidermidis
QTAYNKLIENVSTNGKKPASI

SEQ ID NO: 1753067 - protein, 39 aa, Staphylococcus epidermidis
QTFTATYAGKTWTATLSELGLSPTDSYNFLVTSSQYGNG

SEQ ID NO: 1753068 - protein, 30 aa, Staphylococcus epidermidis
QTLNYILVYATLMLIFFIVFNYAGQVAMEI

SEQ ID NO: 1753069 - protein, 28 aa, Staphylococcus epidermidis
QTREVGKTINPITITTTDNSKDVLTTTV

SEQ ID NO: 1753070 - protein, 36 aa, Staphylococcus epidermidis
QVAQDELFGLNELNSIFINITQKPTARKAISDKASQ

SEQ ID NO: 1753071 - protein, 17 aa, Staphylococcus epidermidis
QVGLGLKTGIDLPNETP

SEQ ID NO: 1753072 - protein, 29 aa, Staphylococcus epidermidis
QVGSYFLFIIIVVFLLYANFLFMKRRGRE

SEQ ID NO: 1753073 - protein, 27 aa, Staphylococcus epidermidis
QVQFGTFEYTESAVAKVRYVDANTGKD

SEQ ID NO: 1753074 - protein, 20 aa, Staphylococcus epidermidis
QVRPVQYNWDHLDFVGLDDT

SEQ ID NO: 1753075 - protein, 20 aa, Staphylococcus epidermidis
QVRWLFRVTALVVFGLIVFS

SEQ ID NO: 1753076 - protein, 25 aa, Staphylococcus epidermidis
QVSFDKDFDFNIRVANNRQSNTTGA

SEQ ID NO: 1753077 - protein, 24 aa, Staphylococcus epidermidis
QVTQALNKIKAIQPKLTEAINMLQ

SEQ ID NO: 1753078 - protein, 20 aa, Staphylococcus epidermidis
QYGIKQFNFVAHSMGNMSFA

SEQ ID NO: 1753079 - protein, 21 aa, Staphylococcus epidermidis
QYGKPFQIYKFRTMTDAKDEN

SEQ ID NO: 1753080 - protein, 25 aa, Staphylococcus epidermidis
QYGYTLLFVILISSLAAMLLQSMTV

SEQ ID NO: 1753081 - protein, 25 aa, Staphylococcus epidermidis
QYGYTLLFVILISSLSAMLLQSMTV

SEQ ID NO: 1753082 - protein, 18 aa, Staphylococcus epidermidis
QYILIYVIGIFFLIRYIK

SEQ ID NO: 1753083 - protein, 19 aa, Staphylococcus epidermidis
QYVFGKNLVKFLIIFLSFS

SEQ ID NO: 1753084 - protein, 22 aa, Staphylococcus epidermidis
RAEDTMFSVKSKVEQLKNDSKD

SEQ ID NO: 1753085 - protein, 26 aa, Staphylococcus epidermidis
RAFTLIEMLLVLLIISLLLILIIPNI

SEQ ID NO: 1753086 - protein, 25 aa, Staphylococcus epidermidis
RAIYITPVWFFILGLMYLRYRKESK

SEQ ID NO: 1753087 - protein, 20 aa, Staphylococcus epidermidis
RALYIPILIEQLFILIMGQA

SEQ ID NO: 1753088 - protein, 18 aa, Staphylococcus epidermidis
RANGLNSNNIHNGQTLVI
